United States Patent 11,801,313 (MATERIALS AND METHODS FOR TREATMENT OF PAIN RELATED DISORDERS) - sequence listing, part 2

SEQ ID NO: 6186 - DNA, 20 bp, Artificial Sequence
  Description of Artificial Sequence: Synthetic oligonucleotide
  Target: SCN10A; (-) strand; PAM type: NNAGAAW; PAM sequence: CAAGAAA
aaagcatcaataaagtaagg

SEQ ID NO: 6187 - DNA, 20 bp, Artificial Sequence
  Description of Artificial Sequence: Synthetic oligonucleotide
  Target: SCN10A; (-) strand; PAM type: NNAGAAW; PAM sequence: TAAGAAA
acaacaataaggatgagtct

SEQ ID NO: 6188 - DNA, 20 bp, Artificial Sequence
  Description of Artificial Sequence: Synthetic oligonucleotide
  Target: SCN10A; (-) strand; PAM type: NNAGAAW; PAM sequence: TGAGAAA
atttctgttatattctaaaa

SEQ ID NO: 6189 - DNA, 20 bp, Artificial Sequence
  Description of Artificial Sequence: Synthetic oligonucleotide
  Target: SCN10A; (-) strand; PAM type: NNAGAAW; PAM sequence: CAAGAAA
tggacaccagattacagcta

SEQ ID NO: 6190 - DNA, 20 bp, Artificial Sequence
  Description of Artificial Sequence: Synthetic oligonucleotide
  Target: SCN10A; (-) strand; PAM type: NNAGAAW; PAM sequence: ACAGAAA
cccttaggtacctatgttta

SEQ ID NO: 6191 - DNA, 20 bp, Artificial Sequence
  Description of Artificial Sequence: Synthetic oligonucleotide
  Target: SCN10A; (-) strand; PAM type: NNAGAAW; PAM sequence: ACAGAAA
attgggaatgacatggagca

SEQ ID NO: 6192 - DNA, 20 bp, Artificial Sequence
  Description of Artificial Sequence: Synthetic oligonucleotide
  Target: SCN10A; (-) strand; PAM type: NNAGAAW; PAM sequence: TTAGAAA
taatgaactctacaaatcaa

SEQ ID NO: 6193 - DNA, 20 bp, Artificial Sequence
  Description of Artificial Sequence: Synthetic oligonucleotide
  Target: SCN10A; (-) strand; PAM type: NNAGAAW; PAM sequence: TAAGAAT
acattttagtatactataat

SEQ ID NO: 6194 - DNA, 20 bp, Artificial Sequence
  Description of Artificial Sequence: Synthetic oligonucleotide
  Target: SCN10A; (-) strand; PAM type: NNAGAAW; PAM sequence: TAAGAAA
atatctttatgacctcagac

SEQ ID NO: 6195 - DNA, 20 bp, Artificial Sequence
  Description of Artificial Sequence: Synthetic oligonucleotide
  Target: SCN10A; (-) strand; PAM type: NNAGAAW; PAM sequence: GAAGAAA
gtagatttttctaattctgt

SEQ ID NO: 6196 - DNA, 20 bp, Artificial Sequence
  Description of Artificial Sequence: Synthetic oligonucleotide
  Target: SCN10A; (-) strand; PAM type: NNAGAAW; PAM sequence: TTAGAAT
tccaactttcttctttttgc

SEQ ID NO: 6197 - DNA, 20 bp, Artificial Sequence
  Description of Artificial Sequence: Synthetic oligonucleotide
  Target: SCN10A; (-) strand; PAM type: NNAGAAW; PAM sequence: GTAGAAT
cgcatgcttgtatctttata

SEQ ID NO: 6198 - DNA, 20 bp, Artificial Sequence
  Description of Artificial Sequence: Synthetic oligonucleotide
  Target: SCN10A; (-) strand; PAM type: NNAGAAW; PAM sequence: TGAGAAT
ctgttcttatgtcagtttgc

SEQ ID NO: 6199 - DNA, 20 bp, Artificial Sequence
  Description of Artificial Sequence: Synthetic oligonucleotide
  Target: SCN10A; (-) strand; PAM type: NNAGAAW; PAM sequence: GCAGAAA
ttaagttctggggtacatgt

SEQ ID NO: 6200 - DNA, 20 bp, Artificial Sequence
  Description of Artificial Sequence: Synthetic oligonucleotide
  Target: SCN10A; (-) strand; PAM type: NNAGAAW; PAM sequence: CAAGAAT
atccaactttgcaccacaca

SEQ ID NO: 6201 - DNA, 20 bp, Artificial Sequence
  Description of Artificial Sequence: Synthetic oligonucleotide
  Target: SCN10A; (-) strand; PAM type: NNAGAAW; PAM sequence: GAAGAAT
ggtcttcaaaaaatgatgct

SEQ ID NO: 6202 - DNA, 20 bp, Artificial Sequence
  Description of Artificial Sequence: Synthetic oligonucleotide
  Target: SCN10A; (-) strand; PAM type: NNAGAAW; PAM sequence: TCAGAAT
tgccattggtgtaagattgg

SEQ ID NO: 6203 - DNA, 20 bp, Artificial Sequence
  Description of Artificial Sequence: Synthetic oligonucleotide
  Target: SCN10A; (-) strand; PAM type: NNAGAAW; PAM sequence: GAAGAAA
atagccaagaaacttttgag

SEQ ID NO: 6204 - DNA, 20 bp, Artificial Sequence
  Description of Artificial Sequence: Synthetic oligonucleotide
  Target: SCN10A; (-) strand; PAM type: NNAGAAW; PAM sequence: CAAGAAA
tttaaagagcaaattatagc

SEQ ID NO: 6205 - DNA, 20 bp, Artificial Sequence
  Description of Artificial Sequence: Synthetic oligonucleotide
  Target: SCN10A; (-) strand; PAM type: NNAGAAW; PAM sequence: AAAGAAA
aagtattgtgtaaagttttt

SEQ ID NO: 6206 - DNA, 20 bp, Artificial Sequence
  Description of Artificial Sequence: Synthetic oligonucleotide
  Target: SCN10A; (-) strand; PAM type: NNAGAAW; PAM sequence: ACAGAAA
tgtatagacactagcaacaa

SEQ ID NO: 6207 - DNA, 20 bp, Artificial Sequence
  Description of Artificial Sequence: Synthetic oligonucleotide
  Target: SCN10A; (-) strand; PAM type: NNAGAAW; PAM sequence: TAAGAAT
cataacctagagataaacag

SEQ ID NO: 6208 - DNA, 20 bp, Artificial Sequence
  Description of Artificial Sequence: Synthetic oligonucleotide
  Target: SCN10A; (-) strand; PAM type: NNAGAAW; PAM sequence: GAAGAAA
caaagaaaaaaaaagtgcaa

SEQ ID NO: 6209 - DNA, 20 bp, Artificial Sequence
  Description of Artificial Sequence: Synthetic oligonucleotide
  Target: SCN10A; (-) strand; PAM type: NNAGAAW; PAM sequence: AAAGAAA
ctcagccagcatagtaaagc

SEQ ID NO: 6210 - DNA, 20 bp, Artificial Sequence
  Description of Artificial Sequence: Synthetic oligonucleotide
  Target: SCN10A; (-) strand; PAM type: NNAGAAW; PAM sequence: AAAGAAA
aagctttccctttgagatca

SEQ ID NO: 6211 - DNA, 20 bp, Artificial Sequence
  Description of Artificial Sequence: Synthetic oligonucleotide
  Target: SCN10A; (-) strand; PAM type: NNAGAAW; PAM sequence: GGAGAAA
ctaggggagggatagcatta

SEQ ID NO: 6212 - DNA, 20 bp, Artificial Sequence
  Description of Artificial Sequence: Synthetic oligonucleotide
  Target: SCN10A; (-) strand; PAM type: NNAGAAW; PAM sequence: ACAGAAA
ctcagcaaactaacacaaga

SEQ ID NO: 6213 - DNA, 20 bp, Artificial Sequence
  Description of Artificial Sequence: Synthetic oligonucleotide
  Target: SCN10A; (-) strand; PAM type: NNAGAAW; PAM sequence: TTAGAAA
ccatttataattttaaattc

SEQ ID NO: 6214 - DNA, 20 bp, Artificial Sequence
  Description of Artificial Sequence: Synthetic oligonucleotide
  Target: SCN10A; (-) strand; PAM type: NNAGAAW; PAM sequence: ACAGAAA
taacagtaatgcatgccaca

SEQ ID NO: 6215 - DNA, 20 bp, Artificial Sequence
  Description of Artificial Sequence: Synthetic oligonucleotide
  Target: SCN10A; (-) strand; PAM type: NNAGAAW; PAM sequence: TCAGAAT
tgggtgaaacccctatagtt

SEQ ID NO: 6216 - DNA, 20 bp, Artificial Sequence
  Description of Artificial Sequence: Synthetic oligonucleotide
  Target: SCN10A; (-) strand; PAM type: NNAGAAW; PAM sequence: TTAGAAA
caaatggctctggagtatat

SEQ ID NO: 6217 - DNA, 20 bp, Artificial Sequence
  Description of Artificial Sequence: Synthetic oligonucleotide
  Target: SCN10A; (-) strand; PAM type: NNAGAAW; PAM sequence: CCAGAAA
taaatgcctgagtcccagcc

SEQ ID NO: 6218 - DNA, 20 bp, Artificial Sequence
  Description of Artificial Sequence: Synthetic oligonucleotide
  Target: SCN10A; (-) strand; PAM type: NNAGAAW; PAM sequence: AGAGAAA
atgacccgaactgaccttcc

SEQ ID NO: 6219 - DNA, 20 bp, Artificial Sequence
  Description of Artificial Sequence: Synthetic oligonucleotide
  Target: SCN10A; (-) strand; PAM type: NNAGAAW; PAM sequence: TGAGAAA
ggttgactagctgcatgacc

SEQ ID NO: 6220 - DNA, 20 bp, Artificial Sequence
  Description of Artificial Sequence: Synthetic oligonucleotide
  Target: SCN10A; (-) strand; PAM type: NNAGAAW; PAM sequence: TTAGAAT
ttctaacttttctttgtctt

SEQ ID NO: 6221 - DNA, 20 bp, Artificial Sequence
  Description of Artificial Sequence: Synthetic oligonucleotide
  Target: SCN10A; (-) strand; PAM type: NNAGAAW; PAM sequence: TAAGAAA
gttgggagcccagctattcc

SEQ ID NO: 6222 - DNA, 20 bp, Artificial Sequence
  Description of Artificial Sequence: Synthetic oligonucleotide
  Target: SCN10A; (-) strand; PAM type: NNAGAAW; PAM sequence: ACAGAAA
ctagacacatcaaggcattt

SEQ ID NO: 6223 - DNA, 20 bp, Artificial Sequence
  Description of Artificial Sequence: Synthetic oligonucleotide
  Target: SCN10A; (-) strand; PAM type: NNAGAAW; PAM sequence: ATAGAAT
aggaaaatgtggtttaatta

SEQ ID NO: 6224 - DNA, 20 bp, Artificial Sequence
  Description of Artificial Sequence: Synthetic oligonucleotide
  Target: SCN10A; (-) strand; PAM type: NNAGAAW; PAM sequence: GTAGAAT
tatattacttttaaatattt

SEQ ID NO: 6225 - DNA, 20 bp, Artificial Sequence
  Description of Artificial Sequence: Synthetic oligonucleotide
  Target: SCN10A; (-) strand; PAM type: NNAGAAW; PAM sequence: CTAGAAT
aactccagccccaaaagata

SEQ ID NO: 6226 - DNA, 20 bp, Artificial Sequence
  Description of Artificial Sequence: Synthetic oligonucleotide
  Target: SCN10A; (-) strand; PAM type: NNAGAAW; PAM sequence: ACAGAAA
cttggtagagtcacagctgg

SEQ ID NO: 6227 - DNA, 20 bp, Artificial Sequence
  Description of Artificial Sequence: Synthetic oligonucleotide
  Target: SCN10A; (-) strand; PAM type: NNAGAAW; PAM sequence: TTAGAAA
gataagtaagaaacagctaa

SEQ ID NO: 6228 - DNA, 20 bp, Artificial Sequence
  Description of Artificial Sequence: Synthetic oligonucleotide
  Target: SCN10A; (-) strand; PAM type: NNAGAAW; PAM sequence: TAAGAAA
ttgaattacatctggataag

SEQ ID NO: 6229 - DNA, 20 bp, Artificial Sequence
  Description of Artificial Sequence: Synthetic oligonucleotide
  Target: SCN10A; (-) strand; PAM type: NNAGAAW; PAM sequence: AGAGAAA
tacatggaaattacaaataa

SEQ ID NO: 6230 - DNA, 20 bp, Artificial Sequence
  Description of Artificial Sequence: Synthetic oligonucleotide
  Target: SCN10A; (-) strand; PAM type: NNAGAAW; PAM sequence: CAAGAAT
ttttctttctggctggccag

SEQ ID NO: 6231 - DNA, 20 bp, Artificial Sequence
  Description of Artificial Sequence: Synthetic oligonucleotide
  Target: SCN10A; (-) strand; PAM type: NNAGAAW; PAM sequence: CAAGAAT
gcttgcaggaggttgatgta

SEQ ID NO: 6232 - DNA, 20 bp, Artificial Sequence
  Description of Artificial Sequence: Synthetic oligonucleotide
  Target: SCN10A; (-) strand; PAM type: NNAGAAW; PAM sequence: GTAGAAA
ttgcaaggcaagccaaacta

SEQ ID NO: 6233 - DNA, 20 bp, Artificial Sequence
  Description of Artificial Sequence: Synthetic oligonucleotide
  Target: SCN10A; (-) strand; PAM type: NNAGAAW; PAM sequence: AGAGAAA
aggatggttctcttgtcaga

SEQ ID NO: 6234 - DNA, 20 bp, Artificial Sequence
  Description of Artificial Sequence: Synthetic oligonucleotide
  Target: SCN10A; (-) strand; PAM type: NNAGAAW; PAM sequence: GAAGAAA
agatgtagaaggtggagaca

SEQ ID NO: 6235 - DNA, 20 bp, Artificial Sequence
  Description of Artificial Sequence: Synthetic oligonucleotide
  Target: SCN10A; (-) strand; PAM type: NNAGAAW; PAM sequence: GGAGAAA
atcctcctaaatcctcagag

SEQ ID NO: 6236 - DNA, 20 bp, Artificial Sequence
  Description of Artificial Sequence: Synthetic oligonucleotide
  Target: SCN10A; (-) strand; PAM type: NNAGAAW; PAM sequence: TGAGAAT
atccctgaaatcaaaaagtt

SEQ ID NO: 6237 - DNA, 20 bp, Artificial Sequence
  Description of Artificial Sequence: Synthetic oligonucleotide
  Target: SCN10A; (-) strand; PAM type: NNAGAAW; PAM sequence: ACAGAAA
ggaggagcatggcggtgagg

SEQ ID NO: 6238 - DNA, 20 bp, Artificial Sequence
  Description of Artificial Sequence: Synthetic oligonucleotide
  Target: SCN10A; (-) strand; PAM type: NNAGAAW; PAM sequence: ATAGAAA
gaatttttatgacatttatg

SEQ ID NO: 6239 - DNA, 20 bp, Artificial Sequence
  Description of Artificial Sequence: Synthetic oligonucleotide
  Target: SCN10A; (-) strand; PAM type: NNAGAAW; PAM sequence: CCAGAAA
aagtctcggtcccacccagc

SEQ ID NO: 6240 - DNA, 20 bp, Artificial Sequence
  Description of Artificial Sequence: Synthetic oligonucleotide
  Target: SCN10A; (-) strand; PAM type: NNAGAAW; PAM sequence: AAAGAAA
attgctgccaagcagggaac

SEQ ID NO: 6241 - DNA, 20 bp, Artificial Sequence
  Description of Artificial Sequence: Synthetic oligonucleotide
  Target: SCN10A; (-) strand; PAM type: NNAGAAW; PAM sequence: GAAGAAT
gagtataaatacttcctgaa

SEQ ID NO: 6242 - DNA, 20 bp, Artificial Sequence
  Description of Artificial Sequence: Synthetic oligonucleotide
  Target: SCN10A; (-) strand; PAM type: NNAGAAW; PAM sequence: TAAGAAA
caataaataaaagattgtga

SEQ ID NO: 6243 - DNA, 20 bp, Artificial Sequence
  Description of Artificial Sequence: Synthetic oligonucleotide
  Target: SCN10A; (-) strand; PAM type: NNAGAAW; PAM sequence: GGAGAAA
caaatgaaattcaaacaggt

SEQ ID NO: 6244 - DNA, 20 bp, Artificial Sequence
  Description of Artificial Sequence: Synthetic oligonucleotide
  Target: SCN10A; (-) strand; PAM type: NNAGAAW; PAM sequence: AGAGAAA
agactgaacctggaggtccc

SEQ ID NO: 6245 - DNA, 20 bp, Artificial Sequence
  Description of Artificial Sequence: Synthetic oligonucleotide
  Target: SCN10A; (-) strand; PAM type: NNAGAAW; PAM sequence: GAAGAAA
gtatttgaaacctcagacta

SEQ ID NO: 6246 - DNA, 20 bp, Artificial Sequence
  Description of Artificial Sequence: Synthetic oligonucleotide
  Target: SCN10A; (-) strand; PAM type: NNAGAAW; PAM sequence: TGAGAAA
caagggaagacagggaatag

SEQ ID NO: 6247 - DNA, 20 bp, Artificial Sequence
  Description of Artificial Sequence: Synthetic oligonucleotide
  Target: SCN10A; (-) strand; PAM type: NNAGAAW; PAM sequence: TTAGAAT
cagagggaaaggaatggtcc

SEQ ID NO: 6248 - DNA, 20 bp, Artificial Sequence
  Description of Artificial Sequence: Synthetic oligonucleotide
  Target: SCN10A; (-) strand; PAM type: NNAGAAW; PAM sequence: AGAGAAA
aagagctggcagacaaggag

SEQ ID NO: 6249 - DNA, 20 bp, Artificial Sequence
  Description of Artificial Sequence: Synthetic oligonucleotide
  Target: SCN10A; (-) strand; PAM type: NNAGAAW; PAM sequence: AAAGAAA
aaaaaaaaaaagaaaaagaa

SEQ ID NO: 6250 - DNA, 20 bp, Artificial Sequence
  Description of Artificial Sequence: Synthetic oligonucleotide
  Target: SCN10A; (-) strand; PAM type: NNAGAAW; PAM sequence: AAAGAAA
tctcaaaaaaaaaaaaagaa

SEQ ID NO: 6251 - DNA, 20 bp, Artificial Sequence
  Description of Artificial Sequence: Synthetic oligonucleotide
  Target: SCN10A; (-) strand; PAM type: NNAGAAW; PAM sequence: AAAGAAA
accctgtctcaaaaaaaaaa

SEQ ID NO: 6252 - DNA, 20 bp, Artificial Sequence
  Description of Artificial Sequence: Synthetic oligonucleotide
  Target: SCN10A; (-) strand; PAM type: NNAGAAW; PAM sequence: GGAGAAT
ctattcgggaggctgaggtg

SEQ ID NO: 6253 - DNA, 20 bp, Artificial Sequence
  Description of Artificial Sequence: Synthetic oligonucleotide
  Target: SCN10A; (-) strand; PAM type: NNAGAAW; PAM sequence: AGAGAAA
gagagactgagaaggagaag

SEQ ID NO: 6254 - DNA, 20 bp, Artificial Sequence
  Description of Artificial Sequence: Synthetic oligonucleotide
  Target: SCN10A; (-) strand; PAM type: NNAGAAW; PAM sequence: TGAGAAA
caatcatgtatgggaaaagc

SEQ ID NO: 6255 - DNA, 20 bp, Artificial Sequence
  Description of Artificial Sequence: Synthetic oligonucleotide
  Target: SCN10A; (-) strand; PAM type: NNAGAAW; PAM sequence: TTAGAAA
acatagaagagaggcaggta

SEQ ID NO: 6256 - DNA, 20 bp, Artificial Sequence
  Description of Artificial Sequence: Synthetic oligonucleotide
  Target: SCN10A; (-) strand; PAM type: NNAGAAW; PAM sequence: ACAGAAA
tacccaggttgtggacagac

SEQ ID NO: 6257 - DNA, 20 bp, Artificial Sequence
  Description of Artificial Sequence: Synthetic oligonucleotide
  Target: SCN10A; (-) strand; PAM type: NNAGAAW; PAM sequence: ATAGAAA
ttgattgtatgtggaatgaa

SEQ ID NO: 6258 - DNA, 20 bp, Artificial Sequence
  Description of Artificial Sequence: Synthetic oligonucleotide
  Target: SCN10A; (-) strand; PAM type: NNAGAAW; PAM sequence: TTAGAAA
ggccactgttggagaatagg

SEQ ID NO: 6259 - DNA, 20 bp, Artificial Sequence
  Description of Artificial Sequence: Synthetic oligonucleotide
  Target: SCN10A; (-) strand; PAM type: NNAGAAW; PAM sequence: GGAGAAT
aatatcatttggccactgtt

SEQ ID NO: 6260 - DNA, 20 bp, Artificial Sequence
  Description of Artificial Sequence: Synthetic oligonucleotide
  Target: SCN10A; (-) strand; PAM type: NNAGAAW; PAM sequence: TTAGAAA
cacataaccagattttcatt

SEQ ID NO: 6261 - DNA, 20 bp, Artificial Sequence
  Description of Artificial Sequence: Synthetic oligonucleotide
  Target: SCN10A; (-) strand; PAM type: NNAGAAW; PAM sequence: TTAGAAT
cttgagtgctatggagagct

SEQ ID NO: 6262 - DNA, 20 bp, Artificial Sequence
  Description of Artificial Sequence: Synthetic oligonucleotide
  Target: SCN10A; (-) strand; PAM type: NNAGAAW; PAM sequence: AAAGAAT
tggaaaagccttaacataaa

SEQ ID NO: 6263 - DNA, 20 bp, Artificial Sequence
  Description of Artificial Sequence: Synthetic oligonucleotide
  Target: SCN10A; (-) strand; PAM type: NNAGAAW; PAM sequence: CAAGAAT
ttgtctcaaagccaagagta

SEQ ID NO: 6264 - DNA, 20 bp, Artificial Sequence
  Description of Artificial Sequence: Synthetic oligonucleotide
  Target: SCN10A; (-) strand; PAM type: NNAGAAW; PAM sequence: GAAGAAA
cttcatataggtcagaaatg

SEQ ID NO: 6265 - DNA, 20 bp, Artificial Sequence
  Description of Artificial Sequence: Synthetic oligonucleotide
  Target: SCN10A; (-) strand; PAM type: NNAGAAW; PAM sequence: TCAGAAA
taacatagacttcatatagg

SEQ ID NO: 6266 - DNA, 20 bp, Artificial Sequence
  Description of Artificial Sequence: Synthetic oligonucleotide
  Target: SCN10A; (-) strand; PAM type: NNAGAAW; PAM sequence: AGAGAAA
attacaaatcagatgtttat

SEQ ID NO: 6267 - DNA, 20 bp, Artificial Sequence
  Description of Artificial Sequence: Synthetic oligonucleotide
  Target: SCN10A; (-) strand; PAM type: NNAGAAW; PAM sequence: ACAGAAA
tagaaacaatagaaaggcaa

SEQ ID NO: 6268 - DNA, 20 bp, Artificial Sequence
  Description of Artificial Sequence: Synthetic oligonucleotide
  Target: SCN10A; (-) strand; PAM type: NNAGAAW; PAM sequence: ATAGAAA
cttacaatttggtagaaaca

SEQ ID NO: 6269 - DNA, 20 bp, Artificial Sequence
  Description of Artificial Sequence: Synthetic oligonucleotide
  Target: SCN10A; (-) strand; PAM type: NNAGAAW; PAM sequence: GTAGAAA
ctcactgagcttacaatttg

SEQ ID NO: 6270 - DNA, 20 bp, Artificial Sequence
  Description of Artificial Sequence: Synthetic oligonucleotide
  Target: SCN10A; (-) strand; PAM type: NNAGAAW; PAM sequence: CAAGAAA
tatcacagaggtattggatt

SEQ ID NO: 6271 - DNA, 20 bp, Artificial Sequence
  Description of Artificial Sequence: Synthetic oligonucleotide
  Target: SCN10A; (-) strand; PAM type: NNAGAAW; PAM sequence: GAAGAAA
agggtgagggaaagctctca

SEQ ID NO: 6272 - DNA, 20 bp, Artificial Sequence
  Description of Artificial Sequence: Synthetic oligonucleotide
  Target: SCN10A; (-) strand; PAM type: NNAGAAW; PAM sequence: TAAGAAA
gttgactttgaaaagttccg

SEQ ID NO: 6273 - DNA, 20 bp, Artificial Sequence
  Description of Artificial Sequence: Synthetic oligonucleotide
  Target: SCN10A; (-) strand; PAM type: NNAGAAW; PAM sequence: GAAGAAA
cacatagaacttctaagtta

SEQ ID NO: 6274 - DNA, 20 bp, Artificial Sequence
  Description of Artificial Sequence: Synthetic oligonucleotide
  Target: SCN10A; (-) strand; PAM type: NNAGAAW; PAM sequence: TCAGAAT
gcataaatacaccatgttaa

SEQ ID NO: 6275 - DNA, 20 bp, Artificial Sequence
  Description of Artificial Sequence: Synthetic oligonucleotide
  Target: SCN10A; (-) strand; PAM type: NNAGAAW; PAM sequence: GAAGAAT
aatctttgtttctcagaagg

SEQ ID NO: 6276 - DNA, 20 bp, Artificial Sequence
  Description of Artificial Sequence: Synthetic oligonucleotide
  Target: SCN10A; (-) strand; PAM type: NNAGAAW; PAM sequence: AGAGAAA
tcttctcccctagacaagga

SEQ ID NO: 6277 - DNA, 20 bp, Artificial Sequence
  Description of Artificial Sequence: Synthetic oligonucleotide
  Target: SCN10A; (-) strand; PAM type: NNAGAAW; PAM sequence: AGAGAAT
attgcattccagtgtcactg

SEQ ID NO: 6278 - DNA, 20 bp, Artificial Sequence
  Description of Artificial Sequence: Synthetic oligonucleotide
  Target: SCN10A; (-) strand; PAM type: NNAGAAW; PAM sequence: CCAGAAT
ctggagggatttatggtagc

SEQ ID NO: 6279 - DNA, 20 bp, Artificial Sequence
  Description of Artificial Sequence: Synthetic oligonucleotide
  Target: SCN10A; (-) strand; PAM type: NNAGAAW; PAM sequence: TCAGAAT
cttgcaccccaatagttttc

SEQ ID NO: 6280 - DNA, 20 bp, Artificial Sequence
  Description of Artificial Sequence: Synthetic oligonucleotide
  Target: SCN10A; (-) strand; PAM type: NNAGAAW; PAM sequence: CTAGAAA
tcctctcttctatgacattc

SEQ ID NO: 6281 - DNA, 20 bp, Artificial Sequence
  Description of Artificial Sequence: Synthetic oligonucleotide
  Target: SCN10A; (-) strand; PAM type: NNAGAAW; PAM sequence: CTAGAAT
gggccgagcttggagctaaa

SEQ ID NO: 6282 - DNA, 20 bp, Artificial Sequence
  Description of Artificial Sequence: Synthetic oligonucleotide
  Target: SCN10A; (-) strand; PAM type: NNAGAAW; PAM sequence: ATAGAAA
gagggctgaatgcccaccga

SEQ ID NO: 6283 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
ttttgtgtggctttctgtaa

SEQ ID NO: 6284 - DNA, 20 bp, Artificial Sequence
  Description of Artificial Sequence: Synthetic oligonucleotide
  Target: SCN10A; (+) strand; PAM type: NNAGAAW; PAM sequence: TGAGAAT
ttgtccttgcgatagtttgc

SEQ ID NO: 6285 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
cccattcacaattgcttcaa

SEQ ID NO: 6286 - DNA, 20 bp, Artificial Sequence
  Description of Artificial Sequence: Synthetic oligonucleotide
  Target: SCN10A; (+) strand; PAM type: NNAGAAW; PAM sequence: GAAGAAT
aaagaggatacaaacaaatg

SEQ ID NO: 6287 - DNA, 20 bp, Artificial Sequence
  Description of Artificial Sequence: Synthetic oligonucleotide
  Target: SCN10A; (+) strand; PAM type: NNAGAAW; PAM sequence: GAAGAAT
tactccatgctcatgggtag

SEQ ID NO: 6288 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
agctaccaatgactttcttc

SEQ ID NO: 6289 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
ttttttactttttagcatta

SEQ ID NO: 6290 - DNA, 20 bp, Artificial Sequence
  Description of Artificial Sequence: Synthetic oligonucleotide
  Target: SCN10A; (+) strand; PAM type: NNAGAAW; PAM sequence: CTAGAAT
gtacattgtgcacatgtacc

SEQ ID NO: 6291 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
tttaaagtataattttaaaa

SEQ ID NO: 6292 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
aatttaggaaatgcatttgt

SEQ ID NO: 6293 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
atgcatttgtgcagaaaaaa

SEQ ID NO: 6294 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
tgggatgctgtaacaaatta

SEQ ID NO: 6295 - DNA, 20 bp, Artificial Sequence
  Description of Artificial Sequence: Synthetic oligonucleotide
  Target: SCN10A; (+) strand; PAM type: NNAGAAW; PAM sequence: ATAGAAA
aaactaggtagatgacaata

SEQ ID NO: 6296 - DNA, 20 bp, Artificial Sequence
  Description of Artificial Sequence: Synthetic oligonucleotide
  Target: SCN10A; (+) strand; PAM type: NNAGAAW; PAM sequence: TGAGAAT
actcaaagtaaaaatacttt

SEQ ID NO: 6297 - DNA, 20 bp, Artificial Sequence
  Description of Artificial Sequence: Synthetic oligonucleotide
  Target: SCN10A; (+) strand; PAM type: NNAGAAW; PAM sequence: TTAGAAT
tatttggttgaactcatctt

SEQ ID NO: 6298 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
ttagaataaatcaggcattc

SEQ ID NO: 6299 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
cttcttatgggctaatagtg

SEQ ID NO: 6300 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
taacatttgcaggatgaatg

SEQ ID NO: 6301 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
gctgcctctttagctacaca

SEQ ID NO: 6302 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
aaggtccagccatttcagcc

SEQ ID NO: 6303 - DNA, 20 bp, Artificial Sequence
  Description of Artificial Sequence: Synthetic oligonucleotide
  Target: SCN10A; (+) strand; PAM type: NNAGAAW; PAM sequence: ATAGAAA
cagcacgagatgcgaagtct

SEQ ID NO: 6304 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
aactgaaaaatatcaggatc

SEQ ID NO: 6305 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
tcatgatacaggtcagcatc

SEQ ID NO: 6306 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
aggtcagcatcacagaaata

SEQ ID NO: 6307 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
tctcctccatatttgccttc

SEQ ID NO: 6308 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
tgtctgcaaagtccgagaga

SEQ ID NO: 6309 - DNA, 20 bp, Artificial Sequence
  Description of Artificial Sequence: Synthetic oligonucleotide
  Target: SCN10A; (+) strand; PAM type: NNAGAAW; PAM sequence: CCAGAAT
cgtggccacattgaagttct

SEQ ID NO: 6310 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
gaagtaactttgaagtgact

SEQ ID NO: 6311 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
tttgaagtgacttaagaatt

SEQ ID NO: 6312 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
aatcaggcctttaaaagaag

SEQ ID NO: 6313 - DNA, 20 bp, Artificial Sequence
  Description of Artificial Sequence: Synthetic oligonucleotide
  Target: SCN10A; (+) strand; PAM type: NNAGAAW; PAM sequence: CTAGAAT
catgttatctttgcctccgc

SEQ ID NO: 6314 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
atgaacaaagttggaaatat

SEQ ID NO: 6315 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
caatattgtgttggaaagag

SEQ ID NO: 6316 - DNA, 20 bp, Artificial Sequence
  Description of Artificial Sequence: Synthetic oligonucleotide
  Target: SCN10A; (+) strand; PAM type: NNAGAAW; PAM sequence: GGAGAAT
ctccaggatcttattttaag

SEQ ID NO: 6317 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
cacctcttgttggtgggaaa

SEQ ID NO: 6318 - DNA, 20 bp, Artificial Sequence
  Description of Artificial Sequence: Synthetic oligonucleotide
  Target: SCN10A; (+) strand; PAM type: NNAGAAW; PAM sequence: GTAGAAA
aagggaggtaaggagagagg

SEQ ID NO: 6319 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
atagtcaaactcatgggagc

SEQ ID NO: 6320 - DNA, 20 bp, Artificial Sequence
  Description of Artificial Sequence: Synthetic oligonucleotide
  Target: SCN10A; (+) strand; PAM type: NNAGAAW; PAM sequence: ATAGAAT
caaactcatgggagcagaga

SEQ ID NO: 6321 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
gtctacctaaaaatttgcca

SEQ ID NO: 6322 - DNA, 20 bp, Artificial Sequence
  Description of Artificial Sequence: Synthetic oligonucleotide
  Target: SCN10A; (+) strand; PAM type: NNAGAAW; PAM sequence: TGAGAAT
ttaattccagaccctagact

SEQ ID NO: 6323 - DNA, 20 bp, Artificial Sequence
  Description of Artificial Sequence: Synthetic oligonucleotide
  Target: SCN10A; (+) strand; PAM type: NNAGAAW; PAM sequence: CCAGAAT
aaagaactggttgattttgc

SEQ ID NO: 6324 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
caaaaccctggaacttgttc

SEQ ID NO: 6325 - DNA, 20 bp, Artificial Sequence
  Description of Artificial Sequence: Synthetic oligonucleotide
  Target: SCN10A; (+) strand; PAM type: NNAGAAW; PAM sequence: GCAGAAT
ctagtttctcctaacttaaa

SEQ ID NO: 6326 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
ctaacttaaagcagaatatt

SEQ ID NO: 6327 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
aatttgtaaatgaatggaag

SEQ ID NO: 6328 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
ctatcctgttgggttagagc

SEQ ID NO: 6329 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
tttctgtagcagggaatgtt

SEQ ID NO: 6330 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
aatccttaacttttcctatg

SEQ ID NO: 6331 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
ggcacccatgcactgatggg

SEQ ID NO: 6332 - DNA, 20 bp, Artificial Sequence
  Description of Artificial Sequence: Synthetic oligonucleotide
  Target: SCN10A; (+) strand; PAM type: NNAGAAW; PAM sequence: CCAGAAT
gagtgtttaccttgcttggg

SEQ ID NO: 6333 - DNA, 20 bp, Artificial Sequence
  Description of Artificial Sequence: Synthetic oligonucleotide
  Target: SCN10A; (+) strand; PAM type: NNAGAAW; PAM sequence: GGAGAAT
tcttcttccattcaaaggat

SEQ ID NO: 6334 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
aaggatggagaatctcagga

SEQ ID NO: 6335 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
tcttagttgcagcttaatta

SEQ ID NO: 6336 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
aaatatgatttatcttgtcc

SEQ ID NO: 6337 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
tgattgtatgggtgatttag

SEQ ID NO: 6338 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
ccccattgtaatacttctta

SEQ ID NO: 6339 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
aaaatctaatagcttggcta

SEQ ID NO: 6340 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
actaatgctgcatcttagcc

SEQ ID NO: 6341 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
cattcactggagtggatggc

SEQ ID NO: 6342 - DNA, 20 bp, Artificial Sequence
  Description of Artificial Sequence: Synthetic oligonucleotide
  Target: SCN10A; (+) strand; PAM type: NNAGAAW; PAM sequence: GTAGAAT
tctatacctgtaggcgtggg

SEQ ID NO: 6343 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
acttgaactctaaaactgtt

SEQ ID NO: 6344 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
ccaaaatcagaacaggcagg

SEQ ID NO: 6345 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
tgccctctgctgttacagtg

SEQ ID NO: 6346 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
gttttctcatctgtaaaatg

SEQ ID NO: 6347 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
tcccctctgctgttacagtg

SEQ ID NO: 6348 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
tattagccccattgaatgaa

SEQ ID NO: 6349 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
tagtggggcattgctgacag

SEQ ID NO: 6350 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
atataaggcttaccactaca

SEQ ID NO: 6351 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
gcttaccactacagcagaaa

SEQ ID NO: 6352 - DNA, 20 bp, Artificial Sequence
  Description of Artificial Sequence: Synthetic oligonucleotide
  Target: SCN10A; (+) strand; PAM type: NNAGAAW; PAM sequence: GAAGAAT
agcaggaatgagggagtggg

SEQ ID NO: 6353 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
aagccctggagtctttatac

SEQ ID NO: 6354 - DNA, 20 bp, Artificial Sequence
  Description of Artificial Sequence: Synthetic oligonucleotide
  Target: SCN10A; (+) strand; PAM type: NNAGAAW; PAM sequence: GTAGAAT
tcaaatgcagactgatatgg

SEQ ID NO: 6355 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
ctgtgttggaaagggcttgt

SEQ ID NO: 6356 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
gttggaaagggcttgtgcag

SEQ ID NO: 6357 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
taatcccacatgtggctgtt

SEQ ID NO: 6358 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
cattaaagacacagagcctt

SEQ ID NO: 6359 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
cccaccttatgcacatgatg

SEQ ID NO: 6360 - DNA, 20 bp, Artificial Sequence
  Description of Artificial Sequence: Synthetic oligonucleotide
  Target: SCN10A; (+) strand; PAM type: NNAGAAW; PAM sequence: TGAGAAT
tatcttccagatggagaagt

SEQ ID NO: 6361 - DNA, 20 bp, Artificial Sequence
  Description of Artificial Sequence: Synthetic oligonucleotide
  Target: SCN10A; (+) strand; PAM type: NNAGAAW; PAM sequence: CTAGAAA
agctttagcattcttgaggt

SEQ ID NO: 6362 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
aatgaacaggtagatgaagg

SEQ ID NO: 6363 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
gagtgattgactggatgatg

SEQ ID NO: 6364 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
gattgactggatgatgaaag

SEQ ID NO: 6365 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
atggtgtagtctgtaggaat

SEQ ID NO: 6366 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
accaccacctggtgggagat

SEQ ID NO: 6367 - DNA, 20 bp, Artificial Sequence
  Description of Artificial Sequence: Synthetic oligonucleotide
  Target: SCN10A; (+) strand; PAM type: NNAGAAW; PAM sequence: TGAGAAT
cttatttgtaaataagcaaa

SEQ ID NO: 6368 - DNA, 20 bp, Artificial Sequence
  Description of Artificial Sequence: Synthetic oligonucleotide
  Target: SCN10A; (+) strand; PAM type: NNAGAAW; PAM sequence: ATAGAAT
gagaatctattagatacaaa

SEQ ID NO: 6369 - DNA, 20 bp, Artificial Sequence
  Description of Artificial Sequence: Synthetic oligonucleotide
  Target: SCN10A; (+) strand; PAM type: NNAGAAW; PAM sequence: CGAGAAA
ttacccgcatgccttcaaat

SEQ ID NO: 6370 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
gggctttgatgggagccact

SEQ ID NO: 6371 - DNA, 20 bp, Artificial Sequence
  Description of Artificial Sequence: Synthetic oligonucleotide
  Target: SCN10A; (+) strand; PAM type: NNAGAAW; PAM sequence: CCAGAAT
gggagccacttcagaatatt

SEQ ID NO: 6372 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
agatctgagtgcaggagagg

SEQ ID NO: 6373 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
agaaacatcactctaggttt

SEQ ID NO: 6374 - DNA, 20 bp, Artificial Sequence
  Description of Artificial Sequence: Synthetic oligonucleotide
  Target: SCN10A; (+) strand; PAM type: NNAGAAW; PAM sequence: CTAGAAA
tcggaactccaatgagaggt

SEQ ID NO: 6375 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
actctcttaaacaatctggg

SEQ ID NO: 6376 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
tgctcagagaagtggggtgg

SEQ ID NO: 6377 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
aaaatgaaaaagtcagacta

SEQ ID NO: 6378 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
tggtccaaagactgcaaagg

SEQ ID NO: 6379 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
gtgggatgcacacaggagct

SEQ ID NO: 6380 - DNA, 20 bp, Artificial Sequence
  Description of Artificial Sequence: Synthetic oligonucleotide
  Target: SCN10A; (+) strand; PAM type: NNAGAAW; PAM sequence: GAAGAAT
tctaatgccacctcccatag

SEQ ID NO: 6381 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
agttagatgtatagcaaatg

SEQ ID NO: 6382 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
tcattgggatggctagaagg

SEQ ID NO: 6383 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
tgggatggctagaaggaaag

SEQ ID NO: 6384 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
tagctgctcttgccacaggg

SEQ ID NO: 6385 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
gatagttgaatggaaggatg

SEQ ID NO: 6386 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
ggaaggatgggagaaacaaa

SEQ ID NO: 6387 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
atggaaagatggggagctgg

SEQ ID NO: 6388 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
gatgaatgaacagataagtg

SEQ ID NO: 6389 - DNA, 20 bp, Artificial Sequence
  Description of Artificial Sequence: Synthetic oligonucleotide
  Target: SCN10A; (+) strand; PAM type: NNAGAAW; PAM sequence: GAAGAAT
aacagataagtggaagaaag

SEQ ID NO: 6390 - DNA, 20 bp, Artificial Sequence
  Description of Artificial Sequence: Synthetic oligonucleotide
  Target: SCN10A; (+) strand; PAM type: NNAGAAW; PAM sequence: CAAGAAT
aatagatggataggttgaaa

SEQ ID NO: 6391 - DNA, 20 bp, Artificial Sequence
  Description of Artificial Sequence: Synthetic oligonucleotide
  Target: SCN10A; (+) strand; PAM type: NNAGAAW; PAM sequence: GAAGAAT
gaaacaagaatggaaagata

SEQ ID NO: 6392 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
gaagatgcgtgaatgagtga

SEQ ID NO: 6393 - DNA, 20 bp, Artificial Sequence
  Description of Artificial Sequence: Synthetic oligonucleotide
  Target: SCN10A; (+) strand; PAM type: NNAGAAW; PAM sequence: GAAGAAT
gatgattggacagttggata

SEQ ID NO: 6394 - DNA, 20 bp, Artificial Sequence
  Description of Artificial Sequence: Synthetic oligonucleotide
  Target: SCN10A; (+) strand; PAM type: NNAGAAW; PAM sequence: ATAGAAA
atagaagaatgaatcaaaag

SEQ ID NO: 6395 - DNA, 20 bp, Artificial Sequence
  Description of Artificial Sequence: Synthetic oligonucleotide
  Target: SCN10A; (+) strand; PAM type: NNAGAAW; PAM sequence: TTAGAAT
atgaatagatggaaggaagt

SEQ ID NO: 6396 - DNA, 20 bp, Artificial Sequence
  Description of Artificial Sequence: Synthetic oligonucleotide
  Target: SCN10A; (+) strand; PAM type: NNAGAAW; PAM sequence: GAAGAAT
ggcagaagagaagagggaaa

SEQ ID NO: 6397 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
ctgatgaagatgtacagctg

SEQ ID NO: 6398 - DNA, 20 bp, Artificial Sequence
  Description of Artificial Sequence: Synthetic oligonucleotide
  Target: SCN10A; (+) strand; PAM type: NNAGAAW; PAM sequence: GAAGAAT
gaaggatggatggttggaag

SEQ ID NO: 6399 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
tgaataattatttcatatgc

SEQ ID NO: 6400 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
tgcattggcatcagggaaga

SEQ ID NO: 6401 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
ctgccagcacaggaggctgg

SEQ ID NO: 6402 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
gcacatgcctcaccctgctt

SEQ ID NO: 6403 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
accacccaagaccaataaga

SEQ ID NO: 6404 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
agtcttcaaaggcctggaag

SEQ ID NO: 6405 - DNA, 20 bp, Artificial Sequence
  Description of Artificial Sequence: Synthetic oligonucleotide
  Target: SCN10A; (+) strand; PAM type: NNAGAAW; PAM sequence: GCAGAAT
gcctggaaggaagaaaggat

SEQ ID NO: 6406 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
gcagggatgctgaatgcaag

SEQ ID NO: 6407 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
ggatgctgaatgcaagggag

SEQ ID NO: 6408 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
gcagtttacaaaaatgaaag

SEQ ID NO: 6409 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
atcgccaacacacctctgaa

SEQ ID NO: 6410 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
atcagactggtggagatgga

SEQ ID NO: 6411 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
gataatatgagactatttac

SEQ ID NO: 6412 - DNA, 20 bp, Artificial Sequence
  Description of Artificial Sequence: Synthetic oligonucleotide
  Target: SCN10A; (+) strand; PAM type: NNAGAAW; PAM sequence: ATAGAAT
gagaaaaatgtactgaggtt

SEQ ID NO: 6413 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
tattttatgcataagcaaga

SEQ ID NO: 6414 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
aaggagaagagcataggtgt

SEQ ID NO: 6415 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
ttgggctttgacttcctcat

SEQ ID NO: 6416 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
aagcatcacctgggagcttg

SEQ ID NO: 6417 - DNA, 20 bp, Artificial Sequence
  Description of Artificial Sequence: Synthetic oligonucleotide
  Target: SCN10A; (+) strand; PAM type: NNAGAAW; PAM sequence: TGAGAAT
cctgccacagatttatggaa

SEQ ID NO: 6418 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
ataatttctgctcctgctgc

SEQ ID NO: 6419 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
aaaaatttttctttgtattt

SEQ ID NO: 6420 - DNA, 20 bp, Artificial Sequence
  Description of Artificial Sequence: Synthetic oligonucleotide
  Target: SCN10A; (+) strand; PAM type: NNAGAAW; PAM sequence: ATAGAAT
ttgaggccacaattcccttt

SEQ ID NO: 6421 - DNA, 20 bp, Artificial Sequence
  Description of Artificial Sequence: Synthetic oligonucleotide
  Target: SCN10A; (+) strand; PAM type: NNAGAAW; PAM sequence: TGAGAAT
ttcattgcacaaatatttat

SEQ ID NO: 6422 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
tgcctagccggggtcatgga

SEQ ID NO: 6423 - DNA, 20 bp, Artificial Sequence
  Description of Artificial Sequence: Synthetic oligonucleotide
  Target: SCN10A; (+) strand; PAM type: NNAGAAW; PAM sequence: GCAGAAT
aagaagcatgacatccacgt

SEQ ID NO: 6424 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
gccccaggctacttttgcct

SEQ ID NO: 6425 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
tagagaaaatgatgtggaca

SEQ ID NO: 6426 - DNA, 20 bp, Artificial Sequence
  Description of Artificial Sequence: Synthetic oligonucleotide
  Target: SCN10A; (+) strand; PAM type: NNAGAAW; PAM sequence: GGAGAAT
tgtggacaaaagaaagtggg

SEQ ID NO: 6427 - DNA, 20 bp, Artificial Sequence
  Description of Artificial Sequence: Synthetic oligonucleotide
  Target: SCN10A; (+) strand; PAM type: NNAGAAW; PAM sequence: TAAGAAA
gactttaaaaattcccagga

SEQ ID NO: 6428 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
agctggctaaatgagtcaca

SEQ ID NO: 6429 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
ttggacaacatcctgttctt

SEQ ID NO: 6430 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
gttgtgaagacaaaatgata

SEQ ID NO: 6431 - DNA, 20 bp, Artificial Sequence
  Description of Artificial Sequence: Synthetic oligonucleotide
  Target: SCN10A; (+) strand; PAM type: NNAGAAW; PAM sequence: TAAGAAA
ttggttgatgtccagggcaa

SEQ ID NO: 6432 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
agctaggacctgtgcagctt

SEQ ID NO: 6433 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
ttccctagcaccatcaccgt

SEQ ID NO: 6434 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
gcttgaatacgcgcagctgc

SEQ ID NO: 6435 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
ggaaccaatggtttagttac

SEQ ID NO: 6436 - DNA, 20 bp, Artificial Sequence
  Description of Artificial Sequence: Synthetic oligonucleotide
  Target: SCN10A; (+) strand; PAM type: NNAGAAW; PAM sequence: GGAGAAT
atgaaccacaaacaatccca

SEQ ID NO: 6437 - DNA, 20 bp, Artificial Sequence
  Description of Artificial Sequence: Synthetic oligonucleotide
  Target: SCN10A; (+) strand; PAM type: NNAGAAW; PAM sequence: TGAGAAT
actacctaggtattttaagt

SEQ ID NO: 6438 - DNA, 20 bp, Artificial Sequence
  Description of Artificial Sequence: Synthetic oligonucleotide
  Target: SCN10A; (+) strand; PAM type: NNAGAAW; PAM sequence: GCAGAAT
gcaattctacaaagtgctct

SEQ ID NO: 6439 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
tcaagagtgaatgagatctt

SEQ ID NO: 6440 - DNA, 20 bp, Artificial Sequence
  Description of Artificial Sequence: Synthetic oligonucleotide
  Target: SCN10A; (+) strand; PAM type: NNAGAAW; PAM sequence: ATAGAAT
tcattccatttcttcagatg

SEQ ID NO: 6441 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
ataattagatataatatgtt

SEQ ID NO: 6442 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
aataacttgaaactatgtgc

SEQ ID NO: 6443 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
aagttgtgaaaaatacactc

SEQ ID NO: 6444 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
cagatttgacacagtttggg

SEQ ID NO: 6445 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
attagtgaactgaggatata

SEQ ID NO: 6446 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
gatatatcagaataaattat

SEQ ID NO: 6447 - DNA, 20 bp, Artificial Sequence
  Description of Artificial Sequence: Synthetic oligonucleotide
  Target: SCN10A; (+) strand; PAM type: NNAGAAW; PAM sequence: ATAGAAT
tagtgtaagagacatagagg

SEQ ID NO: 6448 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
tatctaaccaaagtccagaa

SEQ ID NO: 6449 - DNA, 20 bp, Artificial Sequence
  Description of Artificial Sequence: Synthetic oligonucleotide
  Target: SCN10A; (+) strand; PAM type: NNAGAAW; PAM sequence: ATAGAAT
aaagtccagaaggagaaaaa

SEQ ID NO: 6450 - DNA, 20 bp, Artificial Sequence
  Description of Artificial Sequence: Synthetic oligonucleotide
  Target: SCN10A; (+) strand; PAM type: NNAGAAW; PAM sequence: CCAGAAT
acatcatgtctgggaacttt

SEQ ID NO: 6451 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
tctgggaactttccagaatt

SEQ ID NO: 6452 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
atagaagatttaaaaagcat

SEQ ID NO: 6453 - DNA, 20 bp, Artificial Sequence
  Description of Artificial Sequence: Synthetic oligonucleotide
  Target: SCN10A; (+) strand; PAM type: NNAGAAW; PAM sequence: CTAGAAT
gaaggaagataaagtatcaa

SEQ ID NO: 6454 - DNA, 20 bp, Artificial Sequence
  Description of Artificial Sequence: Synthetic oligonucleotide
  Target: SCN10A; (+) strand; PAM type: NNAGAAW; PAM sequence: TAAGAAA
caactagaattttacattca

SEQ ID NO: 6455 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
tggccagaaggcacttacta

SEQ ID NO: 6456 - DNA, 20 bp, Artificial Sequence
  Description of Artificial Sequence: Synthetic oligonucleotide
  Target: SCN10A; (+) strand; PAM type: NNAGAAW; PAM sequence: ATAGAAA
aaaggaggtacttcaggtag

SEQ ID NO: 6457 - DNA, 20 bp, Artificial Sequence
  Description of Artificial Sequence: Synthetic oligonucleotide
  Target: SCN10A; (+) strand; PAM type: NNAGAAW; PAM sequence: CAAGAAT
aatatgtaatgtgtaatata

SEQ ID NO: 6458 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
aaactgtgctccaaagggtt

SEQ ID NO: 6459 - DNA, 20 bp, Artificial Sequence
  Description of Artificial Sequence: Synthetic oligonucleotide
  Target: SCN10A; (+) strand; PAM type: NNAGAAW; PAM sequence: TAAGAAA
taggcttacaggataccaga

SEQ ID NO: 6460 - DNA, 20 bp, Artificial Sequence
  Description of Artificial Sequence: Synthetic oligonucleotide
  Target: SCN10A; (+) strand; PAM type: NNAGAAW; PAM sequence: TAAGAAA
tcaaactgtgttccaaagag

SEQ ID NO: 6461 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
ttttaggatagcagataggt

SEQ ID NO: 6462 - DNA, 20 bp, Artificial Sequence
  Description of Artificial Sequence: Synthetic oligonucleotide
  Target: SCN10A; (+) strand; PAM type: NNAGAAW; PAM sequence: GCAGAAT
gatggccgactggagtttgt

SEQ ID NO: 6463 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
tataacaaaggtataaagag

SEQ ID NO: 6464 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
ttgtacttatcttgagtaat

SEQ ID NO: 6465 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
ctatgttggtcaagacagta

SEQ ID NO: 6466 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
ggaaagatttagctggttta

SEQ ID NO: 6467 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
ttagctggtttataagaata

SEQ ID NO: 6468 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
tagccactgtttcttgtgca

SEQ ID NO: 6469 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
aggcatggggaaaggaaagc

SEQ ID NO: 6470 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
gaacaattgagaactttgtc

SEQ ID NO: 6471 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
gcattaggctatgatacgag

SEQ ID NO: 6472 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
aatgtaaagttgatttaaca

SEQ ID NO: 6473 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
caccactttaacagattgaa

SEQ ID NO: 6474 - DNA, 20 bp, Artificial Sequence
  Description of Artificial Sequence: Synthetic oligonucleotide
  Target: SCN10A; (+) strand; PAM type: NNAGAAW; PAM sequence: GTAGAAT
acatgattatctcaatacat

SEQ ID NO: 6475 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
tgaaaggattctttttggga

SEQ ID NO: 6476 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
agaacctaatggcataagga

SEQ ID NO: 6477 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
atggcataaggattagaaaa

SEQ ID NO: 6478 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
cccgtctctactaaaaatac

SEQ ID NO: 6479 - DNA, 20 bp, Artificial Sequence
  Description of Artificial Sequence: Synthetic oligonucleotide
  Target: SCN10A; (+) strand; PAM type: NNAGAAW; PAM sequence: GGAGAAT
ctactcaggaggctgaggca

SEQ ID NO: 6480 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
ctcaaaaaaaaaaaaaaaaa

SEQ ID NO: 6481 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
aaaaaaaaaaaaaaaaaaag

SEQ ID NO: 6482 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
aaaaaaaaaaagaaagaaaa

SEQ ID NO: 6483 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
tttcacatgatgtgattatg

SEQ ID NO: 6484 - DNA, 20 bp, Artificial Sequence
  Description of Artificial Sequence: Synthetic oligonucleotide
  Target: SCN10A; (+) strand; PAM type: NNAGAAW; PAM sequence: TTAGAAT
aacattgtatagataaatta

SEQ ID NO: 6485 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
caaaatgctagccaaaaatg

SEQ ID NO: 6486 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
gaagatatgcaagatcctat

SEQ ID NO: 6487 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
ccttgggataaaacggtaga

SEQ ID NO: 6488 - DNA, 20 bp, Artificial Sequence
  Description of Artificial Sequence: Synthetic oligonucleotide
  Target: SCN10A; (+) strand; PAM type: NNAGAAW; PAM sequence: TGAGAAT
agtgcattgaacacagagtt

SEQ ID NO: 6489 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
ctcaggtgcagacaaggtgg

SEQ ID NO: 6490 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
gagggaagtggaatagatcc

SEQ ID NO: 6491 - DNA, 20 bp, Artificial Sequence
  Description of Artificial Sequence: Synthetic oligonucleotide
  Target: SCN10A; (+) strand; PAM type: NNAGAAW; PAM sequence: GCAGAAT
ggacagggtagcattcccct

SEQ ID NO: 6492 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
cttctgcttccccaagtgta

SEQ ID NO: 6493 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
gcgcccagcctcgtatttta

SEQ ID NO: 6494 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
acatcaatttctagatacct

SEQ ID NO: 6495 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
atttcgggcacaagggaatc

SEQ ID NO: 6496 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
gcagataagggagccaaggc

SEQ ID NO: 6497 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
ggagtttccccaagccatca

SEQ ID NO: 6498 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
ggcaatgataaaaatggcag

SEQ ID NO: 6499 - DNA, 20 bp, Artificial Sequence
  Description of Artificial Sequence: Synthetic oligonucleotide
  Target: SCN10A; (+) strand; PAM type: NNAGAAW; PAM sequence: ATAGAAA
gaaaatgtcttatttacaaa

SEQ ID NO: 6500 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
ccagggtaacagtcaacgtg

SEQ ID NO: 6501 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
ctctaattgtcttaaatagg

SEQ ID NO: 6502 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
atctgagcccctcaccagcc

SEQ ID NO: 6503 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
caatgcatccttcttatgga

SEQ ID NO: 6504 - DNA, 20 bp, Artificial Sequence
  Description of Artificial Sequence: Synthetic oligonucleotide
  Target: SCN10A; (+) strand; PAM type: NNAGAAW; PAM sequence: GTAGAAT
ttgcttccacttttctaact

SEQ ID NO: 6505 - DNA, 20 bp, Artificial Sequence
  Description of Artificial Sequence: Synthetic oligonucleotide
  Target: SCN10A; (+) strand; PAM type: NNAGAAW; PAM sequence: TAAGAAA
aggtggcttaattcaggggt

SEQ ID NO: 6506 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
tgatgtctaaactagatgcc

SEQ ID NO: 6507 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
aaggtagaggcaactgagat

SEQ ID NO: 6508 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
gggatccgtcacaagcccaa

SEQ ID NO: 6509 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
gagccccagccttgccctgc

SEQ ID NO: 6510 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
tgagctcccttttatttcac

SEQ ID NO: 6511 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
tcttacccttataacatttg

SEQ ID NO: 6512 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
agatatcagcctatgtgggc

SEQ ID NO: 6513 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
aaagcataatacattgtgaa

SEQ ID NO: 6514 - DNA, 20 bp, Artificial Sequence
  Description of Artificial Sequence: Synthetic oligonucleotide
  Target: SCN10A; (+) strand; PAM type: NNAGAAW; PAM sequence: GTAGAAA
gcagatttatttgtggtgat

SEQ ID NO: 6515 - DNA, 20 bp, Artificial Sequence
  Description of Artificial Sequence: Synthetic oligonucleotide
  Target: SCN10A; (+) strand; PAM type: NNAGAAW; PAM sequence: GAAGAAT
atatgcatagaacattgctt

SEQ ID NO: 6516 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
tgcacttgaaaaatcagttt

SEQ ID NO: 6517 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
ttttaatcactgactggatt

SEQ ID NO: 6518 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
ttggcctttctattctttct

SEQ ID NO: 6519 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
gaagatgatgtgccctatgc

SEQ ID NO: 6520 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
acaggctaaaaatctgaggc

SEQ ID NO: 6521 - DNA, 20 bp, Artificial Sequence
  Description of Artificial Sequence: Synthetic oligonucleotide
  Target: SCN10A; (+) strand; PAM type: NNAGAAW; PAM sequence: GCAGAAT
cttgttgctatctcattctt

SEQ ID NO: 6522 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
caaatttctgttcttcttgg

SEQ ID NO: 6523 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
tcaacaaatgcttgttgata

SEQ ID NO: 6524 - DNA, 20 bp, Artificial Sequence
  Description of Artificial Sequence: Synthetic oligonucleotide
  Target: SCN10A; (+) strand; PAM type: NNAGAAW; PAM sequence: CGAGAAT
ggaggaagcttaacagtttt

SEQ ID NO: 6525 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
caaaacaaacaaacaaaaac

SEQ ID NO: 6526 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
aaccaagaaacctatctggc

SEQ ID NO: 6527 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
aagaaacctatctggccaag

SEQ ID NO: 6528 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
tgatattaaataattatcaa

SEQ ID NO: 6529 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
gagtctgtacacgttgttgt

SEQ ID NO: 6530 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
aaagcacaaactcaggtatg

SEQ ID NO: 6531 - DNA, 20 bp, Artificial Sequence
  Description of Artificial Sequence: Synthetic oligonucleotide
  Target: SCN10A; (+) strand; PAM type: NNAGAAW; PAM sequence: CTAGAAA
cttgccacctctggctttac

SEQ ID NO: 6532 - DNA, 20 bp, Artificial Sequence
  Description of Artificial Sequence: Synthetic oligonucleotide
  Target: SCN10A; (+) strand; PAM type: NNAGAAW; PAM sequence: GTAGAAT
agtggattcccacttgattg

SEQ ID NO: 6533 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
cagcataatgtgggcttgaa

SEQ ID NO: 6534 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
agatggtggggcctaagaca

SEQ ID NO: 6535 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
tcatctaagtattctgctga

SEQ ID NO: 6536 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
tataaacagttaataaacat

SEQ ID NO: 6537 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
tcatttaaccctccagctat

SEQ ID NO: 6538 - DNA, 20 bp, Artificial Sequence
  Description of Artificial Sequence: Synthetic oligonucleotide
  Target: SCN10A; (+) strand; PAM type: NNAGAAW; PAM sequence: CTAGAAT
tcactagcctggtaatttaa

SEQ ID NO: 6539 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
ttaactagaatgaatcaagg

SEQ ID NO: 6540 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
cacatgataatctcaggaac

SEQ ID NO: 6541 - DNA, 20 bp, Artificial Sequence
  Description of Artificial Sequence: Synthetic oligonucleotide
  Target: SCN10A; (+) strand; PAM type: NNAGAAW; PAM sequence: CTAGAAA
gagagggcaaatgaaaaaca

SEQ ID NO: 6542 - DNA, 20 bp, Artificial Sequence
  Description of Artificial Sequence: Synthetic oligonucleotide
  Target: SCN10A; (+) strand; PAM type: NNAGAAW; PAM sequence: TAAGAAA
gcttctattcagatctgtcc

SEQ ID NO: 6543 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
tttttctcatacctgtccaa

SEQ ID NO: 6544 - DNA, 20 bp, Artificial Sequence
  Description of Artificial Sequence: Synthetic oligonucleotide
  Target: SCN10A; (+) strand; PAM type: NNAGAAW; PAM sequence: TAAGAAA
tggggacagagaagcactga

SEQ ID NO: 6545 - DNA, 20 bp, Artificial Sequence
  Description of Artificial Sequence: Synthetic oligonucleotide
  Target: SCN10A; (+) strand; PAM type: NNAGAAW; PAM sequence: GCAGAAT
atataatttgcatcactact

SEQ ID NO: 6546 - DNA, 20 bp, Artificial Sequence
  Description of Artificial Sequence: Synthetic oligonucleotide
  Target: SCN10A; (+) strand; PAM type: NNAGAAW; PAM sequence: GTAGAAT
tctatgtctgtaaaaaagga

SEQ ID NO: 6547 - DNA, 20 bp, Artificial Sequence
  Description of Artificial Sequence: Synthetic oligonucleotide
  Target: SCN10A; (+) strand; PAM type: NNAGAAW; PAM sequence: CTAGAAA
gcgttttccagaggcgaggc

SEQ ID NO: 6548 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
taggtatgcatggtggggaa

SEQ ID NO: 6549 - DNA, 20 bp, Artificial Sequence
  Description of Artificial Sequence: Synthetic oligonucleotide
  Target: SCN10A; (+) strand; PAM type: NNAGAAW; PAM sequence: GAAGAAT
ggttgcagcctaatttcctg

SEQ ID NO: 6550 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
ctgtgtggcttaaagttgcc

SEQ ID NO: 6551 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
ttcataaacccagagccctc

SEQ ID NO: 6552 - DNA, 20 bp, Artificial Sequence
  Description of Artificial Sequence: Synthetic oligonucleotide
  Target: SCN10A; (+) strand; PAM type: NNAGAAW; PAM sequence: GGAGAAT
tattactaagctactaaagt

SEQ ID NO: 6553 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
cttccaatttttgaagcaaa

SEQ ID NO: 6554 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
tgagcaccaagcaaaccaat

SEQ ID NO: 6555 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
caaaccaatgaagaaactga

SEQ ID NO: 6556 - DNA, 20 bp, Artificial Sequence
  Description of Artificial Sequence: Synthetic oligonucleotide
  Target: SCN10A; (+) strand; PAM type: NNAGAAW; PAM sequence: TTAGAAT
ctccttggccacgagttatt

SEQ ID NO: 6557 - DNA, 20 bp, Artificial Sequence
  Description of Artificial Sequence: Synthetic oligonucleotide
  Target: SCN10A; (+) strand; PAM type: NNAGAAW; PAM sequence: TTAGAAT
atgtcttctgagtataagca

SEQ ID NO: 6558 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
tgctaatctgtgtggggctg

SEQ ID NO: 6559 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
gctgctcaaaaggggcaaag

SEQ ID NO: 6560 - DNA, 20 bp, Artificial Sequence
  Description of Artificial Sequence: Synthetic oligonucleotide
  Target: SCN10A; (+) strand; PAM type: NNAGAAW; PAM sequence: ATAGAAA
agatattatctgtcagacct

SEQ ID NO: 6561 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
tgcaaattttagagtgggag

SEQ ID NO: 6562 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
agaaagttattatgggggga

SEQ ID NO: 6563 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
gcaggaccttaggaaggagg

SEQ ID NO: 6564 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
ataaaaaccacctcgacgca

SEQ ID NO: 6565 - DNA, 20 bp, Artificial Sequence
  Description of Artificial Sequence: Synthetic oligonucleotide
  Target: SCN10A; (+) strand; PAM type: NNAGAAW; PAM sequence: CAAGAAT
ccctcaataggtcacttgca

SEQ ID NO: 6566 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
tcctcacttagcttcttctt

SEQ ID NO: 6567 - DNA, 20 bp, Artificial Sequence
  Description of Artificial Sequence: Synthetic oligonucleotide
  Target: SCN10A; (+) strand; PAM type: NNAGAAW; PAM sequence: CAAGAAT
ggctagtccagaacagtatc

SEQ ID NO: 6568 - DNA, 20 bp, Artificial Sequence
  Description of Artificial Sequence: Synthetic oligonucleotide
  Target: SCN10A; (+) strand; PAM type: NNAGAAW; PAM sequence: GTAGAAA
gccaagatcaagttgaccag

SEQ ID NO: 6569 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
ctgcaggttcaagggaaaga

SEQ ID NO: 6570 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
gggacgctaatactttcacg

SEQ ID NO: 6571 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
acagataaggaatctggggg

SEQ ID NO: 6572 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
tgtcaatatatttattaaaa

SEQ ID NO: 6573 - DNA, 20 bp, Artificial Sequence
  Description of Artificial Sequence: Synthetic oligonucleotide
  Target: SCN10A; (+) strand; PAM type: NNAGAAW; PAM sequence: CCAGAAT
agcaatgcctcgtttgaagt

SEQ ID NO: 6574 - DNA, 20 bp, Artificial Sequence
  Description of Artificial Sequence: Synthetic oligonucleotide
  Target: SCN10A; (+) strand; PAM type: NNAGAAW; PAM sequence: GTAGAAA
gccttgtttctatgtcttct

SEQ ID NO: 6575 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
ctgctctggagccattgcct

SEQ ID NO: 6576 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
agcatctttatgtctatgaa

SEQ ID NO: 6577 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
ttataggctggatttggccc

SEQ ID NO: 6578 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
tgttatgaatctggcctctg

SEQ ID NO: 6579 - DNA, 20 bp, Artificial Sequence
  Description of Artificial Sequence: Synthetic oligonucleotide
  Target: SCN10A; (+) strand; PAM type: NNAGAAW; PAM sequence: ATAGAAT
cttgtgagggtaatgtggct

SEQ ID NO: 6580 - DNA, 20 bp, Artificial Sequence
  Description of Artificial Sequence: Synthetic oligonucleotide
  Target: SCN10A; (+) strand; PAM type: NNAGAAW; PAM sequence: CAAGAAT
ggactgcaacttgctttagt

SEQ ID NO: 6581 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
ttgctttagtcaagaatgta

SEQ ID NO: 6582 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
ccagtccaaaatgctgatgc

SEQ ID NO: 6583 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
tatttatgtagatatctgct

SEQ ID NO: 6584 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
tagatatctgctgaagaaag

SEQ ID NO: 6585 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
atctgctgaagaaaggaaga

SEQ ID NO: 6586 - DNA, 20 bp, Artificial Sequence
  Description of Artificial Sequence: Synthetic oligonucleotide
  Target: SCN10A; (+) strand; PAM type: NNAGAAW; PAM sequence: GTAGAAT
ctcaatctcccccagcagag

SEQ ID NO: 6587 - DNA, 20 bp, Artificial Sequence
  Description of Artificial Sequence: Synthetic oligonucleotide
  Target: SCN10A; (+) strand; PAM type: NNAGAAW; PAM sequence: ATAGAAT
gggatgctgagcaacaggaa

SEQ ID NO: 6588 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
agagagagagagagagagag

SEQ ID NO: 6589 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
agtgaaacaaaaatagacca

SEQ ID NO: 6590 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
aaacaaaaatagaccaagag

SEQ ID NO: 6591 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
aaatagaccaagagaaagaa

SEQ ID NO: 6592 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
aaagaaaaagaaagagacac

SEQ ID NO: 6593 - DNA, 20 bp, Artificial Sequence
  Description of Artificial Sequence: Synthetic oligonucleotide
  Target: SCN10A; (+) strand; PAM type: NNAGAAW; PAM sequence: ATAGAAA
acagagaggtgagtttagca

SEQ ID NO: 6594 - DNA, 20 bp, Artificial Sequence
  Description of Artificial Sequence: Synthetic oligonucleotide
  Target: SCN10A; (+) strand; PAM type: NNAGAAW; PAM sequence: TAAGAAA
ttagcaatagaaagagacta

SEQ ID NO: 6595 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
ggagagcagcttcgcaggta

SEQ ID NO: 6596 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
tctttccctgcagagccaga

SEQ ID NO: 6597 - DNA, 20 bp, Artificial Sequence
  Description of Artificial Sequence: Synthetic oligonucleotide
  Target: SCN10A; (+) strand; PAM type: NNAGAAW; PAM sequence: GTAGAAA
gcagagccagacaagaaatg

SEQ ID NO: 6598 - DNA, 20 bp, Artificial Sequence
  Description of Artificial Sequence: Synthetic oligonucleotide
  Target: SCN10A; (+) strand; PAM type: NNAGAAW; PAM sequence: CTAGAAT
tggtagaaaagacttccact

SEQ ID NO: 6599 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
gggaagcatcaagtcccatt

SEQ ID NO: 6600 - DNA, 20 bp, Artificial Sequence
  Description of Artificial Sequence: Synthetic oligonucleotide
  Target: SCN10A; (+) strand; PAM type: NNAGAAW; PAM sequence: CAAGAAT
gtttctgaattctcagtaat

SEQ ID NO: 6601 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
gcctgaatcccacaaccaga

SEQ ID NO: 6602 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
ataaatgctcacctgggatc

SEQ ID NO: 6603 - DNA, 20 bp, Artificial Sequence
  Description of Artificial Sequence: Synthetic oligonucleotide
  Target: SCN10A; (+) strand; PAM type: NNAGAAW; PAM sequence: CTAGAAA
taacctggggtatcattagc

SEQ ID NO: 6604 - DNA, 20 bp, Artificial Sequence
  Description of Artificial Sequence: Synthetic oligonucleotide
  Target: SCN10A; (+) strand; PAM type: NNAGAAW; PAM sequence: GCAGAAT
atcattagcctagaaaggat

SEQ ID NO: 6605 - DNA, 20 bp, Artificial Sequence
  Description of Artificial Sequence: Synthetic oligonucleotide
  Target: SCN10A; (+) strand; PAM type: NNAGAAW; PAM sequence: TTAGAAT
aaaggatgcagaatggacac

SEQ ID NO: 6606 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
aacaggtggtgttgggttgc

SEQ ID NO: 6607 - DNA, 20 bp, Artificial Sequence
  Description of Artificial Sequence: Synthetic oligonucleotide
  Target: SCN10A; (+) strand; PAM type: NNAGAAW; PAM sequence: TTAGAAT
ctattcctgagttacttcat

SEQ ID NO: 6608 - DNA, 20 bp, Artificial Sequence
  Description of Artificial Sequence: Synthetic oligonucleotide
  Target: SCN10A; (+) strand; PAM type: NNAGAAW; PAM sequence: TGAGAAT
gccatttatatatcttcttt

SEQ ID NO: 6609 - DNA, 20 bp, Artificial Sequence
  Description of Artificial Sequence: Synthetic oligonucleotide
  Target: SCN10A; (+) strand; PAM type: NNAGAAW; PAM sequence: CTAGAAT
agtttttccaatgttatctt

SEQ ID NO: 6610 - DNA, 20 bp, Artificial Sequence
  Description of Artificial Sequence: Synthetic oligonucleotide
  Target: SCN10A; (+) strand; PAM type: NNAGAAW; PAM sequence: GAAGAAT
gttgttatttctatttctgt

SEQ ID NO: 6611 - DNA, 20 bp, Artificial Sequence
  Description of Artificial Sequence: Synthetic oligonucleotide
  Target: SCN10A; (+) strand; PAM type: NNAGAAW; PAM sequence: GTAGAAA
agtgttttgtagttttcctt

SEQ ID NO: 6612 - DNA, 20 bp, Artificial Sequence
  Description of Artificial Sequence: Synthetic oligonucleotide
  Target: SCN10A; (+) strand; PAM type: NNAGAAW; PAM sequence: ATAGAAA
gacttccagtactatgttgg

SEQ ID NO: 6613 - DNA, 20 bp, Artificial Sequence
  Description of Artificial Sequence: Synthetic oligonucleotide
  Target: SCN10A; (+) strand; PAM type: NNAGAAW; PAM sequence: ATAGAAT
aattcttctttgaatgtctg

SEQ ID NO: 6614 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
tctatcacgtggtctatctt

SEQ ID NO: 6615 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
aatattccatgtgctgatga

SEQ ID NO: 6616 - DNA, 20 bp, Artificial Sequence
  Description of Artificial Sequence: Synthetic oligonucleotide
  Target: SCN10A; (+) strand; PAM type: NNAGAAW; PAM sequence: GTAGAAT
gtatattctgcagttgtttg

SEQ ID NO: 6617 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
aaggtctgttttctctgata

SEQ ID NO: 6618 - DNA, 20 bp, Artificial Sequence
  Description of Artificial Sequence: Synthetic oligonucleotide
  Target: SCN10A; (+) strand; PAM type: NNAGAAW; PAM sequence: TTAGAAT
ttaaggttttatttcaagat

SEQ ID NO: 6619 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
ctggcttgcaaggtttcagt

SEQ ID NO: 6620 - DNA, 20 bp, Artificial Sequence
  Description of Artificial Sequence: Synthetic oligonucleotide
  Target: SCN10A; (+) strand; PAM type: NNAGAAW; PAM sequence: GGAGAAT
ttctttatatctatttctct

SEQ ID NO: 6621 - DNA, 20 bp, Artificial Sequence
  Description of Artificial Sequence: Synthetic oligonucleotide
  Target: SCN10A; (+) strand; PAM type: NNAGAAW; PAM sequence: CCAGAAT
aaccctcttttgtcatatta

SEQ ID NO: 6622 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
tcatttgagtagactatttc

SEQ ID NO: 6623 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
caggctgtgagcttccccac

SEQ ID NO: 6624 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
ctgtgagcttccccactgag

SEQ ID NO: 6625 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
tttgccccctggattctgct

SEQ ID NO: 6626 - DNA, 20 bp, Artificial Sequence
  Description of Artificial Sequence: Synthetic oligonucleotide
  Target: SCN10A; (+) strand; PAM type: NNAGAAW; PAM sequence: GCAGAAT
cacagtttttcacctgtctt

SEQ ID NO: 6627 - DNA, 20 bp, Artificial Sequence
  Description of Artificial Sequence: Synthetic oligonucleotide
  Target: SCN10A; (+) strand; PAM type: NNAGAAW; PAM sequence: GTAGAAA
agacatatctgggaaggagg

SEQ ID NO: 6628 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
atgacctgctctgactgctc

SEQ ID NO: 6629 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
tgctccaagaaaaaacatgc

SEQ ID NO: 6630 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
catctaaaaactcccagttt

SEQ ID NO: 6631 - DNA, 20 bp, Artificial Sequence
  Description of Artificial Sequence: Synthetic oligonucleotide
  Target: SCN10A; (+) strand; PAM type: NNAGAAW; PAM sequence: TAAGAAA
ggtaactgacagagcagacc

SEQ ID NO: 6632 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
gagggtgataagtagggctg

SEQ ID NO: 6633 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
gctttatgccatccattcaa

SEQ ID NO: 6634 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
aatgagaaactgtttctgct

SEQ ID NO: 6635 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
gcatactgaaaaatgcatat

SEQ ID NO: 6636 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
tttgaaggatgcttctaaca

SEQ ID NO: 6637 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
acaactgaaaaaaaaaaaaa

SEQ ID NO: 6638 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
tgaaaaaaaaaaaaaaaaga

SEQ ID NO: 6639 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
aaaaaaaaaaaaagaaaaga

SEQ ID NO: 6640 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
aaaaaaaagaaaagaaaaga

SEQ ID NO: 6641 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
aagagggcagaagaagagtt

SEQ ID NO: 6642 - DNA, 20 bp, Artificial Sequence
  Description of Artificial Sequence: Synthetic oligonucleotide
  Target: SCN10A; (+) strand; PAM type: NNAGAAW; PAM sequence: GGAGAAT
ctactccggaggctgaggcg

SEQ ID NO: 6643 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
acaggaagtggaacaaaaaa

SEQ ID NO: 6644 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
tgataaaaagtttgaaaatt

SEQ ID NO: 6645 - DNA, 20 bp, Artificial Sequence
  Description of Artificial Sequence: Synthetic oligonucleotide
  Target: SCN10A; (+) strand; PAM type: NNAGAAW; PAM sequence: CTAGAAA
ttgtttgactaataggaggt

SEQ ID NO: 6646 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
ttgactaataggaggtctag

SEQ ID NO: 6647 - DNA, 20 bp, Artificial Sequence
  Description of Artificial Sequence: Synthetic oligonucleotide
  Target: SCN10A; (+) strand; PAM type: NNAGAAW; PAM sequence: GTAGAAT
tagccaaactgtcaaagaag

SEQ ID NO: 6648 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
gaggatatgctccattcaaa

SEQ ID NO: 6649 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
gaggcaaaaggaatccaaaa

SEQ ID NO: 6650 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
gaatccaaaaaaagaatgaa

SEQ ID NO: 6651 - DNA, 20 bp, Artificial Sequence
  Description of Artificial Sequence: Synthetic oligonucleotide
  Target: SCN10A; (+) strand; PAM type: NNAGAAW; PAM sequence: CTAGAAA
gaatgaagaagaaaaaatct

SEQ ID NO: 6652 - DNA, 20 bp, Artificial Sequence
  Description of Artificial Sequence: Synthetic oligonucleotide
  Target: SCN10A; (+) strand; PAM type: NNAGAAW; PAM sequence: CTAGAAA
aaaacagctgtgcatcaggc

SEQ ID NO: 6653 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
aggcctagaaaacatctagg

SEQ ID NO: 6654 - DNA, 20 bp, Artificial Sequence
  Description of Artificial Sequence: Synthetic oligonucleotide
  Target: SCN10A; (+) strand; PAM type: NNAGAAW; PAM sequence: ATAGAAA
tgggaacaaattagggataa

SEQ ID NO: 6655 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
taggaagccaataaataaca

SEQ ID NO: 6656 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
tggcctctggaaagaagaga

SEQ ID NO: 6657 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
tgaaattgctgttttttttg

SEQ ID NO: 6658 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
tttttttcacatctgtgaga

SEQ ID NO: 6659 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
cactctttatgttttctaaa

SEQ ID NO: 6660 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
ctaaattagaaaatcttaac

SEQ ID NO: 6661 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
ttgtcaaatcaaacacagac

SEQ ID NO: 6662 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
aagtgctttttctggtgaat

SEQ ID NO: 6663 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
ctgtgtacctcaacagcaaa

SEQ ID NO: 6664 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
aaacttttttataatcccga

SEQ ID NO: 6665 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
tgtcaatgttgtggcatgta

SEQ ID NO: 6666 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
tttatcattattgttatgct

SEQ ID NO: 6667 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
gtttttgaaaacataaaaag

SEQ ID NO: 6668 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
gagatccttagatcacttgt

SEQ ID NO: 6669 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
aattgctctgctaaacaaag

SEQ ID NO: 6670 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
atgatgaaagtctcaacaaa

SEQ ID NO: 6671 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
ggaaaaataaaaaagtggta

SEQ ID NO: 6672 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
gtggtataagaatcataaag

SEQ ID NO: 6673 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
taggaagtccaagggaatct

SEQ ID NO: 6674 - DNA, 20 bp, Artificial Sequence
  Description of Artificial Sequence: Synthetic oligonucleotide
  Target: SCN10A; (+) strand; PAM type: NNAGAAW; PAM sequence: ATAGAAA
gctggatgcaaaatcactat

SEQ ID NO: 6675 - DNA, 20 bp, Artificial Sequence
  Description of Artificial Sequence: Synthetic oligonucleotide
  Target: SCN10A; (+) strand; PAM type: NNAGAAW; PAM sequence: GTAGAAA
ggaaaaagacattataaaat

SEQ ID NO: 6676 - DNA, 20 bp, Artificial Sequence
  Description of Artificial Sequence: Synthetic oligonucleotide
  Target: SCN10A; (+) strand; PAM type: NNAGAAW; PAM sequence: TAAGAAA
acaaagtttccacagagttg

SEQ ID NO: 6677 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
ttaaactgatatggaaaagt

SEQ ID NO: 6678 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
atgtgacaatgagattactg

SEQ ID NO: 6679 - DNA, 20 bp, Artificial Sequence
  Description of Artificial Sequence: Synthetic oligonucleotide
  Target: SCN10A; (+) strand; PAM type: NNAGAAW; PAM sequence: GTAGAAA
ggagattgaaatacctaaat

SEQ ID NO: 6680 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
aaggaaaactgtaactttga

SEQ ID NO: 6681 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
ttcacatgttctttgccagg

SEQ ID NO: 6682 - DNA, 20 bp, Artificial Sequence
  Description of Artificial Sequence: Synthetic oligonucleotide
  Target: SCN10A; (+) strand; PAM type: NNAGAAW; PAM sequence: CCAGAAT
tataatttgtcaaaggtttt

SEQ ID NO: 6683 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
ttcccaagcaaaagagggga

SEQ ID NO: 6684 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
gcagacagataggcaggcac

SEQ ID NO: 6685 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
attatcaatttgcatttcaa

SEQ ID NO: 6686 - DNA, 20 bp, Artificial Sequence
  Description of Artificial Sequence: Synthetic oligonucleotide
  Target: SCN10A; (+) strand; PAM type: NNAGAAW; PAM sequence: AAAGAAT
cagttaatacaaaatctcct

SEQ ID NO: 6687 - DNA, 20 bp, Artificial Sequence
  Description of Artificial Sequence: Synthetic oligonucleotide
  Target: SCN10A; (+) strand; PAM type: NNAGAAW; PAM sequence: CTAGAAA
ttgacctggcaattctactt

SEQ ID NO: 6688 - DNA, 20 bp, Artificial Sequence
  Description of Artificial Sequence: Synthetic oligonucleotide
  Target: SCN10A; (+) strand; PAM type: NNAGAAW; PAM sequence: CAAGAAT
tttatagtttgtcttttgtc

SEQ ID NO: 6689 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
aactctatttcattatgatc

SEQ ID NO: 6690 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
cccagcaaagccattacatc

SEQ ID NO: 6691 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
tcagcaaatcgatgagatgc

SEQ ID NO: 6692 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
cctgcagctggcattggtca

SEQ ID NO: 6693 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
acttccataaccagcgggat

SEQ ID NO: 6694 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
tagactgggtggcttatgca

SEQ ID NO: 6695 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
cttgtgttctcacacaaagg

SEQ ID NO: 6696 - DNA, 20 bp, Artificial Sequence
  Description of Artificial Sequence: Synthetic oligonucleotide
  Target: SCN10A; (+) strand; PAM type: NNAGAAW; PAM sequence: TTAGAAT
ttgctgtaagttttctcatt

SEQ ID NO: 6697 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
ttttctcattttagaatata

SEQ ID NO: 6698 - DNA, 20 bp, Artificial Sequence
  Description of Artificial Sequence: Synthetic oligonucleotide
  Target: SCN10A; (+) strand; PAM type: NNAGAAW; PAM sequence: GAAGAAT
aggtacctaagggtgtaata

SEQ ID NO: 6699 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
tctttgatttaaaaaaaggt

SEQ ID NO: 6700 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
acgtgattatctcaatagat

SEQ ID NO: 6701 - DNA, 20 bp, Artificial Sequence
  Description of Artificial Sequence: Synthetic oligonucleotide
  Target: SCN10A; (+) strand; PAM type: NNAGAAW; PAM sequence: CAAGAAT
ctttgaaaaccagcacaaga

SEQ ID NO: 6702 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
ctggccagggcgatcaggca

SEQ ID NO: 6703 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
ccagggcgatcaggcaagag

SEQ ID NO: 6704 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
cagatgacatgactgtatat

SEQ ID NO: 6705 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
cccattcacaattgcaacaa

SEQ ID NO: 6706 - DNA, 20 bp, Artificial Sequence
  Description of Artificial Sequence: Synthetic oligonucleotide
  Target: SCN10A; (+) strand; PAM type: NNAGAAW; PAM sequence: CTAGAAA
caacaaagagaataaaatat

SEQ ID NO: 6707 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
agctaccactgactttcttc

SEQ ID NO: 6708 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
cactgactttcttcacagaa

SEQ ID NO: 6709 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
aagacaattctaagcaaaaa

SEQ ID NO: 6710 - DNA, 20 bp, Artificial Sequence
  Description of Artificial Sequence: Synthetic oligonucleotide
  Target: SCN10A; (+) strand; PAM type: NNAGAAW; PAM sequence: GCAGAAA
ggaaaactggctagccttag

SEQ ID NO: 6711 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
ctaaaaccataaaaacccta

SEQ ID NO: 6712 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
taaagagcttctgcacagca

SEQ ID NO: 6713 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
tcagagtgaataggtaacct

SEQ ID NO: 6714 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
aataggtaacctacagaatg

SEQ ID NO: 6715 - DNA, 20 bp, Artificial Sequence
  Description of Artificial Sequence: Synthetic oligonucleotide
  Target: SCN10A; (+) strand; PAM type: NNAGAAW; PAM sequence: CCAGAAT
atctgacaaagggctaatat

SEQ ID NO: 6716 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
aaaaaacttaaacaaattta

SEQ ID NO: 6717 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
gctcatcatcactggtcatt

SEQ ID NO: 6718 - DNA, 20 bp, Artificial Sequence
  Description of Artificial Sequence: Synthetic oligonucleotide
  Target: SCN10A; (+) strand; PAM type: NNAGAAW; PAM sequence: TTAGAAT
gagatggagtctcataccag

SEQ ID NO: 6719 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
gattcctcaaggatctagaa

SEQ ID NO: 6720 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
ccatcagtgatagactggat

SEQ ID NO: 6721 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
ctcagcaaactgacataaga

SEQ ID NO: 6722 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
ctaggggagggatagcatta

SEQ ID NO: 6723 - DNA, 20 bp, Artificial Sequence
  Description of Artificial Sequence: Synthetic oligonucleotide
  Target: SCN10A; (+) strand; PAM type: NNAGAAW; PAM sequence: CTAGAAT
caagtgaggtgttgatccac

SEQ ID NO: 6724 - DNA, 20 bp, Artificial Sequence
  Description of Artificial Sequence: Synthetic oligonucleotide
  Target: SCN10A; (+) strand; PAM type: NNAGAAW; PAM sequence: GTAGAAT
atagtaaatctcgacatcca

SEQ ID NO: 6725 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
atttcatgtaaacttttgag

SEQ ID NO: 6726 - DNA, 20 bp, Artificial Sequence
  Description of Artificial Sequence: Synthetic oligonucleotide
  Target: SCN10A; (+) strand; PAM type: NNAGAAW; PAM sequence: TGAGAAT
ctgttcttgtgttagtttgc

SEQ ID NO: 6727 - DNA, 20 bp, Artificial Sequence
  Description of Artificial Sequence: Synthetic oligonucleotide
  Target: SCN10A; (+) strand; PAM type: NNAGAAW; PAM sequence: TAAGAAT
cccttctatttcaacttttc

SEQ ID NO: 6728 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
aaaaaaaaaaaaaaaaaaaa

SEQ ID NO: 6729 - DNA, 20 bp, Artificial Sequence
  Description of Artificial Sequence: Synthetic oligonucleotide
  Target: SCN10A; (+) strand; PAM type: NNAGAAW; PAM sequence: ATAGAAT
tcacccactaacctagggaa

SEQ ID NO: 6730 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
acaaagactgccaagtgaag

SEQ ID NO: 6731 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
gactgccaagtgaaggaaga

SEQ ID NO: 6732 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
aaatatctacattttgaagc

SEQ ID NO: 6733 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
tcttttttattctaaaagac

SEQ ID NO: 6734 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
ttctaaaagacaaagaaaag

SEQ ID NO: 6735 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
gaaatgaaatactggctcag

SEQ ID NO: 6736 - DNA, 20 bp, Artificial Sequence
  Description of Artificial Sequence: Synthetic oligonucleotide
  Target: SCN10A; (+) strand; PAM type: NNAGAAW; PAM sequence: GGAGAAT
gaactctgaatagctagagt

SEQ ID NO: 6737 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
tggaaggggaaaatagaagg

SEQ ID NO: 6738 - DNA, 20 bp, Artificial Sequence
  Description of Artificial Sequence: Synthetic oligonucleotide
  Target: SCN10A; (+) strand; PAM type: NNAGAAW; PAM sequence: GGAGAAT
aagggaagaaatgttggtgg

SEQ ID NO: 6739 - DNA, 20 bp, Artificial Sequence
  Description of Artificial Sequence: Synthetic oligonucleotide
  Target: SCN10A; (+) strand; PAM type: NNAGAAW; PAM sequence: TAAGAAA
ctgctgacttacaattaaat

SEQ ID NO: 6740 - DNA, 20 bp, Artificial Sequence
  Description of Artificial Sequence: Synthetic oligonucleotide
  Target: SCN10A; (+) strand; PAM type: NNAGAAW; PAM sequence: TTAGAAT
aacattcatagcaaatgtga

SEQ ID NO: 6741 - DNA, 20 bp, Artificial Sequence
  Description of Artificial Sequence: Synthetic oligonucleotide
  Target: SCN10A; (+) strand; PAM type: NNAGAAW; PAM sequence: TGAGAAT
aaatattaataatagggccc

SEQ ID NO: 6742 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
ctcatcaaatctcaagatga

SEQ ID NO: 6743 - DNA, 20 bp, Artificial Sequence
  Description of Artificial Sequence: Synthetic oligonucleotide
  Target: SCN10A; (+) strand; PAM type: NNAGAAW; PAM sequence: CCAGAAT
cttatccagatgtaattcaa

SEQ ID NO: 6744 - DNA, 20 bp, Artificial Sequence
  Description of Artificial Sequence: Synthetic oligonucleotide
  Target: SCN10A; (+) strand; PAM type: NNAGAAW; PAM sequence: AGAGAAT
caagcagagacgacacattg

SEQ ID NO: 6745 - DNA, 20 bp, Artificial Sequence
  Description of Artificial Sequence: Synthetic oligonucleotide
  Target: SCN10A; (+) strand; PAM type: NNAGAAW; PAM sequence: GTAGAAT
ttgtcattaaatatccttct

SEQ ID NO: 6746 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
ctgaaaattcaagattcagc

SEQ ID NO: 6747 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
acgtaattcttgctggccag

SEQ ID NO: 6748 - DNA, 20 bp, Artificial Sequence
  Description of Artificial Sequence: Synthetic oligonucleotide
  Target: SCN10A; (+) strand; PAM type: NNAGAAW; PAM sequence: AAAGAAA
aattcttgctggccagccag

SEQ ID NO: 6749 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
agaaagaaaaaaatgtaaaa

SEQ ID NO: 6750 - DNA, 20 bp, Artificial Sequence
  Description of Artificial Sequence: Synthetic oligonucleotide
  Target: SCN10A; (+) strand; PAM type: NNAGAAW; PAM sequence: CCAGAAA
accagctcaatgacaactgt

SEQ ID NO: 6751 - DNA, 20 bp, Artificial Sequence
  Description of Artificial Sequence: Synthetic oligonucleotide
  Target: SCN10A; (+) strand; PAM type: NNAGAAW; PAM sequence: TAAGAAA
tcttttttactgaagccttc

SEQ ID NO: 6752 - DNA, 20 bp, Artificial Sequence
  Description of Artificial Sequence: Synthetic oligonucleotide
  Target: SCN10A; (+) strand; PAM type: NNAGAAW; PAM sequence: TGAGAAT
aagcggaccacacaccgtgg

SEQ ID NO: 6753 - DNA, 20 bp, Artificial Sequence
  Description of Artificial Sequence: Synthetic oligonucleotide
  Target: SCN10A; (+) strand; PAM type: NNAGAAW; PAM sequence: ACAGAAA
aatgtctgaaacaaaacaaa

SEQ ID NO: 6754 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
aacagaaagtggacctccaa

SEQ ID NO: 6755 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
ctcttggcatgggagaggag

SEQ ID NO: 6756 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
ccagatatatgtatatcata

SEQ ID NO: 6757 - DNA, 20 bp, Artificial Sequence
  Description of Artificial Sequence: Synthetic oligonucleotide
  Target: SCN10A; (+) strand; PAM type: NNAGAAW; PAM sequence: TTAGAAA
gtgtgtatatatatctcata

SEQ ID NO: 6758 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
ttcaccaatgtatgatcata

SEQ ID NO: 6759 - DNA, 20 bp, Artificial Sequence
  Description of Artificial Sequence: Synthetic oligonucleotide
  Target: SCN10A; (+) strand; PAM type: NNAGAAW; PAM sequence: GGAGAAT
ctggagaactccagattatt

SEQ ID NO: 6760 - DNA, 20 bp, Artificial Sequence
  Description of Artificial Sequence: Synthetic oligonucleotide
  Target: SCN10A; (+) strand; PAM type: NNAGAAW; PAM sequence: GGAGAAA
gaccatatttcctagttcat

SEQ ID NO: 6761 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
tggcactctatcttttgttt

SEQ ID NO: 6762 - DNA, 20 bp, Artificial Sequence
  Description of Artificial Sequence: Synthetic oligonucleotide
  Target: SCN10A; (+) strand; PAM type: NNAGAAW; PAM sequence: ACAGAAT
gtgcctggaactaactagat

SEQ ID NO: 6763 - DNA, 20 bp, Artificial Sequence
  Description of Artificial Sequence: Synthetic oligonucleotide
  Target: SCN10A; (+) strand; PAM type: NNAGAAW; PAM sequence: TCAGAAA
aaaactaaagaacattttgt

SEQ ID NO: 6764 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
tgtctttaattcttcccttc

SEQ ID NO: 6765 - DNA, 20 bp, Artificial Sequence
  Description of Artificial Sequence: Synthetic oligonucleotide
  Target: SCN10A; (+) strand; PAM type: NNAGAAW; PAM sequence: CAAGAAT
tcagttgtttagtaacaatg

SEQ ID NO: 6766 - DNA, 20 bp, Artificial Sequence
  Description of Artificial Sequence: Synthetic oligonucleotide
  Target: SCN10A; (+) strand; PAM type: NNAGAAW; PAM sequence: CCAGAAT
ggattgagaacaggactaag

SEQ ID NO: 6767 - DNA, 20 bp, Artificial Sequence
  Description of Artificial Sequence: Synthetic oligonucleotide
  Target: SCN10A; (+) strand; PAM type: NNAGAAW; PAM sequence: TGAGAAA
agtgtctttacatgacattc

SEQ ID NO: 6768 - DNA, 20 bp, Artificial Sequence
  Description of Artificial Sequence: Synthetic oligonucleotide
  Target: SCN10A; (+) strand; PAM type: NNAGAAW; PAM sequence: GAAGAAA
gaggaaaagtaacataagaa

SEQ ID NO: 6769 - DNA, 20 bp, Artificial Sequence
  Description of Artificial Sequence: Synthetic oligonucleotide
  Target: SCN10A; (+) strand; PAM type: NNAGAAW; PAM sequence: TCAGAAT
ctcttatgggcaaactgggc

SEQ ID NO: 6770 - DNA, 20 bp, Artificial Sequence
  Description of Artificial Sequence: Synthetic oligonucleotide
  Target: SCN10A; (+) strand; PAM type: NNAGAAW; PAM sequence: AGAGAAA
cagaacttacttcagtggcc

SEQ ID NO: 6771 - DNA, 20 bp, Artificial Sequence
  Description of Artificial Sequence: Synthetic oligonucleotide
  Target: SCN10A; (+) strand; PAM type: NNAGAAW; PAM sequence: CAAGAAA
tggctgaggaggagacaatc

SEQ ID NO: 6772 - DNA, 20 bp, Artificial Sequence
  Description of Artificial Sequence: Synthetic oligonucleotide
  Target: SCN10A; (-) strand; PAM type: NNGRRT; PAM sequence: TAGAAT
atagtccgtatgcctggcca

SEQ ID NO: 6773 - DNA, 20 bp, Artificial Sequence
  Description of Artificial Sequence: Synthetic oligonucleotide
  Target: SCN10A; (-) strand; PAM type: NNGRRT; PAM sequence: AAGGGT
acaaaacctaaggttaccaa

SEQ ID NO: 6774 - DNA, 20 bp, Artificial Sequence
  Description of Artificial Sequence: Synthetic oligonucleotide
  Target: SCN10A; (-) strand; PAM type: NNGRRT; PAM sequence: AAGAGT
tttaaatggactctgggaaa

SEQ ID NO: 6775 - DNA, 20 bp, Artificial Sequence
  Description of Artificial Sequence: Synthetic oligonucleotide
  Target: SCN10A; (-) strand; PAM type: NNGRRT; PAM sequence: CAGAGT
aaagaaacaaatagaaaaga

SEQ ID NO: 6776 - DNA, 20 bp, Artificial Sequence
  Description of Artificial Sequence: Synthetic oligonucleotide
  Target: SCN10A; (-) strand; PAM type: NNGRRT; PAM sequence: CAGAAT
acccgggatatagagacata

SEQ ID NO: 6777 - DNA, 20 bp, Artificial Sequence
  Description of Artificial Sequence: Synthetic oligonucleotide
  Target: SCN10A; (-) strand; PAM type: NNGRRT; PAM sequence: CGGGAT
taataataattaaaaaaacc

SEQ ID NO: 6778 - DNA, 20 bp, Artificial Sequence
  Description of Artificial Sequence: Synthetic oligonucleotide
  Target: SCN10A; (-) strand; PAM type: NNGRRT; PAM sequence: ATGGGT
ctaatgtaaatgacaagtta

SEQ ID NO: 6779 - DNA, 20 bp, Artificial Sequence
  Description of Artificial Sequence: Synthetic oligonucleotide
  Target: SCN10A; (-) strand; PAM type: NNGRRT; PAM sequence: AGGGAT
gtggggtggagggagggggg

SEQ ID NO: 6780 - DNA, 20 bp, Artificial Sequence
  Description of Artificial Sequence: Synthetic oligonucleotide
  Target: SCN10A; (-) strand; PAM type: NNGRRT; PAM sequence: TGGGGT
tcacacaccggggacagttg

SEQ ID NO: 6781 - DNA, 20 bp, Artificial Sequence
  Description of Artificial Sequence: Synthetic oligonucleotide
  Target: SCN10A; (-) strand; PAM type: NNGRRT; PAM sequence: GGGAAT
gcatgttctcactcataggt

SEQ ID NO: 6782 - DNA, 20 bp, Artificial Sequence
  Description of Artificial Sequence: Synthetic oligonucleotide
  Target: SCN10A; (-) strand; PAM type: NNGRRT; PAM sequence: ATGGAT
ttcatgtcctttgcagggac

SEQ ID NO: 6783 - DNA, 20 bp, Artificial Sequence
  Description of Artificial Sequence: Synthetic oligonucleotide
  Target: SCN10A; (-) strand; PAM type: NNGRRT; PAM sequence: ATGAGT
ctatgcagccataaaaaatg

SEQ ID NO: 6784 - DNA, 20 bp, Artificial Sequence
  Description of Artificial Sequence: Synthetic oligonucleotide
  Target: SCN10A; (-) strand; PAM type: NNGRRT; PAM sequence: TGGAAT
aatgtggcacatatacacca

SEQ ID NO: 6785 - DNA, 20 bp, Artificial Sequence
  Description of Artificial Sequence: Synthetic oligonucleotide
  Target: SCN10A; (-) strand; PAM type: NNGRRT; PAM sequence: CTGGAT
aaatgtccaacagtgataga

SEQ ID NO: 6786 - DNA, 20 bp, Artificial Sequence
  Description of Artificial Sequence: Synthetic oligonucleotide
  Target: SCN10A; (-) strand; PAM type: NNGRRT; PAM sequence: AAGGAT
cattactgggtatataccca

SEQ ID NO: 6787 - DNA, 20 bp, Artificial Sequence
  Description of Artificial Sequence: Synthetic oligonucleotide
  Target: SCN10A; (-) strand; PAM type: NNGRRT; PAM sequence: CTGGGT
ttgacccagccatcccatta

SEQ ID NO: 6788 - DNA, 20 bp, Artificial Sequence
  Description of Artificial Sequence: Synthetic oligonucleotide
  Target: SCN10A; (-) strand; PAM type: NNGRRT; PAM sequence: AGGGAT
agtcggtgtggcaattcctc

SEQ ID NO: 6789 - DNA, 20 bp, Artificial Sequence
  Description of Artificial Sequence: Synthetic oligonucleotide
  Target: SCN10A; (-) strand; PAM type: NNGRRT; PAM sequence: GTGGGT
ggaacacttttacactgttg

SEQ ID NO: 6790 - DNA, 20 bp, Artificial Sequence
  Description of Artificial Sequence: Synthetic oligonucleotide
  Target: SCN10A; (-) strand; PAM type: NNGRRT; PAM sequence: GAGGAT
aggaaacaacaggtgctgga

SEQ ID NO: 6791 - DNA, 20 bp, Artificial Sequence
  Description of Artificial Sequence: Synthetic oligonucleotide
  Target: SCN10A; (-) strand; PAM type: NNGRRT; PAM sequence: TAGAAT
agataccatctcacaccagt

SEQ ID NO: 6792 - DNA, 20 bp, Artificial Sequence
  Description of Artificial Sequence: Synthetic oligonucleotide
  Target: SCN10A; (-) strand; PAM type: NNGRRT; PAM sequence: AAGGAT
atcccatcaaaaagtgggcg

SEQ ID NO: 6793 - DNA, 20 bp, Artificial Sequence
  Description of Artificial Sequence: Synthetic oligonucleotide
  Target: SCN10A; (-) strand; PAM type: NNGRRT; PAM sequence: CAGAAT
tctgacgaagggctaatatc

SEQ ID NO: 6794 - DNA, 20 bp, Artificial Sequence
  Description of Artificial Sequence: Synthetic oligonucleotide
  Target: SCN10A; (-) strand; PAM type: NNGRRT; PAM sequence: CAGGAT
tcagagtgaacagaaaccta

SEQ ID NO: 6795 - DNA, 20 bp, Artificial Sequence
  Description of Artificial Sequence: Synthetic oligonucleotide
  Target: SCN10A; (-) strand; PAM type: NNGRRT; PAM sequence: CAGAGT
gcagcaaaagaaaccaccat

SEQ ID NO: 6796 - DNA, 20 bp, Artificial Sequence
  Description of Artificial Sequence: Synthetic oligonucleotide
  Target: SCN10A; (-) strand; PAM type: NNGRRT; PAM sequence: TGGGAT
caaaagtcaaaattgacaaa

SEQ ID NO: 6797 - DNA, 20 bp, Artificial Sequence
  Description of Artificial Sequence: Synthetic oligonucleotide
  Target: SCN10A; (-) strand; PAM type: NNGRRT; PAM sequence: ATGGAT
tatacaaaaattaattcaag

SEQ ID NO: 6798 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ccatatggagaaagctgaaa

SEQ ID NO: 6799 - DNA, 20 bp, Artificial Sequence
  Description of Artificial Sequence: Synthetic oligonucleotide
  Target: SCN10A; (-) strand; PAM type: NNGRRT; PAM sequence: AAGGAT
acaaaaacaagaaatgggga

SEQ ID NO: 6800 - DNA, 20 bp, Artificial Sequence
  Description of Artificial Sequence: Synthetic oligonucleotide
  Target: SCN10A; (-) strand; PAM type: NNGRRT; PAM sequence: GGGAGT
tctttgaagcaattgtgaat

SEQ ID NO: 6801 - DNA, 20 bp, Artificial Sequence
  Description of Artificial Sequence: Synthetic oligonucleotide
  Target: SCN10A; (-) strand; PAM type: NNGRRT; PAM sequence: GTGAAT
ttattctctttgaagcaatt

SEQ ID NO: 6802 - DNA, 20 bp, Artificial Sequence
  Description of Artificial Sequence: Synthetic oligonucleotide
  Target: SCN10A; (-) strand; PAM type: NNGRRT; PAM sequence: TGGAGT
attcttcctacccatgagca

SEQ ID NO: 6803 - DNA, 20 bp, Artificial Sequence
  Description of Artificial Sequence: Synthetic oligonucleotide
  Target: SCN10A; (-) strand; PAM type: NNGRRT; PAM sequence: TTGAAT
gtagcttgatggggatggca

SEQ ID NO: 6804 - DNA, 20 bp, Artificial Sequence
  Description of Artificial Sequence: Synthetic oligonucleotide
  Target: SCN10A; (-) strand; PAM type: NNGRRT; PAM sequence: GGGGAT
aaagtcattggtagcttgat

SEQ ID NO: 6805 - DNA, 20 bp, Artificial Sequence
  Description of Artificial Sequence: Synthetic oligonucleotide
  Target: SCN10A; (-) strand; PAM type: NNGRRT; PAM sequence: TAGGAT
ggttaaaaaaaaaacaggat

SEQ ID NO: 6806 - DNA, 20 bp, Artificial Sequence
  Description of Artificial Sequence: Synthetic oligonucleotide
  Target: SCN10A; (-) strand; PAM type: NNGRRT; PAM sequence: CAGGAT
aagtaaggttaaaaaaaaaa

SEQ ID NO: 6807 - DNA, 20 bp, Artificial Sequence
  Description of Artificial Sequence: Synthetic oligonucleotide
  Target: SCN10A; (-) strand; PAM type: NNGRRT; PAM sequence: TAGAGT
tgccagtaacaaatcagaaa

SEQ ID NO: 6808 - DNA, 20 bp, Artificial Sequence
  Description of Artificial Sequence: Synthetic oligonucleotide
  Target: SCN10A; (-) strand; PAM type: NNGRRT; PAM sequence: TAGGGT
agaatgaatgacttaattat

SEQ ID NO: 6809 - DNA, 20 bp, Artificial Sequence
  Description of Artificial Sequence: Synthetic oligonucleotide
  Target: SCN10A; (-) strand; PAM type: NNGRRT; PAM sequence: ATGAAT
ttagactgtgtaacttaaga

SEQ ID NO: 6810 - DNA, 20 bp, Artificial Sequence
  Description of Artificial Sequence: Synthetic oligonucleotide
  Target: SCN10A; (-) strand; PAM type: NNGRRT; PAM sequence: AAGAAT
atcattagactgtgtaactt

SEQ ID NO: 6811 - DNA, 20 bp, Artificial Sequence
  Description of Artificial Sequence: Synthetic oligonucleotide
  Target: SCN10A; (-) strand; PAM type: NNGRRT; PAM sequence: TAGGGT
taaaattatactttaaattc

SEQ ID NO: 6812 - DNA, 20 bp, Artificial Sequence
  Description of Artificial Sequence: Synthetic oligonucleotide
  Target: SCN10A; (-) strand; PAM type: NNGRRT; PAM sequence: AGGGAT
aagtcactttcctaagtgtt

SEQ ID NO: 6813 - DNA, 20 bp, Artificial Sequence
  Description of Artificial Sequence: Synthetic oligonucleotide
  Target: SCN10A; (-) strand; PAM type: NNGRRT; PAM sequence: CAGAAT
ttcagaacatccacttaaca

SEQ ID NO: 6814 - DNA, 20 bp, Artificial Sequence
  Description of Artificial Sequence: Synthetic oligonucleotide
  Target: SCN10A; (-) strand; PAM type: NNGRRT; PAM sequence: CAGGAT
cactgaagggagataagaga

SEQ ID NO: 6815 - DNA, 20 bp, Artificial Sequence
  Description of Artificial Sequence: Synthetic oligonucleotide
  Target: SCN10A; (-) strand; PAM type: NNGRRT; PAM sequence: GAGGAT
atctctctggcccagaatgt

SEQ ID NO: 6816 - DNA, 20 bp, Artificial Sequence
  Description of Artificial Sequence: Synthetic oligonucleotide
  Target: SCN10A; (-) strand; PAM type: NNGRRT; PAM sequence: CAGAAT
aaactagaatctctctggcc

SEQ ID NO: 6817 - DNA, 20 bp, Artificial Sequence
  Description of Artificial Sequence: Synthetic oligonucleotide
  Target: SCN10A; (-) strand; PAM type: NNGRRT; PAM sequence: TAGAAT
ccacccacaagaggtaaaac

SEQ ID NO: 6818 - DNA, 20 bp, Artificial Sequence
  Description of Artificial Sequence: Synthetic oligonucleotide
  Target: SCN10A; (-) strand; PAM type: NNGRRT; PAM sequence: CGGAGT
tatacacatcttgcatgaca

SEQ ID NO: 6819 - DNA, 20 bp, Artificial Sequence
  Description of Artificial Sequence: Synthetic oligonucleotide
  Target: SCN10A; (-) strand; PAM type: NNGRRT; PAM sequence: AGGGAT
gtaatgggaaacattggaaa

SEQ ID NO: 6820 - DNA, 20 bp, Artificial Sequence
  Description of Artificial Sequence: Synthetic oligonucleotide
  Target: SCN10A; (-) strand; PAM type: NNGRRT; PAM sequence: GAGAAT
atctagcctcagaagtgtaa

SEQ ID NO: 6821 - DNA, 20 bp, Artificial Sequence
  Description of Artificial Sequence: Synthetic oligonucleotide
  Target: SCN10A; (-) strand; PAM type: NNGRRT; PAM sequence: AGGAAT
agagatacatgtgcaggcca

SEQ ID NO: 6822 - DNA, 20 bp, Artificial Sequence
  Description of Artificial Sequence: Synthetic oligonucleotide
  Target: SCN10A; (-) strand; PAM type: NNGRRT; PAM sequence: GAGAAT
gaacagagacacacagagag

SEQ ID NO: 6823 - DNA, 20 bp, Artificial Sequence
  Description of Artificial Sequence: Synthetic oligonucleotide
  Target: SCN10A; (-) strand; PAM type: NNGRRT; PAM sequence: GGGAAT
tggtgttgctaaaatatgag

SEQ ID NO: 6824 - DNA, 20 bp, Artificial Sequence
  Description of Artificial Sequence: Synthetic oligonucleotide
  Target: SCN10A; (-) strand; PAM type: NNGRRT; PAM sequence: AAGGGT
ggttgaataatgttccctaa

SEQ ID NO: 6825 - DNA, 20 bp, Artificial Sequence
  Description of Artificial Sequence: Synthetic oligonucleotide
  Target: SCN10A; (-) strand; PAM type: NNGRRT; PAM sequence: TTGAAT
atgttgaattatgctttggg

SEQ ID NO: 6826 - DNA, 20 bp, Artificial Sequence
  Description of Artificial Sequence: Synthetic oligonucleotide
  Target: SCN10A; (-) strand; PAM type: NNGRRT; PAM sequence: TTGGGT
actttatgttgaattatgct

SEQ ID NO: 6827 - DNA, 20 bp, Artificial Sequence
  Description of Artificial Sequence: Synthetic oligonucleotide
  Target: SCN10A; (-) strand; PAM type: NNGRRT; PAM sequence: TTGAAT
gaacataattcaactttatg

SEQ ID NO: 6828 - DNA, 20 bp, Artificial Sequence
  Description of Artificial Sequence: Synthetic oligonucleotide
  Target: SCN10A; (-) strand; PAM type: NNGRRT; PAM sequence: TTGAAT
aaaagtatttttactttgag

SEQ ID NO: 6829 - DNA, 20 bp, Artificial Sequence
  Description of Artificial Sequence: Synthetic oligonucleotide
  Target: SCN10A; (-) strand; PAM type: NNGRRT; PAM sequence: TTGAGT
ttctcaaaagtatttttact

SEQ ID NO: 6830 - DNA, 20 bp, Artificial Sequence
  Description of Artificial Sequence: Synthetic oligonucleotide
  Target: SCN10A; (-) strand; PAM type: NNGRRT; PAM sequence: AAGAAT
atttttacaatgatatgtga

SEQ ID NO: 6831 - DNA, 20 bp, Artificial Sequence
  Description of Artificial Sequence: Synthetic oligonucleotide
  Target: SCN10A; (-) strand; PAM type: NNGRRT; PAM sequence: GAGAGT
ataagacagctaagtggaca

SEQ ID NO: 6832 - DNA, 20 bp, Artificial Sequence
  Description of Artificial Sequence: Synthetic oligonucleotide
  Target: SCN10A; (-) strand; PAM type: NNGRRT; PAM sequence: GTGGAT
cttcaacgtctaaatcccat

SEQ ID NO: 6833 - DNA, 20 bp, Artificial Sequence
  Description of Artificial Sequence: Synthetic oligonucleotide
  Target: SCN10A; (-) strand; PAM type: NNGRRT; PAM sequence: ATGAGT
tgcctgatttattctaaaag

SEQ ID NO: 6834 - DNA, 20 bp, Artificial Sequence
  Description of Artificial Sequence: Synthetic oligonucleotide
  Target: SCN10A; (-) strand; PAM type: NNGRRT; PAM sequence: CTGAAT
catctcaaatcagctattct

SEQ ID NO: 6835 - DNA, 20 bp, Artificial Sequence
  Description of Artificial Sequence: Synthetic oligonucleotide
  Target: SCN10A; (-) strand; PAM type: NNGRRT; PAM sequence: TGGGAT
gcaggttaataagatgatga

SEQ ID NO: 6836 - DNA, 20 bp, Artificial Sequence
  Description of Artificial Sequence: Synthetic oligonucleotide
  Target: SCN10A; (-) strand; PAM type: NNGRRT; PAM sequence: GGGAGT
aggctctcaagatgcttact

SEQ ID NO: 6837 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tgatacatctcacatgcctc

SEQ ID NO: 6838 - DNA, 20 bp, Artificial Sequence
  Description of Artificial Sequence: Synthetic oligonucleotide
  Target: SCN10A; (-) strand; PAM type: NNGRRT; PAM sequence: AGGGAT
cctataacaacataggacat

SEQ ID NO: 6839 - DNA, 20 bp, Artificial Sequence
  Description of Artificial Sequence: Synthetic oligonucleotide
  Target: SCN10A; (-) strand; PAM type: NNGRRT; PAM sequence: AGGAGT
aatggagtaagaattgtcag

SEQ ID NO: 6840 - DNA, 20 bp, Artificial Sequence
  Description of Artificial Sequence: Synthetic oligonucleotide
  Target: SCN10A; (-) strand; PAM type: NNGRRT; PAM sequence: AAGAAT
ttgtatgaactgaatggagt

SEQ ID NO: 6841 - DNA, 20 bp, Artificial Sequence
  Description of Artificial Sequence: Synthetic oligonucleotide
  Target: SCN10A; (-) strand; PAM type: NNGRRT; PAM sequence: TGGAGT
gattaattgtatgaactgaa

SEQ ID NO: 6842 - DNA, 20 bp, Artificial Sequence
  Description of Artificial Sequence: Synthetic oligonucleotide
  Target: SCN10A; (-) strand; PAM type: NNGRRT; PAM sequence: CTGAAT
caaaagattaattgtatgaa

SEQ ID NO: 6843 - DNA, 20 bp, Artificial Sequence
  Description of Artificial Sequence: Synthetic oligonucleotide
  Target: SCN10A; (-) strand; PAM type: NNGRRT; PAM sequence: AGGAAT
ccaagaacaagagataaaat

SEQ ID NO: 6844 - DNA, 20 bp, Artificial Sequence
  Description of Artificial Sequence: Synthetic oligonucleotide
  Target: SCN10A; (-) strand; PAM type: NNGRRT; PAM sequence: GAGAAT
agaagaaaaagtataatcat

SEQ ID NO: 6845 - DNA, 20 bp, Artificial Sequence
  Description of Artificial Sequence: Synthetic oligonucleotide
  Target: SCN10A; (-) strand; PAM type: NNGRRT; PAM sequence: GAGAGT
cataatcagacattaaggag

SEQ ID NO: 6846 - DNA, 20 bp, Artificial Sequence
  Description of Artificial Sequence: Synthetic oligonucleotide
  Target: SCN10A; (-) strand; PAM type: NNGRRT; PAM sequence: CAGAGT
ggcagcttttgaatacattc

SEQ ID NO: 6847 - DNA, 20 bp, Artificial Sequence
  Description of Artificial Sequence: Synthetic oligonucleotide
  Target: SCN10A; (-) strand; PAM type: NNGRRT; PAM sequence: TTGAAT
tgtagctaaagaggcagctt

SEQ ID NO: 6848 - DNA, 20 bp, Artificial Sequence
  Description of Artificial Sequence: Synthetic oligonucleotide
  Target: SCN10A; (-) strand; PAM type: NNGRRT; PAM sequence: ATGAAT
attggtgggaagggaagaaa

SEQ ID NO: 6849 - DNA, 20 bp, Artificial Sequence
  Description of Artificial Sequence: Synthetic oligonucleotide
  Target: SCN10A; (-) strand; PAM type: NNGRRT; PAM sequence: TGGAAT
tgggatctggaaatgccagt

SEQ ID NO: 6850 - DNA, 20 bp, Artificial Sequence
  Description of Artificial Sequence: Synthetic oligonucleotide
  Target: SCN10A; (-) strand; PAM type: NNGRRT; PAM sequence: TGGGAT
agcaggaaagagcactgtcc

SEQ ID NO: 6851 - DNA, 20 bp, Artificial Sequence
  Description of Artificial Sequence: Synthetic oligonucleotide
  Target: SCN10A; (-) strand; PAM type: NNGRRT; PAM sequence: CTGGGT
ttttcagtttgagattgagg

SEQ ID NO: 6852 - DNA, 20 bp, Artificial Sequence
  Description of Artificial Sequence: Synthetic oligonucleotide
  Target: SCN10A; (-) strand; PAM type: NNGRRT; PAM sequence: TGGGAT
gtcacttacccctcactttc

SEQ ID NO: 6853 - DNA, 20 bp, Artificial Sequence
  Description of Artificial Sequence: Synthetic oligonucleotide
  Target: SCN10A; (-) strand; PAM type: NNGRRT; PAM sequence: ATGAGT
ctgtgatgctgacctgtatc

SEQ ID NO: 6854 - DNA, 20 bp, Artificial Sequence
  Description of Artificial Sequence: Synthetic oligonucleotide
  Target: SCN10A; (-) strand; PAM type: NNGRRT; PAM sequence: CAGGGT
gtcggacaactgctctgacc

SEQ ID NO: 6855 - DNA, 20 bp, Artificial Sequence
  Description of Artificial Sequence: Synthetic oligonucleotide
  Target: SCN10A; (-) strand; PAM type: NNGRRT; PAM sequence: TAGGAT
cagagattggcaatattatt

SEQ ID NO: 6856 - DNA, 20 bp, Artificial Sequence
  Description of Artificial Sequence: Synthetic oligonucleotide
  Target: SCN10A; (-) strand; PAM type: NNGRRT; PAM sequence: ATGGGT
ctgaatttcaatatcagatc

SEQ ID NO: 6857 - DNA, 20 bp, Artificial Sequence
  Description of Artificial Sequence: Synthetic oligonucleotide
  Target: SCN10A; (-) strand; PAM type: NNGRRT; PAM sequence: CTGAAT
cttccactgtgatttccctt

SEQ ID NO: 6858 - DNA, 20 bp, Artificial Sequence
  Description of Artificial Sequence: Synthetic oligonucleotide
  Target: SCN10A; (-) strand; PAM type: NNGRRT; PAM sequence: AGGAGT
aaaaaccatcatacacaaat

SEQ ID NO: 6859 - DNA, 20 bp, Artificial Sequence
  Description of Artificial Sequence: Synthetic oligonucleotide
  Target: SCN10A; (-) strand; PAM type: NNGRRT; PAM sequence: GGGAAT
cacaatgtcagaactgggca

SEQ ID NO: 6860 - DNA, 20 bp, Artificial Sequence
  Description of Artificial Sequence: Synthetic oligonucleotide
  Target: SCN10A; (-) strand; PAM type: NNGRRT; PAM sequence: CTGGAT
cctagtgagaacactccagc

SEQ ID NO: 6861 - DNA, 20 bp, Artificial Sequence
  Description of Artificial Sequence: Synthetic oligonucleotide
  Target: SCN10A; (-) strand; PAM type: NNGRRT; PAM sequence: TAGAGT
gtcactagaggccttagtga

SEQ ID NO: 6862 - DNA, 20 bp, Artificial Sequence
  Description of Artificial Sequence: Synthetic oligonucleotide
  Target: SCN10A; (-) strand; PAM type: NNGRRT; PAM sequence: GAGAGT
catcattcccaccgtcctat

SEQ ID NO: 6863 - DNA, 20 bp, Artificial Sequence
  Description of Artificial Sequence: Synthetic oligonucleotide
  Target: SCN10A; (-) strand; PAM type: NNGRRT; PAM sequence: TTGGAT
tcctaggagaatccggggag

SEQ ID NO: 6864 - DNA, 20 bp, Artificial Sequence
  Description of Artificial Sequence: Synthetic oligonucleotide
  Target: SCN10A; (-) strand; PAM type: NNGRRT; PAM sequence: GGGAGT
gaatgtcctaggagaatccg

SEQ ID NO: 6865 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tttcaccaagaatgtcctag

SEQ ID NO: 6866 - DNA, 20 bp, Artificial Sequence
  Description of Artificial Sequence: Synthetic oligonucleotide
  Target: SCN10A; (-) strand; PAM type: NNGRRT; PAM sequence: AAGAAT
acatcctttttgctttcacc

SEQ ID NO: 6867 - DNA, 20 bp, Artificial Sequence
  Description of Artificial Sequence: Synthetic oligonucleotide
  Target: SCN10A; (-) strand; PAM type: NNGRRT; PAM sequence: GAGAAT
gacactctctctggtcccct

SEQ ID NO: 6868 - DNA, 20 bp, Artificial Sequence
  Description of Artificial Sequence: Synthetic oligonucleotide
  Target: SCN10A; (-) strand; PAM type: NNGRRT; PAM sequence: CTGAGT
cggaggagagcactgagccc

SEQ ID NO: 6869 - DNA, 20 bp, Artificial Sequence
  Description of Artificial Sequence: Synthetic oligonucleotide
  Target: SCN10A; (-) strand; PAM type: NNGRRT; PAM sequence: TGGGAT
agattaccacgtcggccggc

SEQ ID NO: 6870 - DNA, 20 bp, Artificial Sequence
  Description of Artificial Sequence: Synthetic oligonucleotide
  Target: SCN10A; (-) strand; PAM type: NNGRRT; PAM sequence: GGGGAT
agactgatccgagcggccaa

SEQ ID NO: 6871 - DNA, 20 bp, Artificial Sequence
  Description of Artificial Sequence: Synthetic oligonucleotide
  Target: SCN10A; (-) strand; PAM type: NNGRRT; PAM sequence: CCGAAT
ttcagagtcatccgcctggc

SEQ ID NO: 6872 - DNA, 20 bp, Artificial Sequence
  Description of Artificial Sequence: Synthetic oligonucleotide
  Target: SCN10A; (-) strand; PAM type: NNGRRT; PAM sequence: CAGAGT
tacttctccccaacgctctt

SEQ ID NO: 6873 - DNA, 20 bp, Artificial Sequence
  Description of Artificial Sequence: Synthetic oligonucleotide
  Target: SCN10A; (-) strand; PAM type: NNGRRT; PAM sequence: CAGAGT
gcagtctataccaagcaaag

SEQ ID NO: 6874 - DNA, 20 bp, Artificial Sequence
  Description of Artificial Sequence: Synthetic oligonucleotide
  Target: SCN10A; (-) strand; PAM type: NNGRRT; PAM sequence: GTGGAT
agggcccagagtcctcaaat

SEQ ID NO: 6875 - DNA, 20 bp, Artificial Sequence
  Description of Artificial Sequence: Synthetic oligonucleotide
  Target: SCN10A; (-) strand; PAM type: NNGRRT; PAM sequence: CAGAGT
catgccaggctctgagggcc

SEQ ID NO: 6876 - DNA, 20 bp, Artificial Sequence
  Description of Artificial Sequence: Synthetic oligonucleotide
  Target: SCN10A; (-) strand; PAM type: NNGRRT; PAM sequence: AAGGGT
ggcaaagataacatggtagg

SEQ ID NO: 6877 - DNA, 20 bp, Artificial Sequence
  Description of Artificial Sequence: Synthetic oligonucleotide
  Target: SCN10A; (-) strand; PAM type: NNGRRT; PAM sequence: GAGGAT
tgactgtggaggttgaccaa

SEQ ID NO: 6878 - DNA, 20 bp, Artificial Sequence
  Description of Artificial Sequence: Synthetic oligonucleotide
  Target: SCN10A; (-) strand; PAM type: NNGRRT; PAM sequence: TGGAAT
ggccaaagactgtgagcctg

SEQ ID NO: 6879 - DNA, 20 bp, Artificial Sequence
  Description of Artificial Sequence: Synthetic oligonucleotide
  Target: SCN10A; (-) strand; PAM type: NNGRRT; PAM sequence: CAGGGT
gctgcagtatcagggaggag

SEQ ID NO: 6880 - DNA, 20 bp, Artificial Sequence
  Description of Artificial Sequence: Synthetic oligonucleotide
  Target: SCN10A; (-) strand; PAM type: NNGRRT; PAM sequence: CAGGGT
gccttcacagagcacaggac

SEQ ID NO: 6881 - DNA, 20 bp, Artificial Sequence
  Description of Artificial Sequence: Synthetic oligonucleotide
  Target: SCN10A; (-) strand; PAM type: NNGRRT; PAM sequence: AGGGGT
aggtagggagaggaatcata

SEQ ID NO: 6882 - DNA, 20 bp, Artificial Sequence
  Description of Artificial Sequence: Synthetic oligonucleotide
  Target: SCN10A; (-) strand; PAM type: NNGRRT; PAM sequence: AGGAAT
tcacagtaggaggtagggag

SEQ ID NO: 6883 - DNA, 20 bp, Artificial Sequence
  Description of Artificial Sequence: Synthetic oligonucleotide
  Target: SCN10A; (-) strand; PAM type: NNGRRT; PAM sequence: CAGAGT
acaggaccgggtgccagaaa

SEQ ID NO: 6884 - DNA, 20 bp, Artificial Sequence
  Description of Artificial Sequence: Synthetic oligonucleotide
  Target: SCN10A; (-) strand; PAM type: NNGRRT; PAM sequence: CCGGGT
ccgtacaattagccacagga

SEQ ID NO: 6885 - DNA, 20 bp, Artificial Sequence
  Description of Artificial Sequence: Synthetic oligonucleotide
  Target: SCN10A; (-) strand; PAM type: NNGRRT; PAM sequence: CCGAAT
tttagctgtcagccagttgc

SEQ ID NO: 6886 - DNA, 20 bp, Artificial Sequence
  Description of Artificial Sequence: Synthetic oligonucleotide
  Target: SCN10A; (-) strand; PAM type: NNGRRT; PAM sequence: TGGAGT
tttccaactttgttcatagt

SEQ ID NO: 6887 - DNA, 20 bp, Artificial Sequence
  Description of Artificial Sequence: Synthetic oligonucleotide
  Target: SCN10A; (-) strand; PAM type: NNGRRT; PAM sequence: CAGAGT
tgtctggcagaaaattttac

SEQ ID NO: 6888 - DNA, 20 bp, Artificial Sequence
  Description of Artificial Sequence: Synthetic oligonucleotide
  Target: SCN10A; (-) strand; PAM type: NNGRRT; PAM sequence: TTGAGT
ttcccaccaacaagaggtga

SEQ ID NO: 6889 - DNA, 20 bp, Artificial Sequence
  Description of Artificial Sequence: Synthetic oligonucleotide
  Target: SCN10A; (-) strand; PAM type: NNGRRT; PAM sequence: AGGAAT
gtagcaccatccgctggggc

SEQ ID NO: 6890 - DNA, 20 bp, Artificial Sequence
  Description of Artificial Sequence: Synthetic oligonucleotide
  Target: SCN10A; (-) strand; PAM type: NNGRRT; PAM sequence: CAGGGT
ctaccagttcctgtggctta

SEQ ID NO: 6891 - DNA, 20 bp, Artificial Sequence
  Description of Artificial Sequence: Synthetic oligonucleotide
  Target: SCN10A; (-) strand; PAM type: NNGRRT; PAM sequence: GGGGAT
caagtacttagttctatgat

SEQ ID NO: 6892 - DNA, 20 bp, Artificial Sequence
  Description of Artificial Sequence: Synthetic oligonucleotide
  Target: SCN10A; (-) strand; PAM type: NNGRRT; PAM sequence: AGGAGT
cttatctcacttagcataat

SEQ ID NO: 6893 - DNA, 20 bp, Artificial Sequence
  Description of Artificial Sequence: Synthetic oligonucleotide
  Target: SCN10A; (-) strand; PAM type: NNGRRT; PAM sequence: ATGAGT
ccattctattctctgctccc

SEQ ID NO: 6894 - DNA, 20 bp, Artificial Sequence
  Description of Artificial Sequence: Synthetic oligonucleotide
  Target: SCN10A; (-) strand; PAM type: NNGRRT; PAM sequence: TAGGAT
ctatgctataagtagagctc

SEQ ID NO: 6895 - DNA, 20 bp, Artificial Sequence
  Description of Artificial Sequence: Synthetic oligonucleotide
  Target: SCN10A; (-) strand; PAM type: NNGRRT; PAM sequence: TTGGGT
cctgcctatttatttattta

SEQ ID NO: 6896 - DNA, 20 bp, Artificial Sequence
  Description of Artificial Sequence: Synthetic oligonucleotide
  Target: SCN10A; (-) strand; PAM type: NNGRRT; PAM sequence: ATGAGT
tgtttaatgtacacaacttt

SEQ ID NO: 6897 - DNA, 20 bp, Artificial Sequence
  Description of Artificial Sequence: Synthetic oligonucleotide
  Target: SCN10A; (-) strand; PAM type: NNGRRT; PAM sequence: GGGGAT
cttgggttgcgtgtatttcc

SEQ ID NO: 6898 - DNA, 20 bp, Artificial Sequence
  Description of Artificial Sequence: Synthetic oligonucleotide
  Target: SCN10A; (-) strand; PAM type: NNGRRT; PAM sequence: TTGGGT
cttggtgctgaaacacagcc

SEQ ID NO: 6899 - DNA, 20 bp, Artificial Sequence
  Description of Artificial Sequence: Synthetic oligonucleotide
  Target: SCN10A; (-) strand; PAM type: NNGRRT; PAM sequence: GAGAGT
ctgatttagtaacaagagct

SEQ ID NO: 6900 - DNA, 20 bp, Artificial Sequence
  Description of Artificial Sequence: Synthetic oligonucleotide
  Target: SCN10A; (-) strand; PAM type: NNGRRT; PAM sequence: CGGGGT
gacctgcttacttttcatgt

SEQ ID NO: 6901 - DNA, 20 bp, Artificial Sequence
  Description of Artificial Sequence: Synthetic oligonucleotide
  Target: SCN10A; (-) strand; PAM type: NNGRRT; PAM sequence: ATGGGT
aagagactgtccctgggctt

SEQ ID NO: 6902 - DNA, 20 bp, Artificial Sequence
  Description of Artificial Sequence: Synthetic oligonucleotide
  Target: SCN10A; (-) strand; PAM type: NNGRRT; PAM sequence: CTGAGT
agagtttccaagggttgaag

SEQ ID NO: 6903 - DNA, 20 bp, Artificial Sequence
  Description of Artificial Sequence: Synthetic oligonucleotide
  Target: SCN10A; (-) strand; PAM type: NNGRRT; PAM sequence: AAGGGT
tgcagggtcacagagtttcc

SEQ ID NO: 6904 - DNA, 20 bp, Artificial Sequence
  Description of Artificial Sequence: Synthetic oligonucleotide
  Target: SCN10A; (-) strand; PAM type: NNGRRT; PAM sequence: CAGAGT
aagaatattatgcagggtca

SEQ ID NO: 6905 - DNA, 20 bp, Artificial Sequence
  Description of Artificial Sequence: Synthetic oligonucleotide
  Target: SCN10A; (-) strand; PAM type: NNGRRT; PAM sequence: CAGGGT
cagagatcaagaatattatg

SEQ ID NO: 6906 - DNA, 20 bp, Artificial Sequence
  Description of Artificial Sequence: Synthetic oligonucleotide
  Target: SCN10A; (-) strand; PAM type: NNGRRT; PAM sequence: AAGAAT
aaaattgagactcagagatc

SEQ ID NO: 6907 - DNA, 20 bp, Artificial Sequence
  Description of Artificial Sequence: Synthetic oligonucleotide
  Target: SCN10A; (-) strand; PAM type: NNGRRT; PAM sequence: ATGAAT
tgagcactgagctgggctcc

SEQ ID NO: 6908 - DNA, 20 bp, Artificial Sequence
  Description of Artificial Sequence: Synthetic oligonucleotide
  Target: SCN10A; (-) strand; PAM type: NNGRRT; PAM sequence: CTGAAT
gggaaatggagctgccttga

SEQ ID NO: 6909 - DNA, 20 bp, Artificial Sequence
  Description of Artificial Sequence: Synthetic oligonucleotide
  Target: SCN10A; (-) strand; PAM type: NNGRRT; PAM sequence: TAGAGT
tggtgttcagagaaaattac

SEQ ID NO: 6910 - DNA, 20 bp, Artificial Sequence
  Description of Artificial Sequence: Synthetic oligonucleotide
  Target: SCN10A; (-) strand; PAM type: NNGRRT; PAM sequence: TTGGGT
tgaatgacaggcccagtatt

SEQ ID NO: 6911 - DNA, 20 bp, Artificial Sequence
  Description of Artificial Sequence: Synthetic oligonucleotide
  Target: SCN10A; (-) strand; PAM type: NNGRRT; PAM sequence: TTGAAT
aaggcccagtctgggtgttg

SEQ ID NO: 6912 - DNA, 20 bp, Artificial Sequence
  Description of Artificial Sequence: Synthetic oligonucleotide
  Target: SCN10A; (-) strand; PAM type: NNGRRT; PAM sequence: CTGGGT
taatactgttaaggcccagt

SEQ ID NO: 6913 - DNA, 20 bp, Artificial Sequence
  Description of Artificial Sequence: Synthetic oligonucleotide
  Target: SCN10A; (-) strand; PAM type: NNGRRT; PAM sequence: ATGAGT
caactgttctattagggaac

SEQ ID NO: 6914 - DNA, 20 bp, Artificial Sequence
  Description of Artificial Sequence: Synthetic oligonucleotide
  Target: SCN10A; (-) strand; PAM type: NNGRRT; PAM sequence: TGGAAT
agattctcaagtctagggtc

SEQ ID NO: 6915 - DNA, 20 bp, Artificial Sequence
  Description of Artificial Sequence: Synthetic oligonucleotide
  Target: SCN10A; (-) strand; PAM type: NNGRRT; PAM sequence: TAGGGT
tcaaaggagattctcaagtc

SEQ ID NO: 6916 - DNA, 20 bp, Artificial Sequence
  Description of Artificial Sequence: Synthetic oligonucleotide
  Target: SCN10A; (-) strand; PAM type: NNGRRT; PAM sequence: ATGGAT
aatctgttctggaaaaggag

SEQ ID NO: 6917 - DNA, 20 bp, Artificial Sequence
  Description of Artificial Sequence: Synthetic oligonucleotide
  Target: SCN10A; (-) strand; PAM type: NNGRRT; PAM sequence: ATGAGT
ggcaggtggtgtaatgtgag

SEQ ID NO: 6918 - DNA, 20 bp, Artificial Sequence
  Description of Artificial Sequence: Synthetic oligonucleotide
  Target: SCN10A; (-) strand; PAM type: NNGRRT; PAM sequence: TGGAGT
aacctcagaccgtaagatga

SEQ ID NO: 6919 - DNA, 20 bp, Artificial Sequence
  Description of Artificial Sequence: Synthetic oligonucleotide
  Target: SCN10A; (-) strand; PAM type: NNGRRT; PAM sequence: GGGAAT
tagaacctcaggggctgaca

SEQ ID NO: 6920 - DNA, 20 bp, Artificial Sequence
  Description of Artificial Sequence: Synthetic oligonucleotide
  Target: SCN10A; (-) strand; PAM type: NNGRRT; PAM sequence: AAGAGT
ccctgtatttgcagctttcc

SEQ ID NO: 6921 - DNA, 20 bp, Artificial Sequence
  Description of Artificial Sequence: Synthetic oligonucleotide
  Target: SCN10A; (-) strand; PAM type: NNGRRT; PAM sequence: TGGGAT
cacctctgtttgggggtctt

SEQ ID NO: 6922 - DNA, 20 bp, Artificial Sequence
  Description of Artificial Sequence: Synthetic oligonucleotide
  Target: SCN10A; (-) strand; PAM type: NNGRRT; PAM sequence: GGGGGT
gggaagccccacctctgttt

SEQ ID NO: 6923 - DNA, 20 bp, Artificial Sequence
  Description of Artificial Sequence: Synthetic oligonucleotide
  Target: SCN10A; (-) strand; PAM type: NNGRRT; PAM sequence: GCGAGT
ttgtggtggttctctccatt

SEQ ID NO: 6924 - DNA, 20 bp, Artificial Sequence
  Description of Artificial Sequence: Synthetic oligonucleotide
  Target: SCN10A; (-) strand; PAM type: NNGRRT; PAM sequence: TGGAAT
agtactacttcacaaatggc

SEQ ID NO: 6925 - DNA, 20 bp, Artificial Sequence
  Description of Artificial Sequence: Synthetic oligonucleotide
  Target: SCN10A; (-) strand; PAM type: NNGRRT; PAM sequence: GCGAAT
ctttgtggccgtcttcacag

SEQ ID NO: 6926 - DNA, 20 bp, Artificial Sequence
  Description of Artificial Sequence: Synthetic oligonucleotide
  Target: SCN10A; (-) strand; PAM type: NNGRRT; PAM sequence: CAGGGT
tgttttctcagaacaagttc

SEQ ID NO: 6927 - DNA, 20 bp, Artificial Sequence
  Description of Artificial Sequence: Synthetic oligonucleotide
  Target: SCN10A; (-) strand; PAM type: NNGRRT; PAM sequence: TGGAGT
atttcgcttctgttaagatg

SEQ ID NO: 6928 - DNA, 20 bp, Artificial Sequence
  Description of Artificial Sequence: Synthetic oligonucleotide
  Target: SCN10A; (-) strand; PAM type: NNGRRT; PAM sequence: AAGGAT
agtgaaattttggaagaggt

SEQ ID NO: 6929 - DNA, 20 bp, Artificial Sequence
  Description of Artificial Sequence: Synthetic oligonucleotide
  Target: SCN10A; (-) strand; PAM type: NNGRRT; PAM sequence: TAGAGT
cttgaactggggcaatgagg

SEQ ID NO: 6930 - DNA, 20 bp, Artificial Sequence
  Description of Artificial Sequence: Synthetic oligonucleotide
  Target: SCN10A; (-) strand; PAM type: NNGRRT; PAM sequence: GTGAAT
agaggagataggagggcatt

SEQ ID NO: 6931 - DNA, 20 bp, Artificial Sequence
  Description of Artificial Sequence: Synthetic oligonucleotide
  Target: SCN10A; (-) strand; PAM type: NNGRRT; PAM sequence: TGGAAT
gatggattactcaagactgt

SEQ ID NO: 6932 - DNA, 20 bp, Artificial Sequence
  Description of Artificial Sequence: Synthetic oligonucleotide
  Target: SCN10A; (-) strand; PAM type: NNGRRT; PAM sequence: ATGGAT
gtaagtggagcttaaaagag

SEQ ID NO: 6933 - DNA, 20 bp, Artificial Sequence
  Description of Artificial Sequence: Synthetic oligonucleotide
  Target: SCN10A; (-) strand; PAM type: NNGRRT; PAM sequence: CAGGGT
aagtgggatccccaaaggga

SEQ ID NO: 6934 - DNA, 20 bp, Artificial Sequence
  Description of Artificial Sequence: Synthetic oligonucleotide
  Target: SCN10A; (-) strand; PAM type: NNGRRT; PAM sequence: TGGGAT
actcgaggctgactgaaaag

SEQ ID NO: 6935 - DNA, 20 bp, Artificial Sequence
  Description of Artificial Sequence: Synthetic oligonucleotide
  Target: SCN10A; (-) strand; PAM type: NNGRRT; PAM sequence: AAGAAT
ggaacagagggaacatttcc

SEQ ID NO: 6936 - DNA, 20 bp, Artificial Sequence
  Description of Artificial Sequence: Synthetic oligonucleotide
  Target: SCN10A; (-) strand; PAM type: NNGRRT; PAM sequence: TGGGAT
caaagcgtggggaatggggt

SEQ ID NO: 6937 - DNA, 20 bp, Artificial Sequence
  Description of Artificial Sequence: Synthetic oligonucleotide
  Target: SCN10A; (-) strand; PAM type: NNGRRT; PAM sequence: TGGGGT
gaaggtcaaagcgtggggaa

SEQ ID NO: 6938 - DNA, 20 bp, Artificial Sequence
  Description of Artificial Sequence: Synthetic oligonucleotide
  Target: SCN10A; (-) strand; PAM type: NNGRRT; PAM sequence: GGGAAT
tgggagaaggtcaaagcgtg

SEQ ID NO: 6939 - DNA, 20 bp, Artificial Sequence
  Description of Artificial Sequence: Synthetic oligonucleotide
  Target: SCN10A; (-) strand; PAM type: NNGRRT; PAM sequence: TTGAAT
gtaggggagaatggcagcct

SEQ ID NO: 6940 - DNA, 20 bp, Artificial Sequence
  Description of Artificial Sequence: Synthetic oligonucleotide
  Target: SCN10A; (-) strand; PAM type: NNGRRT; PAM sequence: GAGAAT
ctgaggtacatggggtaggg

SEQ ID NO: 6941 - DNA, 20 bp, Artificial Sequence
  Description of Artificial Sequence: Synthetic oligonucleotide
  Target: SCN10A; (-) strand; PAM type: NNGRRT; PAM sequence: TGGGGT
ggcctaacccctgaggtaca

SEQ ID NO: 6942 - DNA, 20 bp, Artificial Sequence
  Description of Artificial Sequence: Synthetic oligonucleotide
  Target: SCN10A; (-) strand; PAM type: NNGRRT; PAM sequence: AAGGGT
caggaagagcagtggtgtgg

SEQ ID NO: 6943 - DNA, 20 bp, Artificial Sequence
  Description of Artificial Sequence: Synthetic oligonucleotide
  Target: SCN10A; (-) strand; PAM type: NNGRRT; PAM sequence: AGGGGT
ggcaaagcttcaaagcaaga

SEQ ID NO: 6944 - DNA, 20 bp, Artificial Sequence
  Description of Artificial Sequence: Synthetic oligonucleotide
  Target: SCN10A; (-) strand; PAM type: NNGRRT; PAM sequence: AAGAGT
attactgaggcagagggacc

SEQ ID NO: 6945 - DNA, 20 bp, Artificial Sequence
  Description of Artificial Sequence: Synthetic oligonucleotide
  Target: SCN10A; (-) strand; PAM type: NNGRRT; PAM sequence: AAGAGT
tgttgcctaggataatagcc

SEQ ID NO: 6946 - DNA, 20 bp, Artificial Sequence
  Description of Artificial Sequence: Synthetic oligonucleotide
  Target: SCN10A; (-) strand; PAM type: NNGRRT; PAM sequence: TAGGAT
acatggacattaatgttgcc

SEQ ID NO: 6947 - DNA, 20 bp, Artificial Sequence
  Description of Artificial Sequence: Synthetic oligonucleotide
  Target: SCN10A; (-) strand; PAM type: NNGRRT; PAM sequence: AAGAGT
gtgcaataaaccaagagaca

SEQ ID NO: 6948 - DNA, 20 bp, Artificial Sequence
  Description of Artificial Sequence: Synthetic oligonucleotide
  Target: SCN10A; (-) strand; PAM type: NNGRRT; PAM sequence: GTGAAT
ctgttgatgtgggctgagga

SEQ ID NO: 6949 - DNA, 20 bp, Artificial Sequence
  Description of Artificial Sequence: Synthetic oligonucleotide
  Target: SCN10A; (-) strand; PAM type: NNGRRT; PAM sequence: AGGAGT
agctctgttgatgtgggctg

SEQ ID NO: 6950 - DNA, 20 bp, Artificial Sequence
  Description of Artificial Sequence: Synthetic oligonucleotide
  Target: SCN10A; (-) strand; PAM type: NNGRRT; PAM sequence: CAGGAT
ttagtgagaacaatctctgt

SEQ ID NO: 6951 - DNA, 20 bp, Artificial Sequence
  Description of Artificial Sequence: Synthetic oligonucleotide
  Target: SCN10A; (-) strand; PAM type: NNGRRT; PAM sequence: TTGGAT
gcaatatcagacaagcgtcc

SEQ ID NO: 6952 - DNA, 20 bp, Artificial Sequence
  Description of Artificial Sequence: Synthetic oligonucleotide
  Target: SCN10A; (-) strand; PAM type: NNGRRT; PAM sequence: AAGGGT
aaagcaacatttcaaggtag

SEQ ID NO: 6953 - DNA, 20 bp, Artificial Sequence
  Description of Artificial Sequence: Synthetic oligonucleotide
  Target: SCN10A; (-) strand; PAM type: NNGRRT; PAM sequence: TTGGGT
agaactctgatgtctaaaag

SEQ ID NO: 6954 - DNA, 20 bp, Artificial Sequence
  Description of Artificial Sequence: Synthetic oligonucleotide
  Target: SCN10A; (-) strand; PAM type: NNGRRT; PAM sequence: AAGGAT
aaaaaatggggtgaagagca

SEQ ID NO: 6955 - DNA, 20 bp, Artificial Sequence
  Description of Artificial Sequence: Synthetic oligonucleotide
  Target: SCN10A; (-) strand; PAM type: NNGRRT; PAM sequence: TGGGGT
aattgtcaagggagaaaaaa

SEQ ID NO: 6956 - DNA, 20 bp, Artificial Sequence
  Description of Artificial Sequence: Synthetic oligonucleotide
  Target: SCN10A; (-) strand; PAM type: NNGRRT; PAM sequence: CTGGAT
acatatatgttaattcctgg

SEQ ID NO: 6957 - DNA, 20 bp, Artificial Sequence
  Description of Artificial Sequence: Synthetic oligonucleotide
  Target: SCN10A; (-) strand; PAM type: NNGRRT; PAM sequence: CAGGGT
gccaggcactatgcagacac

SEQ ID NO: 6958 - DNA, 20 bp, Artificial Sequence
  Description of Artificial Sequence: Synthetic oligonucleotide
  Target: SCN10A; (-) strand; PAM type: NNGRRT; PAM sequence: AAGGGT
gaattgaatttagtcaaata

SEQ ID NO: 6959 - DNA, 20 bp, Artificial Sequence
  Description of Artificial Sequence: Synthetic oligonucleotide
  Target: SCN10A; (-) strand; PAM type: NNGRRT; PAM sequence: TTGAAT
tatgtacccttggtacagaa

SEQ ID NO: 6960 - DNA, 20 bp, Artificial Sequence
  Description of Artificial Sequence: Synthetic oligonucleotide
  Target: SCN10A; (-) strand; PAM type: NNGRRT; PAM sequence: CAGAAT
ttcagtatgtacccttggta

SEQ ID NO: 6961 - DNA, 20 bp, Artificial Sequence
  Description of Artificial Sequence: Synthetic oligonucleotide
  Target: SCN10A; (-) strand; PAM type: NNGRRT; PAM sequence: AGGGAT
gctcccgtgggctccctgga

SEQ ID NO: 6962 - DNA, 20 bp, Artificial Sequence
  Description of Artificial Sequence: Synthetic oligonucleotide
  Target: SCN10A; (-) strand; PAM type: NNGRRT; PAM sequence: AAGGAT
cccaccatgaagcagaaggc

SEQ ID NO: 6963 - DNA, 20 bp, Artificial Sequence
  Description of Artificial Sequence: Synthetic oligonucleotide
  Target: SCN10A; (-) strand; PAM type: NNGRRT; PAM sequence: CAGGAT
gattctttgctctaacccaa

SEQ ID NO: 6964 - DNA, 20 bp, Artificial Sequence
  Description of Artificial Sequence: Synthetic oligonucleotide
  Target: SCN10A; (-) strand; PAM type: NNGRRT; PAM sequence: AGGGAT
attttcagtgatgaaatgga

SEQ ID NO: 6965 - DNA, 20 bp, Artificial Sequence
  Description of Artificial Sequence: Synthetic oligonucleotide
  Target: SCN10A; (-) strand; PAM type: NNGRRT; PAM sequence: ATGAAT
taattagaagtcatgtgacc

SEQ ID NO: 6966 - DNA, 20 bp, Artificial Sequence
  Description of Artificial Sequence: Synthetic oligonucleotide
  Target: SCN10A; (-) strand; PAM type: NNGRRT; PAM sequence: CAGAAT
gctactccattccctaaagt

SEQ ID NO: 6967 - DNA, 20 bp, Artificial Sequence
  Description of Artificial Sequence: Synthetic oligonucleotide
  Target: SCN10A; (-) strand; PAM type: NNGRRT; PAM sequence: AAGGGT
tcatcgtctctgagagcacc

SEQ ID NO: 6968 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tagaaatataataggctcta

SEQ ID NO: 6969 - DNA, 20 bp, Artificial Sequence
  Description of Artificial Sequence: Synthetic oligonucleotide
  Target: SCN10A; (-) strand; PAM type: NNGRRT; PAM sequence: AAGGAT
tttcttccataggaaaagtt

SEQ ID NO: 6970 - DNA, 20 bp, Artificial Sequence
  Description of Artificial Sequence: Synthetic oligonucleotide
  Target: SCN10A; (-) strand; PAM type: NNGRRT; PAM sequence: ATGGGT
gatttctgccccatcagtgc

SEQ ID NO: 6971 - DNA, 20 bp, Artificial Sequence
  Description of Artificial Sequence: Synthetic oligonucleotide
  Target: SCN10A; (-) strand; PAM type: NNGRRT; PAM sequence: CAGGAT
ataccagcaaagcactgaca

SEQ ID NO: 6972 - DNA, 20 bp, Artificial Sequence
  Description of Artificial Sequence: Synthetic oligonucleotide
  Target: SCN10A; (-) strand; PAM type: NNGRRT; PAM sequence: TGGAAT
tttggccagattattggccc

SEQ ID NO: 6973 - DNA, 20 bp, Artificial Sequence
  Description of Artificial Sequence: Synthetic oligonucleotide
  Target: SCN10A; (-) strand; PAM type: NNGRRT; PAM sequence: CCGGAT
cacatgcccagtggcacaag

SEQ ID NO: 6974 - DNA, 20 bp, Artificial Sequence
  Description of Artificial Sequence: Synthetic oligonucleotide
  Target: SCN10A; (-) strand; PAM type: NNGRRT; PAM sequence: CAGAGT
acagagaaatcagcacaaag

SEQ ID NO: 6975 - DNA, 20 bp, Artificial Sequence
  Description of Artificial Sequence: Synthetic oligonucleotide
  Target: SCN10A; (-) strand; PAM type: NNGRRT; PAM sequence: AGGGAT
aaacaaaactttgaagtggc

SEQ ID NO: 6976 - DNA, 20 bp, Artificial Sequence
  Description of Artificial Sequence: Synthetic oligonucleotide
  Target: SCN10A; (-) strand; PAM type: NNGRRT; PAM sequence: GTGGAT
atcctttgaatggaagaaga

SEQ ID NO: 6977 - DNA, 20 bp, Artificial Sequence
  Description of Artificial Sequence: Synthetic oligonucleotide
  Target: SCN10A; (-) strand; PAM type: NNGRRT; PAM sequence: AAGAGT
ctccatcctttgaatggaag

SEQ ID NO: 6978 - DNA, 20 bp, Artificial Sequence
  Description of Artificial Sequence: Synthetic oligonucleotide
  Target: SCN10A; (-) strand; PAM type: NNGRRT; PAM sequence: TTGAAT
ttcctgagattctccatcct

SEQ ID NO: 6979 - DNA, 20 bp, Artificial Sequence
  Description of Artificial Sequence: Synthetic oligonucleotide
  Target: SCN10A; (-) strand; PAM type: NNGRRT; PAM sequence: GAGGAT
agctgcaactaagatcctcc

SEQ ID NO: 6980 - DNA, 20 bp, Artificial Sequence
  Description of Artificial Sequence: Synthetic oligonucleotide
  Target: SCN10A; (-) strand; PAM type: NNGRRT; PAM sequence: CGGAGT
cagtaaataggagtgggaga

SEQ ID NO: 6981 - DNA, 20 bp, Artificial Sequence
  Description of Artificial Sequence: Synthetic oligonucleotide
  Target: SCN10A; (-) strand; PAM type: NNGRRT; PAM sequence: AGGAGT
tgaaattccaggcagtaaat

SEQ ID NO: 6982 - DNA, 20 bp, Artificial Sequence
  Description of Artificial Sequence: Synthetic oligonucleotide
  Target: SCN10A; (-) strand; PAM type: NNGRRT; PAM sequence: TTGAAT
tacttgtggctggagtaaga

SEQ ID NO: 6983 - DNA, 20 bp, Artificial Sequence
  Description of Artificial Sequence: Synthetic oligonucleotide
  Target: SCN10A; (-) strand; PAM type: NNGRRT; PAM sequence: TGGAGT
cactggcctttacttgtggc

SEQ ID NO: 6984 - DNA, 20 bp, Artificial Sequence
  Description of Artificial Sequence: Synthetic oligonucleotide
  Target: SCN10A; (-) strand; PAM type: NNGRRT; PAM sequence: CTGAGT
acttactgagaagcaagcag

SEQ ID NO: 6985 - DNA, 20 bp, Artificial Sequence
  Description of Artificial Sequence: Synthetic oligonucleotide
  Target: SCN10A; (-) strand; PAM type: NNGRRT; PAM sequence: ATGGGT
gtcccaaccacattcaagtc

SEQ ID NO: 6986 - DNA, 20 bp, Artificial Sequence
  Description of Artificial Sequence: Synthetic oligonucleotide
  Target: SCN10A; (-) strand; PAM type: NNGRRT; PAM sequence: CTGAGT
aattaaaattaggtgaaagg

SEQ ID NO: 6987 - DNA, 20 bp, Artificial Sequence
  Description of Artificial Sequence: Synthetic oligonucleotide
  Target: SCN10A; (-) strand; PAM type: NNGRRT; PAM sequence: TTGAGT
agcaaaagtccttaggctca

SEQ ID NO: 6988 - DNA, 20 bp, Artificial Sequence
  Description of Artificial Sequence: Synthetic oligonucleotide
  Target: SCN10A; (-) strand; PAM type: NNGRRT; PAM sequence: TTGAGT
tacaatcaagataactggat

SEQ ID NO: 6989 - DNA, 20 bp, Artificial Sequence
  Description of Artificial Sequence: Synthetic oligonucleotide
  Target: SCN10A; (-) strand; PAM type: NNGRRT; PAM sequence: CTGGAT
cacccatacaatcaagataa

SEQ ID NO: 6990 - DNA, 20 bp, Artificial Sequence
  Description of Artificial Sequence: Synthetic oligonucleotide
  Target: SCN10A; (-) strand; PAM type: NNGRRT; PAM sequence: GGGAGT
aagtattacaatggggagtg

SEQ ID NO: 6991 - DNA, 20 bp, Artificial Sequence
  Description of Artificial Sequence: Synthetic oligonucleotide
  Target: SCN10A; (-) strand; PAM type: NNGRRT; PAM sequence: GGGAGT
tgataagaagtattacaatg

SEQ ID NO: 6992 - DNA, 20 bp, Artificial Sequence
  Description of Artificial Sequence: Synthetic oligonucleotide
  Target: SCN10A; (-) strand; PAM type: NNGRRT; PAM sequence: ATGAAT
tgtattttgaaatagtggtc

SEQ ID NO: 6993 - DNA, 20 bp, Artificial Sequence
  Description of Artificial Sequence: Synthetic oligonucleotide
  Target: SCN10A; (-) strand; PAM type: NNGRRT; PAM sequence: TAGGAT
gatttttttaaatcaaggta

SEQ ID NO: 6994 - DNA, 20 bp, Artificial Sequence
  Description of Artificial Sequence: Synthetic oligonucleotide
  Target: SCN10A; (-) strand; PAM type: NNGRRT; PAM sequence: ATGAAT
aggaacaagcctttccctaa

SEQ ID NO: 6995 - DNA, 20 bp, Artificial Sequence
  Description of Artificial Sequence: Synthetic oligonucleotide
  Target: SCN10A; (-) strand; PAM type: NNGRRT; PAM sequence: TGGAAT
gagccatccactccagtgaa

SEQ ID NO: 6996 - DNA, 20 bp, Artificial Sequence
  Description of Artificial Sequence: Synthetic oligonucleotide
  Target: SCN10A; (-) strand; PAM type: NNGRRT; PAM sequence: GTGAAT
tttctgagccatccactcca

SEQ ID NO: 6997 - DNA, 20 bp, Artificial Sequence
  Description of Artificial Sequence: Synthetic oligonucleotide
  Target: SCN10A; (-) strand; PAM type: NNGRRT; PAM sequence: AAGAAT
attattgttgatcgtcttca

SEQ ID NO: 6998 - DNA, 20 bp, Artificial Sequence
  Description of Artificial Sequence: Synthetic oligonucleotide
  Target: SCN10A; (-) strand; PAM type: NNGRRT; PAM sequence: GGGGGT
gggaatggatgaacaggttt

SEQ ID NO: 6999 - DNA, 20 bp, Artificial Sequence
  Description of Artificial Sequence: Synthetic oligonucleotide
  Target: SCN10A; (-) strand; PAM type: NNGRRT; PAM sequence: ATGGAT
aagatagcacttttttggga

SEQ ID NO: 7000 - DNA, 20 bp, Artificial Sequence
  Description of Artificial Sequence: Synthetic oligonucleotide
  Target: SCN10A; (-) strand; PAM type: NNGRRT; PAM sequence: GGGAAT
ccctaagatagcactttttt

SEQ ID NO: 7001 - DNA, 20 bp, Artificial Sequence
  Description of Artificial Sequence: Synthetic oligonucleotide
  Target: SCN10A; (-) strand; PAM type: NNGRRT; PAM sequence: TCGAGT
ggaaccaaaagttatcccac

SEQ ID NO: 7002 - DNA, 20 bp, Artificial Sequence
  Description of Artificial Sequence: Synthetic oligonucleotide
  Target: SCN10A; (-) strand; PAM type: NNGRRT; PAM sequence: CAGGAT
caacaacccaactcccctgt

SEQ ID NO: 7003 - DNA, 20 bp, Artificial Sequence
  Description of Artificial Sequence: Synthetic oligonucleotide
  Target: SCN10A; (-) strand; PAM type: NNGRRT; PAM sequence: AGGGAT
agtaagggtagttagaaccc

SEQ ID NO: 7004 - DNA, 20 bp, Artificial Sequence
  Description of Artificial Sequence: Synthetic oligonucleotide
  Target: SCN10A; (-) strand; PAM type: NNGRRT; PAM sequence: AAGGGT
aggttaagctaagtgacagt

SEQ ID NO: 7005 - DNA, 20 bp, Artificial Sequence
  Description of Artificial Sequence: Synthetic oligonucleotide
  Target: SCN10A; (-) strand; PAM type: NNGRRT; PAM sequence: CAGGAT
acagttttagagttcaagta

SEQ ID NO: 7006 - DNA, 20 bp, Artificial Sequence
  Description of Artificial Sequence: Synthetic oligonucleotide
  Target: SCN10A; (-) strand; PAM type: NNGRRT; PAM sequence: TAGAGT
ctgagtttctccaacagttt

SEQ ID NO: 7007 - DNA, 20 bp, Artificial Sequence
  Description of Artificial Sequence: Synthetic oligonucleotide
  Target: SCN10A; (-) strand; PAM type: NNGRRT; PAM sequence: CTGAGT
tgaatctgttgggggaagca

SEQ ID NO: 7008 - DNA, 20 bp, Artificial Sequence
  Description of Artificial Sequence: Synthetic oligonucleotide
  Target: SCN10A; (-) strand; PAM type: NNGRRT; PAM sequence: ATGAAT
accttttacagctatttgaa

SEQ ID NO: 7009 - DNA, 20 bp, Artificial Sequence
  Description of Artificial Sequence: Synthetic oligonucleotide
  Target: SCN10A; (-) strand; PAM type: NNGRRT; PAM sequence: TGGAGT
aagaagcaactctggtcttc

SEQ ID NO: 7010 - DNA, 20 bp, Artificial Sequence
  Description of Artificial Sequence: Synthetic oligonucleotide
  Target: SCN10A; (-) strand; PAM type: NNGRRT; PAM sequence: AGGAAT
gatgagggttcctaggccca

SEQ ID NO: 7011 - DNA, 20 bp, Artificial Sequence
  Description of Artificial Sequence: Synthetic oligonucleotide
  Target: SCN10A; (-) strand; PAM type: NNGRRT; PAM sequence: GAGGGT
gacgttgggatgagggtgat

SEQ ID NO: 7012 - DNA, 20 bp, Artificial Sequence
  Description of Artificial Sequence: Synthetic oligonucleotide
  Target: SCN10A; (-) strand; PAM type: NNGRRT; PAM sequence: GAGGGT
atctgggttgacgttgggat

SEQ ID NO: 7013 - DNA, 20 bp, Artificial Sequence
  Description of Artificial Sequence: Synthetic oligonucleotide
  Target: SCN10A; (-) strand; PAM type: NNGRRT; PAM sequence: TGGGAT
gagaagatctgggttgacgt

SEQ ID NO: 7014 - DNA, 20 bp, Artificial Sequence
  Description of Artificial Sequence: Synthetic oligonucleotide
  Target: SCN10A; (-) strand; PAM type: NNGRRT; PAM sequence: CTGGGT
ctgtttatggaagagaagat

SEQ ID NO: 7015 - DNA, 20 bp, Artificial Sequence
  Description of Artificial Sequence: Synthetic oligonucleotide
  Target: SCN10A; (-) strand; PAM type: NNGRRT; PAM sequence: GGGAGT
tgtgtcaggcaggggcctga

SEQ ID NO: 7016 - DNA, 20 bp, Artificial Sequence
  Description of Artificial Sequence: Synthetic oligonucleotide
  Target: SCN10A; (-) strand; PAM type: NNGRRT; PAM sequence: GTGAAT
tcctctagcacagcctgtct

SEQ ID NO: 7017 - DNA, 20 bp, Artificial Sequence
  Description of Artificial Sequence: Synthetic oligonucleotide
  Target: SCN10A; (-) strand; PAM type: NNGRRT; PAM sequence: GGGGGT
ttctgattttggtatccgta

SEQ ID NO: 7018 - DNA, 20 bp, Artificial Sequence
  Description of Artificial Sequence: Synthetic oligonucleotide
  Target: SCN10A; (-) strand; PAM type: NNGRRT; PAM sequence: CTGGAT
tcagtcccaccgttccgaca

SEQ ID NO: 7019 - DNA, 20 bp, Artificial Sequence
  Description of Artificial Sequence: Synthetic oligonucleotide
  Target: SCN10A; (-) strand; PAM type: NNGRRT; PAM sequence: GGGAGT
ttgctttagagacccaggca

SEQ ID NO: 7020 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ccaccctttatccagcatct

SEQ ID NO: 7021 - DNA, 20 bp, Artificial Sequence
  Description of Artificial Sequence: Synthetic oligonucleotide
  Target: SCN10A; (-) strand; PAM type: NNGRRT; PAM sequence: TTGAGT
aaccaacatgtaccttctcc

SEQ ID NO: 7022 - DNA, 20 bp, Artificial Sequence
  Description of Artificial Sequence: Synthetic oligonucleotide
  Target: SCN10A; (-) strand; PAM type: NNGRRT; PAM sequence: TGGAAT
agaagcccaaagaattttac

SEQ ID NO: 7023 - DNA, 20 bp, Artificial Sequence
  Description of Artificial Sequence: Synthetic oligonucleotide
  Target: SCN10A; (-) strand; PAM type: NNGRRT; PAM sequence: AAGAAT
actgtgactctagaagccca

SEQ ID NO: 7024 - DNA, 20 bp, Artificial Sequence
  Description of Artificial Sequence: Synthetic oligonucleotide
  Target: SCN10A; (-) strand; PAM type: NNGRRT; PAM sequence: CAGAGT
ttgagggcttctgtccctcc

SEQ ID NO: 7025 - DNA, 20 bp, Artificial Sequence
  Description of Artificial Sequence: Synthetic oligonucleotide
  Target: SCN10A; (-) strand; PAM type: NNGRRT; PAM sequence: AAGGAT
ccctctgagaccaaggaccc

SEQ ID NO: 7026 - DNA, 20 bp, Artificial Sequence
  Description of Artificial Sequence: Synthetic oligonucleotide
  Target: SCN10A; (-) strand; PAM type: NNGRRT; PAM sequence: TTGAAT
aggaagctaaaggtgagagt

SEQ ID NO: 7027 - DNA, 20 bp, Artificial Sequence
  Description of Artificial Sequence: Synthetic oligonucleotide
  Target: SCN10A; (-) strand; PAM type: NNGRRT; PAM sequence: GAGAGT
tatgtcaggaagctaaaggt

SEQ ID NO: 7028 - DNA, 20 bp, Artificial Sequence
  Description of Artificial Sequence: Synthetic oligonucleotide
  Target: SCN10A; (-) strand; PAM type: NNGRRT; PAM sequence: CAGAGT
gcatctactgaatccttggt

SEQ ID NO: 7029 - DNA, 20 bp, Artificial Sequence
  Description of Artificial Sequence: Synthetic oligonucleotide
  Target: SCN10A; (-) strand; PAM type: NNGRRT; PAM sequence: CTGAAT
tcactgagaaactgcatcta

SEQ ID NO: 7030 - DNA, 20 bp, Artificial Sequence
  Description of Artificial Sequence: Synthetic oligonucleotide
  Target: SCN10A; (-) strand; PAM type: NNGRRT; PAM sequence: TGGGGT
agatgagctagtgaccaggc

SEQ ID NO: 7031 - DNA, 20 bp, Artificial Sequence
  Description of Artificial Sequence: Synthetic oligonucleotide
  Target: SCN10A; (-) strand; PAM type: NNGRRT; PAM sequence: CAGGAT
ttctgagcataagaagagga

SEQ ID NO: 7032 - DNA, 20 bp, Artificial Sequence
  Description of Artificial Sequence: Synthetic oligonucleotide
  Target: SCN10A; (-) strand; PAM type: NNGRRT; PAM sequence: CAGGGT
acttacaggaaatccttgcc

SEQ ID NO: 7033 - DNA, 20 bp, Artificial Sequence
  Description of Artificial Sequence: Synthetic oligonucleotide
  Target: SCN10A; (-) strand; PAM type: NNGRRT; PAM sequence: GGGAGT
ctggcactgtaacagcagag

SEQ ID NO: 7034 - DNA, 20 bp, Artificial Sequence
  Description of Artificial Sequence: Synthetic oligonucleotide
  Target: SCN10A; (-) strand; PAM type: NNGRRT; PAM sequence: AGGGGT
ctactctctggattgtggtg

SEQ ID NO: 7035 - DNA, 20 bp, Artificial Sequence
  Description of Artificial Sequence: Synthetic oligonucleotide
  Target: SCN10A; (-) strand; PAM type: NNGRRT; PAM sequence: CTGGAT
gggctaataatacctactct

SEQ ID NO: 7036 - DNA, 20 bp, Artificial Sequence
  Description of Artificial Sequence: Synthetic oligonucleotide
  Target: SCN10A; (-) strand; PAM type: NNGRRT; PAM sequence: CTGAGT
tggcaatattttaaacccct

SEQ ID NO: 7037 - DNA, 20 bp, Artificial Sequence
  Description of Artificial Sequence: Synthetic oligonucleotide
  Target: SCN10A; (-) strand; PAM type: NNGRRT; PAM sequence: GTGGAT
cattcctgactcaactactt

SEQ ID NO: 7038 - DNA, 20 bp, Artificial Sequence
  Description of Artificial Sequence: Synthetic oligonucleotide
  Target: SCN10A; (-) strand; PAM type: NNGRRT; PAM sequence: CTGGGT
gtcacagagtacatgcaaac

SEQ ID NO: 7039 - DNA, 20 bp, Artificial Sequence
  Description of Artificial Sequence: Synthetic oligonucleotide
  Target: SCN10A; (-) strand; PAM type: NNGRRT; PAM sequence: CAGAGT
ggggctacatggataagtca

SEQ ID NO: 7040 - DNA, 20 bp, Artificial Sequence
  Description of Artificial Sequence: Synthetic oligonucleotide
  Target: SCN10A; (-) strand; PAM type: NNGRRT; PAM sequence: ATGGAT
cccgagagaaaaggggctac

SEQ ID NO: 7041 - DNA, 20 bp, Artificial Sequence
  Description of Artificial Sequence: Synthetic oligonucleotide
  Target: SCN10A; (-) strand; PAM type: NNGRRT; PAM sequence: TCGAAT
ccgactctgattaataggaa

SEQ ID NO: 7042 - DNA, 20 bp, Artificial Sequence
  Description of Artificial Sequence: Synthetic oligonucleotide
  Target: SCN10A; (-) strand; PAM type: NNGRRT; PAM sequence: AGGAAT
gggtgccgactctgattaat

SEQ ID NO: 7043 - DNA, 20 bp, Artificial Sequence
  Description of Artificial Sequence: Synthetic oligonucleotide
  Target: SCN10A; (-) strand; PAM type: NNGRRT; PAM sequence: AAGGGT
ggaggaaggcttgtgcctcc

SEQ ID NO: 7044 - DNA, 20 bp, Artificial Sequence
  Description of Artificial Sequence: Synthetic oligonucleotide
  Target: SCN10A; (-) strand; PAM type: NNGRRT; PAM sequence: TGGGAT
ggcagaatcccaaccctcct

SEQ ID NO: 7045 - DNA, 20 bp, Artificial Sequence
  Description of Artificial Sequence: Synthetic oligonucleotide
  Target: SCN10A; (-) strand; PAM type: NNGRRT; PAM sequence: CAGAAT
aggccatggcccagcactgg

SEQ ID NO: 7046 - DNA, 20 bp, Artificial Sequence
  Description of Artificial Sequence: Synthetic oligonucleotide
  Target: SCN10A; (-) strand; PAM type: NNGRRT; PAM sequence: CTGAGT
gatatgatccccacaaagga

SEQ ID NO: 7047 - DNA, 20 bp, Artificial Sequence
  Description of Artificial Sequence: Synthetic oligonucleotide
  Target: SCN10A; (-) strand; PAM type: NNGRRT; PAM sequence: GGGGAT
tagaacttgctgacctgttg

SEQ ID NO: 7048 - DNA, 20 bp, Artificial Sequence
  Description of Artificial Sequence: Synthetic oligonucleotide
  Target: SCN10A; (-) strand; PAM type: NNGRRT; PAM sequence: AGGGAT
gaatacaagcagggaaagaa

SEQ ID NO: 7049 - DNA, 20 bp, Artificial Sequence
  Description of Artificial Sequence: Synthetic oligonucleotide
  Target: SCN10A; (-) strand; PAM type: NNGRRT; PAM sequence: GAGAAT
gtgttccaagtgagccctgg

SEQ ID NO: 7050 - DNA, 20 bp, Artificial Sequence
  Description of Artificial Sequence: Synthetic oligonucleotide
  Target: SCN10A; (-) strand; PAM type: NNGRRT; PAM sequence: AGGGAT
actcaggattcacatctcaa

SEQ ID NO: 7051 - DNA, 20 bp, Artificial Sequence
  Description of Artificial Sequence: Synthetic oligonucleotide
  Target: SCN10A; (-) strand; PAM type: NNGRRT; PAM sequence: CAGGAT
gccccactaacatcctcact

SEQ ID NO: 7052 - DNA, 20 bp, Artificial Sequence
  Description of Artificial Sequence: Synthetic oligonucleotide
  Target: SCN10A; (-) strand; PAM type: NNGRRT; PAM sequence: AAGAGT
cctgtgattgctgttgcagg

SEQ ID NO: 7053 - DNA, 20 bp, Artificial Sequence
  Description of Artificial Sequence: Synthetic oligonucleotide
  Target: SCN10A; (-) strand; PAM type: NNGRRT; PAM sequence: AGGAGT
aaaaaagataagtggtgctc

SEQ ID NO: 7054 - DNA, 20 bp, Artificial Sequence
  Description of Artificial Sequence: Synthetic oligonucleotide
  Target: SCN10A; (-) strand; PAM type: NNGRRT; PAM sequence: TGGGGT
ttcacactgaatctctttgt

SEQ ID NO: 7055 - DNA, 20 bp, Artificial Sequence
  Description of Artificial Sequence: Synthetic oligonucleotide
  Target: SCN10A; (-) strand; PAM type: NNGRRT; PAM sequence: CTGAAT
tttttggaggcttcttcaca

SEQ ID NO: 7056 - DNA, 20 bp, Artificial Sequence
  Description of Artificial Sequence: Synthetic oligonucleotide
  Target: SCN10A; (-) strand; PAM type: NNGRRT; PAM sequence: CAGAGT
catgtcttaggcttggcttt

SEQ ID NO: 7057 - DNA, 20 bp, Artificial Sequence
  Description of Artificial Sequence: Synthetic oligonucleotide
  Target: SCN10A; (-) strand; PAM type: NNGRRT; PAM sequence: TTGGAT
actccctcattcctgcttcc

SEQ ID NO: 7058 - DNA, 20 bp, Artificial Sequence
  Description of Artificial Sequence: Synthetic oligonucleotide
  Target: SCN10A; (-) strand; PAM type: NNGRRT; PAM sequence: TAGGAT
agttactcagaggaccccag

SEQ ID NO: 7059 - DNA, 20 bp, Artificial Sequence
  Description of Artificial Sequence: Synthetic oligonucleotide
  Target: SCN10A; (-) strand; PAM type: NNGRRT; PAM sequence: GAGGAT
ccaataagttttgggagtct

SEQ ID NO: 7060 - DNA, 20 bp, Artificial Sequence
  Description of Artificial Sequence: Synthetic oligonucleotide
  Target: SCN10A; (-) strand; PAM type: NNGRRT; PAM sequence: GGGAGT
aacccttaccaataagtttt

SEQ ID NO: 7061 - DNA, 20 bp, Artificial Sequence
  Description of Artificial Sequence: Synthetic oligonucleotide
  Target: SCN10A; (-) strand; PAM type: NNGRRT; PAM sequence: AGGGAT
caacttctcccccaagtacc

SEQ ID NO: 7062 - DNA, 20 bp, Artificial Sequence
  Description of Artificial Sequence: Synthetic oligonucleotide
  Target: SCN10A; (-) strand; PAM type: NNGRRT; PAM sequence: GGGAAT
aggctggggagacactattg

SEQ ID NO: 7063 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tgctcgggagactgagacag

SEQ ID NO: 7064 - DNA, 20 bp, Artificial Sequence
  Description of Artificial Sequence: Synthetic oligonucleotide
  Target: SCN10A; (-) strand; PAM type: NNGRRT; PAM sequence: CAGGAT
tcaggaactatcataaaacc

SEQ ID NO: 7065 - DNA, 20 bp, Artificial Sequence
  Description of Artificial Sequence: Synthetic oligonucleotide
  Target: SCN10A; (-) strand; PAM type: NNGRRT; PAM sequence: TAGAAT
gtgcatagggaggaatgagg

SEQ ID NO: 7066 - DNA, 20 bp, Artificial Sequence
  Description of Artificial Sequence: Synthetic oligonucleotide
  Target: SCN10A; (-) strand; PAM type: NNGRRT; PAM sequence: AGGAAT
ctaaatcaaggtgcataggg

SEQ ID NO: 7067 - DNA, 20 bp, Artificial Sequence
  Description of Artificial Sequence: Synthetic oligonucleotide
  Target: SCN10A; (-) strand; PAM type: NNGRRT; PAM sequence: AAGGGT
gacaagggtgggagcaaagc

SEQ ID NO: 7068 - DNA, 20 bp, Artificial Sequence
  Description of Artificial Sequence: Synthetic oligonucleotide
  Target: SCN10A; (-) strand; PAM type: NNGRRT; PAM sequence: AAGGGT
atgtgagccactccctggac

SEQ ID NO: 7069 - DNA, 20 bp, Artificial Sequence
  Description of Artificial Sequence: Synthetic oligonucleotide
  Target: SCN10A; (-) strand; PAM type: NNGRRT; PAM sequence: TTGAGT
agtgtccagctggctctctg

SEQ ID NO: 7070 - DNA, 20 bp, Artificial Sequence
  Description of Artificial Sequence: Synthetic oligonucleotide
  Target: SCN10A; (-) strand; PAM type: NNGRRT; PAM sequence: GTGAGT
cagctgttgattcccgggag

SEQ ID NO: 7071 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ctccaggcaacctttaaagg

SEQ ID NO: 7072 - DNA, 20 bp, Artificial Sequence
  Description of Artificial Sequence: Synthetic oligonucleotide
  Target: SCN10A; (-) strand; PAM type: NNGRRT; PAM sequence: CTGAGT
tatagatggatgggcagaca

SEQ ID NO: 7073 - DNA, 20 bp, Artificial Sequence
  Description of Artificial Sequence: Synthetic oligonucleotide
  Target: SCN10A; (-) strand; PAM type: NNGRRT; PAM sequence: ATGGAT
ttgggaagggtccagtatag

SEQ ID NO: 7074 - DNA, 20 bp, Artificial Sequence
  Description of Artificial Sequence: Synthetic oligonucleotide
  Target: SCN10A; (-) strand; PAM type: NNGRRT; PAM sequence: AAGGGT
ctgggccaccatggcttggg

SEQ ID NO: 7075 - DNA, 20 bp, Artificial Sequence
  Description of Artificial Sequence: Synthetic oligonucleotide
  Target: SCN10A; (-) strand; PAM type: NNGRRT; PAM sequence: TGGGAT
tattcttaaacagccacatg

SEQ ID NO: 7076 - DNA, 20 bp, Artificial Sequence
  Description of Artificial Sequence: Synthetic oligonucleotide
  Target: SCN10A; (-) strand; PAM type: NNGRRT; PAM sequence: AAGAAT
acacccagtttctagacctc

SEQ ID NO: 7077 - DNA, 20 bp, Artificial Sequence
  Description of Artificial Sequence: Synthetic oligonucleotide
  Target: SCN10A; (-) strand; PAM type: NNGRRT; PAM sequence: AGGAGT
ttaagtgctgtaacaggcct

SEQ ID NO: 7078 - DNA, 20 bp, Artificial Sequence
  Description of Artificial Sequence: Synthetic oligonucleotide
  Target: SCN10A; (-) strand; PAM type: NNGRRT; PAM sequence: GTGAAT
tatgagaaacagactaatag

SEQ ID NO: 7079 - DNA, 20 bp, Artificial Sequence
  Description of Artificial Sequence: Synthetic oligonucleotide
  Target: SCN10A; (-) strand; PAM type: NNGRRT; PAM sequence: CTGAGT
atttattcaacaaataatct

SEQ ID NO: 7080 - DNA, 20 bp, Artificial Sequence
  Description of Artificial Sequence: Synthetic oligonucleotide
  Target: SCN10A; (-) strand; PAM type: NNGRRT; PAM sequence: TTGAGT
catttgtcatgcagttactc

SEQ ID NO: 7081 - DNA, 20 bp, Artificial Sequence
  Description of Artificial Sequence: Synthetic oligonucleotide
  Target: SCN10A; (-) strand; PAM type: NNGRRT; PAM sequence: GTGAGT
tgccatgggattatcaggtg

SEQ ID NO: 7082 - DNA, 20 bp, Artificial Sequence
  Description of Artificial Sequence: Synthetic oligonucleotide
  Target: SCN10A; (-) strand; PAM type: NNGRRT; PAM sequence: TGGGAT
ataaagggatgggcctgcca

SEQ ID NO: 7083 - DNA, 20 bp, Artificial Sequence
  Description of Artificial Sequence: Synthetic oligonucleotide
  Target: SCN10A; (-) strand; PAM type: NNGRRT; PAM sequence: AGGGAT
gggctagtagaatagcataa

SEQ ID NO: 7084 - DNA, 20 bp, Artificial Sequence
  Description of Artificial Sequence: Synthetic oligonucleotide
  Target: SCN10A; (-) strand; PAM type: NNGRRT; PAM sequence: TAGAAT
attacacaagtgtgggctag

SEQ ID NO: 7085 - DNA, 20 bp, Artificial Sequence
  Description of Artificial Sequence: Synthetic oligonucleotide
  Target: SCN10A; (-) strand; PAM type: NNGRRT; PAM sequence: GTGAAT
gaggctagagggccttccta

SEQ ID NO: 7086 - DNA, 20 bp, Artificial Sequence
  Description of Artificial Sequence: Synthetic oligonucleotide
  Target: SCN10A; (-) strand; PAM type: NNGRRT; PAM sequence: AGGAGT
tgctatgtggggactttgca

SEQ ID NO: 7087 - DNA, 20 bp, Artificial Sequence
  Description of Artificial Sequence: Synthetic oligonucleotide
  Target: SCN10A; (-) strand; PAM type: NNGRRT; PAM sequence: GAGAGT
tttggccgctcaataaaatg

SEQ ID NO: 7088 - DNA, 20 bp, Artificial Sequence
  Description of Artificial Sequence: Synthetic oligonucleotide
  Target: SCN10A; (-) strand; PAM type: NNGRRT; PAM sequence: GTGAGT
accttgcacttctgcaggtg

SEQ ID NO: 7089 - DNA, 20 bp, Artificial Sequence
  Description of Artificial Sequence: Synthetic oligonucleotide
  Target: SCN10A; (-) strand; PAM type: NNGRRT; PAM sequence: ATGGGT
tcaactttgataatgttgca

SEQ ID NO: 7090 - DNA, 20 bp, Artificial Sequence
  Description of Artificial Sequence: Synthetic oligonucleotide
  Target: SCN10A; (-) strand; PAM type: NNGRRT; PAM sequence: CTGGGT
aactccactggcagcttctt

SEQ ID NO: 7091 - DNA, 20 bp, Artificial Sequence
  Description of Artificial Sequence: Synthetic oligonucleotide
  Target: SCN10A; (-) strand; PAM type: NNGRRT; PAM sequence: GTGAAT
cccttgtacctttgtcgatt

SEQ ID NO: 7092 - DNA, 20 bp, Artificial Sequence
  Description of Artificial Sequence: Synthetic oligonucleotide
  Target: SCN10A; (-) strand; PAM type: NNGRRT; PAM sequence: GAGAGT
gtgcatcaactataccgatg

SEQ ID NO: 7093 - DNA, 20 bp, Artificial Sequence
  Description of Artificial Sequence: Synthetic oligonucleotide
  Target: SCN10A; (-) strand; PAM type: NNGRRT; PAM sequence: ATGGGT
tctggctcatcttcagcatc

SEQ ID NO: 7094 - DNA, 20 bp, Artificial Sequence
  Description of Artificial Sequence: Synthetic oligonucleotide
  Target: SCN10A; (-) strand; PAM type: NNGRRT; PAM sequence: ATGAAT
tgggcgccatcccatccatc

SEQ ID NO: 7095 - DNA, 20 bp, Artificial Sequence
  Description of Artificial Sequence: Synthetic oligonucleotide
  Target: SCN10A; (-) strand; PAM type: NNGRRT; PAM sequence: GTGGAT
ctatctcccaccaggtggtg

SEQ ID NO: 7096 - DNA, 20 bp, Artificial Sequence
  Description of Artificial Sequence: Synthetic oligonucleotide
  Target: SCN10A; (-) strand; PAM type: NNGRRT; PAM sequence: GGGGGT
aagagatagaatccagcaga

SEQ ID NO: 7097 - DNA, 20 bp, Artificial Sequence
  Description of Artificial Sequence: Synthetic oligonucleotide
  Target: SCN10A; (-) strand; PAM type: NNGRRT; PAM sequence: TAGAAT
tgaatgagtatagaaagaga

SEQ ID NO: 7098 - DNA, 20 bp, Artificial Sequence
  Description of Artificial Sequence: Synthetic oligonucleotide
  Target: SCN10A; (-) strand; PAM type: NNGRRT; PAM sequence: ATGAGT
tggctcatgaagcagcctga

SEQ ID NO: 7099 - DNA, 20 bp, Artificial Sequence
  Description of Artificial Sequence: Synthetic oligonucleotide
  Target: SCN10A; (-) strand; PAM type: NNGRRT; PAM sequence: CTGAAT
ccactggctcatgaagcagc

SEQ ID NO: 7100 - DNA, 20 bp, Artificial Sequence
  Description of Artificial Sequence: Synthetic oligonucleotide
  Target: SCN10A; (-) strand; PAM type: NNGRRT; PAM sequence: CTGAAT
tgtctctcagtcttctgagt

SEQ ID NO: 7101 - DNA, 20 bp, Artificial Sequence
  Description of Artificial Sequence: Synthetic oligonucleotide
  Target: SCN10A; (-) strand; PAM type: NNGRRT; PAM sequence: CTGAGT
gcccaatgtctctcagtctt

SEQ ID NO: 7102 - DNA, 20 bp, Artificial Sequence
  Description of Artificial Sequence: Synthetic oligonucleotide
  Target: SCN10A; (-) strand; PAM type: NNGRRT; PAM sequence: CTGAAT
tcttctcactgcaacccacc

SEQ ID NO: 7103 - DNA, 20 bp, Artificial Sequence
  Description of Artificial Sequence: Synthetic oligonucleotide
  Target: SCN10A; (-) strand; PAM type: NNGRRT; PAM sequence: ATGAGT
acacacactcacacttctaa

SEQ ID NO: 7104 - DNA, 20 bp, Artificial Sequence
  Description of Artificial Sequence: Synthetic oligonucleotide
  Target: SCN10A; (-) strand; PAM type: NNGRRT; PAM sequence: GAGAAT
ttttatgtatggtatttaag

SEQ ID NO: 7105 - DNA, 20 bp, Artificial Sequence
  Description of Artificial Sequence: Synthetic oligonucleotide
  Target: SCN10A; (-) strand; PAM type: NNGRRT; PAM sequence: ATGGAT
aaataagctattttgtgaat

SEQ ID NO: 7106 - DNA, 20 bp, Artificial Sequence
  Description of Artificial Sequence: Synthetic oligonucleotide
  Target: SCN10A; (-) strand; PAM type: NNGRRT; PAM sequence: GTGAAT
atttacaaataagctatttt

SEQ ID NO: 7107 - DNA, 20 bp, Artificial Sequence
  Description of Artificial Sequence: Synthetic oligonucleotide
  Target: SCN10A; (-) strand; PAM type: NNGRRT; PAM sequence: CAGAAT
cctaactgcctccgtcagga

SEQ ID NO: 7108 - DNA, 20 bp, Artificial Sequence
  Description of Artificial Sequence: Synthetic oligonucleotide
  Target: SCN10A; (-) strand; PAM type: NNGRRT; PAM sequence: TGGAAT
ttacctcagctgccacccac

SEQ ID NO: 7109 - DNA, 20 bp, Artificial Sequence
  Description of Artificial Sequence: Synthetic oligonucleotide
  Target: SCN10A; (-) strand; PAM type: NNGRRT; PAM sequence: ATGAGT
agtctttcctctaatactcc

SEQ ID NO: 7110 - DNA, 20 bp, Artificial Sequence
  Description of Artificial Sequence: Synthetic oligonucleotide
  Target: SCN10A; (-) strand; PAM type: NNGRRT; PAM sequence: ATGAGT
tctctgtctttccatgacaa

SEQ ID NO: 7111 - DNA, 20 bp, Artificial Sequence
  Description of Artificial Sequence: Synthetic oligonucleotide
  Target: SCN10A; (-) strand; PAM type: NNGRRT; PAM sequence: CTGAAT
ttgctcttagtgaagtaatc

SEQ ID NO: 7112 - DNA, 20 bp, Artificial Sequence
  Description of Artificial Sequence: Synthetic oligonucleotide
  Target: SCN10A; (-) strand; PAM type: NNGRRT; PAM sequence: CTGAGT
cccacctccaaaggtaggct

SEQ ID NO: 7113 - DNA, 20 bp, Artificial Sequence
  Description of Artificial Sequence: Synthetic oligonucleotide
  Target: SCN10A; (-) strand; PAM type: NNGRRT; PAM sequence: CTGGGT
ttgtgccattatactccagc

SEQ ID NO: 7114 - DNA, 20 bp, Artificial Sequence
  Description of Artificial Sequence: Synthetic oligonucleotide
  Target: SCN10A; (-) strand; PAM type: NNGRRT; PAM sequence: AGGAGT
cgggcggatcacctgaggtt

SEQ ID NO: 7115 - DNA, 20 bp, Artificial Sequence
  Description of Artificial Sequence: Synthetic oligonucleotide
  Target: SCN10A; (-) strand; PAM type: NNGRRT; PAM sequence: GCGGAT
actttgggaggctgaggcgg

SEQ ID NO: 7116 - DNA, 20 bp, Artificial Sequence
  Description of Artificial Sequence: Synthetic oligonucleotide
  Target: SCN10A; (-) strand; PAM type: NNGRRT; PAM sequence: GCGGGT
ctttctcgatttgaaggcat

SEQ ID NO: 7117 - DNA, 20 bp, Artificial Sequence
  Description of Artificial Sequence: Synthetic oligonucleotide
  Target: SCN10A; (-) strand; PAM type: NNGRRT; PAM sequence: TGGAAT
aagtctcacagcgaagattc

SEQ ID NO: 7118 - DNA, 20 bp, Artificial Sequence
  Description of Artificial Sequence: Synthetic oligonucleotide
  Target: SCN10A; (-) strand; PAM type: NNGRRT; PAM sequence: TAGAGT
ggactgcctttctggaaacc

SEQ ID NO: 7119 - DNA, 20 bp, Artificial Sequence
  Description of Artificial Sequence: Synthetic oligonucleotide
  Target: SCN10A; (-) strand; PAM type: NNGRRT; PAM sequence: GGGAGT
taggaatgggaggctgggca

SEQ ID NO: 7120 - DNA, 20 bp, Artificial Sequence
  Description of Artificial Sequence: Synthetic oligonucleotide
  Target: SCN10A; (-) strand; PAM type: NNGRRT; PAM sequence: AGGAAT
ggatgatggcttagacgtgt

SEQ ID NO: 7121 - DNA, 20 bp, Artificial Sequence
  Description of Artificial Sequence: Synthetic oligonucleotide
  Target: SCN10A; (-) strand; PAM type: NNGRRT; PAM sequence: TAGGAT
gttccgaataaggtgggagc

SEQ ID NO: 7122 - DNA, 20 bp, Artificial Sequence
  Description of Artificial Sequence: Synthetic oligonucleotide
  Target: SCN10A; (-) strand; PAM type: NNGRRT; PAM sequence: CCGAAT
ctagacctctcattggagtt

SEQ ID NO: 7123 - DNA, 20 bp, Artificial Sequence
  Description of Artificial Sequence: Synthetic oligonucleotide
  Target: SCN10A; (-) strand; PAM type: NNGRRT; PAM sequence: TGGAGT
actctttctagacctctcat

SEQ ID NO: 7124 - DNA, 20 bp, Artificial Sequence
  Description of Artificial Sequence: Synthetic oligonucleotide
  Target: SCN10A; (-) strand; PAM type: NNGRRT; PAM sequence: GTGAAT
ccagattgtttaagagagtg

SEQ ID NO: 7125 - DNA, 20 bp, Artificial Sequence
  Description of Artificial Sequence: Synthetic oligonucleotide
  Target: SCN10A; (-) strand; PAM type: NNGRRT; PAM sequence: GAGAGT
ttcttgcccagattgtttaa

SEQ ID NO: 7126 - DNA, 20 bp, Artificial Sequence
  Description of Artificial Sequence: Synthetic oligonucleotide
  Target: SCN10A; (-) strand; PAM type: NNGRRT; PAM sequence: CTGAGT
gaggttggtgatgttagaga

SEQ ID NO: 7127 - DNA, 20 bp, Artificial Sequence
  Description of Artificial Sequence: Synthetic oligonucleotide
  Target: SCN10A; (-) strand; PAM type: NNGRRT; PAM sequence: AAGAGT
ctgcccctagaaggaaaagg

SEQ ID NO: 7128 - DNA, 20 bp, Artificial Sequence
  Description of Artificial Sequence: Synthetic oligonucleotide
  Target: SCN10A; (-) strand; PAM type: NNGRRT; PAM sequence: CAGAAT
attcagattactatattcct

SEQ ID NO: 7129 - DNA, 20 bp, Artificial Sequence
  Description of Artificial Sequence: Synthetic oligonucleotide
  Target: SCN10A; (-) strand; PAM type: NNGRRT; PAM sequence: GGGAAT
caaaaaatcagggttcaaat

SEQ ID NO: 7130 - DNA, 20 bp, Artificial Sequence
  Description of Artificial Sequence: Synthetic oligonucleotide
  Target: SCN10A; (-) strand; PAM type: NNGRRT; PAM sequence: CAGGGT
aacccaagctcacaaaaaat

SEQ ID NO: 7131 - DNA, 20 bp, Artificial Sequence
  Description of Artificial Sequence: Synthetic oligonucleotide
  Target: SCN10A; (-) strand; PAM type: NNGRRT; PAM sequence: AAGGGT
tctgactttttcattttaca

SEQ ID NO: 7132 - DNA, 20 bp, Artificial Sequence
  Description of Artificial Sequence: Synthetic oligonucleotide
  Target: SCN10A; (-) strand; PAM type: NNGRRT; PAM sequence: TGGAAT
ctgcagagctatcagaactt

SEQ ID NO: 7133 - DNA, 20 bp, Artificial Sequence
  Description of Artificial Sequence: Synthetic oligonucleotide
  Target: SCN10A; (-) strand; PAM type: NNGRRT; PAM sequence: CAGGGT
gtggctaagatctcacagga

SEQ ID NO: 7134 - DNA, 20 bp, Artificial Sequence
  Description of Artificial Sequence: Synthetic oligonucleotide
  Target: SCN10A; (-) strand; PAM type: NNGRRT; PAM sequence: CTGAAT
actgccaggataagctgagc

SEQ ID NO: 7135 - DNA, 20 bp, Artificial Sequence
  Description of Artificial Sequence: Synthetic oligonucleotide
  Target: SCN10A; (-) strand; PAM type: NNGRRT; PAM sequence: CAGGAT
tgtgcatcccacctaactgc

SEQ ID NO: 7136 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tgcaataagccactcatcca

SEQ ID NO: 7137 - DNA, 20 bp, Artificial Sequence
  Description of Artificial Sequence: Synthetic oligonucleotide
  Target: SCN10A; (-) strand; PAM type: NNGRRT; PAM sequence: GAGGGT
gccttgcatgaatgaaggaa

SEQ ID NO: 7138 - DNA, 20 bp, Artificial Sequence
  Description of Artificial Sequence: Synthetic oligonucleotide
  Target: SCN10A; (-) strand; PAM type: NNGRRT; PAM sequence: ATGAAT
gctgatgtctggagccttgc

SEQ ID NO: 7139 - DNA, 20 bp, Artificial Sequence
  Description of Artificial Sequence: Synthetic oligonucleotide
  Target: SCN10A; (-) strand; PAM type: NNGRRT; PAM sequence: CTGGGT
accctcatgcacccaggcag

SEQ ID NO: 7140 - DNA, 20 bp, Artificial Sequence
  Description of Artificial Sequence: Synthetic oligonucleotide
  Target: SCN10A; (-) strand; PAM type: NNGRRT; PAM sequence: TAGGGT
gggctgagcaaaagactgaa

SEQ ID NO: 7141 - DNA, 20 bp, Artificial Sequence
  Description of Artificial Sequence: Synthetic oligonucleotide
  Target: SCN10A; (-) strand; PAM type: NNGRRT; PAM sequence: CTGAAT
ccagggggctgagcaaaaga

SEQ ID NO: 7142 - DNA, 20 bp, Artificial Sequence
  Description of Artificial Sequence: Synthetic oligonucleotide
  Target: SCN10A; (-) strand; PAM type: NNGRRT; PAM sequence: TTGGGT
cagtgggaatggaggtgggc

SEQ ID NO: 7143 - DNA, 20 bp, Artificial Sequence
  Description of Artificial Sequence: Synthetic oligonucleotide
  Target: SCN10A; (-) strand; PAM type: NNGRRT; PAM sequence: GGGAAT
aggctagtgggctgagcagt

SEQ ID NO: 7144 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tcataatcagatttgcagtg

SEQ ID NO: 7145 - DNA, 20 bp, Artificial Sequence
  Description of Artificial Sequence: Synthetic oligonucleotide
  Target: SCN10A; (-) strand; PAM type: NNGRRT; PAM sequence: GGGAGT
ataaagtaccagtgatgttt

SEQ ID NO: 7146 - DNA, 20 bp, Artificial Sequence
  Description of Artificial Sequence: Synthetic oligonucleotide
  Target: SCN10A; (-) strand; PAM type: NNGRRT; PAM sequence: GAGGGT
cagagtatggagtttatcct

SEQ ID NO: 7147 - DNA, 20 bp, Artificial Sequence
  Description of Artificial Sequence: Synthetic oligonucleotide
  Target: SCN10A; (-) strand; PAM type: NNGRRT; PAM sequence: TGGAGT
atgacacaggctacagagta

SEQ ID NO: 7148 - DNA, 20 bp, Artificial Sequence
  Description of Artificial Sequence: Synthetic oligonucleotide
  Target: SCN10A; (-) strand; PAM type: NNGRRT; PAM sequence: CAGAGT
tgaccatatgacacaggcta

SEQ ID NO: 7149 - DNA, 20 bp, Artificial Sequence
  Description of Artificial Sequence: Synthetic oligonucleotide
  Target: SCN10A; (-) strand; PAM type: NNGRRT; PAM sequence: GTGGGT
atttgatttgggtagaatgt

SEQ ID NO: 7150 - DNA, 20 bp, Artificial Sequence
  Description of Artificial Sequence: Synthetic oligonucleotide
  Target: SCN10A; (-) strand; PAM type: NNGRRT; PAM sequence: TAGAAT
agggaacaatttgatttggg

SEQ ID NO: 7151 - DNA, 20 bp, Artificial Sequence
  Description of Artificial Sequence: Synthetic oligonucleotide
  Target: SCN10A; (-) strand; PAM type: NNGRRT; PAM sequence: TTGGGT
tgctcagggaacaatttgat

SEQ ID NO: 7152 - DNA, 20 bp, Artificial Sequence
  Description of Artificial Sequence: Synthetic oligonucleotide
  Target: SCN10A; (-) strand; PAM type: NNGRRT; PAM sequence: GAGAAT
actcttggggtggggtggtt

SEQ ID NO: 7153 - DNA, 20 bp, Artificial Sequence
  Description of Artificial Sequence: Synthetic oligonucleotide
  Target: SCN10A; (-) strand; PAM type: NNGRRT; PAM sequence: TGGGGT
gccttcttccactcttgggg

SEQ ID NO: 7154 - DNA, 20 bp, Artificial Sequence
  Description of Artificial Sequence: Synthetic oligonucleotide
  Target: SCN10A; (-) strand; PAM type: NNGRRT; PAM sequence: TGGGGT
catgagccttcttccactct

SEQ ID NO: 7155 - DNA, 20 bp, Artificial Sequence
  Description of Artificial Sequence: Synthetic oligonucleotide
  Target: SCN10A; (-) strand; PAM type: NNGRRT; PAM sequence: GTGAAT
gaaataaatgtattataagg

SEQ ID NO: 7156 - DNA, 20 bp, Artificial Sequence
  Description of Artificial Sequence: Synthetic oligonucleotide
  Target: SCN10A; (-) strand; PAM type: NNGRRT; PAM sequence: AAGGGT
catggaaataaatgtattat

SEQ ID NO: 7157 - DNA, 20 bp, Artificial Sequence
  Description of Artificial Sequence: Synthetic oligonucleotide
  Target: SCN10A; (-) strand; PAM type: NNGRRT; PAM sequence: CAGGAT
gaataaatactcactatctc

SEQ ID NO: 7158 - DNA, 20 bp, Artificial Sequence
  Description of Artificial Sequence: Synthetic oligonucleotide
  Target: SCN10A; (-) strand; PAM type: NNGRRT; PAM sequence: CAGAAT
ctttgtaagaaacagaagca

SEQ ID NO: 7159 - DNA, 20 bp, Artificial Sequence
  Description of Artificial Sequence: Synthetic oligonucleotide
  Target: SCN10A; (-) strand; PAM type: NNGRRT; PAM sequence: CAGGAT
atacatctaactattgaata

SEQ ID NO: 7160 - DNA, 20 bp, Artificial Sequence
  Description of Artificial Sequence: Synthetic oligonucleotide
  Target: SCN10A; (-) strand; PAM type: NNGRRT; PAM sequence: TTGAAT
atttgctatacatctaacta

SEQ ID NO: 7161 - DNA, 20 bp, Artificial Sequence
  Description of Artificial Sequence: Synthetic oligonucleotide
  Target: SCN10A; (-) strand; PAM type: NNGRRT; PAM sequence: AGGGAT
ccaaaccatatcaattttta

SEQ ID NO: 7162 - DNA, 20 bp, Artificial Sequence
  Description of Artificial Sequence: Synthetic oligonucleotide
  Target: SCN10A; (-) strand; PAM type: NNGRRT; PAM sequence: TTGGGT
atgggaattcaagataagat

SEQ ID NO: 7163 - DNA, 20 bp, Artificial Sequence
  Description of Artificial Sequence: Synthetic oligonucleotide
  Target: SCN10A; (-) strand; PAM type: NNGRRT; PAM sequence: GGGAAT
cctcccctcccacaacacat

SEQ ID NO: 7164 - DNA, 20 bp, Artificial Sequence
  Description of Artificial Sequence: Synthetic oligonucleotide
  Target: SCN10A; (-) strand; PAM type: NNGRRT; PAM sequence: CAGGGT
catgattcacttacctccca

SEQ ID NO: 7165 - DNA, 20 bp, Artificial Sequence
  Description of Artificial Sequence: Synthetic oligonucleotide
  Target: SCN10A; (-) strand; PAM type: NNGRRT; PAM sequence: GTGGAT
aggtgcgagtcacgtcttat

SEQ ID NO: 7166 - DNA, 20 bp, Artificial Sequence
  Description of Artificial Sequence: Synthetic oligonucleotide
  Target: SCN10A; (-) strand; PAM type: NNGRRT; PAM sequence: GCGAGT
atggcaaaaggaaaggaggt

SEQ ID NO: 7167 - DNA, 20 bp, Artificial Sequence
  Description of Artificial Sequence: Synthetic oligonucleotide
  Target: SCN10A; (-) strand; PAM type: NNGRRT; PAM sequence: ATGGGT
tgaggcctgaaatctgagtc

SEQ ID NO: 7168 - DNA, 20 bp, Artificial Sequence
  Description of Artificial Sequence: Synthetic oligonucleotide
  Target: SCN10A; (-) strand; PAM type: NNGRRT; PAM sequence: CTGAGT
ttagctgtgaggcctgaaat

SEQ ID NO: 7169 - DNA, 20 bp, Artificial Sequence
  Description of Artificial Sequence: Synthetic oligonucleotide
  Target: SCN10A; (-) strand; PAM type: NNGRRT; PAM sequence: AAGGAT
gcttcaggccactgtaccac

SEQ ID NO: 7170 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ttggtgcttgcctcctgaag

SEQ ID NO: 7171 - DNA, 20 bp, Artificial Sequence
  Description of Artificial Sequence: Synthetic oligonucleotide
  Target: SCN10A; (-) strand; PAM type: NNGRRT; PAM sequence: CAGGGT
tagctgagggtttctgcaag

SEQ ID NO: 7172 - DNA, 20 bp, Artificial Sequence
  Description of Artificial Sequence: Synthetic oligonucleotide
  Target: SCN10A; (-) strand; PAM type: NNGRRT; PAM sequence: GAGGGT
ctgttcactgccgcatagct

SEQ ID NO: 7173 - DNA, 20 bp, Artificial Sequence
  Description of Artificial Sequence: Synthetic oligonucleotide
  Target: SCN10A; (-) strand; PAM type: NNGRRT; PAM sequence: CTGAGT
ttgctttgcagcatggttaa

SEQ ID NO: 7174 - DNA, 20 bp, Artificial Sequence
  Description of Artificial Sequence: Synthetic oligonucleotide
  Target: SCN10A; (-) strand; PAM type: NNGRRT; PAM sequence: GAGAAT
ggccagtaatccctgcatta

SEQ ID NO: 7175 - DNA, 20 bp, Artificial Sequence
  Description of Artificial Sequence: Synthetic oligonucleotide
  Target: SCN10A; (-) strand; PAM type: NNGRRT; PAM sequence: TGGAGT
catttggagaggtaatgagc

SEQ ID NO: 7176 - DNA, 20 bp, Artificial Sequence
  Description of Artificial Sequence: Synthetic oligonucleotide
  Target: SCN10A; (-) strand; PAM type: NNGRRT; PAM sequence: TTGGGT
agattctgatcttattggtc

SEQ ID NO: 7177 - DNA, 20 bp, Artificial Sequence
  Description of Artificial Sequence: Synthetic oligonucleotide
  Target: SCN10A; (-) strand; PAM type: NNGRRT; PAM sequence: GAGAAT
cctcacacctggctgcactt

SEQ ID NO: 7178 - DNA, 20 bp, Artificial Sequence
  Description of Artificial Sequence: Synthetic oligonucleotide
  Target: SCN10A; (-) strand; PAM type: NNGRRT; PAM sequence: GAGAAT
agccatgaactgtgagcaca

SEQ ID NO: 7179 - DNA, 20 bp, Artificial Sequence
  Description of Artificial Sequence: Synthetic oligonucleotide
  Target: SCN10A; (-) strand; PAM type: NNGRRT; PAM sequence: ATGGGT
ttatggccctgcatccatag

SEQ ID NO: 7180 - DNA, 20 bp, Artificial Sequence
  Description of Artificial Sequence: Synthetic oligonucleotide
  Target: SCN10A; (-) strand; PAM type: NNGRRT; PAM sequence: GTGAGT
gacacaatagtgactgttag

SEQ ID NO: 7181 - DNA, 20 bp, Artificial Sequence
  Description of Artificial Sequence: Synthetic oligonucleotide
  Target: SCN10A; (-) strand; PAM type: NNGRRT; PAM sequence: ATGAGT
tgagaatagccctgacaccc

SEQ ID NO: 7182 - DNA, 20 bp, Artificial Sequence
  Description of Artificial Sequence: Synthetic oligonucleotide
  Target: SCN10A; (-) strand; PAM type: NNGRRT; PAM sequence: GAGAAT
gagcatttagtgaggagtct

SEQ ID NO: 7183 - DNA, 20 bp, Artificial Sequence
  Description of Artificial Sequence: Synthetic oligonucleotide
  Target: SCN10A; (-) strand; PAM type: NNGRRT; PAM sequence: AGGAGT
aaagttttgagcatttagtg

SEQ ID NO: 7184 - DNA, 20 bp, Artificial Sequence
  Description of Artificial Sequence: Synthetic oligonucleotide
  Target: SCN10A; (-) strand; PAM type: NNGRRT; PAM sequence: TGGGGT
cagtgggaacacgtggggtt

SEQ ID NO: 7185 - DNA, 20 bp, Artificial Sequence
  Description of Artificial Sequence: Synthetic oligonucleotide
  Target: SCN10A; (-) strand; PAM type: NNGRRT; PAM sequence: TGGGGT
agtggctcagtgggaacacg

SEQ ID NO: 7186 - DNA, 20 bp, Artificial Sequence
  Description of Artificial Sequence: Synthetic oligonucleotide
  Target: SCN10A; (-) strand; PAM type: NNGRRT; PAM sequence: GTGAGT
tggacttcctcattgtgaat

SEQ ID NO: 7187 - DNA, 20 bp, Artificial Sequence
  Description of Artificial Sequence: Synthetic oligonucleotide
  Target: SCN10A; (-) strand; PAM type: NNGRRT; PAM sequence: GTGAAT
gctggctggacttcctcatt

SEQ ID NO: 7188 - DNA, 20 bp, Artificial Sequence
  Description of Artificial Sequence: Synthetic oligonucleotide
  Target: SCN10A; (-) strand; PAM type: NNGRRT; PAM sequence: GTGGGT
gtgttcgagatgctgcttaa

SEQ ID NO: 7189 - DNA, 20 bp, Artificial Sequence
  Description of Artificial Sequence: Synthetic oligonucleotide
  Target: SCN10A; (-) strand; PAM type: NNGRRT; PAM sequence: CAGGGT
gctttgctggagtacactga

SEQ ID NO: 7190 - DNA, 20 bp, Artificial Sequence
  Description of Artificial Sequence: Synthetic oligonucleotide
  Target: SCN10A; (-) strand; PAM type: NNGRRT; PAM sequence: TGGAGT
gcccacggtgaaagctttgc

SEQ ID NO: 7191 - DNA, 20 bp, Artificial Sequence
  Description of Artificial Sequence: Synthetic oligonucleotide
  Target: SCN10A; (-) strand; PAM type: NNGRRT; PAM sequence: GTGGGT
tcagtctgggccccagtgct

SEQ ID NO: 7192 - DNA, 20 bp, Artificial Sequence
  Description of Artificial Sequence: Synthetic oligonucleotide
  Target: SCN10A; (-) strand; PAM type: NNGRRT; PAM sequence: CTGGGT
gggactgtggtcagggctgg

SEQ ID NO: 7193 - DNA, 20 bp, Artificial Sequence
  Description of Artificial Sequence: Synthetic oligonucleotide
  Target: SCN10A; (-) strand; PAM type: NNGRRT; PAM sequence: TTGGAT
ggccctgaagaagtcatgct

SEQ ID NO: 7194 - DNA, 20 bp, Artificial Sequence
  Description of Artificial Sequence: Synthetic oligonucleotide
  Target: SCN10A; (-) strand; PAM type: NNGRRT; PAM sequence: TTGAAT
aaacagcatcttcttttaat

SEQ ID NO: 7195 - DNA, 20 bp, Artificial Sequence
  Description of Artificial Sequence: Synthetic oligonucleotide
  Target: SCN10A; (-) strand; PAM type: NNGRRT; PAM sequence: TAGGGT
cccccacagccacagcatcc

SEQ ID NO: 7196 - DNA, 20 bp, Artificial Sequence
  Description of Artificial Sequence: Synthetic oligonucleotide
  Target: SCN10A; (-) strand; PAM type: NNGRRT; PAM sequence: AAGAGT
aaaaaaaaaaaaaaaaaaaa

SEQ ID NO: 7197 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tacttgggaggctgaggcag

SEQ ID NO: 7198 - DNA, 20 bp, Artificial Sequence
  Description of Artificial Sequence: Synthetic oligonucleotide
  Target: SCN10A; (-) strand; PAM type: NNGRRT; PAM sequence: GCGGAT
actttgggaggctgaggcgg

SEQ ID NO: 7199 - DNA, 20 bp, Artificial Sequence
  Description of Artificial Sequence: Synthetic oligonucleotide
  Target: SCN10A; (-) strand; PAM type: NNGRRT; PAM sequence: AAGAGT
cactcctgccagtcacttgt

SEQ ID NO: 7200 - DNA, 20 bp, Artificial Sequence
  Description of Artificial Sequence: Synthetic oligonucleotide
  Target: SCN10A; (-) strand; PAM type: NNGRRT; PAM sequence: CTGAGT
ttgctaggttcctgaaacct

SEQ ID NO: 7201 - DNA, 20 bp, Artificial Sequence
  Description of Artificial Sequence: Synthetic oligonucleotide
  Target: SCN10A; (-) strand; PAM type: NNGRRT; PAM sequence: AGGAAT
ttaggattagtgcttgaagg

SEQ ID NO: 7202 - DNA, 20 bp, Artificial Sequence
  Description of Artificial Sequence: Synthetic oligonucleotide
  Target: SCN10A; (-) strand; PAM type: NNGRRT; PAM sequence: TAGGAT
ccaacagcctccagtgtcct

SEQ ID NO: 7203 - DNA, 20 bp, Artificial Sequence
  Description of Artificial Sequence: Synthetic oligonucleotide
  Target: SCN10A; (-) strand; PAM type: NNGRRT; PAM sequence: CTGAGT
actggccccttaaagaggac

SEQ ID NO: 7204 - DNA, 20 bp, Artificial Sequence
  Description of Artificial Sequence: Synthetic oligonucleotide
  Target: SCN10A; (-) strand; PAM type: NNGRRT; PAM sequence: AAGGAT
gccgacactcccagcagatg

SEQ ID NO: 7205 - DNA, 20 bp, Artificial Sequence
  Description of Artificial Sequence: Synthetic oligonucleotide
  Target: SCN10A; (-) strand; PAM type: NNGRRT; PAM sequence: GGGGGT
cccagcgaagccatcaggaa

SEQ ID NO: 7206 - DNA, 20 bp, Artificial Sequence
  Description of Artificial Sequence: Synthetic oligonucleotide
  Target: SCN10A; (-) strand; PAM type: NNGRRT; PAM sequence: GAGGAT
ctgagggctgccccagcggg

SEQ ID NO: 7207 - DNA, 20 bp, Artificial Sequence
  Description of Artificial Sequence: Synthetic oligonucleotide
  Target: SCN10A; (-) strand; PAM type: NNGRRT; PAM sequence: GTGGGT
atcggaagctgagaaaagat

SEQ ID NO: 7208 - DNA, 20 bp, Artificial Sequence
  Description of Artificial Sequence: Synthetic oligonucleotide
  Target: SCN10A; (-) strand; PAM type: NNGRRT; PAM sequence: CAGAAT
cttagtcctcgtcctagaca

SEQ ID NO: 7209 - DNA, 20 bp, Artificial Sequence
  Description of Artificial Sequence: Synthetic oligonucleotide
  Target: SCN10A; (-) strand; PAM type: NNGRRT; PAM sequence: TTGGAT
tgtgtactcccttagagacg

SEQ ID NO: 7210 - DNA, 20 bp, Artificial Sequence
  Description of Artificial Sequence: Synthetic oligonucleotide
  Target: SCN10A; (-) strand; PAM type: NNGRRT; PAM sequence: TTGAAT
atgtttacttctaatacaca

SEQ ID NO: 7211 - DNA, 20 bp, Artificial Sequence
  Description of Artificial Sequence: Synthetic oligonucleotide
  Target: SCN10A; (-) strand; PAM type: NNGRRT; PAM sequence: TTGAGT
gccttctttaggctttcact

SEQ ID NO: 7212 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ctcttctccttccagtcctg

SEQ ID NO: 7213 - DNA, 20 bp, Artificial Sequence
  Description of Artificial Sequence: Synthetic oligonucleotide
  Target: SCN10A; (-) strand; PAM type: NNGRRT; PAM sequence: CTGGGT
gcagggactggtctgccatc

SEQ ID NO: 7214 - DNA, 20 bp, Artificial Sequence
  Description of Artificial Sequence: Synthetic oligonucleotide
  Target: SCN10A; (-) strand; PAM type: NNGRRT; PAM sequence: GAGAGT
gacgcaaagccaagggagaa

SEQ ID NO: 7215 - DNA, 20 bp, Artificial Sequence
  Description of Artificial Sequence: Synthetic oligonucleotide
  Target: SCN10A; (-) strand; PAM type: NNGRRT; PAM sequence: TAGGGT
ctgagaggtgggaggaaaac

SEQ ID NO: 7216 - DNA, 20 bp, Artificial Sequence
  Description of Artificial Sequence: Synthetic oligonucleotide
  Target: SCN10A; (-) strand; PAM type: NNGRRT; PAM sequence: CAGGAT
agcacaggtgcgggacgagg

SEQ ID NO: 7217 - DNA, 20 bp, Artificial Sequence
  Description of Artificial Sequence: Synthetic oligonucleotide
  Target: SCN10A; (-) strand; PAM type: NNGRRT; PAM sequence: AAGGGT
taaatgccagattgtccagg

SEQ ID NO: 7218 - DNA, 20 bp, Artificial Sequence
  Description of Artificial Sequence: Synthetic oligonucleotide
  Target: SCN10A; (-) strand; PAM type: NNGRRT; PAM sequence: CAGGGT
agggctgggaatagagagtt

SEQ ID NO: 7219 - DNA, 20 bp, Artificial Sequence
  Description of Artificial Sequence: Synthetic oligonucleotide
  Target: SCN10A; (-) strand; PAM type: NNGRRT; PAM sequence: GAGAGT
tagttgaagggctgggaata

SEQ ID NO: 7220 - DNA, 20 bp, Artificial Sequence
  Description of Artificial Sequence: Synthetic oligonucleotide
  Target: SCN10A; (-) strand; PAM type: NNGRRT; PAM sequence: GGGAAT
aggtaattagttgaagggct

SEQ ID NO: 7221 - DNA, 20 bp, Artificial Sequence
  Description of Artificial Sequence: Synthetic oligonucleotide
  Target: SCN10A; (-) strand; PAM type: NNGRRT; PAM sequence: CTGAAT
agacatctctaaggccctgg

SEQ ID NO: 7222 - DNA, 20 bp, Artificial Sequence
  Description of Artificial Sequence: Synthetic oligonucleotide
  Target: SCN10A; (-) strand; PAM type: NNGRRT; PAM sequence: CAGAGT
gccttatgggaatagagatt

SEQ ID NO: 7223 - DNA, 20 bp, Artificial Sequence
  Description of Artificial Sequence: Synthetic oligonucleotide
  Target: SCN10A; (-) strand; PAM type: NNGRRT; PAM sequence: GGGAAT
tttgaataacaaggccttat

SEQ ID NO: 7224 - DNA, 20 bp, Artificial Sequence
  Description of Artificial Sequence: Synthetic oligonucleotide
  Target: SCN10A; (-) strand; PAM type: NNGRRT; PAM sequence: TTGAAT
tgccctcagtgacccacact

SEQ ID NO: 7225 - DNA, 20 bp, Artificial Sequence
  Description of Artificial Sequence: Synthetic oligonucleotide
  Target: SCN10A; (-) strand; PAM type: NNGRRT; PAM sequence: GAGAAT
ataaatctgtggcagggcct

SEQ ID NO: 7226 - DNA, 20 bp, Artificial Sequence
  Description of Artificial Sequence: Synthetic oligonucleotide
  Target: SCN10A; (-) strand; PAM type: NNGRRT; PAM sequence: GTGAGT
ggctgcaagcatttgagtga

SEQ ID NO: 7227 - DNA, 20 bp, Artificial Sequence
  Description of Artificial Sequence: Synthetic oligonucleotide
  Target: SCN10A; (-) strand; PAM type: NNGRRT; PAM sequence: GTGAGT
acctggctgcaagcatttga

SEQ ID NO: 7228 - DNA, 20 bp, Artificial Sequence
  Description of Artificial Sequence: Synthetic oligonucleotide
  Target: SCN10A; (-) strand; PAM type: NNGRRT; PAM sequence: TTGAGT
ccaaacctggctgcaagcat

SEQ ID NO: 7229 - DNA, 20 bp, Artificial Sequence
  Description of Artificial Sequence: Synthetic oligonucleotide
  Target: SCN10A; (-) strand; PAM type: NNGRRT; PAM sequence: GTGGGT
aaggccctggagctgcatca

SEQ ID NO: 7230 - DNA, 20 bp, Artificial Sequence
  Description of Artificial Sequence: Synthetic oligonucleotide
  Target: SCN10A; (-) strand; PAM type: NNGRRT; PAM sequence: AGGAAT
tgcccccaaatcctccagat

SEQ ID NO: 7231 - DNA, 20 bp, Artificial Sequence
  Description of Artificial Sequence: Synthetic oligonucleotide
  Target: SCN10A; (-) strand; PAM type: NNGRRT; PAM sequence: GTGGAT
cttcatgatcctgctcagca

SEQ ID NO: 7232 - DNA, 20 bp, Artificial Sequence
  Description of Artificial Sequence: Synthetic oligonucleotide
  Target: SCN10A; (-) strand; PAM type: NNGRRT; PAM sequence: TGGGAT
tggataccaccaagagtcca

SEQ ID NO: 7233 - DNA, 20 bp, Artificial Sequence
  Description of Artificial Sequence: Synthetic oligonucleotide
  Target: SCN10A; (-) strand; PAM type: NNGRRT; PAM sequence: AAGAGT
gctgcaaactggataccacc

SEQ ID NO: 7234 - DNA, 20 bp, Artificial Sequence
  Description of Artificial Sequence: Synthetic oligonucleotide
  Target: SCN10A; (-) strand; PAM type: NNGRRT; PAM sequence: CTGGAT
gccactgtccctgctgcaaa

SEQ ID NO: 7235 - DNA, 20 bp, Artificial Sequence
  Description of Artificial Sequence: Synthetic oligonucleotide
  Target: SCN10A; (-) strand; PAM type: NNGRRT; PAM sequence: CAGGAT
ccatcagtcacctctcccca

SEQ ID NO: 7236 - DNA, 20 bp, Artificial Sequence
  Description of Artificial Sequence: Synthetic oligonucleotide
  Target: SCN10A; (-) strand; PAM type: NNGRRT; PAM sequence: CAGAAT
atgacaagtgggtttcctag

SEQ ID NO: 7237 - DNA, 20 bp, Artificial Sequence
  Description of Artificial Sequence: Synthetic oligonucleotide
  Target: SCN10A; (-) strand; PAM type: NNGRRT; PAM sequence: GTGGGT
tttttccaagggcatgacaa

SEQ ID NO: 7238 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tcttcacccatattccagga

SEQ ID NO: 7239 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ggagaggaacacctgttggt

SEQ ID NO: 7240 - DNA, 20 bp, Artificial Sequence
  Description of Artificial Sequence: Synthetic oligonucleotide
  Target: SCN10A; (-) strand; PAM type: NNGRRT; PAM sequence: CAGAGT
gatatggctaggaaaaacat

SEQ ID NO: 7241 - DNA, 20 bp, Artificial Sequence
  Description of Artificial Sequence: Synthetic oligonucleotide
  Target: SCN10A; (-) strand; PAM type: NNGRRT; PAM sequence: AAGGAT
ccactggtgtcatctgtaag

SEQ ID NO: 7242 - DNA, 20 bp, Artificial Sequence
  Description of Artificial Sequence: Synthetic oligonucleotide
  Target: SCN10A; (-) strand; PAM type: NNGRRT; PAM sequence: TTGAGT
aagaaaaattttttaaatac

SEQ ID NO: 7243 - DNA, 20 bp, Artificial Sequence
  Description of Artificial Sequence: Synthetic oligonucleotide
  Target: SCN10A; (-) strand; PAM type: NNGRRT; PAM sequence: GGGAAT
tcaagagtccattctataaa

SEQ ID NO: 7244 - DNA, 20 bp, Artificial Sequence
  Description of Artificial Sequence: Synthetic oligonucleotide
  Target: SCN10A; (-) strand; PAM type: NNGRRT; PAM sequence: AAGAGT
atttgtgcaatgaatgaatc

SEQ ID NO: 7245 - DNA, 20 bp, Artificial Sequence
  Description of Artificial Sequence: Synthetic oligonucleotide
  Target: SCN10A; (-) strand; PAM type: NNGRRT; PAM sequence: ATGAAT
aataaatatttgtgcaatga

SEQ ID NO: 7246 - DNA, 20 bp, Artificial Sequence
  Description of Artificial Sequence: Synthetic oligonucleotide
  Target: SCN10A; (-) strand; PAM type: NNGRRT; PAM sequence: ATGAAT
tctcaataaatatttgtgca

SEQ ID NO: 7247 - DNA, 20 bp, Artificial Sequence
  Description of Artificial Sequence: Synthetic oligonucleotide
  Target: SCN10A; (-) strand; PAM type: NNGRRT; PAM sequence: TTGAGT
tgagttctaaaccagccctc

SEQ ID NO: 7248 - DNA, 20 bp, Artificial Sequence
  Description of Artificial Sequence: Synthetic oligonucleotide
  Target: SCN10A; (-) strand; PAM type: NNGRRT; PAM sequence: GTGAGT
ttaccctcaaaaacccctcc

SEQ ID NO: 7249 - DNA, 20 bp, Artificial Sequence
  Description of Artificial Sequence: Synthetic oligonucleotide
  Target: SCN10A; (-) strand; PAM type: NNGRRT; PAM sequence: TGGGAT
cagttgagcgaacactcacc

SEQ ID NO: 7250 - DNA, 20 bp, Artificial Sequence
  Description of Artificial Sequence: Synthetic oligonucleotide
  Target: SCN10A; (-) strand; PAM type: NNGRRT; PAM sequence: CAGAAT
acactgatgttaattagggc

SEQ ID NO: 7251 - DNA, 20 bp, Artificial Sequence
  Description of Artificial Sequence: Synthetic oligonucleotide
  Target: SCN10A; (-) strand; PAM type: NNGRRT; PAM sequence: GGGAGT
ccctgggcttctcccctgca

SEQ ID NO: 7252 - DNA, 20 bp, Artificial Sequence
  Description of Artificial Sequence: Synthetic oligonucleotide
  Target: SCN10A; (-) strand; PAM type: NNGRRT; PAM sequence: ACGAGT
tccccgggccccgcggagag

SEQ ID NO: 7253 - DNA, 20 bp, Artificial Sequence
  Description of Artificial Sequence: Synthetic oligonucleotide
  Target: SCN10A; (-) strand; PAM type: NNGRRT; PAM sequence: ATGGGT
cagctggcgaggcaccaaac

SEQ ID NO: 7254 - DNA, 20 bp, Artificial Sequence
  Description of Artificial Sequence: Synthetic oligonucleotide
  Target: SCN10A; (-) strand; PAM type: NNGRRT; PAM sequence: ATGGGT
agtgaatgctgagagtcgtt

SEQ ID NO: 7255 - DNA, 20 bp, Artificial Sequence
  Description of Artificial Sequence: Synthetic oligonucleotide
  Target: SCN10A; (-) strand; PAM type: NNGRRT; PAM sequence: GAGAGT
attcaagcccagtgaatgct

SEQ ID NO: 7256 - DNA, 20 bp, Artificial Sequence
  Description of Artificial Sequence: Synthetic oligonucleotide
  Target: SCN10A; (-) strand; PAM type: NNGRRT; PAM sequence: GTGAAT
tgattaaatattcaagccca

SEQ ID NO: 7257 - DNA, 20 bp, Artificial Sequence
  Description of Artificial Sequence: Synthetic oligonucleotide
  Target: SCN10A; (-) strand; PAM type: NNGRRT; PAM sequence: TTGAAT
agagcaacttcaacccctaa

SEQ ID NO: 7258 - DNA, 20 bp, Artificial Sequence
  Description of Artificial Sequence: Synthetic oligonucleotide
  Target: SCN10A; (-) strand; PAM type: NNGRRT; PAM sequence: TTGGGT
atggggacccgccccaccat

SEQ ID NO: 7259 - DNA, 20 bp, Artificial Sequence
  Description of Artificial Sequence: Synthetic oligonucleotide
  Target: SCN10A; (-) strand; PAM type: NNGRRT; PAM sequence: CTGGGT
atgttttcagtacacaactt

SEQ ID NO: 7260 - DNA, 20 bp, Artificial Sequence
  Description of Artificial Sequence: Synthetic oligonucleotide
  Target: SCN10A; (-) strand; PAM type: NNGRRT; PAM sequence: GTGGAT
agggctgtcacattctgcac

SEQ ID NO: 7261 - DNA, 20 bp, Artificial Sequence
  Description of Artificial Sequence: Synthetic oligonucleotide
  Target: SCN10A; (-) strand; PAM type: NNGRRT; PAM sequence: CTGGGT
cagaagccgcttggttccca

SEQ ID NO: 7262 - DNA, 20 bp, Artificial Sequence
  Description of Artificial Sequence: Synthetic oligonucleotide
  Target: SCN10A; (-) strand; PAM type: NNGRRT; PAM sequence: GTGGGT
tgggacgggatttgggggct

SEQ ID NO: 7263 - DNA, 20 bp, Artificial Sequence
  Description of Artificial Sequence: Synthetic oligonucleotide
  Target: SCN10A; (-) strand; PAM type: NNGRRT; PAM sequence: CGGGAT
gataagagggagggctggga

SEQ ID NO: 7264 - DNA, 20 bp, Artificial Sequence
  Description of Artificial Sequence: Synthetic oligonucleotide
  Target: SCN10A; (-) strand; PAM type: NNGRRT; PAM sequence: CAGGGT
ctaggcaaggctgaccacag

SEQ ID NO: 7265 - DNA, 20 bp, Artificial Sequence
  Description of Artificial Sequence: Synthetic oligonucleotide
  Target: SCN10A; (-) strand; PAM type: NNGRRT; PAM sequence: AAGAAT
ttatcaagcccttcagcttg

SEQ ID NO: 7266 - DNA, 20 bp, Artificial Sequence
  Description of Artificial Sequence: Synthetic oligonucleotide
  Target: SCN10A; (-) strand; PAM type: NNGRRT; PAM sequence: CTGAGT
tttaatttgacacctagcca

SEQ ID NO: 7267 - DNA, 20 bp, Artificial Sequence
  Description of Artificial Sequence: Synthetic oligonucleotide
  Target: SCN10A; (-) strand; PAM type: NNGRRT; PAM sequence: AAGAAT
aataacactgccttcaattc

SEQ ID NO: 7268 - DNA, 20 bp, Artificial Sequence
  Description of Artificial Sequence: Synthetic oligonucleotide
  Target: SCN10A; (-) strand; PAM type: NNGRRT; PAM sequence: TAGGAT
gagctggaagattagaggtt

SEQ ID NO: 7269 - DNA, 20 bp, Artificial Sequence
  Description of Artificial Sequence: Synthetic oligonucleotide
  Target: SCN10A; (-) strand; PAM type: NNGRRT; PAM sequence: GTGAGT
tagggagaggctctctatag

SEQ ID NO: 7270 - DNA, 20 bp, Artificial Sequence
  Description of Artificial Sequence: Synthetic oligonucleotide
  Target: SCN10A; (-) strand; PAM type: NNGRRT; PAM sequence: AAGAGT
atctttcagagccagcaaat

SEQ ID NO: 7271 - DNA, 20 bp, Artificial Sequence
  Description of Artificial Sequence: Synthetic oligonucleotide
  Target: SCN10A; (-) strand; PAM type: NNGRRT; PAM sequence: TAGGAT
gaatggtaatgcctacttgg

SEQ ID NO: 7272 - DNA, 20 bp, Artificial Sequence
  Description of Artificial Sequence: Synthetic oligonucleotide
  Target: SCN10A; (-) strand; PAM type: NNGRRT; PAM sequence: CTGAAT
ccatttattcatctatgaaa

SEQ ID NO: 7273 - DNA, 20 bp, Artificial Sequence
  Description of Artificial Sequence: Synthetic oligonucleotide
  Target: SCN10A; (-) strand; PAM type: NNGRRT; PAM sequence: AAGAGT
tggttctaggtatagaaaga

SEQ ID NO: 7274 - DNA, 20 bp, Artificial Sequence
  Description of Artificial Sequence: Synthetic oligonucleotide
  Target: SCN10A; (-) strand; PAM type: NNGRRT; PAM sequence: CAGGGT
ccattgccacaatctcactc

SEQ ID NO: 7275 - DNA, 20 bp, Artificial Sequence
  Description of Artificial Sequence: Synthetic oligonucleotide
  Target: SCN10A; (-) strand; PAM type: NNGRRT; PAM sequence: GGGAAT
ataacctcatttcttatcct

SEQ ID NO: 7276 - DNA, 20 bp, Artificial Sequence
  Description of Artificial Sequence: Synthetic oligonucleotide
  Target: SCN10A; (-) strand; PAM type: NNGRRT; PAM sequence: TGGGGT
ctggagggtggcggtgaagg

SEQ ID NO: 7277 - DNA, 20 bp, Artificial Sequence
  Description of Artificial Sequence: Synthetic oligonucleotide
  Target: SCN10A; (-) strand; PAM type: NNGRRT; PAM sequence: GAGGGT
cagtgggctggtagaggctg

SEQ ID NO: 7278 - DNA, 20 bp, Artificial Sequence
  Description of Artificial Sequence: Synthetic oligonucleotide
  Target: SCN10A; (-) strand; PAM type: NNGRRT; PAM sequence: ATGAGT
cctgggtgagacgtggaaag

SEQ ID NO: 7279 - DNA, 20 bp, Artificial Sequence
  Description of Artificial Sequence: Synthetic oligonucleotide
  Target: SCN10A; (-) strand; PAM type: NNGRRT; PAM sequence: CTGGGT
ctgaggacctggctccatcc

SEQ ID NO: 7280 - DNA, 20 bp, Artificial Sequence
  Description of Artificial Sequence: Synthetic oligonucleotide
  Target: SCN10A; (-) strand; PAM type: NNGRRT; PAM sequence: AAGGGT
aaatttagaactggtcatct

SEQ ID NO: 7281 - DNA, 20 bp, Artificial Sequence
  Description of Artificial Sequence: Synthetic oligonucleotide
  Target: SCN10A; (-) strand; PAM type: NNGRRT; PAM sequence: ATGAGT
gtatgtatatatgtatgtac

SEQ ID NO: 7282 - DNA, 20 bp, Artificial Sequence
  Description of Artificial Sequence: Synthetic oligonucleotide
  Target: SCN10A; (-) strand; PAM type: NNGRRT; PAM sequence: AAGGAT
tcttataattaatggagccc

SEQ ID NO: 7283 - DNA, 20 bp, Artificial Sequence
  Description of Artificial Sequence: Synthetic oligonucleotide
  Target: SCN10A; (-) strand; PAM type: NNGRRT; PAM sequence: CTGAAT
atatttagtcatcaaaacag

SEQ ID NO: 7284 - DNA, 20 bp, Artificial Sequence
  Description of Artificial Sequence: Synthetic oligonucleotide
  Target: SCN10A; (-) strand; PAM type: NNGRRT; PAM sequence: TTGAGT
tggtccagaaaagctgtgct

SEQ ID NO: 7285 - DNA, 20 bp, Artificial Sequence
  Description of Artificial Sequence: Synthetic oligonucleotide
  Target: SCN10A; (-) strand; PAM type: NNGRRT; PAM sequence: CAGGAT
taatgagatttctctaagaa

SEQ ID NO: 7286 - DNA, 20 bp, Artificial Sequence
  Description of Artificial Sequence: Synthetic oligonucleotide
  Target: SCN10A; (-) strand; PAM type: NNGRRT; PAM sequence: GGGGAT
aaggccaccttgaggtgctt

SEQ ID NO: 7287 - DNA, 20 bp, Artificial Sequence
  Description of Artificial Sequence: Synthetic oligonucleotide
  Target: SCN10A; (-) strand; PAM type: NNGRRT; PAM sequence: GGGAGT
attccccaggcagacaaaca

SEQ ID NO: 7288 - DNA, 20 bp, Artificial Sequence
  Description of Artificial Sequence: Synthetic oligonucleotide
  Target: SCN10A; (-) strand; PAM type: NNGRRT; PAM sequence: CAGAAT
cagggcctggaagaaaaagt

SEQ ID NO: 7289 - DNA, 20 bp, Artificial Sequence
  Description of Artificial Sequence: Synthetic oligonucleotide
  Target: SCN10A; (-) strand; PAM type: NNGRRT; PAM sequence: AGGAGT
aaccatgccaagctttccag

SEQ ID NO: 7290 - DNA, 20 bp, Artificial Sequence
  Description of Artificial Sequence: Synthetic oligonucleotide
  Target: SCN10A; (-) strand; PAM type: NNGRRT; PAM sequence: TTGAGT
gtggggaggggcttcagggc

SEQ ID NO: 7291 - DNA, 20 bp, Artificial Sequence
  Description of Artificial Sequence: Synthetic oligonucleotide
  Target: SCN10A; (-) strand; PAM type: NNGRRT; PAM sequence: AAGAGT
gtgatccccaaaggacaggt

SEQ ID NO: 7292 - DNA, 20 bp, Artificial Sequence
  Description of Artificial Sequence: Synthetic oligonucleotide
  Target: SCN10A; (-) strand; PAM type: NNGRRT; PAM sequence: GAGGAT
aatctgatcttgatgacttg

SEQ ID NO: 7293 - DNA, 20 bp, Artificial Sequence
  Description of Artificial Sequence: Synthetic oligonucleotide
  Target: SCN10A; (-) strand; PAM type: NNGRRT; PAM sequence: GTGAAT
ctctgtgcccattgctgagg

SEQ ID NO: 7294 - DNA, 20 bp, Artificial Sequence
  Description of Artificial Sequence: Synthetic oligonucleotide
  Target: SCN10A; (-) strand; PAM type: NNGRRT; PAM sequence: GAGGGT
gggtctctgtgcccattgct

SEQ ID NO: 7295 - DNA, 20 bp, Artificial Sequence
  Description of Artificial Sequence: Synthetic oligonucleotide
  Target: SCN10A; (-) strand; PAM type: NNGRRT; PAM sequence: GTGGGT
ttcatcgctaatccgactgt

SEQ ID NO: 7296 - DNA, 20 bp, Artificial Sequence
  Description of Artificial Sequence: Synthetic oligonucleotide
  Target: SCN10A; (-) strand; PAM type: NNGRRT; PAM sequence: AGGGAT
tccaagctcccagaggcccc

SEQ ID NO: 7297 - DNA, 20 bp, Artificial Sequence
  Description of Artificial Sequence: Synthetic oligonucleotide
  Target: SCN10A; (-) strand; PAM type: NNGRRT; PAM sequence: ACGGAT
aacctgcaggtggccctggc

SEQ ID NO: 7298 - DNA, 20 bp, Artificial Sequence
  Description of Artificial Sequence: Synthetic oligonucleotide
  Target: SCN10A; (-) strand; PAM type: NNGRRT; PAM sequence: CCGGGT
cccccaaaagggacagcatc

SEQ ID NO: 7299 - DNA, 20 bp, Artificial Sequence
  Description of Artificial Sequence: Synthetic oligonucleotide
  Target: SCN10A; (-) strand; PAM type: NNGRRT; PAM sequence: GCGGGT
tccaagcctcgtccactgag

SEQ ID NO: 7300 - DNA, 20 bp, Artificial Sequence
  Description of Artificial Sequence: Synthetic oligonucleotide
  Target: SCN10A; (-) strand; PAM type: NNGRRT; PAM sequence: GAGGGT
agcccagggctttggcacat

SEQ ID NO: 7301 - DNA, 20 bp, Artificial Sequence
  Description of Artificial Sequence: Synthetic oligonucleotide
  Target: SCN10A; (-) strand; PAM type: NNGRRT; PAM sequence: CAGAGT
gcaagatgtgcccaggattc

SEQ ID NO: 7302 - DNA, 20 bp, Artificial Sequence
  Description of Artificial Sequence: Synthetic oligonucleotide
  Target: SCN10A; (-) strand; PAM type: NNGRRT; PAM sequence: CAGGAT
tggaagcagcaagatgtgcc

SEQ ID NO: 7303 - DNA, 20 bp, Artificial Sequence
  Description of Artificial Sequence: Synthetic oligonucleotide
  Target: SCN10A; (-) strand; PAM type: NNGRRT; PAM sequence: AGGGAT
tccaccctggtgcctgagcc

SEQ ID NO: 7304 - DNA, 20 bp, Artificial Sequence
  Description of Artificial Sequence: Synthetic oligonucleotide
  Target: SCN10A; (-) strand; PAM type: NNGRRT; PAM sequence: ATGAGT
ccaacttgggttctttcctc

SEQ ID NO: 7305 - DNA, 20 bp, Artificial Sequence
  Description of Artificial Sequence: Synthetic oligonucleotide
  Target: SCN10A; (-) strand; PAM type: NNGRRT; PAM sequence: TTGGGT
tgccctggacatcaaccaac

SEQ ID NO: 7306 - DNA, 20 bp, Artificial Sequence
  Description of Artificial Sequence: Synthetic oligonucleotide
  Target: SCN10A; (-) strand; PAM type: NNGRRT; PAM sequence: GAGGAT
gggactgactggttgtgtgg

SEQ ID NO: 7307 - DNA, 20 bp, Artificial Sequence
  Description of Artificial Sequence: Synthetic oligonucleotide
  Target: SCN10A; (-) strand; PAM type: NNGRRT; PAM sequence: TGGGGT
tccacccactctggtcatgg

SEQ ID NO: 7308 - DNA, 20 bp, Artificial Sequence
  Description of Artificial Sequence: Synthetic oligonucleotide
  Target: SCN10A; (-) strand; PAM type: NNGRRT; PAM sequence: ATGGGT
ggctgcagggagggggcaca

SEQ ID NO: 7309 - DNA, 20 bp, Artificial Sequence
  Description of Artificial Sequence: Synthetic oligonucleotide
  Target: SCN10A; (-) strand; PAM type: NNGRRT; PAM sequence: GAGAAT
cttactcatgggtttactgg

SEQ ID NO: 7310 - DNA, 20 bp, Artificial Sequence
  Description of Artificial Sequence: Synthetic oligonucleotide
  Target: SCN10A; (-) strand; PAM type: NNGRRT; PAM sequence: ATGGGT
caagaaaataatgcttactc

SEQ ID NO: 7311 - DNA, 20 bp, Artificial Sequence
  Description of Artificial Sequence: Synthetic oligonucleotide
  Target: SCN10A; (-) strand; PAM type: NNGRRT; PAM sequence: GTGGGT
tctgctccaccatttactag

SEQ ID NO: 7312 - DNA, 20 bp, Artificial Sequence
  Description of Artificial Sequence: Synthetic oligonucleotide
  Target: SCN10A; (-) strand; PAM type: NNGRRT; PAM sequence: TAGAAT
tagaaaagaaagacctggtg

SEQ ID NO: 7313 - DNA, 20 bp, Artificial Sequence
  Description of Artificial Sequence: Synthetic oligonucleotide
  Target: SCN10A; (-) strand; PAM type: NNGRRT; PAM sequence: AGGAAT
tgggaggcagtctgacttgc

SEQ ID NO: 7314 - DNA, 20 bp, Artificial Sequence
  Description of Artificial Sequence: Synthetic oligonucleotide
  Target: SCN10A; (-) strand; PAM type: NNGRRT; PAM sequence: TGGGAT
tcaaacttttcaaattcatg

SEQ ID NO: 7315 - DNA, 20 bp, Artificial Sequence
  Description of Artificial Sequence: Synthetic oligonucleotide
  Target: SCN10A; (-) strand; PAM type: NNGRRT; PAM sequence: CTGGGT
ctggggaaaggagaaggctt

SEQ ID NO: 7316 - DNA, 20 bp, Artificial Sequence
  Description of Artificial Sequence: Synthetic oligonucleotide
  Target: SCN10A; (-) strand; PAM type: NNGRRT; PAM sequence: GTGAGT
tggtgctagggaacctggtg

SEQ ID NO: 7317 - DNA, 20 bp, Artificial Sequence
  Description of Artificial Sequence: Synthetic oligonucleotide
  Target: SCN10A; (-) strand; PAM type: NNGRRT; PAM sequence: GTGGAT
ttccgtatcctctgtggaga

SEQ ID NO: 7318 - DNA, 20 bp, Artificial Sequence
  Description of Artificial Sequence: Synthetic oligonucleotide
  Target: SCN10A; (-) strand; PAM type: NNGRRT; PAM sequence: GAGAGT
tgtcttccgtatcctctgtg

SEQ ID NO: 7319 - DNA, 20 bp, Artificial Sequence
  Description of Artificial Sequence: Synthetic oligonucleotide
  Target: SCN10A; (-) strand; PAM type: NNGRRT; PAM sequence: TGGGAT
cagaaaacgccctggtttaa

SEQ ID NO: 7320 - DNA, 20 bp, Artificial Sequence
  Description of Artificial Sequence: Synthetic oligonucleotide
  Target: SCN10A; (-) strand; PAM type: NNGRRT; PAM sequence: TTGAGT
atagaaggcagatcatattt

SEQ ID NO: 7321 - DNA, 20 bp, Artificial Sequence
  Description of Artificial Sequence: Synthetic oligonucleotide
  Target: SCN10A; (-) strand; PAM type: NNGRRT; PAM sequence: CAGAGT
tcaggcctgtggctatagaa

SEQ ID NO: 7322 - DNA, 20 bp, Artificial Sequence
  Description of Artificial Sequence: Synthetic oligonucleotide
  Target: SCN10A; (-) strand; PAM type: NNGRRT; PAM sequence: AGGGAT
agaagaggcccatattcagg

SEQ ID NO: 7323 - DNA, 20 bp, Artificial Sequence
  Description of Artificial Sequence: Synthetic oligonucleotide
  Target: SCN10A; (-) strand; PAM type: NNGRRT; PAM sequence: GTGGGT
gccaatacctatcgaatgca

SEQ ID NO: 7324 - DNA, 20 bp, Artificial Sequence
  Description of Artificial Sequence: Synthetic oligonucleotide
  Target: SCN10A; (-) strand; PAM type: NNGRRT; PAM sequence: TCGAAT
agatgttttgccaataccta

SEQ ID NO: 7325 - DNA, 20 bp, Artificial Sequence
  Description of Artificial Sequence: Synthetic oligonucleotide
  Target: SCN10A; (-) strand; PAM type: NNGRRT; PAM sequence: CTGAGT
attaaatcaacttatgaatg

SEQ ID NO: 7326 - DNA, 20 bp, Artificial Sequence
  Description of Artificial Sequence: Synthetic oligonucleotide
  Target: SCN10A; (-) strand; PAM type: NNGRRT; PAM sequence: ATGAAT
ttggtcaattaaatcaactt

SEQ ID NO: 7327 - DNA, 20 bp, Artificial Sequence
  Description of Artificial Sequence: Synthetic oligonucleotide
  Target: SCN10A; (-) strand; PAM type: NNGRRT; PAM sequence: GGGGGT
cctgcacggctggagttctg

SEQ ID NO: 7328 - DNA, 20 bp, Artificial Sequence
  Description of Artificial Sequence: Synthetic oligonucleotide
  Target: SCN10A; (-) strand; PAM type: NNGRRT; PAM sequence: TGGAGT
ctgccatgcacctgcacggc

SEQ ID NO: 7329 - DNA, 20 bp, Artificial Sequence
  Description of Artificial Sequence: Synthetic oligonucleotide
  Target: SCN10A; (-) strand; PAM type: NNGRRT; PAM sequence: TTGAGT
tcttgtgggacttagcatat

SEQ ID NO: 7330 - DNA, 20 bp, Artificial Sequence
  Description of Artificial Sequence: Synthetic oligonucleotide
  Target: SCN10A; (-) strand; PAM type: NNGRRT; PAM sequence: ATGGGT
cgtgggatttactcacggat

SEQ ID NO: 7331 - DNA, 20 bp, Artificial Sequence
  Description of Artificial Sequence: Synthetic oligonucleotide
  Target: SCN10A; (-) strand; PAM type: NNGRRT; PAM sequence: ACGGAT
tcctcccgtgggatttactc

SEQ ID NO: 7332 - DNA, 20 bp, Artificial Sequence
  Description of Artificial Sequence: Synthetic oligonucleotide
  Target: SCN10A; (-) strand; PAM type: NNGRRT; PAM sequence: TGGGAT
caggattaaacctcctcccg

SEQ ID NO: 7333 - DNA, 20 bp, Artificial Sequence
  Description of Artificial Sequence: Synthetic oligonucleotide
  Target: SCN10A; (-) strand; PAM type: NNGRRT; PAM sequence: CAGGAT
atacagcacttactgtataa

SEQ ID NO: 7334 - DNA, 20 bp, Artificial Sequence
  Description of Artificial Sequence: Synthetic oligonucleotide
  Target: SCN10A; (-) strand; PAM type: NNGRRT; PAM sequence: TTGGGT
tgaggagagtaacttccaga

SEQ ID NO: 7335 - DNA, 20 bp, Artificial Sequence
  Description of Artificial Sequence: Synthetic oligonucleotide
  Target: SCN10A; (-) strand; PAM type: NNGRRT; PAM sequence: GAGAGT
agctctgcttcccatatgag

SEQ ID NO: 7336 - DNA, 20 bp, Artificial Sequence
  Description of Artificial Sequence: Synthetic oligonucleotide
  Target: SCN10A; (-) strand; PAM type: NNGRRT; PAM sequence: CAGAGT
ctgcctctgtgaccagtcca

SEQ ID NO: 7337 - DNA, 20 bp, Artificial Sequence
  Description of Artificial Sequence: Synthetic oligonucleotide
  Target: SCN10A; (-) strand; PAM type: NNGRRT; PAM sequence: TGGGAT
acatgaagggtatagctctt

SEQ ID NO: 7338 - DNA, 20 bp, Artificial Sequence
  Description of Artificial Sequence: Synthetic oligonucleotide
  Target: SCN10A; (-) strand; PAM type: NNGRRT; PAM sequence: AAGGGT
ttgtggttcatccttacatg

SEQ ID NO: 7339 - DNA, 20 bp, Artificial Sequence
  Description of Artificial Sequence: Synthetic oligonucleotide
  Target: SCN10A; (-) strand; PAM type: NNGRRT; PAM sequence: TGGGAT
caattttccttgcattctcc

SEQ ID NO: 7340 - DNA, 20 bp, Artificial Sequence
  Description of Artificial Sequence: Synthetic oligonucleotide
  Target: SCN10A; (-) strand; PAM type: NNGRRT; PAM sequence: GTGAAT
acttaaaatacctaggtagt

SEQ ID NO: 7341 - DNA, 20 bp, Artificial Sequence
  Description of Artificial Sequence: Synthetic oligonucleotide
  Target: SCN10A; (-) strand; PAM type: NNGRRT; PAM sequence: TAGAAT
taattctgcagagcactttg

SEQ ID NO: 7342 - DNA, 20 bp, Artificial Sequence
  Description of Artificial Sequence: Synthetic oligonucleotide
  Target: SCN10A; (-) strand; PAM type: NNGRRT; PAM sequence: GGGAAT
aactcttaaacaatttttga

SEQ ID NO: 7343 - DNA, 20 bp, Artificial Sequence
  Description of Artificial Sequence: Synthetic oligonucleotide
  Target: SCN10A; (-) strand; PAM type: NNGRRT; PAM sequence: TGGAAT
aattctatcatctgaagaaa

SEQ ID NO: 7344 - DNA, 20 bp, Artificial Sequence
  Description of Artificial Sequence: Synthetic oligonucleotide
  Target: SCN10A; (-) strand; PAM type: NNGRRT; PAM sequence: AAGAGT
gtattatatttttcatttct

SEQ ID NO: 7345 - DNA, 20 bp, Artificial Sequence
  Description of Artificial Sequence: Synthetic oligonucleotide
  Target: SCN10A; (-) strand; PAM type: NNGRRT; PAM sequence: CTGAAT
atgtctctctaggttacatt

SEQ ID NO: 7346 - DNA, 20 bp, Artificial Sequence
  Description of Artificial Sequence: Synthetic oligonucleotide
  Target: SCN10A; (-) strand; PAM type: NNGRRT; PAM sequence: TTGAAT
gcttaagatatactgacttc

SEQ ID NO: 7347 - DNA, 20 bp, Artificial Sequence
  Description of Artificial Sequence: Synthetic oligonucleotide
  Target: SCN10A; (-) strand; PAM type: NNGRRT; PAM sequence: CTGGAT
taactgttattccttccttt

SEQ ID NO: 7348 - DNA, 20 bp, Artificial Sequence
  Description of Artificial Sequence: Synthetic oligonucleotide
  Target: SCN10A; (-) strand; PAM type: NNGRRT; PAM sequence: ATGAAT
gtctttgagagacatttctt

SEQ ID NO: 7349 - DNA, 20 bp, Artificial Sequence
  Description of Artificial Sequence: Synthetic oligonucleotide
  Target: SCN10A; (-) strand; PAM type: NNGRRT; PAM sequence: TAGAAT
tctacctgaagtacctcctt

SEQ ID NO: 7350 - DNA, 20 bp, Artificial Sequence
  Description of Artificial Sequence: Synthetic oligonucleotide
  Target: SCN10A; (-) strand; PAM type: NNGRRT; PAM sequence: TGGGAT
tacacattacatattacttc

SEQ ID NO: 7351 - DNA, 20 bp, Artificial Sequence
  Description of Artificial Sequence: Synthetic oligonucleotide
  Target: SCN10A; (-) strand; PAM type: NNGRRT; PAM sequence: GTGAGT
gtttgagtttcagattttca

SEQ ID NO: 7352 - DNA, 20 bp, Artificial Sequence
  Description of Artificial Sequence: Synthetic oligonucleotide
  Target: SCN10A; (-) strand; PAM type: NNGRRT; PAM sequence: TTGAGT
cttactctttggaacacagt

SEQ ID NO: 7353 - DNA, 20 bp, Artificial Sequence
  Description of Artificial Sequence: Synthetic oligonucleotide
  Target: SCN10A; (-) strand; PAM type: NNGRRT; PAM sequence: AAGAAT
atctgctatcctaaaaactc

SEQ ID NO: 7354 - DNA, 20 bp, Artificial Sequence
  Description of Artificial Sequence: Synthetic oligonucleotide
  Target: SCN10A; (-) strand; PAM type: NNGRRT; PAM sequence: GGGAGT
ttcatcatcacacaagggga

SEQ ID NO: 7355 - DNA, 20 bp, Artificial Sequence
  Description of Artificial Sequence: Synthetic oligonucleotide
  Target: SCN10A; (-) strand; PAM type: NNGRRT; PAM sequence: GGGAGT
gttgcatatgcaaatctggg

SEQ ID NO: 7356 - DNA, 20 bp, Artificial Sequence
  Description of Artificial Sequence: Synthetic oligonucleotide
  Target: SCN10A; (-) strand; PAM type: NNGRRT; PAM sequence: ATGGGT
ttatctcttcatgcttactc

SEQ ID NO: 7357 - DNA, 20 bp, Artificial Sequence
  Description of Artificial Sequence: Synthetic oligonucleotide
  Target: SCN10A; (-) strand; PAM type: NNGRRT; PAM sequence: GAGAGT
ggaaggaaaggggaggtttg

SEQ ID NO: 7358 - DNA, 20 bp, Artificial Sequence
  Description of Artificial Sequence: Synthetic oligonucleotide
  Target: SCN10A; (-) strand; PAM type: NNGRRT; PAM sequence: CGGGAT
aatgtttagtgggtggatac

SEQ ID NO: 7359 - DNA, 20 bp, Artificial Sequence
  Description of Artificial Sequence: Synthetic oligonucleotide
  Target: SCN10A; (-) strand; PAM type: NNGRRT; PAM sequence: GTGGAT
tattagaaaatgtttagtgg

SEQ ID NO: 7360 - DNA, 20 bp, Artificial Sequence
  Description of Artificial Sequence: Synthetic oligonucleotide
  Target: SCN10A; (-) strand; PAM type: NNGRRT; PAM sequence: GTGGGT
tttttattagaaaatgttta

SEQ ID NO: 7361 - DNA, 20 bp, Artificial Sequence
  Description of Artificial Sequence: Synthetic oligonucleotide
  Target: SCN10A; (-) strand; PAM type: NNGRRT; PAM sequence: GTGAAT
ttgtgtctgggaggagaaaa

SEQ ID NO: 7362 - DNA, 20 bp, Artificial Sequence
  Description of Artificial Sequence: Synthetic oligonucleotide
  Target: SCN10A; (-) strand; PAM type: NNGRRT; PAM sequence: GGGGGT
aaagggaaagaaaaagttca

SEQ ID NO: 7363 - DNA, 20 bp, Artificial Sequence
  Description of Artificial Sequence: Synthetic oligonucleotide
  Target: SCN10A; (-) strand; PAM type: NNGRRT; PAM sequence: TAGGAT
caagtagcgcctcaaggatc

SEQ ID NO: 7364 - DNA, 20 bp, Artificial Sequence
  Description of Artificial Sequence: Synthetic oligonucleotide
  Target: SCN10A; (-) strand; PAM type: NNGRRT; PAM sequence: AAGGAT
tctacttcaagtagcgcctc

SEQ ID NO: 7365 - DNA, 20 bp, Artificial Sequence
  Description of Artificial Sequence: Synthetic oligonucleotide
  Target: SCN10A; (-) strand; PAM type: NNGRRT; PAM sequence: GGGAGT
gcttgttgggaagctctcct

SEQ ID NO: 7366 - DNA, 20 bp, Artificial Sequence
  Description of Artificial Sequence: Synthetic oligonucleotide
  Target: SCN10A; (-) strand; PAM type: NNGRRT; PAM sequence: GTGAGT
cagtgataccctctaaatct

SEQ ID NO: 7367 - DNA, 20 bp, Artificial Sequence
  Description of Artificial Sequence: Synthetic oligonucleotide
  Target: SCN10A; (-) strand; PAM type: NNGRRT; PAM sequence: CTGAAT
tgccagcaatatttttgtca

SEQ ID NO: 7368 - DNA, 20 bp, Artificial Sequence
  Description of Artificial Sequence: Synthetic oligonucleotide
  Target: SCN10A; (-) strand; PAM type: NNGRRT; PAM sequence: TAGGGT
ggtttaataaacccttcccc

SEQ ID NO: 7369 - DNA, 20 bp, Artificial Sequence
  Description of Artificial Sequence: Synthetic oligonucleotide
  Target: SCN10A; (-) strand; PAM type: NNGRRT; PAM sequence: CTGGAT
atcgtcaaggctctaaactt

SEQ ID NO: 7370 - DNA, 20 bp, Artificial Sequence
  Description of Artificial Sequence: Synthetic oligonucleotide
  Target: SCN10A; (-) strand; PAM type: NNGRRT; PAM sequence: TGGAAT
taatcccattgctcactgcc

SEQ ID NO: 7371 - DNA, 20 bp, Artificial Sequence
  Description of Artificial Sequence: Synthetic oligonucleotide
  Target: SCN10A; (-) strand; PAM type: NNGRRT; PAM sequence: AAGAGT
ccattactacaagctttgct

SEQ ID NO: 7372 - DNA, 20 bp, Artificial Sequence
  Description of Artificial Sequence: Synthetic oligonucleotide
  Target: SCN10A; (-) strand; PAM type: NNGRRT; PAM sequence: AGGGAT
agtgaaaggctttttcagtc

SEQ ID NO: 7373 - DNA, 20 bp, Artificial Sequence
  Description of Artificial Sequence: Synthetic oligonucleotide
  Target: SCN10A; (-) strand; PAM type: NNGRRT; PAM sequence: CTGAGT
tatacagacaatctctaaaa

SEQ ID NO: 7374 - DNA, 20 bp, Artificial Sequence
  Description of Artificial Sequence: Synthetic oligonucleotide
  Target: SCN10A; (-) strand; PAM type: NNGRRT; PAM sequence: GAGGAT
tatttgggaggctgaggtgg

SEQ ID NO: 7375 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tacttgggaggctgagggag

SEQ ID NO: 7376 - DNA, 20 bp, Artificial Sequence
  Description of Artificial Sequence: Synthetic oligonucleotide
  Target: SCN10A; (-) strand; PAM type: NNGRRT; PAM sequence: GGGAGT
caggcggatcacctgaggtc

SEQ ID NO: 7377 - DNA, 20 bp, Artificial Sequence
  Description of Artificial Sequence: Synthetic oligonucleotide
  Target: SCN10A; (-) strand; PAM type: NNGRRT; PAM sequence: GCGGAT
actgttggaggcgcaggcag

SEQ ID NO: 7378 - DNA, 20 bp, Artificial Sequence
  Description of Artificial Sequence: Synthetic oligonucleotide
  Target: SCN10A; (-) strand; PAM type: NNGRRT; PAM sequence: TTGAAT
gggtgaggcatgagaattgc

SEQ ID NO: 7379 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tactcaggagggtgaggcat

SEQ ID NO: 7380 - DNA, 20 bp, Artificial Sequence
  Description of Artificial Sequence: Synthetic oligonucleotide
  Target: SCN10A; (-) strand; PAM type: NNGRRT; PAM sequence: GAGGGT
ctgtaatcccagctactcag

SEQ ID NO: 7381 - DNA, 20 bp, Artificial Sequence
  Description of Artificial Sequence: Synthetic oligonucleotide
  Target: SCN10A; (-) strand; PAM type: NNGRRT; PAM sequence: CTGGGT
actaaaaatatataaattag

SEQ ID NO: 7382 - DNA, 20 bp, Artificial Sequence
  Description of Artificial Sequence: Synthetic oligonucleotide
  Target: SCN10A; (-) strand; PAM type: NNGRRT; PAM sequence: AGGAGT
tgggaggattgcttgaggac

SEQ ID NO: 7383 - DNA, 20 bp, Artificial Sequence
  Description of Artificial Sequence: Synthetic oligonucleotide
  Target: SCN10A; (-) strand; PAM type: NNGRRT; PAM sequence: GAGGAT
attttgggaggccaaggtgg

SEQ ID NO: 7384 - DNA, 20 bp, Artificial Sequence
  Description of Artificial Sequence: Synthetic oligonucleotide
  Target: SCN10A; (-) strand; PAM type: NNGRRT; PAM sequence: CAGAAT
gtggctcacgcctgtaatcc

SEQ ID NO: 7385 - DNA, 20 bp, Artificial Sequence
  Description of Artificial Sequence: Synthetic oligonucleotide
  Target: SCN10A; (-) strand; PAM type: NNGRRT; PAM sequence: TGGGGT
ttaaagccaagggggccagg

SEQ ID NO: 7386 - DNA, 20 bp, Artificial Sequence
  Description of Artificial Sequence: Synthetic oligonucleotide
  Target: SCN10A; (-) strand; PAM type: NNGRRT; PAM sequence: ATGAGT
agatttttttatccatatca

SEQ ID NO: 7387 - DNA, 20 bp, Artificial Sequence
  Description of Artificial Sequence: Synthetic oligonucleotide
  Target: SCN10A; (-) strand; PAM type: NNGRRT; PAM sequence: GTGAAT
tccttcaatctgttaaagtg

SEQ ID NO: 7388 - DNA, 20 bp, Artificial Sequence
  Description of Artificial Sequence: Synthetic oligonucleotide
  Target: SCN10A; (-) strand; PAM type: NNGRRT; PAM sequence: ATGGAT
atcaagaatatttatcatga

SEQ ID NO: 7389 - DNA, 20 bp, Artificial Sequence
  Description of Artificial Sequence: Synthetic oligonucleotide
  Target: SCN10A; (-) strand; PAM type: NNGRRT; PAM sequence: ATGAAT
ttttatcaagaatatttatc

SEQ ID NO: 7390 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tcaggaagttctcttttatc

SEQ ID NO: 7391 - DNA, 20 bp, Artificial Sequence
  Description of Artificial Sequence: Synthetic oligonucleotide
  Target: SCN10A; (-) strand; PAM type: NNGRRT; PAM sequence: AAGAAT
atcaattttctgatcccaaa

SEQ ID NO: 7392 - DNA, 20 bp, Artificial Sequence
  Description of Artificial Sequence: Synthetic oligonucleotide
  Target: SCN10A; (-) strand; PAM type: NNGRRT; PAM sequence: TGGGAT
gccttggcctcctaaagtgc

SEQ ID NO: 7393 - DNA, 20 bp, Artificial Sequence
  Description of Artificial Sequence: Synthetic oligonucleotide
  Target: SCN10A; (-) strand; PAM type: NNGRRT; PAM sequence: CAGGAT
cggggtttcaccgtgttagc

SEQ ID NO: 7394 - DNA, 20 bp, Artificial Sequence
  Description of Artificial Sequence: Synthetic oligonucleotide
  Target: SCN10A; (-) strand; PAM type: NNGRRT; PAM sequence: CGGGGT
ctttgtatttttagtagaga

SEQ ID NO: 7395 - DNA, 20 bp, Artificial Sequence
  Description of Artificial Sequence: Synthetic oligonucleotide
  Target: SCN10A; (-) strand; PAM type: NNGRRT; PAM sequence: CTGAGT
cattctcctgcctcagcctc

SEQ ID NO: 7396 - DNA, 20 bp, Artificial Sequence
  Description of Artificial Sequence: Synthetic oligonucleotide
  Target: SCN10A; (-) strand; PAM type: NNGRRT; PAM sequence: CCGGGT
ctcattgccagctccacctc

SEQ ID NO: 7397 - DNA, 20 bp, Artificial Sequence
  Description of Artificial Sequence: Synthetic oligonucleotide
  Target: SCN10A; (-) strand; PAM type: NNGRRT; PAM sequence: TAGAGT
tctcgctctgtcacccaggc

SEQ ID NO: 7398 - DNA, 20 bp, Artificial Sequence
  Description of Artificial Sequence: Synthetic oligonucleotide
  Target: SCN10A; (-) strand; PAM type: NNGRRT; PAM sequence: CAGAGT
ttttttttttttttttgaga

SEQ ID NO: 7399 - DNA, 20 bp, Artificial Sequence
  Description of Artificial Sequence: Synthetic oligonucleotide
  Target: SCN10A; (-) strand; PAM type: NNGRRT; PAM sequence: ATGAGT
cacatcatgtgaaaataaca

SEQ ID NO: 7400 - DNA, 20 bp, Artificial Sequence
  Description of Artificial Sequence: Synthetic oligonucleotide
  Target: SCN10A; (-) strand; PAM type: NNGRRT; PAM sequence: TAGGAT
ggtttttataattttctcca

SEQ ID NO: 7401 - DNA, 20 bp, Artificial Sequence
  Description of Artificial Sequence: Synthetic oligonucleotide
  Target: SCN10A; (-) strand; PAM type: NNGRRT; PAM sequence: TAGAAT
gcacactttcatattcactt

SEQ ID NO: 7402 - DNA, 20 bp, Artificial Sequence
  Description of Artificial Sequence: Synthetic oligonucleotide
  Target: SCN10A; (-) strand; PAM type: NNGRRT; PAM sequence: AAGAAT
taatccacctaatttacttc

SEQ ID NO: 7403 - DNA, 20 bp, Artificial Sequence
  Description of Artificial Sequence: Synthetic oligonucleotide
  Target: SCN10A; (-) strand; PAM type: NNGRRT; PAM sequence: CAGAGT
ctatcccatgaggcaaaaac

SEQ ID NO: 7404 - DNA, 20 bp, Artificial Sequence
  Description of Artificial Sequence: Synthetic oligonucleotide
  Target: SCN10A; (-) strand; PAM type: NNGRRT; PAM sequence: TTGGAT
cccaaccacactatctaaag

SEQ ID NO: 7405 - DNA, 20 bp, Artificial Sequence
  Description of Artificial Sequence: Synthetic oligonucleotide
  Target: SCN10A; (-) strand; PAM type: NNGRRT; PAM sequence: TGGAAT
gaagtttttttcgctgtgcc

SEQ ID NO: 7406 - DNA, 20 bp, Artificial Sequence
  Description of Artificial Sequence: Synthetic oligonucleotide
  Target: SCN10A; (-) strand; PAM type: NNGRRT; PAM sequence: GAGAAT
cactggtttcccattgctct

SEQ ID NO: 7407 - DNA, 20 bp, Artificial Sequence
  Description of Artificial Sequence: Synthetic oligonucleotide
  Target: SCN10A; (-) strand; PAM type: NNGRRT; PAM sequence: CAGAGT
cacacacacacacacacaca

SEQ ID NO: 7408 - DNA, 20 bp, Artificial Sequence
  Description of Artificial Sequence: Synthetic oligonucleotide
  Target: SCN10A; (-) strand; PAM type: NNGRRT; PAM sequence: GAGAGT
tgtttgccaaaacctcaccg

SEQ ID NO: 7409 - DNA, 20 bp, Artificial Sequence
  Description of Artificial Sequence: Synthetic oligonucleotide
  Target: SCN10A; (-) strand; PAM type: NNGRRT; PAM sequence: TGGGAT
ccaccaactacacactttct

SEQ ID NO: 7410 - DNA, 20 bp, Artificial Sequence
  Description of Artificial Sequence: Synthetic oligonucleotide
  Target: SCN10A; (-) strand; PAM type: NNGRRT; PAM sequence: GGGAAT
gcccctacaggattctgcag

SEQ ID NO: 7411 - DNA, 20 bp, Artificial Sequence
  Description of Artificial Sequence: Synthetic oligonucleotide
  Target: SCN10A; (-) strand; PAM type: NNGRRT; PAM sequence: CAGGAT
tacttcacagtctgccccta

SEQ ID NO: 7412 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tactcgggaggctgaggcag

SEQ ID NO: 7413 - DNA, 20 bp, Artificial Sequence
  Description of Artificial Sequence: Synthetic oligonucleotide
  Target: SCN10A; (-) strand; PAM type: NNGRRT; PAM sequence: GCGGAT
actttgggaggccgaggcag

SEQ ID NO: 7414 - DNA, 20 bp, Artificial Sequence
  Description of Artificial Sequence: Synthetic oligonucleotide
  Target: SCN10A; (-) strand; PAM type: NNGRRT; PAM sequence: CAGAAT
acttgaaaatcttacaaggt

SEQ ID NO: 7415 - DNA, 20 bp, Artificial Sequence
  Description of Artificial Sequence: Synthetic oligonucleotide
  Target: SCN10A; (-) strand; PAM type: NNGRRT; PAM sequence: TAGAGT
catcccagggaggagaaggg

SEQ ID NO: 7416 - DNA, 20 bp, Artificial Sequence
  Description of Artificial Sequence: Synthetic oligonucleotide
  Target: SCN10A; (-) strand; PAM type: NNGRRT; PAM sequence: AAGGGT
gtcaccatcccagggaggag

SEQ ID NO: 7417 - DNA, 20 bp, Artificial Sequence
  Description of Artificial Sequence: Synthetic oligonucleotide
  Target: SCN10A; (-) strand; PAM type: NNGRRT; PAM sequence: CAGAGT
tatggcctgtccattattgt

SEQ ID NO: 7418 - DNA, 20 bp, Artificial Sequence
  Description of Artificial Sequence: Synthetic oligonucleotide
  Target: SCN10A; (-) strand; PAM type: NNGRRT; PAM sequence: AGGAAT
gaaaggagacacagagagag

SEQ ID NO: 7419 - DNA, 20 bp, Artificial Sequence
  Description of Artificial Sequence: Synthetic oligonucleotide
  Target: SCN10A; (-) strand; PAM type: NNGRRT; PAM sequence: CAGAGT
ctgcactccagcctgggaga

SEQ ID NO: 7420 - DNA, 20 bp, Artificial Sequence
  Description of Artificial Sequence: Synthetic oligonucleotide
  Target: SCN10A; (-) strand; PAM type: NNGRRT; PAM sequence: GAGGAT
tactcagaagactgaggtgg

SEQ ID NO: 7421 - DNA, 20 bp, Artificial Sequence
  Description of Artificial Sequence: Synthetic oligonucleotide
  Target: SCN10A; (-) strand; PAM type: NNGRRT; PAM sequence: AGGAGT
caggcagatcgcttgagccc

SEQ ID NO: 7422 - DNA, 20 bp, Artificial Sequence
  Description of Artificial Sequence: Synthetic oligonucleotide
  Target: SCN10A; (-) strand; PAM type: NNGRRT; PAM sequence: AGGGAT
agcagtgcacaactcctggg

SEQ ID NO: 7423 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ccatggaagagatgtgggca

SEQ ID NO: 7424 - DNA, 20 bp, Artificial Sequence
  Description of Artificial Sequence: Synthetic oligonucleotide
  Target: SCN10A; (-) strand; PAM type: NNGRRT; PAM sequence: AGGGGT
gaacttggcgtacctggatt

SEQ ID NO: 7425 - DNA, 20 bp, Artificial Sequence
  Description of Artificial Sequence: Synthetic oligonucleotide
  Target: SCN10A; (-) strand; PAM type: NNGRRT; PAM sequence: CTGGAT
agcccctgaacttggcgtac

SEQ ID NO: 7426 - DNA, 20 bp, Artificial Sequence
  Description of Artificial Sequence: Synthetic oligonucleotide
  Target: SCN10A; (-) strand; PAM type: NNGRRT; PAM sequence: GGGGGT
gttggcatccagaggttgaa

SEQ ID NO: 7427 - DNA, 20 bp, Artificial Sequence
  Description of Artificial Sequence: Synthetic oligonucleotide
  Target: SCN10A; (-) strand; PAM type: NNGRRT; PAM sequence: GGGAGT
agagaggtgacaaaacaaag

SEQ ID NO: 7428 - DNA, 20 bp, Artificial Sequence
  Description of Artificial Sequence: Synthetic oligonucleotide
  Target: SCN10A; (-) strand; PAM type: NNGRRT; PAM sequence: AGGAAT
agcgcaggccgcctgctctc

SEQ ID NO: 7429 - DNA, 20 bp, Artificial Sequence
  Description of Artificial Sequence: Synthetic oligonucleotide
  Target: SCN10A; (-) strand; PAM type: NNGRRT; PAM sequence: GGGAAT
ttggcatctcactgactctt

SEQ ID NO: 7430 - DNA, 20 bp, Artificial Sequence
  Description of Artificial Sequence: Synthetic oligonucleotide
  Target: SCN10A; (-) strand; PAM type: NNGRRT; PAM sequence: TCGGGT
ctgtcagattcccaggagtg

SEQ ID NO: 7431 - DNA, 20 bp, Artificial Sequence
  Description of Artificial Sequence: Synthetic oligonucleotide
  Target: SCN10A; (-) strand; PAM type: NNGRRT; PAM sequence: AGGAGT
gccaaacctgtcagattccc

SEQ ID NO: 7432 - DNA, 20 bp, Artificial Sequence
  Description of Artificial Sequence: Synthetic oligonucleotide
  Target: SCN10A; (-) strand; PAM type: NNGRRT; PAM sequence: CTGGAT
caagcgaataagccacagac

SEQ ID NO: 7433 - DNA, 20 bp, Artificial Sequence
  Description of Artificial Sequence: Synthetic oligonucleotide
  Target: SCN10A; (-) strand; PAM type: NNGRRT; PAM sequence: GCGAAT
gtctcccatctgccaagcaa

SEQ ID NO: 7434 - DNA, 20 bp, Artificial Sequence
  Description of Artificial Sequence: Synthetic oligonucleotide
  Target: SCN10A; (-) strand; PAM type: NNGRRT; PAM sequence: AAGAAT
ctcaggggtgggtgaggaaa

SEQ ID NO: 7435 - DNA, 20 bp, Artificial Sequence
  Description of Artificial Sequence: Synthetic oligonucleotide
  Target: SCN10A; (-) strand; PAM type: NNGRRT; PAM sequence: GTGGGT
cgtttttaagatcctcaggg

SEQ ID NO: 7436 - DNA, 20 bp, Artificial Sequence
  Description of Artificial Sequence: Synthetic oligonucleotide
  Target: SCN10A; (-) strand; PAM type: NNGRRT; PAM sequence: AGGGGT
tagtcgtttttaagatcctc

SEQ ID NO: 7437 - DNA, 20 bp, Artificial Sequence
  Description of Artificial Sequence: Synthetic oligonucleotide
  Target: SCN10A; (-) strand; PAM type: NNGRRT; PAM sequence: CAGAGT
gccccagcttttcgctgact

SEQ ID NO: 7438 - DNA, 20 bp, Artificial Sequence
  Description of Artificial Sequence: Synthetic oligonucleotide
  Target: SCN10A; (-) strand; PAM type: NNGRRT; PAM sequence: TTGGGT
actcctgggcgactggagac

SEQ ID NO: 7439 - DNA, 20 bp, Artificial Sequence
  Description of Artificial Sequence: Synthetic oligonucleotide
  Target: SCN10A; (-) strand; PAM type: NNGRRT; PAM sequence: CAGGGT
cctgtccttgtgggagggag

SEQ ID NO: 7440 - DNA, 20 bp, Artificial Sequence
  Description of Artificial Sequence: Synthetic oligonucleotide
  Target: SCN10A; (-) strand; PAM type: NNGRRT; PAM sequence: GTGAGT
ttgactgcatcatcgtcact

SEQ ID NO: 7441 - DNA, 20 bp, Artificial Sequence
  Description of Artificial Sequence: Synthetic oligonucleotide
  Target: SCN10A; (-) strand; PAM type: NNGRRT; PAM sequence: TGGAAT
actattatttccagaagaag

SEQ ID NO: 7442 - DNA, 20 bp, Artificial Sequence
  Description of Artificial Sequence: Synthetic oligonucleotide
  Target: SCN10A; (-) strand; PAM type: NNGRRT; PAM sequence: AAGGAT
atagcaactgaacaaaacaa

SEQ ID NO: 7443 - DNA, 20 bp, Artificial Sequence
  Description of Artificial Sequence: Synthetic oligonucleotide
  Target: SCN10A; (-) strand; PAM type: NNGRRT; PAM sequence: GAGAAT
ctgcagcatgcacagcccct

SEQ ID NO: 7444 - DNA, 20 bp, Artificial Sequence
  Description of Artificial Sequence: Synthetic oligonucleotide
  Target: SCN10A; (-) strand; PAM type: NNGRRT; PAM sequence: TGGGAT
aagctaggaaatgtctgggc

SEQ ID NO: 7445 - DNA, 20 bp, Artificial Sequence
  Description of Artificial Sequence: Synthetic oligonucleotide
  Target: SCN10A; (-) strand; PAM type: NNGRRT; PAM sequence: AAGGAT
tgaggaaattgaggtacagg

SEQ ID NO: 7446 - DNA, 20 bp, Artificial Sequence
  Description of Artificial Sequence: Synthetic oligonucleotide
  Target: SCN10A; (-) strand; PAM type: NNGRRT; PAM sequence: ATGAAT
ctagtcactgttacttatga

SEQ ID NO: 7447 - DNA, 20 bp, Artificial Sequence
  Description of Artificial Sequence: Synthetic oligonucleotide
  Target: SCN10A; (-) strand; PAM type: NNGRRT; PAM sequence: ATGAAT
cttactagtcactgttactt

SEQ ID NO: 7448 - DNA, 20 bp, Artificial Sequence
  Description of Artificial Sequence: Synthetic oligonucleotide
  Target: SCN10A; (-) strand; PAM type: NNGRRT; PAM sequence: ATGAAT
ctaaaagaatcttagaggca

SEQ ID NO: 7449 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tagagacacacagagcctaa

SEQ ID NO: 7450 - DNA, 20 bp, Artificial Sequence
  Description of Artificial Sequence: Synthetic oligonucleotide
  Target: SCN10A; (-) strand; PAM type: NNGRRT; PAM sequence: CAGAAT
gttctgacctctctcagtgt

SEQ ID NO: 7451 - DNA, 20 bp, Artificial Sequence
  Description of Artificial Sequence: Synthetic oligonucleotide
  Target: SCN10A; (-) strand; PAM type: NNGRRT; PAM sequence: AAGGAT
cctgttttcttctccataag

SEQ ID NO: 7452 - DNA, 20 bp, Artificial Sequence
  Description of Artificial Sequence: Synthetic oligonucleotide
  Target: SCN10A; (-) strand; PAM type: NNGRRT; PAM sequence: TTGAAT
ggacactccatagatactct

SEQ ID NO: 7453 - DNA, 20 bp, Artificial Sequence
  Description of Artificial Sequence: Synthetic oligonucleotide
  Target: SCN10A; (-) strand; PAM type: NNGRRT; PAM sequence: CAGGGT
atagctggtgagggtggatc

SEQ ID NO: 7454 - DNA, 20 bp, Artificial Sequence
  Description of Artificial Sequence: Synthetic oligonucleotide
  Target: SCN10A; (-) strand; PAM type: NNGRRT; PAM sequence: GTGGAT
aaattgtatagctggtgagg

SEQ ID NO: 7455 - DNA, 20 bp, Artificial Sequence
  Description of Artificial Sequence: Synthetic oligonucleotide
  Target: SCN10A; (-) strand; PAM type: NNGRRT; PAM sequence: GAGGGT
cccaaaattgtatagctggt

SEQ ID NO: 7456 - DNA, 20 bp, Artificial Sequence
  Description of Artificial Sequence: Synthetic oligonucleotide
  Target: SCN10A; (-) strand; PAM type: NNGRRT; PAM sequence: ATGAAT
tgcaatgagtcaggtgcttt

SEQ ID NO: 7457 - DNA, 20 bp, Artificial Sequence
  Description of Artificial Sequence: Synthetic oligonucleotide
  Target: SCN10A; (-) strand; PAM type: NNGRRT; PAM sequence: ATGAGT
tcatgtgcttggtgcctgca

SEQ ID NO: 7458 - DNA, 20 bp, Artificial Sequence
  Description of Artificial Sequence: Synthetic oligonucleotide
  Target: SCN10A; (-) strand; PAM type: NNGRRT; PAM sequence: TGGAAT
taagaccacagagggcctta

SEQ ID NO: 7459 - DNA, 20 bp, Artificial Sequence
  Description of Artificial Sequence: Synthetic oligonucleotide
  Target: SCN10A; (-) strand; PAM type: NNGRRT; PAM sequence: GAGAAT
aaggaaaaatggaaagagaa

SEQ ID NO: 7460 - DNA, 20 bp, Artificial Sequence
  Description of Artificial Sequence: Synthetic oligonucleotide
  Target: SCN10A; (-) strand; PAM type: NNGRRT; PAM sequence: TGGAAT
cagtaggttctggaacatgg

SEQ ID NO: 7461 - DNA, 20 bp, Artificial Sequence
  Description of Artificial Sequence: Synthetic oligonucleotide
  Target: SCN10A; (-) strand; PAM type: NNGRRT; PAM sequence: TGGGGT
tcaccagaactgtctggctt

SEQ ID NO: 7462 - DNA, 20 bp, Artificial Sequence
  Description of Artificial Sequence: Synthetic oligonucleotide
  Target: SCN10A; (-) strand; PAM type: NNGRRT; PAM sequence: CTGGAT
accaagctggaggtgaccta

SEQ ID NO: 7463 - DNA, 20 bp, Artificial Sequence
  Description of Artificial Sequence: Synthetic oligonucleotide
  Target: SCN10A; (-) strand; PAM type: NNGRRT; PAM sequence: CAGGGT
tcctgccttcatgtccgcag

SEQ ID NO: 7464 - DNA, 20 bp, Artificial Sequence
  Description of Artificial Sequence: Synthetic oligonucleotide
  Target: SCN10A; (-) strand; PAM type: NNGRRT; PAM sequence: AAGGGT
catgataggcagaagctaga

SEQ ID NO: 7465 - DNA, 20 bp, Artificial Sequence
  Description of Artificial Sequence: Synthetic oligonucleotide
  Target: SCN10A; (-) strand; PAM type: NNGRRT; PAM sequence: CTGAAT
aagcccgcttttcttaaccc

SEQ ID NO: 7466 - DNA, 20 bp, Artificial Sequence
  Description of Artificial Sequence: Synthetic oligonucleotide
  Target: SCN10A; (-) strand; PAM type: NNGRRT; PAM sequence: CAGAAT
gttgagtttagtggccacat

SEQ ID NO: 7467 - DNA, 20 bp, Artificial Sequence
  Description of Artificial Sequence: Synthetic oligonucleotide
  Target: SCN10A; (-) strand; PAM type: NNGRRT; PAM sequence: TTGAGT
atcttcccaagatcatagag

SEQ ID NO: 7468 - DNA, 20 bp, Artificial Sequence
  Description of Artificial Sequence: Synthetic oligonucleotide
  Target: SCN10A; (-) strand; PAM type: NNGRRT; PAM sequence: TAGAGT
aaataatcttcccaagatca

SEQ ID NO: 7469 - DNA, 20 bp, Artificial Sequence
  Description of Artificial Sequence: Synthetic oligonucleotide
  Target: SCN10A; (-) strand; PAM type: NNGRRT; PAM sequence: ATGGAT
ataatactcagatgcttctc

SEQ ID NO: 7470 - DNA, 20 bp, Artificial Sequence
  Description of Artificial Sequence: Synthetic oligonucleotide
  Target: SCN10A; (-) strand; PAM type: NNGRRT; PAM sequence: AGGAAT
tccaaccttgccccacccac

SEQ ID NO: 7471 - DNA, 20 bp, Artificial Sequence
  Description of Artificial Sequence: Synthetic oligonucleotide
  Target: SCN10A; (-) strand; PAM type: NNGRRT; PAM sequence: CTGGAT
atactggatttcactatata

SEQ ID NO: 7472 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ttaacaagatacaatccata

SEQ ID NO: 7473 - DNA, 20 bp, Artificial Sequence
  Description of Artificial Sequence: Synthetic oligonucleotide
  Target: SCN10A; (-) strand; PAM type: NNGRRT; PAM sequence: AAGAGT
tgttgtcacttaaggagaaa

SEQ ID NO: 7474 - DNA, 20 bp, Artificial Sequence
  Description of Artificial Sequence: Synthetic oligonucleotide
  Target: SCN10A; (-) strand; PAM type: NNGRRT; PAM sequence: GAGGAT
agttgcctctaccttgaaat

SEQ ID NO: 7475 - DNA, 20 bp, Artificial Sequence
  Description of Artificial Sequence: Synthetic oligonucleotide
  Target: SCN10A; (-) strand; PAM type: NNGRRT; PAM sequence: CTGGAT
aggacaaccacttgaatttt

SEQ ID NO: 7476 - DNA, 20 bp, Artificial Sequence
  Description of Artificial Sequence: Synthetic oligonucleotide
  Target: SCN10A; (-) strand; PAM type: NNGRRT; PAM sequence: TTGAAT
acaaaacataggacaaccac

SEQ ID NO: 7477 - DNA, 20 bp, Artificial Sequence
  Description of Artificial Sequence: Synthetic oligonucleotide
  Target: SCN10A; (-) strand; PAM type: NNGRRT; PAM sequence: TGGGAT
tgagctggtgggaatggctt

SEQ ID NO: 7478 - DNA, 20 bp, Artificial Sequence
  Description of Artificial Sequence: Synthetic oligonucleotide
  Target: SCN10A; (-) strand; PAM type: NNGRRT; PAM sequence: GGGAAT
aggacccaggctgagctggt

SEQ ID NO: 7479 - DNA, 20 bp, Artificial Sequence
  Description of Artificial Sequence: Synthetic oligonucleotide
  Target: SCN10A; (-) strand; PAM type: NNGRRT; PAM sequence: CTGGGT
gtgcaggagacatgtggaca

SEQ ID NO: 7480 - DNA, 20 bp, Artificial Sequence
  Description of Artificial Sequence: Synthetic oligonucleotide
  Target: SCN10A; (-) strand; PAM type: NNGRRT; PAM sequence: TGGGGT
atggcagggtgcagttcggg

SEQ ID NO: 7481 - DNA, 20 bp, Artificial Sequence
  Description of Artificial Sequence: Synthetic oligonucleotide
  Target: SCN10A; (-) strand; PAM type: NNGRRT; PAM sequence: TCGGGT
ggatgatggcagggtgcagt

SEQ ID NO: 7482 - DNA, 20 bp, Artificial Sequence
  Description of Artificial Sequence: Synthetic oligonucleotide
  Target: SCN10A; (-) strand; PAM type: NNGRRT; PAM sequence: CAGGGT
gggcggggtggggatgatgg

SEQ ID NO: 7483 - DNA, 20 bp, Artificial Sequence
  Description of Artificial Sequence: Synthetic oligonucleotide
  Target: SCN10A; (-) strand; PAM type: NNGRRT; PAM sequence: GGGGAT
tggcgtggtcggggcggggt

SEQ ID NO: 7484 - DNA, 20 bp, Artificial Sequence
  Description of Artificial Sequence: Synthetic oligonucleotide
  Target: SCN10A; (-) strand; PAM type: NNGRRT; PAM sequence: CGGGGT
cctcactggcgtggtcgggg

SEQ ID NO: 7485 - DNA, 20 bp, Artificial Sequence
  Description of Artificial Sequence: Synthetic oligonucleotide
  Target: SCN10A; (-) strand; PAM type: NNGRRT; PAM sequence: GTGAGT
tgctccagataggcaacatc

SEQ ID NO: 7486 - DNA, 20 bp, Artificial Sequence
  Description of Artificial Sequence: Synthetic oligonucleotide
  Target: SCN10A; (-) strand; PAM type: NNGRRT; PAM sequence: ACGGAT
caattctctttgggcttgtg

SEQ ID NO: 7487 - DNA, 20 bp, Artificial Sequence
  Description of Artificial Sequence: Synthetic oligonucleotide
  Target: SCN10A; (-) strand; PAM type: NNGRRT; PAM sequence: GTGGGT
atctgggattgctgccccat

SEQ ID NO: 7488 - DNA, 20 bp, Artificial Sequence
  Description of Artificial Sequence: Synthetic oligonucleotide
  Target: SCN10A; (-) strand; PAM type: NNGRRT; PAM sequence: TGGGAT
tgtctcagaagtatctgatc

SEQ ID NO: 7489 - DNA, 20 bp, Artificial Sequence
  Description of Artificial Sequence: Synthetic oligonucleotide
  Target: SCN10A; (-) strand; PAM type: NNGRRT; PAM sequence: AGGAGT
acactataatgcagaactcg

SEQ ID NO: 7490 - DNA, 20 bp, Artificial Sequence
  Description of Artificial Sequence: Synthetic oligonucleotide
  Target: SCN10A; (-) strand; PAM type: NNGRRT; PAM sequence: TGGGGT
ctagaggatgaccgcagaat

SEQ ID NO: 7491 - DNA, 20 bp, Artificial Sequence
  Description of Artificial Sequence: Synthetic oligonucleotide
  Target: SCN10A; (-) strand; PAM type: NNGRRT; PAM sequence: CAGAAT
caaggtctagaggatgaccg

SEQ ID NO: 7492 - DNA, 20 bp, Artificial Sequence
  Description of Artificial Sequence: Synthetic oligonucleotide
  Target: SCN10A; (-) strand; PAM type: NNGRRT; PAM sequence: GAGGAT
attattaacaacaaggtcta

SEQ ID NO: 7493 - DNA, 20 bp, Artificial Sequence
  Description of Artificial Sequence: Synthetic oligonucleotide
  Target: SCN10A; (-) strand; PAM type: NNGRRT; PAM sequence: ATGAAT
aggagttcaaaatataggaa

SEQ ID NO: 7494 - DNA, 20 bp, Artificial Sequence
  Description of Artificial Sequence: Synthetic oligonucleotide
  Target: SCN10A; (-) strand; PAM type: NNGRRT; PAM sequence: AGGAGT
aattggagttgcaggactaa

SEQ ID NO: 7495 - DNA, 20 bp, Artificial Sequence
  Description of Artificial Sequence: Synthetic oligonucleotide
  Target: SCN10A; (-) strand; PAM type: NNGRRT; PAM sequence: TGGAGT
tggatggggcagatattaat

SEQ ID NO: 7496 - DNA, 20 bp, Artificial Sequence
  Description of Artificial Sequence: Synthetic oligonucleotide
  Target: SCN10A; (-) strand; PAM type: NNGRRT; PAM sequence: CTGGAT
aatgtcagcagtttaaagga

SEQ ID NO: 7497 - DNA, 20 bp, Artificial Sequence
  Description of Artificial Sequence: Synthetic oligonucleotide
  Target: SCN10A; (-) strand; PAM type: NNGRRT; PAM sequence: ATGGAT
acaagggagtagttagagag

SEQ ID NO: 7498 - DNA, 20 bp, Artificial Sequence
  Description of Artificial Sequence: Synthetic oligonucleotide
  Target: SCN10A; (-) strand; PAM type: NNGRRT; PAM sequence: GGGAGT
ggaattgagggtgcctacaa

SEQ ID NO: 7499 - DNA, 20 bp, Artificial Sequence
  Description of Artificial Sequence: Synthetic oligonucleotide
  Target: SCN10A; (-) strand; PAM type: NNGRRT; PAM sequence: GAGGGT
aggagaggggcaaaggaatt

SEQ ID NO: 7500 - DNA, 20 bp, Artificial Sequence
  Description of Artificial Sequence: Synthetic oligonucleotide
  Target: SCN10A; (-) strand; PAM type: NNGRRT; PAM sequence: AGGAAT
atgaaggaggagaggggcaa

SEQ ID NO: 7501 - DNA, 20 bp, Artificial Sequence
  Description of Artificial Sequence: Synthetic oligonucleotide
  Target: SCN10A; (-) strand; PAM type: NNGRRT; PAM sequence: TTGGGT
agtacagagtagtctacaaa

SEQ ID NO: 7502 - DNA, 20 bp, Artificial Sequence
  Description of Artificial Sequence: Synthetic oligonucleotide
  Target: SCN10A; (-) strand; PAM type: NNGRRT; PAM sequence: CAGAGT
cagctggttgggtgcaagta

SEQ ID NO: 7503 - DNA, 20 bp, Artificial Sequence
  Description of Artificial Sequence: Synthetic oligonucleotide
  Target: SCN10A; (-) strand; PAM type: NNGRRT; PAM sequence: TTGGGT
ttccagccaggtccagctgg

SEQ ID NO: 7504 - DNA, 20 bp, Artificial Sequence
  Description of Artificial Sequence: Synthetic oligonucleotide
  Target: SCN10A; (-) strand; PAM type: NNGRRT; PAM sequence: GAGGGT
tggggctcacagatctctag

SEQ ID NO: 7505 - DNA, 20 bp, Artificial Sequence
  Description of Artificial Sequence: Synthetic oligonucleotide
  Target: SCN10A; (-) strand; PAM type: NNGRRT; PAM sequence: TGGAAT
catctggaagaatgaaggaa

SEQ ID NO: 7506 - DNA, 20 bp, Artificial Sequence
  Description of Artificial Sequence: Synthetic oligonucleotide
  Target: SCN10A; (-) strand; PAM type: NNGRRT; PAM sequence: AGGAAT
acagtcatctggaagaatga

SEQ ID NO: 7507 - DNA, 20 bp, Artificial Sequence
  Description of Artificial Sequence: Synthetic oligonucleotide
  Target: SCN10A; (-) strand; PAM type: NNGRRT; PAM sequence: AAGAAT
agtgagaaacagtcatctgg

SEQ ID NO: 7508 - DNA, 20 bp, Artificial Sequence
  Description of Artificial Sequence: Synthetic oligonucleotide
  Target: SCN10A; (-) strand; PAM type: NNGRRT; PAM sequence: GAGAGT
taaaagggagctcatcaaca

SEQ ID NO: 7509 - DNA, 20 bp, Artificial Sequence
  Description of Artificial Sequence: Synthetic oligonucleotide
  Target: SCN10A; (-) strand; PAM type: NNGRRT; PAM sequence: CTGAGT
tttgtgaactagtctatatt

SEQ ID NO: 7510 - DNA, 20 bp, Artificial Sequence
  Description of Artificial Sequence: Synthetic oligonucleotide
  Target: SCN10A; (-) strand; PAM type: NNGRRT; PAM sequence: CAGAAT
cactgtgtggggcacgaaga

SEQ ID NO: 7511 - DNA, 20 bp, Artificial Sequence
  Description of Artificial Sequence: Synthetic oligonucleotide
  Target: SCN10A; (-) strand; PAM type: NNGRRT; PAM sequence: AGGGGT
aagagcccggcacaagtggg

SEQ ID NO: 7512 - DNA, 20 bp, Artificial Sequence
  Description of Artificial Sequence: Synthetic oligonucleotide
  Target: SCN10A; (-) strand; PAM type: NNGRRT; PAM sequence: TTGAAT
aggtctggatgatgcaggcc

SEQ ID NO: 7513 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ggtctggaagggagacaggt

SEQ ID NO: 7514 - DNA, 20 bp, Artificial Sequence
  Description of Artificial Sequence: Synthetic oligonucleotide
  Target: SCN10A; (-) strand; PAM type: NNGRRT; PAM sequence: TGGGGT
agcagtaatgaaagagagca

SEQ ID NO: 7515 - DNA, 20 bp, Artificial Sequence
  Description of Artificial Sequence: Synthetic oligonucleotide
  Target: SCN10A; (-) strand; PAM type: NNGRRT; PAM sequence: AGGAAT
aagtgtagaaaactcttgca

SEQ ID NO: 7516 - DNA, 20 bp, Artificial Sequence
  Description of Artificial Sequence: Synthetic oligonucleotide
  Target: SCN10A; (-) strand; PAM type: NNGRRT; PAM sequence: TTGAAT
gagaactggaaatcaattat

SEQ ID NO: 7517 - DNA, 20 bp, Artificial Sequence
  Description of Artificial Sequence: Synthetic oligonucleotide
  Target: SCN10A; (-) strand; PAM type: NNGRRT; PAM sequence: AAGGGT
taaattctgtcaaatgttat

SEQ ID NO: 7518 - DNA, 20 bp, Artificial Sequence
  Description of Artificial Sequence: Synthetic oligonucleotide
  Target: SCN10A; (-) strand; PAM type: NNGRRT; PAM sequence: TTGAGT
agaagctaaggtgagaatgc

SEQ ID NO: 7519 - DNA, 20 bp, Artificial Sequence
  Description of Artificial Sequence: Synthetic oligonucleotide
  Target: SCN10A; (-) strand; PAM type: NNGRRT; PAM sequence: GAGAAT
aaacacagagaagctaaggt

SEQ ID NO: 7520 - DNA, 20 bp, Artificial Sequence
  Description of Artificial Sequence: Synthetic oligonucleotide
  Target: SCN10A; (-) strand; PAM type: NNGRRT; PAM sequence: GGGAAT
aattggacacataatttggt

SEQ ID NO: 7521 - DNA, 20 bp, Artificial Sequence
  Description of Artificial Sequence: Synthetic oligonucleotide
  Target: SCN10A; (-) strand; PAM type: NNGRRT; PAM sequence: AGGGAT
gataagcctagtgttcagga

SEQ ID NO: 7522 - DNA, 20 bp, Artificial Sequence
  Description of Artificial Sequence: Synthetic oligonucleotide
  Target: SCN10A; (-) strand; PAM type: NNGRRT; PAM sequence: AGGAAT
tcaagatgcatgtcttgccg

SEQ ID NO: 7523 - DNA, 20 bp, Artificial Sequence
  Description of Artificial Sequence: Synthetic oligonucleotide
  Target: SCN10A; (-) strand; PAM type: NNGRRT; PAM sequence: CAGGAT
gggattgttgattttggtcc

SEQ ID NO: 7524 - DNA, 20 bp, Artificial Sequence
  Description of Artificial Sequence: Synthetic oligonucleotide
  Target: SCN10A; (-) strand; PAM type: NNGRRT; PAM sequence: AGGGAT
ttcttgcttttgttccaaac

SEQ ID NO: 7525 - DNA, 20 bp, Artificial Sequence
  Description of Artificial Sequence: Synthetic oligonucleotide
  Target: SCN10A; (-) strand; PAM type: NNGRRT; PAM sequence: CAGGAT
ggggacctctttaagcgtaa

SEQ ID NO: 7526 - DNA, 20 bp, Artificial Sequence
  Description of Artificial Sequence: Synthetic oligonucleotide
  Target: SCN10A; (-) strand; PAM type: NNGRRT; PAM sequence: GAGAAT
agactcctgcagtggcagga

SEQ ID NO: 7527 - DNA, 20 bp, Artificial Sequence
  Description of Artificial Sequence: Synthetic oligonucleotide
  Target: SCN10A; (-) strand; PAM type: NNGRRT; PAM sequence: AAGGGT
gactgaagattaagggaaga

SEQ ID NO: 7528 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tgctaatgggaaggatctgg

SEQ ID NO: 7529 - DNA, 20 bp, Artificial Sequence
  Description of Artificial Sequence: Synthetic oligonucleotide
  Target: SCN10A; (-) strand; PAM type: NNGRRT; PAM sequence: AAGGAT
catatttgcatgctaatggg

SEQ ID NO: 7530 - DNA, 20 bp, Artificial Sequence
  Description of Artificial Sequence: Synthetic oligonucleotide
  Target: SCN10A; (-) strand; PAM type: NNGRRT; PAM sequence: GGGAGT
tttttggtttttgtgtttgg

SEQ ID NO: 7531 - DNA, 20 bp, Artificial Sequence
  Description of Artificial Sequence: Synthetic oligonucleotide
  Target: SCN10A; (-) strand; PAM type: NNGRRT; PAM sequence: GAGAAT
agatggcactagggagtagg

SEQ ID NO: 7532 - DNA, 20 bp, Artificial Sequence
  Description of Artificial Sequence: Synthetic oligonucleotide
  Target: SCN10A; (-) strand; PAM type: NNGRRT; PAM sequence: GGGAGT
gagatagtaagatggcacta

SEQ ID NO: 7533 - DNA, 20 bp, Artificial Sequence
  Description of Artificial Sequence: Synthetic oligonucleotide
  Target: SCN10A; (-) strand; PAM type: NNGRRT; PAM sequence: GCGGGT
atattgaaggggcttaaaga

SEQ ID NO: 7534 - DNA, 20 bp, Artificial Sequence
  Description of Artificial Sequence: Synthetic oligonucleotide
  Target: SCN10A; (-) strand; PAM type: NNGRRT; PAM sequence: AAGGGT
aaagaggattaatggagtaa

SEQ ID NO: 7535 - DNA, 20 bp, Artificial Sequence
  Description of Artificial Sequence: Synthetic oligonucleotide
  Target: SCN10A; (-) strand; PAM type: NNGRRT; PAM sequence: TGGAGT
tctaagcaaaagaggattaa

SEQ ID NO: 7536 - DNA, 20 bp, Artificial Sequence
  Description of Artificial Sequence: Synthetic oligonucleotide
  Target: SCN10A; (-) strand; PAM type: NNGRRT; PAM sequence: GAGGAT
ctttggtgatctaagcaaaa

SEQ ID NO: 7537 - DNA, 20 bp, Artificial Sequence
  Description of Artificial Sequence: Synthetic oligonucleotide
  Target: SCN10A; (-) strand; PAM type: NNGRRT; PAM sequence: ATGGAT
ggtccaggggctttagtcac

SEQ ID NO: 7538 - DNA, 20 bp, Artificial Sequence
  Description of Artificial Sequence: Synthetic oligonucleotide
  Target: SCN10A; (-) strand; PAM type: NNGRRT; PAM sequence: AAGAAT
agagtaaaaatttcttcaga

SEQ ID NO: 7539 - DNA, 20 bp, Artificial Sequence
  Description of Artificial Sequence: Synthetic oligonucleotide
  Target: SCN10A; (-) strand; PAM type: NNGRRT; PAM sequence: AAGAGT
gaagaatacaatgcagagcc

SEQ ID NO: 7540 - DNA, 20 bp, Artificial Sequence
  Description of Artificial Sequence: Synthetic oligonucleotide
  Target: SCN10A; (-) strand; PAM type: NNGRRT; PAM sequence: AAGAAT
agaaataggaaaagatctag

SEQ ID NO: 7541 - DNA, 20 bp, Artificial Sequence
  Description of Artificial Sequence: Synthetic oligonucleotide
  Target: SCN10A; (-) strand; PAM type: NNGRRT; PAM sequence: AAGGGT
aactggatgagttaacacag

SEQ ID NO: 7542 - DNA, 20 bp, Artificial Sequence
  Description of Artificial Sequence: Synthetic oligonucleotide
  Target: SCN10A; (-) strand; PAM type: NNGRRT; PAM sequence: ATGAGT
ttttgaaaagatgcaactgg

SEQ ID NO: 7543 - DNA, 20 bp, Artificial Sequence
  Description of Artificial Sequence: Synthetic oligonucleotide
  Target: SCN10A; (-) strand; PAM type: NNGRRT; PAM sequence: CTGGAT
gtaattttgaaaagatgcaa

SEQ ID NO: 7544 - DNA, 20 bp, Artificial Sequence
  Description of Artificial Sequence: Synthetic oligonucleotide
  Target: SCN10A; (-) strand; PAM type: NNGRRT; PAM sequence: TTGAAT
tatatatatttgaaagcagt

SEQ ID NO: 7545 - DNA, 20 bp, Artificial Sequence
  Description of Artificial Sequence: Synthetic oligonucleotide
  Target: SCN10A; (-) strand; PAM type: NNGRRT; PAM sequence: AGGGGT
ggaagttgactttaggatat

SEQ ID NO: 7546 - DNA, 20 bp, Artificial Sequence
  Description of Artificial Sequence: Synthetic oligonucleotide
  Target: SCN10A; (-) strand; PAM type: NNGRRT; PAM sequence: TAGGAT
gtccagtaggaagttgactt

SEQ ID NO: 7547 - DNA, 20 bp, Artificial Sequence
  Description of Artificial Sequence: Synthetic oligonucleotide
  Target: SCN10A; (-) strand; PAM type: NNGRRT; PAM sequence: AGGGGT
tgcccttggagcatctaggt

SEQ ID NO: 7548 - DNA, 20 bp, Artificial Sequence
  Description of Artificial Sequence: Synthetic oligonucleotide
  Target: SCN10A; (-) strand; PAM type: NNGRRT; PAM sequence: TTGGGT
tgagttgagtctgggatata

SEQ ID NO: 7549 - DNA, 20 bp, Artificial Sequence
  Description of Artificial Sequence: Synthetic oligonucleotide
  Target: SCN10A; (-) strand; PAM type: NNGRRT; PAM sequence: TGGGAT
agaagattatgagttgagtc

SEQ ID NO: 7550 - DNA, 20 bp, Artificial Sequence
  Description of Artificial Sequence: Synthetic oligonucleotide
  Target: SCN10A; (-) strand; PAM type: NNGRRT; PAM sequence: TTGAGT
agatgaaagaagattatgag

SEQ ID NO: 7551 - DNA, 20 bp, Artificial Sequence
  Description of Artificial Sequence: Synthetic oligonucleotide
  Target: SCN10A; (-) strand; PAM type: NNGRRT; PAM sequence: ATGAGT
gggaaagatgaaagaagatt

SEQ ID NO: 7552 - DNA, 20 bp, Artificial Sequence
  Description of Artificial Sequence: Synthetic oligonucleotide
  Target: SCN10A; (-) strand; PAM type: NNGRRT; PAM sequence: AAGGAT
gtggggctgatgggaaatgg

SEQ ID NO: 7553 - DNA, 20 bp, Artificial Sequence
  Description of Artificial Sequence: Synthetic oligonucleotide
  Target: SCN10A; (-) strand; PAM type: NNGRRT; PAM sequence: TGGGGT
agatggcagtgcttgaactc

SEQ ID NO: 7554 - DNA, 20 bp, Artificial Sequence
  Description of Artificial Sequence: Synthetic oligonucleotide
  Target: SCN10A; (-) strand; PAM type: NNGRRT; PAM sequence: CTGGAT
tgcattttataaaagttact

SEQ ID NO: 7555 - DNA, 20 bp, Artificial Sequence
  Description of Artificial Sequence: Synthetic oligonucleotide
  Target: SCN10A; (-) strand; PAM type: NNGRRT; PAM sequence: AAGGAT
agaggagtgaggtgccatta

SEQ ID NO: 7556 - DNA, 20 bp, Artificial Sequence
  Description of Artificial Sequence: Synthetic oligonucleotide
  Target: SCN10A; (-) strand; PAM type: NNGRRT; PAM sequence: AGGAGT
atatgggacttcatgctaag

SEQ ID NO: 7557 - DNA, 20 bp, Artificial Sequence
  Description of Artificial Sequence: Synthetic oligonucleotide
  Target: SCN10A; (-) strand; PAM type: NNGRRT; PAM sequence: AAGGAT
agaaactcctagactgcatt

SEQ ID NO: 7558 - DNA, 20 bp, Artificial Sequence
  Description of Artificial Sequence: Synthetic oligonucleotide
  Target: SCN10A; (-) strand; PAM type: NNGRRT; PAM sequence: ATGAGT
ctgaaaataaggctagaggg

SEQ ID NO: 7559 - DNA, 20 bp, Artificial Sequence
  Description of Artificial Sequence: Synthetic oligonucleotide
  Target: SCN10A; (-) strand; PAM type: NNGRRT; PAM sequence: AGGGAT
agaactgaaaataaggctag

SEQ ID NO: 7560 - DNA, 20 bp, Artificial Sequence
  Description of Artificial Sequence: Synthetic oligonucleotide
  Target: SCN10A; (-) strand; PAM type: NNGRRT; PAM sequence: AGGAAT
gaagagagaataacatttga

SEQ ID NO: 7561 - DNA, 20 bp, Artificial Sequence
  Description of Artificial Sequence: Synthetic oligonucleotide
  Target: SCN10A; (-) strand; PAM type: NNGRRT; PAM sequence: GAGAAT
aaggactgcaaagcagaaga

SEQ ID NO: 7562 - DNA, 20 bp, Artificial Sequence
  Description of Artificial Sequence: Synthetic oligonucleotide
  Target: SCN10A; (-) strand; PAM type: NNGRRT; PAM sequence: GGGAAT
gtaagatttgcctggagcca

SEQ ID NO: 7563 - DNA, 20 bp, Artificial Sequence
  Description of Artificial Sequence: Synthetic oligonucleotide
  Target: SCN10A; (-) strand; PAM type: NNGRRT; PAM sequence: CAGGAT
agtgccttaaagaggaagtg

SEQ ID NO: 7564 - DNA, 20 bp, Artificial Sequence
  Description of Artificial Sequence: Synthetic oligonucleotide
  Target: SCN10A; (-) strand; PAM type: NNGRRT; PAM sequence: GTGAGT
gcagtgagcttactggagtg

SEQ ID NO: 7565 - DNA, 20 bp, Artificial Sequence
  Description of Artificial Sequence: Synthetic oligonucleotide
  Target: SCN10A; (-) strand; PAM type: NNGRRT; PAM sequence: TGGAGT
ggtcacagcagtgagcttac

SEQ ID NO: 7566 - DNA, 20 bp, Artificial Sequence
  Description of Artificial Sequence: Synthetic oligonucleotide
  Target: SCN10A; (-) strand; PAM type: NNGRRT; PAM sequence: CTGGGT
ccaagccagaattccagaag

SEQ ID NO: 7567 - DNA, 20 bp, Artificial Sequence
  Description of Artificial Sequence: Synthetic oligonucleotide
  Target: SCN10A; (-) strand; PAM type: NNGRRT; PAM sequence: CAGAAT
gatttcactgttgtccaagc

SEQ ID NO: 7568 - DNA, 20 bp, Artificial Sequence
  Description of Artificial Sequence: Synthetic oligonucleotide
  Target: SCN10A; (-) strand; PAM type: NNGRRT; PAM sequence: AGGAGT
aaagtttggcccaaaccaac

SEQ ID NO: 7569 - DNA, 20 bp, Artificial Sequence
  Description of Artificial Sequence: Synthetic oligonucleotide
  Target: SCN10A; (-) strand; PAM type: NNGRRT; PAM sequence: AGGGAT
ataaaggccacctctttaag

SEQ ID NO: 7570 - DNA, 20 bp, Artificial Sequence
  Description of Artificial Sequence: Synthetic oligonucleotide
  Target: SCN10A; (-) strand; PAM type: NNGRRT; PAM sequence: TAGGAT
tcatgctgccagagtcgtaa

SEQ ID NO: 7571 - DNA, 20 bp, Artificial Sequence
  Description of Artificial Sequence: Synthetic oligonucleotide
  Target: SCN10A; (-) strand; PAM type: NNGRRT; PAM sequence: CAGAGT
tgaaggatgcttcatgctgc

SEQ ID NO: 7572 - DNA, 20 bp, Artificial Sequence
  Description of Artificial Sequence: Synthetic oligonucleotide
  Target: SCN10A; (-) strand; PAM type: NNGRRT; PAM sequence: AAGGAT
ttacacacatgagacacctg

SEQ ID NO: 7573 - DNA, 20 bp, Artificial Sequence
  Description of Artificial Sequence: Synthetic oligonucleotide
  Target: SCN10A; (-) strand; PAM type: NNGRRT; PAM sequence: TTGGAT
gggcacatcatcttctctgg

SEQ ID NO: 7574 - DNA, 20 bp, Artificial Sequence
  Description of Artificial Sequence: Synthetic oligonucleotide
  Target: SCN10A; (-) strand; PAM type: NNGRRT; PAM sequence: TAGAGT
caaggaagatgctgtgacag

SEQ ID NO: 7575 - DNA, 20 bp, Artificial Sequence
  Description of Artificial Sequence: Synthetic oligonucleotide
  Target: SCN10A; (-) strand; PAM type: NNGRRT; PAM sequence: TAGGGT
aataggcaaatatgttgggg

SEQ ID NO: 7576 - DNA, 20 bp, Artificial Sequence
  Description of Artificial Sequence: Synthetic oligonucleotide
  Target: SCN10A; (-) strand; PAM type: NNGRRT; PAM sequence: TGGGGT
taagtaataggcaaatatgt

SEQ ID NO: 7577 - DNA, 20 bp, Artificial Sequence
  Description of Artificial Sequence: Synthetic oligonucleotide
  Target: SCN10A; (-) strand; PAM type: NNGRRT; PAM sequence: GGGAGT
atatttgggtggttggcggc

SEQ ID NO: 7578 - DNA, 20 bp, Artificial Sequence
  Description of Artificial Sequence: Synthetic oligonucleotide
  Target: SCN10A; (-) strand; PAM type: NNGRRT; PAM sequence: TTGGGT
tgcatgcacaaaggtgatat

SEQ ID NO: 7579 - DNA, 20 bp, Artificial Sequence
  Description of Artificial Sequence: Synthetic oligonucleotide
  Target: SCN10A; (-) strand; PAM type: NNGRRT; PAM sequence: ATGAGT
tagagttttgtgaggattaa

SEQ ID NO: 7580 - DNA, 20 bp, Artificial Sequence
  Description of Artificial Sequence: Synthetic oligonucleotide
  Target: SCN10A; (-) strand; PAM type: NNGRRT; PAM sequence: GAGGAT
cttatcttgtagagttttgt

SEQ ID NO: 7581 - DNA, 20 bp, Artificial Sequence
  Description of Artificial Sequence: Synthetic oligonucleotide
  Target: SCN10A; (-) strand; PAM type: NNGRRT; PAM sequence: TAGAGT
gtgagaatatacttatcttg

SEQ ID NO: 7582 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tttttagcctgtaaagtagt

SEQ ID NO: 7583 - DNA, 20 bp, Artificial Sequence
  Description of Artificial Sequence: Synthetic oligonucleotide
  Target: SCN10A; (-) strand; PAM type: NNGRRT; PAM sequence: CTGGGT
ctgctctggaacccggctgc

SEQ ID NO: 7584 - DNA, 20 bp, Artificial Sequence
  Description of Artificial Sequence: Synthetic oligonucleotide
  Target: SCN10A; (-) strand; PAM type: NNGRRT; PAM sequence: GAGGGT
gggatgaatgagaggcaaca

SEQ ID NO: 7585 - DNA, 20 bp, Artificial Sequence
  Description of Artificial Sequence: Synthetic oligonucleotide
  Target: SCN10A; (-) strand; PAM type: NNGRRT; PAM sequence: ATGAAT
agacaaaagaaggtcatggg

SEQ ID NO: 7586 - DNA, 20 bp, Artificial Sequence
  Description of Artificial Sequence: Synthetic oligonucleotide
  Target: SCN10A; (-) strand; PAM type: NNGRRT; PAM sequence: TGGGAT
ggtaagacaaaagaaggtca

SEQ ID NO: 7587 - DNA, 20 bp, Artificial Sequence
  Description of Artificial Sequence: Synthetic oligonucleotide
  Target: SCN10A; (-) strand; PAM type: NNGRRT; PAM sequence: AAGAAT
gcaagtacaatgcattctgc

SEQ ID NO: 7588 - DNA, 20 bp, Artificial Sequence
  Description of Artificial Sequence: Synthetic oligonucleotide
  Target: SCN10A; (-) strand; PAM type: NNGRRT; PAM sequence: AGGAAT
cagaaatttgaattaaataa

SEQ ID NO: 7589 - DNA, 20 bp, Artificial Sequence
  Description of Artificial Sequence: Synthetic oligonucleotide
  Target: SCN10A; (-) strand; PAM type: NNGRRT; PAM sequence: TTGAAT
tctccaagaagaacagaaat

SEQ ID NO: 7590 - DNA, 20 bp, Artificial Sequence
  Description of Artificial Sequence: Synthetic oligonucleotide
  Target: SCN10A; (-) strand; PAM type: NNGRRT; PAM sequence: ATGAAT
cagggaaggggacatgaaag

SEQ ID NO: 7591 - DNA, 20 bp, Artificial Sequence
  Description of Artificial Sequence: Synthetic oligonucleotide
  Target: SCN10A; (-) strand; PAM type: NNGRRT; PAM sequence: TGGAAT
ctgatataagcttgcgctca

SEQ ID NO: 7592 - DNA, 20 bp, Artificial Sequence
  Description of Artificial Sequence: Synthetic oligonucleotide
  Target: SCN10A; (-) strand; PAM type: NNGRRT; PAM sequence: TGGGAT
tgtggcattgcttcaggtgc

SEQ ID NO: 7593 - DNA, 20 bp, Artificial Sequence
  Description of Artificial Sequence: Synthetic oligonucleotide
  Target: SCN10A; (-) strand; PAM type: NNGRRT; PAM sequence: TTGAAT
tagtcatcaaacagcaaaca

SEQ ID NO: 7594 - DNA, 20 bp, Artificial Sequence
  Description of Artificial Sequence: Synthetic oligonucleotide
  Target: SCN10A; (-) strand; PAM type: NNGRRT; PAM sequence: TAGAAT
ttctaacatttttcatggca

SEQ ID NO: 7595 - DNA, 20 bp, Artificial Sequence
  Description of Artificial Sequence: Synthetic oligonucleotide
  Target: SCN10A; (-) strand; PAM type: NNGRRT; PAM sequence: TAGAGT
aatatcactgttcattgtaa

SEQ ID NO: 7596 - DNA, 20 bp, Artificial Sequence
  Description of Artificial Sequence: Synthetic oligonucleotide
  Target: SCN10A; (-) strand; PAM type: NNGRRT; PAM sequence: CTGAGT
aagttacatttcttgcatac

SEQ ID NO: 7597 - DNA, 20 bp, Artificial Sequence
  Description of Artificial Sequence: Synthetic oligonucleotide
  Target: SCN10A; (-) strand; PAM type: NNGRRT; PAM sequence: TTGAAT
gtgaggacttgaagcataaa

SEQ ID NO: 7598 - DNA, 20 bp, Artificial Sequence
  Description of Artificial Sequence: Synthetic oligonucleotide
  Target: SCN10A; (-) strand; PAM type: NNGRRT; PAM sequence: ATGAGT
agtgaaggctatggaaaaag

SEQ ID NO: 7599 - DNA, 20 bp, Artificial Sequence
  Description of Artificial Sequence: Synthetic oligonucleotide
  Target: SCN10A; (-) strand; PAM type: NNGRRT; PAM sequence: CTGGGT
tccagaatggcagagaggag

SEQ ID NO: 7600 - DNA, 20 bp, Artificial Sequence
  Description of Artificial Sequence: Synthetic oligonucleotide
  Target: SCN10A; (-) strand; PAM type: NNGRRT; PAM sequence: CAGAAT
cagagagagccctgtggctc

SEQ ID NO: 7601 - DNA, 20 bp, Artificial Sequence
  Description of Artificial Sequence: Synthetic oligonucleotide
  Target: SCN10A; (-) strand; PAM type: NNGRRT; PAM sequence: TAGAGT
caaggaagatactgtgagag

SEQ ID NO: 7602 - DNA, 20 bp, Artificial Sequence
  Description of Artificial Sequence: Synthetic oligonucleotide
  Target: SCN10A; (-) strand; PAM type: NNGRRT; PAM sequence: GAGAGT
ccgctcaaggaagatactgt

SEQ ID NO: 7603 - DNA, 20 bp, Artificial Sequence
  Description of Artificial Sequence: Synthetic oligonucleotide
  Target: SCN10A; (-) strand; PAM type: NNGRRT; PAM sequence: TAGGAT
aatagtcaggtatcttgggg

SEQ ID NO: 7604 - DNA, 20 bp, Artificial Sequence
  Description of Artificial Sequence: Synthetic oligonucleotide
  Target: SCN10A; (-) strand; PAM type: NNGRRT; PAM sequence: TGGGGT
taaggaatagtcaggtatct

SEQ ID NO: 7605 - DNA, 20 bp, Artificial Sequence
  Description of Artificial Sequence: Synthetic oligonucleotide
  Target: SCN10A; (-) strand; PAM type: NNGRRT; PAM sequence: AGGAAT
tgataaaaaggaagaaaata

SEQ ID NO: 7606 - DNA, 20 bp, Artificial Sequence
  Description of Artificial Sequence: Synthetic oligonucleotide
  Target: SCN10A; (-) strand; PAM type: NNGRRT; PAM sequence: GGGGGT
attaacaaaggtgatatctg

SEQ ID NO: 7607 - DNA, 20 bp, Artificial Sequence
  Description of Artificial Sequence: Synthetic oligonucleotide
  Target: SCN10A; (-) strand; PAM type: NNGRRT; PAM sequence: CTGGAT
tgtatctgttttgctcacag

SEQ ID NO: 7608 - DNA, 20 bp, Artificial Sequence
  Description of Artificial Sequence: Synthetic oligonucleotide
  Target: SCN10A; (-) strand; PAM type: NNGRRT; PAM sequence: TAGAGT
attcacatgcacagaaactg

SEQ ID NO: 7609 - DNA, 20 bp, Artificial Sequence
  Description of Artificial Sequence: Synthetic oligonucleotide
  Target: SCN10A; (-) strand; PAM type: NNGRRT; PAM sequence: AGGGAT
agaaaccaaaaaaatgtttg

SEQ ID NO: 7610 - DNA, 20 bp, Artificial Sequence
  Description of Artificial Sequence: Synthetic oligonucleotide
  Target: SCN10A; (-) strand; PAM type: NNGRRT; PAM sequence: CTGAAT
gttttcctcccagccctagg

SEQ ID NO: 7611 - DNA, 20 bp, Artificial Sequence
  Description of Artificial Sequence: Synthetic oligonucleotide
  Target: SCN10A; (-) strand; PAM type: NNGRRT; PAM sequence: AGGAGT
gtgctggtgtgcccctgaga

SEQ ID NO: 7612 - DNA, 20 bp, Artificial Sequence
  Description of Artificial Sequence: Synthetic oligonucleotide
  Target: SCN10A; (-) strand; PAM type: NNGRRT; PAM sequence: TTGAGT
tggaggagttgtaagggagc

SEQ ID NO: 7613 - DNA, 20 bp, Artificial Sequence
  Description of Artificial Sequence: Synthetic oligonucleotide
  Target: SCN10A; (-) strand; PAM type: NNGRRT; PAM sequence: AGGAGT
attaaactgacctaggctgg

SEQ ID NO: 7614 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tttttttgccttagggtatg

SEQ ID NO: 7615 - DNA, 20 bp, Artificial Sequence
  Description of Artificial Sequence: Synthetic oligonucleotide
  Target: SCN10A; (-) strand; PAM type: NNGRRT; PAM sequence: TAGGGT
aatccagcctttttttgcct

SEQ ID NO: 7616 - DNA, 20 bp, Artificial Sequence
  Description of Artificial Sequence: Synthetic oligonucleotide
  Target: SCN10A; (-) strand; PAM type: NNGRRT; PAM sequence: GAGAGT
caagccaaagggtagaggaa

SEQ ID NO: 7617 - DNA, 20 bp, Artificial Sequence
  Description of Artificial Sequence: Synthetic oligonucleotide
  Target: SCN10A; (-) strand; PAM type: NNGRRT; PAM sequence: AAGGGT
tgtatctaagttccaagcca

SEQ ID NO: 7618 - DNA, 20 bp, Artificial Sequence
  Description of Artificial Sequence: Synthetic oligonucleotide
  Target: SCN10A; (-) strand; PAM type: NNGRRT; PAM sequence: GGGAAT
tagaattctaccaatcaagt

SEQ ID NO: 7619 - DNA, 20 bp, Artificial Sequence
  Description of Artificial Sequence: Synthetic oligonucleotide
  Target: SCN10A; (-) strand; PAM type: NNGRRT; PAM sequence: TAGAAT
taactaagtccttgttaatt

SEQ ID NO: 7620 - DNA, 20 bp, Artificial Sequence
  Description of Artificial Sequence: Synthetic oligonucleotide
  Target: SCN10A; (-) strand; PAM type: NNGRRT; PAM sequence: CTGAAT
ttgttcaagcccacattatg

SEQ ID NO: 7621 - DNA, 20 bp, Artificial Sequence
  Description of Artificial Sequence: Synthetic oligonucleotide
  Target: SCN10A; (-) strand; PAM type: NNGRRT; PAM sequence: GAGAAT
aagtgatctggcaggcatca

SEQ ID NO: 7622 - DNA, 20 bp, Artificial Sequence
  Description of Artificial Sequence: Synthetic oligonucleotide
  Target: SCN10A; (-) strand; PAM type: NNGRRT; PAM sequence: ATGAAT
ttcaaaaacaaaataatttg

SEQ ID NO: 7623 - DNA, 20 bp, Artificial Sequence
  Description of Artificial Sequence: Synthetic oligonucleotide
  Target: SCN10A; (-) strand; PAM type: NNGRRT; PAM sequence: TGGAAT
aagcgtccatctctgtgtac

SEQ ID NO: 7624 - DNA, 20 bp, Artificial Sequence
  Description of Artificial Sequence: Synthetic oligonucleotide
  Target: SCN10A; (-) strand; PAM type: NNGRRT; PAM sequence: ATGAAT
tgttcatccactgtgtcatg

SEQ ID NO: 7625 - DNA, 20 bp, Artificial Sequence
  Description of Artificial Sequence: Synthetic oligonucleotide
  Target: SCN10A; (-) strand; PAM type: NNGRRT; PAM sequence: GAGGGT
gtatcataacctccgtcctt

SEQ ID NO: 7626 - DNA, 20 bp, Artificial Sequence
  Description of Artificial Sequence: Synthetic oligonucleotide
  Target: SCN10A; (-) strand; PAM type: NNGRRT; PAM sequence: ATGAGT
ctttccgggcccaaagggca

SEQ ID NO: 7627 - DNA, 20 bp, Artificial Sequence
  Description of Artificial Sequence: Synthetic oligonucleotide
  Target: SCN10A; (-) strand; PAM type: NNGRRT; PAM sequence: CAGAAT
aaagaagactttcttgtcag

SEQ ID NO: 7628 - DNA, 20 bp, Artificial Sequence
  Description of Artificial Sequence: Synthetic oligonucleotide
  Target: SCN10A; (-) strand; PAM type: NNGRRT; PAM sequence: CTGAAT
tgagattggccaataagagg

SEQ ID NO: 7629 - DNA, 20 bp, Artificial Sequence
  Description of Artificial Sequence: Synthetic oligonucleotide
  Target: SCN10A; (-) strand; PAM type: NNGRRT; PAM sequence: CAGAAT
aatacaatgtaggatattca

SEQ ID NO: 7630 - DNA, 20 bp, Artificial Sequence
  Description of Artificial Sequence: Synthetic oligonucleotide
  Target: SCN10A; (-) strand; PAM type: NNGRRT; PAM sequence: TAGGAT
ttgtttgtgtaaatacaatg

SEQ ID NO: 7631 - DNA, 20 bp, Artificial Sequence
  Description of Artificial Sequence: Synthetic oligonucleotide
  Target: SCN10A; (-) strand; PAM type: NNGRRT; PAM sequence: GAGGGT
aaaaggtttctaaatagctg

SEQ ID NO: 7632 - DNA, 20 bp, Artificial Sequence
  Description of Artificial Sequence: Synthetic oligonucleotide
  Target: SCN10A; (-) strand; PAM type: NNGRRT; PAM sequence: CTGAGT
ccaactgtgccagttaccac

SEQ ID NO: 7633 - DNA, 20 bp, Artificial Sequence
  Description of Artificial Sequence: Synthetic oligonucleotide
  Target: SCN10A; (-) strand; PAM type: NNGRRT; PAM sequence: GGGAGT
ggcatcctgcagggctcgct

SEQ ID NO: 7634 - DNA, 20 bp, Artificial Sequence
  Description of Artificial Sequence: Synthetic oligonucleotide
  Target: SCN10A; (-) strand; PAM type: NNGRRT; PAM sequence: TGGAAT
gagtaggtctccagggcaaa

SEQ ID NO: 7635 - DNA, 20 bp, Artificial Sequence
  Description of Artificial Sequence: Synthetic oligonucleotide
  Target: SCN10A; (-) strand; PAM type: NNGRRT; PAM sequence: GAGAGT
cagagacagtggagaaggta

SEQ ID NO: 7636 - DNA, 20 bp, Artificial Sequence
  Description of Artificial Sequence: Synthetic oligonucleotide
  Target: SCN10A; (-) strand; PAM type: NNGRRT; PAM sequence: AAGGAT
cctggccagaaccagagggt

SEQ ID NO: 7637 - DNA, 20 bp, Artificial Sequence
  Description of Artificial Sequence: Synthetic oligonucleotide
  Target: SCN10A; (-) strand; PAM type: NNGRRT; PAM sequence: GAGGGT
accaaacctggccagaacca

SEQ ID NO: 7638 - DNA, 20 bp, Artificial Sequence
  Description of Artificial Sequence: Synthetic oligonucleotide
  Target: SCN10A; (-) strand; PAM type: NNGRRT; PAM sequence: TTGAAT
acttgtctctccttctatcc

SEQ ID NO: 7639 - DNA, 20 bp, Artificial Sequence
  Description of Artificial Sequence: Synthetic oligonucleotide
  Target: SCN10A; (-) strand; PAM type: NNGRRT; PAM sequence: GAGGAT
cagaacttgtgatcttagta

SEQ ID NO: 7640 - DNA, 20 bp, Artificial Sequence
  Description of Artificial Sequence: Synthetic oligonucleotide
  Target: SCN10A; (-) strand; PAM type: NNGRRT; PAM sequence: CAGAAT
gaagggatgaaggaaaggac

SEQ ID NO: 7641 - DNA, 20 bp, Artificial Sequence
  Description of Artificial Sequence: Synthetic oligonucleotide
  Target: SCN10A; (-) strand; PAM type: NNGRRT; PAM sequence: AGGGAT
ctgttacatgcctaggctga

SEQ ID NO: 7642 - DNA, 20 bp, Artificial Sequence
  Description of Artificial Sequence: Synthetic oligonucleotide
  Target: SCN10A; (-) strand; PAM type: NNGRRT; PAM sequence: ATGAAT
gtgtgggctgggcttaggga

SEQ ID NO: 7643 - DNA, 20 bp, Artificial Sequence
  Description of Artificial Sequence: Synthetic oligonucleotide
  Target: SCN10A; (-) strand; PAM type: NNGRRT; PAM sequence: GGGAAT
agaggtgtgggctgggctta

SEQ ID NO: 7644 - DNA, 20 bp, Artificial Sequence
  Description of Artificial Sequence: Synthetic oligonucleotide
  Target: SCN10A; (-) strand; PAM type: NNGRRT; PAM sequence: GAGAGT
cactccgatgggctaataga

SEQ ID NO: 7645 - DNA, 20 bp, Artificial Sequence
  Description of Artificial Sequence: Synthetic oligonucleotide
  Target: SCN10A; (-) strand; PAM type: NNGRRT; PAM sequence: CAGGGT
tgactcaatgtcatgtgatt

SEQ ID NO: 7646 - DNA, 20 bp, Artificial Sequence
  Description of Artificial Sequence: Synthetic oligonucleotide
  Target: SCN10A; (-) strand; PAM type: NNGRRT; PAM sequence: TAGAGT
ccactgatacagataagtct

SEQ ID NO: 7647 - DNA, 20 bp, Artificial Sequence
  Description of Artificial Sequence: Synthetic oligonucleotide
  Target: SCN10A; (-) strand; PAM type: NNGRRT; PAM sequence: CAGAAT
ggatacagcgcaattgcaga

SEQ ID NO: 7648 - DNA, 20 bp, Artificial Sequence
  Description of Artificial Sequence: Synthetic oligonucleotide
  Target: SCN10A; (-) strand; PAM type: NNGRRT; PAM sequence: AGGGAT
tttgccctctctggctagcc

SEQ ID NO: 7649 - DNA, 20 bp, Artificial Sequence
  Description of Artificial Sequence: Synthetic oligonucleotide
  Target: SCN10A; (-) strand; PAM type: NNGRRT; PAM sequence: GTGAGT
tcctcattggattgggagct

SEQ ID NO: 7650 - DNA, 20 bp, Artificial Sequence
  Description of Artificial Sequence: Synthetic oligonucleotide
  Target: SCN10A; (-) strand; PAM type: NNGRRT; PAM sequence: TTGGAT
ggcaagtcagggattcctca

SEQ ID NO: 7651 - DNA, 20 bp, Artificial Sequence
  Description of Artificial Sequence: Synthetic oligonucleotide
  Target: SCN10A; (-) strand; PAM type: NNGRRT; PAM sequence: AGGGAT
gcagagtgtaatggcaagtc

SEQ ID NO: 7652 - DNA, 20 bp, Artificial Sequence
  Description of Artificial Sequence: Synthetic oligonucleotide
  Target: SCN10A; (-) strand; PAM type: NNGRRT; PAM sequence: CAGAGT
actctttaatagaataatcg

SEQ ID NO: 7653 - DNA, 20 bp, Artificial Sequence
  Description of Artificial Sequence: Synthetic oligonucleotide
  Target: SCN10A; (-) strand; PAM type: NNGRRT; PAM sequence: TAGAAT
aactggccagcactctttaa

SEQ ID NO: 7654 - DNA, 20 bp, Artificial Sequence
  Description of Artificial Sequence: Synthetic oligonucleotide
  Target: SCN10A; (-) strand; PAM type: NNGRRT; PAM sequence: CTGAAT
ggaagtttcttaggacagat

SEQ ID NO: 7655 - DNA, 20 bp, Artificial Sequence
  Description of Artificial Sequence: Synthetic oligonucleotide
  Target: SCN10A; (-) strand; PAM type: NNGRRT; PAM sequence: TTGAGT
gacccagagagagagagaga

SEQ ID NO: 7656 - DNA, 20 bp, Artificial Sequence
  Description of Artificial Sequence: Synthetic oligonucleotide
  Target: SCN10A; (-) strand; PAM type: NNGRRT; PAM sequence: AGGGAT
gcctgagtatcaccaatgga

SEQ ID NO: 7657 - DNA, 20 bp, Artificial Sequence
  Description of Artificial Sequence: Synthetic oligonucleotide
  Target: SCN10A; (-) strand; PAM type: NNGRRT; PAM sequence: CTGAGT
gaagccttgagccaagaagc

SEQ ID NO: 7658 - DNA, 20 bp, Artificial Sequence
  Description of Artificial Sequence: Synthetic oligonucleotide
  Target: SCN10A; (-) strand; PAM type: NNGRRT; PAM sequence: GTGAAT
gtcgatgtctcggtgagttt

SEQ ID NO: 7659 - DNA, 20 bp, Artificial Sequence
  Description of Artificial Sequence: Synthetic oligonucleotide
  Target: SCN10A; (-) strand; PAM type: NNGRRT; PAM sequence: GTGAGT
ctggagctgtcgatgtctcg

SEQ ID NO: 7660 - DNA, 20 bp, Artificial Sequence
  Description of Artificial Sequence: Synthetic oligonucleotide
  Target: SCN10A; (-) strand; PAM type: NNGRRT; PAM sequence: GGGGGT
ggggctctctgctgctgggt

SEQ ID NO: 7661 - DNA, 20 bp, Artificial Sequence
  Description of Artificial Sequence: Synthetic oligonucleotide
  Target: SCN10A; (-) strand; PAM type: NNGRRT; PAM sequence: CTGGGT
gccatcggggctctctgctg

SEQ ID NO: 7662 - DNA, 20 bp, Artificial Sequence
  Description of Artificial Sequence: Synthetic oligonucleotide
  Target: SCN10A; (-) strand; PAM type: NNGRRT; PAM sequence: TGGAGT
cctgagggagtcacagatga

SEQ ID NO: 7663 - DNA, 20 bp, Artificial Sequence
  Description of Artificial Sequence: Synthetic oligonucleotide
  Target: SCN10A; (-) strand; PAM type: NNGRRT; PAM sequence: GGGAGT
cgagatatctcactccctga

SEQ ID NO: 7664 - DNA, 20 bp, Artificial Sequence
  Description of Artificial Sequence: Synthetic oligonucleotide
  Target: SCN10A; (-) strand; PAM type: NNGRRT; PAM sequence: GGGAGT
aaagacaggggcagggaaat

SEQ ID NO: 7665 - DNA, 20 bp, Artificial Sequence
  Description of Artificial Sequence: Synthetic oligonucleotide
  Target: SCN10A; (-) strand; PAM type: NNGRRT; PAM sequence: TAGAAT
ttttccccaccatgcatacc

SEQ ID NO: 7666 - DNA, 20 bp, Artificial Sequence
  Description of Artificial Sequence: Synthetic oligonucleotide
  Target: SCN10A; (-) strand; PAM type: NNGRRT; PAM sequence: TAGAGT
ggtctttcccggagtctatc

SEQ ID NO: 7667 - DNA, 20 bp, Artificial Sequence
  Description of Artificial Sequence: Synthetic oligonucleotide
  Target: SCN10A; (-) strand; PAM type: NNGRRT; PAM sequence: CGGAGT
tcctctctcctggtctttcc

SEQ ID NO: 7668 - DNA, 20 bp, Artificial Sequence
  Description of Artificial Sequence: Synthetic oligonucleotide
  Target: SCN10A; (-) strand; PAM type: NNGRRT; PAM sequence: ATGAAT
attcatacagatgggatcta

SEQ ID NO: 7669 - DNA, 20 bp, Artificial Sequence
  Description of Artificial Sequence: Synthetic oligonucleotide
  Target: SCN10A; (-) strand; PAM type: NNGRRT; PAM sequence: TGGGAT
aactctcacattcatacaga

SEQ ID NO: 7670 - DNA, 20 bp, Artificial Sequence
  Description of Artificial Sequence: Synthetic oligonucleotide
  Target: SCN10A; (-) strand; PAM type: NNGRRT; PAM sequence: AGGGAT
tgttgactgttcaagcctcg

SEQ ID NO: 7671 - DNA, 20 bp, Artificial Sequence
  Description of Artificial Sequence: Synthetic oligonucleotide
  Target: SCN10A; (-) strand; PAM type: NNGRRT; PAM sequence: AGGAAT
ggaaatgtttattgatttgg

SEQ ID NO: 7672 - DNA, 20 bp, Artificial Sequence
  Description of Artificial Sequence: Synthetic oligonucleotide
  Target: SCN10A; (-) strand; PAM type: NNGRRT; PAM sequence: ATGAAT
tctctgagggctctgggttt

SEQ ID NO: 7673 - DNA, 20 bp, Artificial Sequence
  Description of Artificial Sequence: Synthetic oligonucleotide
  Target: SCN10A; (-) strand; PAM type: NNGRRT; PAM sequence: CTGGGT
acactaattctctgagggct

SEQ ID NO: 7674 - DNA, 20 bp, Artificial Sequence
  Description of Artificial Sequence: Synthetic oligonucleotide
  Target: SCN10A; (-) strand; PAM type: NNGRRT; PAM sequence: CAGAGT
gtggaataaatcggtatgat

SEQ ID NO: 7675 - DNA, 20 bp, Artificial Sequence
  Description of Artificial Sequence: Synthetic oligonucleotide
  Target: SCN10A; (-) strand; PAM type: NNGRRT; PAM sequence: TGGAAT
aaggagttaaggaaggtgag

SEQ ID NO: 7676 - DNA, 20 bp, Artificial Sequence
  Description of Artificial Sequence: Synthetic oligonucleotide
  Target: SCN10A; (-) strand; PAM type: NNGRRT; PAM sequence: GTGAGT
ataaaaaggagttaaggaag

SEQ ID NO: 7677 - DNA, 20 bp, Artificial Sequence
  Description of Artificial Sequence: Synthetic oligonucleotide
  Target: SCN10A; (-) strand; PAM type: NNGRRT; PAM sequence: AGGAGT
ttagtagcttagtaataaaa

SEQ ID NO: 7678 - DNA, 20 bp, Artificial Sequence
  Description of Artificial Sequence: Synthetic oligonucleotide
  Target: SCN10A; (-) strand; PAM type: NNGRRT; PAM sequence: GGGGAT
acttcagttctgtgagataa

SEQ ID NO: 7679 - DNA, 20 bp, Artificial Sequence
  Description of Artificial Sequence: Synthetic oligonucleotide
  Target: SCN10A; (-) strand; PAM type: NNGRRT; PAM sequence: CAGGAT
ttttaataatggttgctaaa

SEQ ID NO: 7680 - DNA, 20 bp, Artificial Sequence
  Description of Artificial Sequence: Synthetic oligonucleotide
  Target: SCN10A; (-) strand; PAM type: NNGRRT; PAM sequence: GAGAGT
ttgggcatgtattacaggca

SEQ ID NO: 7681 - DNA, 20 bp, Artificial Sequence
  Description of Artificial Sequence: Synthetic oligonucleotide
  Target: SCN10A; (-) strand; PAM type: NNGRRT; PAM sequence: ATGAGT
tggaaggatttttgcatttt

SEQ ID NO: 7682 - DNA, 20 bp, Artificial Sequence
  Description of Artificial Sequence: Synthetic oligonucleotide
  Target: SCN10A; (-) strand; PAM type: NNGRRT; PAM sequence: AAGGAT
tcatttgcttcaaaaattgg

SEQ ID NO: 7683 - DNA, 20 bp, Artificial Sequence
  Description of Artificial Sequence: Synthetic oligonucleotide
  Target: SCN10A; (-) strand; PAM type: NNGRRT; PAM sequence: ATGGAT
gtagtattcccttccttaat

SEQ ID NO: 7684 - DNA, 20 bp, Artificial Sequence
  Description of Artificial Sequence: Synthetic oligonucleotide
  Target: SCN10A; (-) strand; PAM type: NNGRRT; PAM sequence: ATGAAT
ccagttggtctcgttagagg

SEQ ID NO: 7685 - DNA, 20 bp, Artificial Sequence
  Description of Artificial Sequence: Synthetic oligonucleotide
  Target: SCN10A; (-) strand; PAM type: NNGRRT; PAM sequence: GAGGAT
cagaccagttggtctcgtta

SEQ ID NO: 7686 - DNA, 20 bp, Artificial Sequence
  Description of Artificial Sequence: Synthetic oligonucleotide
  Target: SCN10A; (-) strand; PAM type: NNGRRT; PAM sequence: GAGGGT
aatatatagaagagacccag

SEQ ID NO: 7687 - DNA, 20 bp, Artificial Sequence
  Description of Artificial Sequence: Synthetic oligonucleotide
  Target: SCN10A; (-) strand; PAM type: NNGRRT; PAM sequence: AGGAAT
aaccaatagaaattaaatag

SEQ ID NO: 7688 - DNA, 20 bp, Artificial Sequence
  Description of Artificial Sequence: Synthetic oligonucleotide
  Target: SCN10A; (-) strand; PAM type: NNGRRT; PAM sequence: AGGAGT
agacttgagagagtttgggg

SEQ ID NO: 7689 - DNA, 20 bp, Artificial Sequence
  Description of Artificial Sequence: Synthetic oligonucleotide
  Target: SCN10A; (-) strand; PAM type: NNGRRT; PAM sequence: GAGAGT
tctagtaattgaagacttga

SEQ ID NO: 7690 - DNA, 20 bp, Artificial Sequence
  Description of Artificial Sequence: Synthetic oligonucleotide
  Target: SCN10A; (-) strand; PAM type: NNGRRT; PAM sequence: AGGGGT
atcaacaataaatagcatgt

SEQ ID NO: 7691 - DNA, 20 bp, Artificial Sequence
  Description of Artificial Sequence: Synthetic oligonucleotide
  Target: SCN10A; (-) strand; PAM type: NNGRRT; PAM sequence: TGGGAT
ttcctggaggaaggcataat

SEQ ID NO: 7692 - DNA, 20 bp, Artificial Sequence
  Description of Artificial Sequence: Synthetic oligonucleotide
  Target: SCN10A; (-) strand; PAM type: NNGRRT; PAM sequence: CTGGAT
aaacatccactcttatgggg

SEQ ID NO: 7693 - DNA, 20 bp, Artificial Sequence
  Description of Artificial Sequence: Synthetic oligonucleotide
  Target: SCN10A; (-) strand; PAM type: NNGRRT; PAM sequence: GAGAAT
agacacatacatggtgtttt

SEQ ID NO: 7694 - DNA, 20 bp, Artificial Sequence
  Description of Artificial Sequence: Synthetic oligonucleotide
  Target: SCN10A; (-) strand; PAM type: NNGRRT; PAM sequence: TTGGGT
ttttccctaaggatttccat

SEQ ID NO: 7695 - DNA, 20 bp, Artificial Sequence
  Description of Artificial Sequence: Synthetic oligonucleotide
  Target: SCN10A; (-) strand; PAM type: NNGRRT; PAM sequence: AAGGAT
tagaacatgttcttttccct

SEQ ID NO: 7696 - DNA, 20 bp, Artificial Sequence
  Description of Artificial Sequence: Synthetic oligonucleotide
  Target: SCN10A; (-) strand; PAM type: NNGRRT; PAM sequence: TTGGAT
agccccacacagattagcac

SEQ ID NO: 7697 - DNA, 20 bp, Artificial Sequence
  Description of Artificial Sequence: Synthetic oligonucleotide
  Target: SCN10A; (-) strand; PAM type: NNGRRT; PAM sequence: CTGAAT
ccatggaaatgtcaatgaca

SEQ ID NO: 7698 - DNA, 20 bp, Artificial Sequence
  Description of Artificial Sequence: Synthetic oligonucleotide
  Target: SCN10A; (-) strand; PAM type: NNGRRT; PAM sequence: ATGAAT
tcagacaatcacagaacagg

SEQ ID NO: 7699 - DNA, 20 bp, Artificial Sequence
  Description of Artificial Sequence: Synthetic oligonucleotide
  Target: SCN10A; (-) strand; PAM type: NNGRRT; PAM sequence: CAGGAT
cagttcagacaatcacagaa

SEQ ID NO: 7700 - DNA, 20 bp, Artificial Sequence
  Description of Artificial Sequence: Synthetic oligonucleotide
  Target: SCN10A; (-) strand; PAM type: NNGRRT; PAM sequence: AAGGAT
tcttttcctgtgctaagccg

SEQ ID NO: 7701 - DNA, 20 bp, Artificial Sequence
  Description of Artificial Sequence: Synthetic oligonucleotide
  Target: SCN10A; (-) strand; PAM type: NNGRRT; PAM sequence: GGGGAT
cacactaacagtgtggaaaa

SEQ ID NO: 7702 - DNA, 20 bp, Artificial Sequence
  Description of Artificial Sequence: Synthetic oligonucleotide
  Target: SCN10A; (-) strand; PAM type: NNGRRT; PAM sequence: GAGGGT
agataatatctgctgtgtgg

SEQ ID NO: 7703 - DNA, 20 bp, Artificial Sequence
  Description of Artificial Sequence: Synthetic oligonucleotide
  Target: SCN10A; (-) strand; PAM type: NNGRRT; PAM sequence: GGGAAT
tctgtgacacaatccagcct

SEQ ID NO: 7704 - DNA, 20 bp, Artificial Sequence
  Description of Artificial Sequence: Synthetic oligonucleotide
  Target: SCN10A; (-) strand; PAM type: NNGRRT; PAM sequence: TTGGGT
ttcacaattttatataatta

SEQ ID NO: 7705 - DNA, 20 bp, Artificial Sequence
  Description of Artificial Sequence: Synthetic oligonucleotide
  Target: SCN10A; (-) strand; PAM type: NNGRRT; PAM sequence: TAGAGT
gaggctctggtctgcagttc

SEQ ID NO: 7706 - DNA, 20 bp, Artificial Sequence
  Description of Artificial Sequence: Synthetic oligonucleotide
  Target: SCN10A; (-) strand; PAM type: NNGRRT; PAM sequence: ATGGGT
tttcaggattgggcaatcaa

SEQ ID NO: 7707 - DNA, 20 bp, Artificial Sequence
  Description of Artificial Sequence: Synthetic oligonucleotide
  Target: SCN10A; (-) strand; PAM type: NNGRRT; PAM sequence: CAGGAT
ccaatttgactcccaggttt

SEQ ID NO: 7708 - DNA, 20 bp, Artificial Sequence
  Description of Artificial Sequence: Synthetic oligonucleotide
  Target: SCN10A; (-) strand; PAM type: NNGRRT; PAM sequence: GGGAGT
ggactgtggaaaaaggaaag

SEQ ID NO: 7709 - DNA, 20 bp, Artificial Sequence
  Description of Artificial Sequence: Synthetic oligonucleotide
  Target: SCN10A; (-) strand; PAM type: NNGRRT; PAM sequence: TGGGAT
gggaagtggatcaacaagat

SEQ ID NO: 7710 - DNA, 20 bp, Artificial Sequence
  Description of Artificial Sequence: Synthetic oligonucleotide
  Target: SCN10A; (-) strand; PAM type: NNGRRT; PAM sequence: GTGGAT
tataaggacaccttagggaa

SEQ ID NO: 7711 - DNA, 20 bp, Artificial Sequence
  Description of Artificial Sequence: Synthetic oligonucleotide
  Target: SCN10A; (-) strand; PAM type: NNGRRT; PAM sequence: GTGAAT
attatagatggggaaaaggg

SEQ ID NO: 7712 - DNA, 20 bp, Artificial Sequence
  Description of Artificial Sequence: Synthetic oligonucleotide
  Target: SCN10A; (-) strand; PAM type: NNGRRT; PAM sequence: AGGGGT
tgtaattatagatggggaaa

SEQ ID NO: 7713 - DNA, 20 bp, Artificial Sequence
  Description of Artificial Sequence: Synthetic oligonucleotide
  Target: SCN10A; (-) strand; PAM type: NNGRRT; PAM sequence: AAGGAT
gctggaggcatagagcctaa

SEQ ID NO: 7714 - DNA, 20 bp, Artificial Sequence
  Description of Artificial Sequence: Synthetic oligonucleotide
  Target: SCN10A; (-) strand; PAM type: NNGRRT; PAM sequence: TGGAGT
agctgccgtagacaatgagt

SEQ ID NO: 7715 - DNA, 20 bp, Artificial Sequence
  Description of Artificial Sequence: Synthetic oligonucleotide
  Target: SCN10A; (-) strand; PAM type: NNGRRT; PAM sequence: ATGAGT
cattgcagctgccgtagaca

SEQ ID NO: 7716 - DNA, 20 bp, Artificial Sequence
  Description of Artificial Sequence: Synthetic oligonucleotide
  Target: SCN10A; (-) strand; PAM type: NNGRRT; PAM sequence: CAGGAT
tctgatccttacaaccagcg

SEQ ID NO: 7717 - DNA, 20 bp, Artificial Sequence
  Description of Artificial Sequence: Synthetic oligonucleotide
  Target: SCN10A; (-) strand; PAM type: NNGRRT; PAM sequence: AAGAGT
agaaggcatagaataaagcc

SEQ ID NO: 7718 - DNA, 20 bp, Artificial Sequence
  Description of Artificial Sequence: Synthetic oligonucleotide
  Target: SCN10A; (-) strand; PAM type: NNGRRT; PAM sequence: TAGAAT
aatgccagtgagagaaggca

SEQ ID NO: 7719 - DNA, 20 bp, Artificial Sequence
  Description of Artificial Sequence: Synthetic oligonucleotide
  Target: SCN10A; (-) strand; PAM type: NNGRRT; PAM sequence: ATGGAT
aacctctctccactcccaca

SEQ ID NO: 7720 - DNA, 20 bp, Artificial Sequence
  Description of Artificial Sequence: Synthetic oligonucleotide
  Target: SCN10A; (-) strand; PAM type: NNGRRT; PAM sequence: AGGGAT
tcgcaggtgctagcagcact

SEQ ID NO: 7721 - DNA, 20 bp, Artificial Sequence
  Description of Artificial Sequence: Synthetic oligonucleotide
  Target: SCN10A; (-) strand; PAM type: NNGRRT; PAM sequence: GGGGGT
agagtaccccatgaatgagt

SEQ ID NO: 7722 - DNA, 20 bp, Artificial Sequence
  Description of Artificial Sequence: Synthetic oligonucleotide
  Target: SCN10A; (-) strand; PAM type: NNGRRT; PAM sequence: ATGAGT
accaacagagtaccccatga

SEQ ID NO: 7723 - DNA, 20 bp, Artificial Sequence
  Description of Artificial Sequence: Synthetic oligonucleotide
  Target: SCN10A; (-) strand; PAM type: NNGRRT; PAM sequence: ATGAAT
gggcaccaacagagtacccc

SEQ ID NO: 7724 - DNA, 20 bp, Artificial Sequence
  Description of Artificial Sequence: Synthetic oligonucleotide
  Target: SCN10A; (-) strand; PAM type: NNGRRT; PAM sequence: CAGAGT
ggatctgggtggggcaccaa

SEQ ID NO: 7725 - DNA, 20 bp, Artificial Sequence
  Description of Artificial Sequence: Synthetic oligonucleotide
  Target: SCN10A; (-) strand; PAM type: NNGRRT; PAM sequence: CTGGGT
gctgacctggtgaaagggat

SEQ ID NO: 7726 - DNA, 20 bp, Artificial Sequence
  Description of Artificial Sequence: Synthetic oligonucleotide
  Target: SCN10A; (-) strand; PAM type: NNGRRT; PAM sequence: AGGGAT
agctgtgctgacctggtgaa

SEQ ID NO: 7727 - DNA, 20 bp, Artificial Sequence
  Description of Artificial Sequence: Synthetic oligonucleotide
  Target: SCN10A; (-) strand; PAM type: NNGRRT; PAM sequence: CGGGAT
ctgctgccatgcaagcagct

SEQ ID NO: 7728 - DNA, 20 bp, Artificial Sequence
  Description of Artificial Sequence: Synthetic oligonucleotide
  Target: SCN10A; (-) strand; PAM type: NNGRRT; PAM sequence: TAGAAT
gccaaaagagactttttttg

SEQ ID NO: 7729 - DNA, 20 bp, Artificial Sequence
  Description of Artificial Sequence: Synthetic oligonucleotide
  Target: SCN10A; (-) strand; PAM type: NNGRRT; PAM sequence: AGGAGT
gcagagggtggaactaaaca

SEQ ID NO: 7730 - DNA, 20 bp, Artificial Sequence
  Description of Artificial Sequence: Synthetic oligonucleotide
  Target: SCN10A; (-) strand; PAM type: NNGRRT; PAM sequence: GAGGGT
aagcaaaacagaatggggca

SEQ ID NO: 7731 - DNA, 20 bp, Artificial Sequence
  Description of Artificial Sequence: Synthetic oligonucleotide
  Target: SCN10A; (-) strand; PAM type: NNGRRT; PAM sequence: CAGAAT
agaaagcgaatgaagcaaaa

SEQ ID NO: 7732 - DNA, 20 bp, Artificial Sequence
  Description of Artificial Sequence: Synthetic oligonucleotide
  Target: SCN10A; (-) strand; PAM type: NNGRRT; PAM sequence: GCGAAT
gggagtgctctcaggagaaa

SEQ ID NO: 7733 - DNA, 20 bp, Artificial Sequence
  Description of Artificial Sequence: Synthetic oligonucleotide
  Target: SCN10A; (-) strand; PAM type: NNGRRT; PAM sequence: GGGAGT
ttgtgcaagtgacctattga

SEQ ID NO: 7734 - DNA, 20 bp, Artificial Sequence
  Description of Artificial Sequence: Synthetic oligonucleotide
  Target: SCN10A; (-) strand; PAM type: NNGRRT; PAM sequence: GAGGAT
tctcaaagaagaagctaagt

SEQ ID NO: 7735 - DNA, 20 bp, Artificial Sequence
  Description of Artificial Sequence: Synthetic oligonucleotide
  Target: SCN10A; (-) strand; PAM type: NNGRRT; PAM sequence: AGGAAT
accgtttagggagctatagg

SEQ ID NO: 7736 - DNA, 20 bp, Artificial Sequence
  Description of Artificial Sequence: Synthetic oligonucleotide
  Target: SCN10A; (-) strand; PAM type: NNGRRT; PAM sequence: TTGGAT
aggttgcagactgtccattc

SEQ ID NO: 7737 - DNA, 20 bp, Artificial Sequence
  Description of Artificial Sequence: Synthetic oligonucleotide
  Target: SCN10A; (-) strand; PAM type: NNGRRT; PAM sequence: AGGAGT
gaaggagcaggaggtttgtg

SEQ ID NO: 7738 - DNA, 20 bp, Artificial Sequence
  Description of Artificial Sequence: Synthetic oligonucleotide
  Target: SCN10A; (-) strand; PAM type: NNGRRT; PAM sequence: TGGGAT
ttttgtgctcgtaatcttcc

SEQ ID NO: 7739 - DNA, 20 bp, Artificial Sequence
  Description of Artificial Sequence: Synthetic oligonucleotide
  Target: SCN10A; (-) strand; PAM type: NNGRRT; PAM sequence: ATGGGT
aattcaggggtccatgtgct

SEQ ID NO: 7740 - DNA, 20 bp, Artificial Sequence
  Description of Artificial Sequence: Synthetic oligonucleotide
  Target: SCN10A; (-) strand; PAM type: NNGRRT; PAM sequence: AGGGGT
gaggaggctgacttaaattc

SEQ ID NO: 7741 - DNA, 20 bp, Artificial Sequence
  Description of Artificial Sequence: Synthetic oligonucleotide
  Target: SCN10A; (-) strand; PAM type: NNGRRT; PAM sequence: GTGGGT
gcagacttggttggaggctg

SEQ ID NO: 7742 - DNA, 20 bp, Artificial Sequence
  Description of Artificial Sequence: Synthetic oligonucleotide
  Target: SCN10A; (-) strand; PAM type: NNGRRT; PAM sequence: CAGGAT
cactgttccgcctcatgaca

SEQ ID NO: 7743 - DNA, 20 bp, Artificial Sequence
  Description of Artificial Sequence: Synthetic oligonucleotide
  Target: SCN10A; (-) strand; PAM type: NNGRRT; PAM sequence: CCGGAT
gccttaaaacttctgacaac

SEQ ID NO: 7744 - DNA, 20 bp, Artificial Sequence
  Description of Artificial Sequence: Synthetic oligonucleotide
  Target: SCN10A; (-) strand; PAM type: NNGRRT; PAM sequence: GGGGAT
taccttgtctgcaataagca

SEQ ID NO: 7745 - DNA, 20 bp, Artificial Sequence
  Description of Artificial Sequence: Synthetic oligonucleotide
  Target: SCN10A; (-) strand; PAM type: NNGRRT; PAM sequence: ATGGAT
agtattagcgtccccgtttt

SEQ ID NO: 7746 - DNA, 20 bp, Artificial Sequence
  Description of Artificial Sequence: Synthetic oligonucleotide
  Target: SCN10A; (-) strand; PAM type: NNGRRT; PAM sequence: TTGAGT
ttatctgtaaagaaagaaca

SEQ ID NO: 7747 - DNA, 20 bp, Artificial Sequence
  Description of Artificial Sequence: Synthetic oligonucleotide
  Target: SCN10A; (-) strand; PAM type: NNGRRT; PAM sequence: AGGAGT
tcctattatgagagagagga

SEQ ID NO: 7748 - DNA, 20 bp, Artificial Sequence
  Description of Artificial Sequence: Synthetic oligonucleotide
  Target: SCN10A; (-) strand; PAM type: NNGRRT; PAM sequence: GTGGAT
atcaggccatctctgctagg

SEQ ID NO: 7749 - DNA, 20 bp, Artificial Sequence
  Description of Artificial Sequence: Synthetic oligonucleotide
  Target: SCN10A; (-) strand; PAM type: NNGRRT; PAM sequence: TAGGGT
attgatcaggccatctctgc

SEQ ID NO: 7750 - DNA, 20 bp, Artificial Sequence
  Description of Artificial Sequence: Synthetic oligonucleotide
  Target: SCN10A; (-) strand; PAM type: NNGRRT; PAM sequence: AGGAAT
aagaattccatgtattcaca

SEQ ID NO: 7751 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tggagaaatcctgggagtaa

SEQ ID NO: 7752 - DNA, 20 bp, Artificial Sequence
  Description of Artificial Sequence: Synthetic oligonucleotide
  Target: SCN10A; (-) strand; PAM type: NNGRRT; PAM sequence: GGGAGT
ggagttcatggagaaatcct

SEQ ID NO: 7753 - DNA, 20 bp, Artificial Sequence
  Description of Artificial Sequence: Synthetic oligonucleotide
  Target: SCN10A; (-) strand; PAM type: NNGRRT; PAM sequence: TGGAGT
ataaggagagccccagaggt

SEQ ID NO: 7754 - DNA, 20 bp, Artificial Sequence
  Description of Artificial Sequence: Synthetic oligonucleotide
  Target: SCN10A; (-) strand; PAM type: NNGRRT; PAM sequence: TGGGAT
gggttgttcacatggatgtc

SEQ ID NO: 7755 - DNA, 20 bp, Artificial Sequence
  Description of Artificial Sequence: Synthetic oligonucleotide
  Target: SCN10A; (-) strand; PAM type: NNGRRT; PAM sequence: ATGGAT
ccatggtatgggttgttcac

SEQ ID NO: 7756 - DNA, 20 bp, Artificial Sequence
  Description of Artificial Sequence: Synthetic oligonucleotide
  Target: SCN10A; (-) strand; PAM type: NNGRRT; PAM sequence: ATGGGT
tcagagctctaatccatggt

SEQ ID NO: 7757 - DNA, 20 bp, Artificial Sequence
  Description of Artificial Sequence: Synthetic oligonucleotide
  Target: SCN10A; (-) strand; PAM type: NNGRRT; PAM sequence: TAGAAT
gagatagacttggaactgat

SEQ ID NO: 7758 - DNA, 20 bp, Artificial Sequence
  Description of Artificial Sequence: Synthetic oligonucleotide
  Target: SCN10A; (-) strand; PAM type: NNGRRT; PAM sequence: GTGGGT
ccaagagcctatctttaaat

SEQ ID NO: 7759 - DNA, 20 bp, Artificial Sequence
  Description of Artificial Sequence: Synthetic oligonucleotide
  Target: SCN10A; (-) strand; PAM type: NNGRRT; PAM sequence: ATGGGT
aattaagaaacctacaggaa

SEQ ID NO: 7760 - DNA, 20 bp, Artificial Sequence
  Description of Artificial Sequence: Synthetic oligonucleotide
  Target: SCN10A; (-) strand; PAM type: NNGRRT; PAM sequence: CAGAGT
catagaaacaaggctgccct

SEQ ID NO: 7761 - DNA, 20 bp, Artificial Sequence
  Description of Artificial Sequence: Synthetic oligonucleotide
  Target: SCN10A; (-) strand; PAM type: NNGRRT; PAM sequence: GTGGAT
gtttatatgcagtggctatg

SEQ ID NO: 7762 - DNA, 20 bp, Artificial Sequence
  Description of Artificial Sequence: Synthetic oligonucleotide
  Target: SCN10A; (-) strand; PAM type: NNGRRT; PAM sequence: AGGAAT
cttccaaggttaaaaacaat

SEQ ID NO: 7763 - DNA, 20 bp, Artificial Sequence
  Description of Artificial Sequence: Synthetic oligonucleotide
  Target: SCN10A; (-) strand; PAM type: NNGRRT; PAM sequence: ATGGAT
caggggtctcaaggcagaaa

SEQ ID NO: 7764 - DNA, 20 bp, Artificial Sequence
  Description of Artificial Sequence: Synthetic oligonucleotide
  Target: SCN10A; (-) strand; PAM type: NNGRRT; PAM sequence: AGGGGT
ggcactgtgggaggaaggtc

SEQ ID NO: 7765 - DNA, 20 bp, Artificial Sequence
  Description of Artificial Sequence: Synthetic oligonucleotide
  Target: SCN10A; (-) strand; PAM type: NNGRRT; PAM sequence: CAGAGT
ctgtggggctgcagagaagc

SEQ ID NO: 7766 - DNA, 20 bp, Artificial Sequence
  Description of Artificial Sequence: Synthetic oligonucleotide
  Target: SCN10A; (-) strand; PAM type: NNGRRT; PAM sequence: CTGGGT
gcatgccgtgaaagctaaac

SEQ ID NO: 7767 - DNA, 20 bp, Artificial Sequence
  Description of Artificial Sequence: Synthetic oligonucleotide
  Target: SCN10A; (-) strand; PAM type: NNGRRT; PAM sequence: CAGAGT
ggccagctcaggataacgga

SEQ ID NO: 7768 - DNA, 20 bp, Artificial Sequence
  Description of Artificial Sequence: Synthetic oligonucleotide
  Target: SCN10A; (-) strand; PAM type: NNGRRT; PAM sequence: CAGGAT
atggcagagagaggccagct

SEQ ID NO: 7769 - DNA, 20 bp, Artificial Sequence
  Description of Artificial Sequence: Synthetic oligonucleotide
  Target: SCN10A; (-) strand; PAM type: NNGRRT; PAM sequence: TGGGAT
agtgggggagtggaccaggc

SEQ ID NO: 7770 - DNA, 20 bp, Artificial Sequence
  Description of Artificial Sequence: Synthetic oligonucleotide
  Target: SCN10A; (-) strand; PAM type: NNGRRT; PAM sequence: GGGAGT
aggtgccagccaggcagtgg

SEQ ID NO: 7771 - DNA, 20 bp, Artificial Sequence
  Description of Artificial Sequence: Synthetic oligonucleotide
  Target: SCN10A; (-) strand; PAM type: NNGRRT; PAM sequence: TTGGGT
tcctttttgtggtaaagttg

SEQ ID NO: 7772 - DNA, 20 bp, Artificial Sequence
  Description of Artificial Sequence: Synthetic oligonucleotide
  Target: SCN10A; (-) strand; PAM type: NNGRRT; PAM sequence: GAGGGT
tttggttctttggctcatga

SEQ ID NO: 7773 - DNA, 20 bp, Artificial Sequence
  Description of Artificial Sequence: Synthetic oligonucleotide
  Target: SCN10A; (-) strand; PAM type: NNGRRT; PAM sequence: AGGGAT
cagaatgtgagacaaagcta

SEQ ID NO: 7774 - DNA, 20 bp, Artificial Sequence
  Description of Artificial Sequence: Synthetic oligonucleotide
  Target: SCN10A; (-) strand; PAM type: NNGRRT; PAM sequence: CAGAAT
gaccattccaggtggcagaa

SEQ ID NO: 7775 - DNA, 20 bp, Artificial Sequence
  Description of Artificial Sequence: Synthetic oligonucleotide
  Target: SCN10A; (-) strand; PAM type: NNGRRT; PAM sequence: GTGAAT
gtaggatgtctccaggctgg

SEQ ID NO: 7776 - DNA, 20 bp, Artificial Sequence
  Description of Artificial Sequence: Synthetic oligonucleotide
  Target: SCN10A; (-) strand; PAM type: NNGRRT; PAM sequence: CTGGGT
gcaggtaggatgtctccagg

SEQ ID NO: 7777 - DNA, 20 bp, Artificial Sequence
  Description of Artificial Sequence: Synthetic oligonucleotide
  Target: SCN10A; (-) strand; PAM type: NNGRRT; PAM sequence: TAGGAT
ggtgagctttcaagggcagg

SEQ ID NO: 7778 - DNA, 20 bp, Artificial Sequence
  Description of Artificial Sequence: Synthetic oligonucleotide
  Target: SCN10A; (-) strand; PAM type: NNGRRT; PAM sequence: GTGGGT
tttggttgccatgtggaaat

SEQ ID NO: 7779 - DNA, 20 bp, Artificial Sequence
  Description of Artificial Sequence: Synthetic oligonucleotide
  Target: SCN10A; (-) strand; PAM type: NNGRRT; PAM sequence: GAGAGT
caggagggaacctaggagct

SEQ ID NO: 7780 - DNA, 20 bp, Artificial Sequence
  Description of Artificial Sequence: Synthetic oligonucleotide
  Target: SCN10A; (-) strand; PAM type: NNGRRT; PAM sequence: TGGAGT
gattcataacaacaaatgag

SEQ ID NO: 7781 - DNA, 20 bp, Artificial Sequence
  Description of Artificial Sequence: Synthetic oligonucleotide
  Target: SCN10A; (-) strand; PAM type: NNGRRT; PAM sequence: ATGAGT
ggccagattcataacaacaa

SEQ ID NO: 7782 - DNA, 20 bp, Artificial Sequence
  Description of Artificial Sequence: Synthetic oligonucleotide
  Target: SCN10A; (-) strand; PAM type: NNGRRT; PAM sequence: TCGAAT
atgtatcagactttgcaatt

SEQ ID NO: 7783 - DNA, 20 bp, Artificial Sequence
  Description of Artificial Sequence: Synthetic oligonucleotide
  Target: SCN10A; (-) strand; PAM type: NNGRRT; PAM sequence: AAGAAT
gggtgtggatacatagagac

SEQ ID NO: 7784 - DNA, 20 bp, Artificial Sequence
  Description of Artificial Sequence: Synthetic oligonucleotide
  Target: SCN10A; (-) strand; PAM type: NNGRRT; PAM sequence: GTGGAT
aaagtcacattggaaagggt

SEQ ID NO: 7785 - DNA, 20 bp, Artificial Sequence
  Description of Artificial Sequence: Synthetic oligonucleotide
  Target: SCN10A; (-) strand; PAM type: NNGRRT; PAM sequence: AAGGGT
agctgaaaagtcacattgga

SEQ ID NO: 7786 - DNA, 20 bp, Artificial Sequence
  Description of Artificial Sequence: Synthetic oligonucleotide
  Target: SCN10A; (-) strand; PAM type: NNGRRT; PAM sequence: TTGGGT
ggactgggatcagatgggca

SEQ ID NO: 7787 - DNA, 20 bp, Artificial Sequence
  Description of Artificial Sequence: Synthetic oligonucleotide
  Target: SCN10A; (-) strand; PAM type: NNGRRT; PAM sequence: TGGGAT
tgtgcatcagcattttggac

SEQ ID NO: 7788 - DNA, 20 bp, Artificial Sequence
  Description of Artificial Sequence: Synthetic oligonucleotide
  Target: SCN10A; (-) strand; PAM type: NNGRRT; PAM sequence: GTGAAT
acaaatgaccccaaaatttt

SEQ ID NO: 7789 - DNA, 20 bp, Artificial Sequence
  Description of Artificial Sequence: Synthetic oligonucleotide
  Target: SCN10A; (-) strand; PAM type: NNGRRT; PAM sequence: ATGAGT
agctcatggggagggaatgt

SEQ ID NO: 7790 - DNA, 20 bp, Artificial Sequence
  Description of Artificial Sequence: Synthetic oligonucleotide
  Target: SCN10A; (-) strand; PAM type: NNGRRT; PAM sequence: GGGAAT
caacccagagctcatgggga

SEQ ID NO: 7791 - DNA, 20 bp, Artificial Sequence
  Description of Artificial Sequence: Synthetic oligonucleotide
  Target: SCN10A; (-) strand; PAM type: NNGRRT; PAM sequence: TGGGGT
tggcatattatgggcacaga

SEQ ID NO: 7792 - DNA, 20 bp, Artificial Sequence
  Description of Artificial Sequence: Synthetic oligonucleotide
  Target: SCN10A; (-) strand; PAM type: NNGRRT; PAM sequence: ACGAGT
ttcccaacttatgacaaagc

SEQ ID NO: 7793 - DNA, 20 bp, Artificial Sequence
  Description of Artificial Sequence: Synthetic oligonucleotide
  Target: SCN10A; (-) strand; PAM type: NNGRRT; PAM sequence: GTGAGT
ggcaatggatctgactcagg

SEQ ID NO: 7794 - DNA, 20 bp, Artificial Sequence
  Description of Artificial Sequence: Synthetic oligonucleotide
  Target: SCN10A; (-) strand; PAM type: NNGRRT; PAM sequence: CAGGGT
gtgtggcaatggatctgact

SEQ ID NO: 7795 - DNA, 20 bp, Artificial Sequence
  Description of Artificial Sequence: Synthetic oligonucleotide
  Target: SCN10A; (-) strand; PAM type: NNGRRT; PAM sequence: ATGGAT
tgaccccttactgtgtggca

SEQ ID NO: 7796 - DNA, 20 bp, Artificial Sequence
  Description of Artificial Sequence: Synthetic oligonucleotide
  Target: SCN10A; (-) strand; PAM type: NNGRRT; PAM sequence: GAGGGT
accacacaaggcttgggttg

SEQ ID NO: 7797 - DNA, 20 bp, Artificial Sequence
  Description of Artificial Sequence: Synthetic oligonucleotide
  Target: SCN10A; (-) strand; PAM type: NNGRRT; PAM sequence: TTGGGT
ttgcattcaccacacaaggc

SEQ ID NO: 7798 - DNA, 20 bp, Artificial Sequence
  Description of Artificial Sequence: Synthetic oligonucleotide
  Target: SCN10A; (-) strand; PAM type: NNGRRT; PAM sequence: GGGAAT
gagctcactttggaagactt

SEQ ID NO: 7799 - DNA, 20 bp, Artificial Sequence
  Description of Artificial Sequence: Synthetic oligonucleotide
  Target: SCN10A; (-) strand; PAM type: NNGRRT; PAM sequence: CTGAGT
catgtggcccagcatgccca

SEQ ID NO: 7800 - DNA, 20 bp, Artificial Sequence
  Description of Artificial Sequence: Synthetic oligonucleotide
  Target: SCN10A; (-) strand; PAM type: NNGRRT; PAM sequence: TTGGGT
tcttgagttgtgttttactt

SEQ ID NO: 7801 - DNA, 20 bp, Artificial Sequence
  Description of Artificial Sequence: Synthetic oligonucleotide
  Target: SCN10A; (-) strand; PAM type: NNGRRT; PAM sequence: TTGAGT
ttcctgccaaaatggttctc

SEQ ID NO: 7802 - DNA, 20 bp, Artificial Sequence
  Description of Artificial Sequence: Synthetic oligonucleotide
  Target: SCN10A; (-) strand; PAM type: NNGRRT; PAM sequence: GGGGAT
cttggtatcatatagggaca

SEQ ID NO: 7803 - DNA, 20 bp, Artificial Sequence
  Description of Artificial Sequence: Synthetic oligonucleotide
  Target: SCN10A; (-) strand; PAM type: NNGRRT; PAM sequence: TGGAGT
catctcacagaaaacgtgag

SEQ ID NO: 7804 - DNA, 20 bp, Artificial Sequence
  Description of Artificial Sequence: Synthetic oligonucleotide
  Target: SCN10A; (-) strand; PAM type: NNGRRT; PAM sequence: GTGAGT
ctactcatctcacagaaaac

SEQ ID NO: 7805 - DNA, 20 bp, Artificial Sequence
  Description of Artificial Sequence: Synthetic oligonucleotide
  Target: SCN10A; (-) strand; PAM type: NNGRRT; PAM sequence: AAGAAT
acctcaaaaataaatgtgtc

SEQ ID NO: 7806 - DNA, 20 bp, Artificial Sequence
  Description of Artificial Sequence: Synthetic oligonucleotide
  Target: SCN10A; (-) strand; PAM type: NNGRRT; PAM sequence: GAGGAT
tcctgtatgtagagatgaag

SEQ ID NO: 7807 - DNA, 20 bp, Artificial Sequence
  Description of Artificial Sequence: Synthetic oligonucleotide
  Target: SCN10A; (-) strand; PAM type: NNGRRT; PAM sequence: TGGAGT
gaaaggtcttggaactgccc

SEQ ID NO: 7808 - DNA, 20 bp, Artificial Sequence
  Description of Artificial Sequence: Synthetic oligonucleotide
  Target: SCN10A; (-) strand; PAM type: NNGRRT; PAM sequence: TCGGAT
tctcagagtaaatgcaagct

SEQ ID NO: 7809 - DNA, 20 bp, Artificial Sequence
  Description of Artificial Sequence: Synthetic oligonucleotide
  Target: SCN10A; (-) strand; PAM type: NNGRRT; PAM sequence: CAGAGT
ctgactctctgcctgcctct

SEQ ID NO: 7810 - DNA, 20 bp, Artificial Sequence
  Description of Artificial Sequence: Synthetic oligonucleotide
  Target: SCN10A; (-) strand; PAM type: NNGRRT; PAM sequence: GAGAAT
agttgcatcgtctttataat

SEQ ID NO: 7811 - DNA, 20 bp, Artificial Sequence
  Description of Artificial Sequence: Synthetic oligonucleotide
  Target: SCN10A; (-) strand; PAM type: NNGRRT; PAM sequence: CTGGGT
gatgataaaaaatgcattgc

SEQ ID NO: 7812 - DNA, 20 bp, Artificial Sequence
  Description of Artificial Sequence: Synthetic oligonucleotide
  Target: SCN10A; (-) strand; PAM type: NNGRRT; PAM sequence: AGGAAT
taaattgaattgctagtgtc

SEQ ID NO: 7813 - DNA, 20 bp, Artificial Sequence
  Description of Artificial Sequence: Synthetic oligonucleotide
  Target: SCN10A; (-) strand; PAM type: NNGRRT; PAM sequence: TTGAAT
ctcagcataaattatttaaa

SEQ ID NO: 7814 - DNA, 20 bp, Artificial Sequence
  Description of Artificial Sequence: Synthetic oligonucleotide
  Target: SCN10A; (-) strand; PAM type: NNGRRT; PAM sequence: TGGGGT
aaagacagatgccaaattac

SEQ ID NO: 7815 - DNA, 20 bp, Artificial Sequence
  Description of Artificial Sequence: Synthetic oligonucleotide
  Target: SCN10A; (-) strand; PAM type: NNGRRT; PAM sequence: GTGGAT
actgacacatgtagtgctca

SEQ ID NO: 7816 - DNA, 20 bp, Artificial Sequence
  Description of Artificial Sequence: Synthetic oligonucleotide
  Target: SCN10A; (-) strand; PAM type: NNGRRT; PAM sequence: TGGGAT
tactgtgctgccccttcttc

SEQ ID NO: 7817 - DNA, 20 bp, Artificial Sequence
  Description of Artificial Sequence: Synthetic oligonucleotide
  Target: SCN10A; (-) strand; PAM type: NNGRRT; PAM sequence: TGGAAT
cctcacatctcaccatgctc

SEQ ID NO: 7818 - DNA, 20 bp, Artificial Sequence
  Description of Artificial Sequence: Synthetic oligonucleotide
  Target: SCN10A; (-) strand; PAM type: NNGRRT; PAM sequence: CTGAGT
tactctcaactgggaagacc

SEQ ID NO: 7819 - DNA, 20 bp, Artificial Sequence
  Description of Artificial Sequence: Synthetic oligonucleotide
  Target: SCN10A; (-) strand; PAM type: NNGRRT; PAM sequence: TAGAGT
gtaaacagaaacacccattc

SEQ ID NO: 7820 - DNA, 20 bp, Artificial Sequence
  Description of Artificial Sequence: Synthetic oligonucleotide
  Target: SCN10A; (-) strand; PAM type: NNGRRT; PAM sequence: AAGAAT
aggttctctcctctcacccc

SEQ ID NO: 7821 - DNA, 20 bp, Artificial Sequence
  Description of Artificial Sequence: Synthetic oligonucleotide
  Target: SCN10A; (-) strand; PAM type: NNGRRT; PAM sequence: GAGGAT
gcccccatgaggttgatggt

SEQ ID NO: 7822 - DNA, 20 bp, Artificial Sequence
  Description of Artificial Sequence: Synthetic oligonucleotide
  Target: SCN10A; (-) strand; PAM type: NNGRRT; PAM sequence: GAGAAT
ttaggcaattcttgattact

SEQ ID NO: 7823 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tttagacacccagaggaaaa

SEQ ID NO: 7824 - DNA, 20 bp, Artificial Sequence
  Description of Artificial Sequence: Synthetic oligonucleotide
  Target: SCN10A; (-) strand; PAM type: NNGRRT; PAM sequence: AAGGAT
tttatttataccttaaacta

SEQ ID NO: 7825 - DNA, 20 bp, Artificial Sequence
  Description of Artificial Sequence: Synthetic oligonucleotide
  Target: SCN10A; (-) strand; PAM type: NNGRRT; PAM sequence: TTGAAT
attcaggcaagacccctcag

SEQ ID NO: 7826 - DNA, 20 bp, Artificial Sequence
  Description of Artificial Sequence: Synthetic oligonucleotide
  Target: SCN10A; (-) strand; PAM type: NNGRRT; PAM sequence: TGGGAT
ttcactttctgttctggttg

SEQ ID NO: 7827 - DNA, 20 bp, Artificial Sequence
  Description of Artificial Sequence: Synthetic oligonucleotide
  Target: SCN10A; (-) strand; PAM type: NNGRRT; PAM sequence: TGGAGT
aagacaaaggaactgaggcc

SEQ ID NO: 7828 - DNA, 20 bp, Artificial Sequence
  Description of Artificial Sequence: Synthetic oligonucleotide
  Target: SCN10A; (-) strand; PAM type: NNGRRT; PAM sequence: CAGAGT
atctcaggcctgcggacatt

SEQ ID NO: 7829 - DNA, 20 bp, Artificial Sequence
  Description of Artificial Sequence: Synthetic oligonucleotide
  Target: SCN10A; (-) strand; PAM type: NNGRRT; PAM sequence: TGGGAT
ggcacagcaatagatctccg

SEQ ID NO: 7830 - DNA, 20 bp, Artificial Sequence
  Description of Artificial Sequence: Synthetic oligonucleotide
  Target: SCN10A; (-) strand; PAM type: NNGRRT; PAM sequence: AAGGGT
gatcacaatgcatcttctca

SEQ ID NO: 7831 - DNA, 20 bp, Artificial Sequence
  Description of Artificial Sequence: Synthetic oligonucleotide
  Target: SCN10A; (-) strand; PAM type: NNGRRT; PAM sequence: GTGGAT
ataacagttagcctgtcaca

SEQ ID NO: 7832 - DNA, 20 bp, Artificial Sequence
  Description of Artificial Sequence: Synthetic oligonucleotide
  Target: SCN10A; (-) strand; PAM type: NNGRRT; PAM sequence: GGGGGT
ttgccacagagtaccgcttc

SEQ ID NO: 7833 - DNA, 20 bp, Artificial Sequence
  Description of Artificial Sequence: Synthetic oligonucleotide
  Target: SCN10A; (-) strand; PAM type: NNGRRT; PAM sequence: CAGAGT
atggcctggggttcttgcca

SEQ ID NO: 7834 - DNA, 20 bp, Artificial Sequence
  Description of Artificial Sequence: Synthetic oligonucleotide
  Target: SCN10A; (-) strand; PAM type: NNGRRT; PAM sequence: TGGGGT
tcatttggaattgtatggcc

SEQ ID NO: 7835 - DNA, 20 bp, Artificial Sequence
  Description of Artificial Sequence: Synthetic oligonucleotide
  Target: SCN10A; (-) strand; PAM type: NNGRRT; PAM sequence: TGGAAT
ctcagttcagcttcctcatt

SEQ ID NO: 7836 - DNA, 20 bp, Artificial Sequence
  Description of Artificial Sequence: Synthetic oligonucleotide
  Target: SCN10A; (-) strand; PAM type: NNGRRT; PAM sequence: ATGGGT
tgggtgtccatgtggggctt

SEQ ID NO: 7837 - DNA, 20 bp, Artificial Sequence
  Description of Artificial Sequence: Synthetic oligonucleotide
  Target: SCN10A; (-) strand; PAM type: NNGRRT; PAM sequence: ATGGGT
aataaaataaaaagatttgc

SEQ ID NO: 7838 - DNA, 20 bp, Artificial Sequence
  Description of Artificial Sequence: Synthetic oligonucleotide
  Target: SCN10A; (-) strand; PAM type: NNGRRT; PAM sequence: AAGAAT
aatctcagaaatcagcgtta

SEQ ID NO: 7839 - DNA, 20 bp, Artificial Sequence
  Description of Artificial Sequence: Synthetic oligonucleotide
  Target: SCN10A; (-) strand; PAM type: NNGRRT; PAM sequence: TCGGGT
ctgggtacagtgtacactgc

SEQ ID NO: 7840 - DNA, 20 bp, Artificial Sequence
  Description of Artificial Sequence: Synthetic oligonucleotide
  Target: SCN10A; (-) strand; PAM type: NNGRRT; PAM sequence: CTGGGT
aagggataagagactacaca

SEQ ID NO: 7841 - DNA, 20 bp, Artificial Sequence
  Description of Artificial Sequence: Synthetic oligonucleotide
  Target: SCN10A; (-) strand; PAM type: NNGRRT; PAM sequence: AGGGAT
ggaaaggtgagacgaaggta

SEQ ID NO: 7842 - DNA, 20 bp, Artificial Sequence
  Description of Artificial Sequence: Synthetic oligonucleotide
  Target: SCN10A; (-) strand; PAM type: NNGRRT; PAM sequence: GAGGAT
acaagcaggagctaagctgt

SEQ ID NO: 7843 - DNA, 20 bp, Artificial Sequence
  Description of Artificial Sequence: Synthetic oligonucleotide
  Target: SCN10A; (-) strand; PAM type: NNGRRT; PAM sequence: AGGAAT
tattctaaatgaagtaactc

SEQ ID NO: 7844 - DNA, 20 bp, Artificial Sequence
  Description of Artificial Sequence: Synthetic oligonucleotide
  Target: SCN10A; (-) strand; PAM type: NNGRRT; PAM sequence: TGGAGT
ggcattggcagcaagctgga

SEQ ID NO: 7845 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ataatggcattggcagcaag

SEQ ID NO: 7846 - DNA, 20 bp, Artificial Sequence
  Description of Artificial Sequence: Synthetic oligonucleotide
  Target: SCN10A; (-) strand; PAM type: NNGRRT; PAM sequence: AGGAAT
aatactactcagttgtaaaa

SEQ ID NO: 7847 - DNA, 20 bp, Artificial Sequence
  Description of Artificial Sequence: Synthetic oligonucleotide
  Target: SCN10A; (-) strand; PAM type: NNGRRT; PAM sequence: TGGAAT
aatatggtgtatgcatacca

SEQ ID NO: 7848 - DNA, 20 bp, Artificial Sequence
  Description of Artificial Sequence: Synthetic oligonucleotide
  Target: SCN10A; (-) strand; PAM type: NNGRRT; PAM sequence: CTGGGT
ttggtccagcaatcccacta

SEQ ID NO: 7849 - DNA, 20 bp, Artificial Sequence
  Description of Artificial Sequence: Synthetic oligonucleotide
  Target: SCN10A; (-) strand; PAM type: NNGRRT; PAM sequence: GGGAAT
aacaattttacactgctggt

SEQ ID NO: 7850 - DNA, 20 bp, Artificial Sequence
  Description of Artificial Sequence: Synthetic oligonucleotide
  Target: SCN10A; (-) strand; PAM type: NNGRRT; PAM sequence: ATGGAT
aaaaaataatagatgttggc

SEQ ID NO: 7851 - DNA, 20 bp, Artificial Sequence
  Description of Artificial Sequence: Synthetic oligonucleotide
  Target: SCN10A; (-) strand; PAM type: NNGRRT; PAM sequence: AAGAAT
agataccaccttactcctgc

SEQ ID NO: 7852 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tccaaaagtgggcaaaggac

SEQ ID NO: 7853 - DNA, 20 bp, Artificial Sequence
  Description of Artificial Sequence: Synthetic oligonucleotide
  Target: SCN10A; (-) strand; PAM type: NNGRRT; PAM sequence: TAGGAT
ccaagtaaacagacaaccca

SEQ ID NO: 7854 - DNA, 20 bp, Artificial Sequence
  Description of Artificial Sequence: Synthetic oligonucleotide
  Target: SCN10A; (-) strand; PAM type: NNGRRT; PAM sequence: TGGGAT
caaaaacaaaaataaataga

SEQ ID NO: 7855 - DNA, 20 bp, Artificial Sequence
  Description of Artificial Sequence: Synthetic oligonucleotide
  Target: SCN10A; (-) strand; PAM type: NNGRRT; PAM sequence: ATGGAT
tatacaaaaatcaattcaag

SEQ ID NO: 7856 - DNA, 20 bp, Artificial Sequence
  Description of Artificial Sequence: Synthetic oligonucleotide
  Target: SCN10A; (-) strand; PAM type: NNGRRT; PAM sequence: CTGAAT
ccacatgtggaagaaagaaa

SEQ ID NO: 7857 - DNA, 20 bp, Artificial Sequence
  Description of Artificial Sequence: Synthetic oligonucleotide
  Target: SCN10A; (-) strand; PAM type: NNGRRT; PAM sequence: TGGGAT
ccctattcaacaaatggtgc

SEQ ID NO: 7858 - DNA, 20 bp, Artificial Sequence
  Description of Artificial Sequence: Synthetic oligonucleotide
  Target: SCN10A; (-) strand; PAM type: NNGRRT; PAM sequence: AAGAAT
aagcacatagaccaatggaa

SEQ ID NO: 7859 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tagccaaagcaagactaagc

SEQ ID NO: 7860 - DNA, 20 bp, Artificial Sequence
  Description of Artificial Sequence: Synthetic oligonucleotide
  Target: SCN10A; (-) strand; PAM type: NNGRRT; PAM sequence: AGGAAT
aaattcatagggaaccaaaa

SEQ ID NO: 7861 - DNA, 20 bp, Artificial Sequence
  Description of Artificial Sequence: Synthetic oligonucleotide
  Target: SCN10A; (-) strand; PAM type: NNGRRT; PAM sequence: ATGGAT
aacacatcccatgctcatgg

SEQ ID NO: 7862 - DNA, 20 bp, Artificial Sequence
  Description of Artificial Sequence: Synthetic oligonucleotide
  Target: SCN10A; (-) strand; PAM type: NNGRRT; PAM sequence: ATGGAT
tgggaacacatcccatgctc

SEQ ID NO: 7863 - DNA, 20 bp, Artificial Sequence
  Description of Artificial Sequence: Synthetic oligonucleotide
  Target: SCN10A; (-) strand; PAM type: NNGRRT; PAM sequence: AGGAAT
aataaaaacaaaaaaatctt

SEQ ID NO: 7864 - DNA, 20 bp, Artificial Sequence
  Description of Artificial Sequence: Synthetic oligonucleotide
  Target: SCN10A; (-) strand; PAM type: NNGRRT; PAM sequence: CAGGAT
aaatgaattcagtaaagttt

SEQ ID NO: 7865 - DNA, 20 bp, Artificial Sequence
  Description of Artificial Sequence: Synthetic oligonucleotide
  Target: SCN10A; (-) strand; PAM type: NNGRRT; PAM sequence: ATGAAT
aaagctcctagatctaataa

SEQ ID NO: 7866 - DNA, 20 bp, Artificial Sequence
  Description of Artificial Sequence: Synthetic oligonucleotide
  Target: SCN10A; (-) strand; PAM type: NNGRRT; PAM sequence: GGGAAT
agacaagagaaataaataaa

SEQ ID NO: 7867 - DNA, 20 bp, Artificial Sequence
  Description of Artificial Sequence: Synthetic oligonucleotide
  Target: SCN10A; (-) strand; PAM type: NNGRRT; PAM sequence: AAGGAT
cctgagaactgaaacaagac

SEQ ID NO: 7868 - DNA, 20 bp, Artificial Sequence
  Description of Artificial Sequence: Synthetic oligonucleotide
  Target: SCN10A; (-) strand; PAM type: NNGRRT; PAM sequence: CAGAAT
aatgctgcacgtcacataaa

SEQ ID NO: 7869 - DNA, 20 bp, Artificial Sequence
  Description of Artificial Sequence: Synthetic oligonucleotide
  Target: SCN10A; (-) strand; PAM type: NNGRRT; PAM sequence: AGGGAT
gggtttcataccagggaggt

SEQ ID NO: 7870 - DNA, 20 bp, Artificial Sequence
  Description of Artificial Sequence: Synthetic oligonucleotide
  Target: SCN10A; (-) strand; PAM type: NNGRRT; PAM sequence: GGGGGT
agataacacaccatgatcaa

SEQ ID NO: 7871 - DNA, 20 bp, Artificial Sequence
  Description of Artificial Sequence: Synthetic oligonucleotide
  Target: SCN10A; (-) strand; PAM type: NNGRRT; PAM sequence: TTGAAT
ctcaacaaaatgctagctaa

SEQ ID NO: 7872 - DNA, 20 bp, Artificial Sequence
  Description of Artificial Sequence: Synthetic oligonucleotide
  Target: SCN10A; (-) strand; PAM type: NNGRRT; PAM sequence: GGGAAT
ttccaaaagatgcagaaaga

SEQ ID NO: 7873 - DNA, 20 bp, Artificial Sequence
  Description of Artificial Sequence: Synthetic oligonucleotide
  Target: SCN10A; (-) strand; PAM type: NNGRRT; PAM sequence: AAGAAT
attctatcagacattcaaag

SEQ ID NO: 7874 - DNA, 20 bp, Artificial Sequence
  Description of Artificial Sequence: Synthetic oligonucleotide
  Target: SCN10A; (-) strand; PAM type: NNGRRT; PAM sequence: CTGAAT
ggagcagactggattcacag

SEQ ID NO: 7875 - DNA, 20 bp, Artificial Sequence
  Description of Artificial Sequence: Synthetic oligonucleotide
  Target: SCN10A; (-) strand; PAM type: NNGRRT; PAM sequence: CTGGAT
aaaaaaagtccaggagcaga

SEQ ID NO: 7876 - DNA, 20 bp, Artificial Sequence
  Description of Artificial Sequence: Synthetic oligonucleotide
  Target: SCN10A; (-) strand; PAM type: NNGRRT; PAM sequence: ATGAAT
aactagaaaatttagaggag

SEQ ID NO: 7877 - DNA, 20 bp, Artificial Sequence
  Description of Artificial Sequence: Synthetic oligonucleotide
  Target: SCN10A; (-) strand; PAM type: NNGRRT; PAM sequence: GCGGGT
aaagataagtgaaacaaaaa

SEQ ID NO: 7878 - DNA, 20 bp, Artificial Sequence
  Description of Artificial Sequence: Synthetic oligonucleotide
  Target: SCN10A; (-) strand; PAM type: NNGRRT; PAM sequence: AGGAAT
cccaaaccaagcagaagaaa

SEQ ID NO: 7879 - DNA, 20 bp, Artificial Sequence
  Description of Artificial Sequence: Synthetic oligonucleotide
  Target: SCN10A; (-) strand; PAM type: NNGRRT; PAM sequence: AGGAAT
taatctaaggtcacacctca

SEQ ID NO: 7880 - DNA, 20 bp, Artificial Sequence
  Description of Artificial Sequence: Synthetic oligonucleotide
  Target: SCN10A; (-) strand; PAM type: NNGRRT; PAM sequence: TGGGAT
acacaacttatcaaaacctc

SEQ ID NO: 7881 - DNA, 20 bp, Artificial Sequence
  Description of Artificial Sequence: Synthetic oligonucleotide
  Target: SCN10A; (-) strand; PAM type: NNGRRT; PAM sequence: CTGAAT
aagtttaaaaattttttgaa

SEQ ID NO: 7882 - DNA, 20 bp, Artificial Sequence
  Description of Artificial Sequence: Synthetic oligonucleotide
  Target: SCN10A; (-) strand; PAM type: NNGRRT; PAM sequence: TTGGGT
aatctgctcttgaatgatct

SEQ ID NO: 7883 - DNA, 20 bp, Artificial Sequence
  Description of Artificial Sequence: Synthetic oligonucleotide
  Target: SCN10A; (-) strand; PAM type: NNGRRT; PAM sequence: TTGAAT
gaaaactaaacaatctgctc

SEQ ID NO: 7884 - DNA, 20 bp, Artificial Sequence
  Description of Artificial Sequence: Synthetic oligonucleotide
  Target: SCN10A; (-) strand; PAM type: NNGRRT; PAM sequence: CGGAGT
gagcacagtcgaataaacct

SEQ ID NO: 7885 - DNA, 20 bp, Artificial Sequence
  Description of Artificial Sequence: Synthetic oligonucleotide
  Target: SCN10A; (-) strand; PAM type: NNGRRT; PAM sequence: TCGAAT
ggtatcctctcagagcacag

SEQ ID NO: 7886 - DNA, 20 bp, Artificial Sequence
  Description of Artificial Sequence: Synthetic oligonucleotide
  Target: SCN10A; (-) strand; PAM type: NNGRRT; PAM sequence: TGGAAT
acattcttttcatcagcaca

SEQ ID NO: 7887 - DNA, 20 bp, Artificial Sequence
  Description of Artificial Sequence: Synthetic oligonucleotide
  Target: SCN10A; (-) strand; PAM type: NNGRRT; PAM sequence: CAGAAT
aacattctaccaaacaactg

SEQ ID NO: 7888 - DNA, 20 bp, Artificial Sequence
  Description of Artificial Sequence: Synthetic oligonucleotide
  Target: SCN10A; (-) strand; PAM type: NNGRRT; PAM sequence: GGGGAT
acagcaatataataatagtg

SEQ ID NO: 7889 - DNA, 20 bp, Artificial Sequence
  Description of Artificial Sequence: Synthetic oligonucleotide
  Target: SCN10A; (-) strand; PAM type: NNGRRT; PAM sequence: AGGAGT
aatggaaaccaaaagcaagc

SEQ ID NO: 7890 - DNA, 20 bp, Artificial Sequence
  Description of Artificial Sequence: Synthetic oligonucleotide
  Target: SCN10A; (-) strand; PAM type: NNGRRT; PAM sequence: TTGAGT
ctcacatctcaatactgatg

SEQ ID NO: 7891 - DNA, 20 bp, Artificial Sequence
  Description of Artificial Sequence: Synthetic oligonucleotide
  Target: SCN10A; (-) strand; PAM type: NNGRRT; PAM sequence: AAGAGT
ataactagcataatgaatag

SEQ ID NO: 7892 - DNA, 20 bp, Artificial Sequence
  Description of Artificial Sequence: Synthetic oligonucleotide
  Target: SCN10A; (-) strand; PAM type: NNGRRT; PAM sequence: ATGAAT
ttaaggcaataactagcata

SEQ ID NO: 7893 - DNA, 20 bp, Artificial Sequence
  Description of Artificial Sequence: Synthetic oligonucleotide
  Target: SCN10A; (-) strand; PAM type: NNGRRT; PAM sequence: AGGAAT
aacaataacacaataaaaaa

SEQ ID NO: 7894 - DNA, 20 bp, Artificial Sequence
  Description of Artificial Sequence: Synthetic oligonucleotide
  Target: SCN10A; (-) strand; PAM type: NNGRRT; PAM sequence: AGGAAT
gcactacaagaaatgctaaa

SEQ ID NO: 7895 - DNA, 20 bp, Artificial Sequence
  Description of Artificial Sequence: Synthetic oligonucleotide
  Target: SCN10A; (-) strand; PAM type: NNGRRT; PAM sequence: GAGAAT
ttcagacaaacaaatggtga

SEQ ID NO: 7896 - DNA, 20 bp, Artificial Sequence
  Description of Artificial Sequence: Synthetic oligonucleotide
  Target: SCN10A; (-) strand; PAM type: NNGRRT; PAM sequence: AAGAAT
aaacaaaataattgccagcc

SEQ ID NO: 7897 - DNA, 20 bp, Artificial Sequence
  Description of Artificial Sequence: Synthetic oligonucleotide
  Target: SCN10A; (-) strand; PAM type: NNGRRT; PAM sequence: TAGGGT
ccttgcaagccagaagggat

SEQ ID NO: 7898 - DNA, 20 bp, Artificial Sequence
  Description of Artificial Sequence: Synthetic oligonucleotide
  Target: SCN10A; (-) strand; PAM type: NNGRRT; PAM sequence: AGGGAT
ctgaaaccttgcaagccaga

SEQ ID NO: 7899 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tctaaagtcaagacaaagaa

SEQ ID NO: 7900 - DNA, 20 bp, Artificial Sequence
  Description of Artificial Sequence: Synthetic oligonucleotide
  Target: SCN10A; (-) strand; PAM type: NNGRRT; PAM sequence: AAGAAT
atccaaatacaagaagctca

SEQ ID NO: 7901 - DNA, 20 bp, Artificial Sequence
  Description of Artificial Sequence: Synthetic oligonucleotide
  Target: SCN10A; (-) strand; PAM type: NNGRRT; PAM sequence: GGGAAT
agtttggaaaacttatttga

SEQ ID NO: 7902 - DNA, 20 bp, Artificial Sequence
  Description of Artificial Sequence: Synthetic oligonucleotide
  Target: SCN10A; (-) strand; PAM type: NNGRRT; PAM sequence: AAGAAT
aataatgggtgttcccaagg

SEQ ID NO: 7903 - DNA, 20 bp, Artificial Sequence
  Description of Artificial Sequence: Synthetic oligonucleotide
  Target: SCN10A; (-) strand; PAM type: NNGRRT; PAM sequence: ATGGGT
aacaaccaaacctaagaata

SEQ ID NO: 7904 - DNA, 20 bp, Artificial Sequence
  Description of Artificial Sequence: Synthetic oligonucleotide
  Target: SCN10A; (-) strand; PAM type: NNGRRT; PAM sequence: AAGAAT
catgtgaaacaaccaaacct

SEQ ID NO: 7905 - DNA, 20 bp, Artificial Sequence
  Description of Artificial Sequence: Synthetic oligonucleotide
  Target: SCN10A; (-) strand; PAM type: NNGRRT; PAM sequence: TGGAAT
gacaaatcggccaataaatt

SEQ ID NO: 7906 - DNA, 20 bp, Artificial Sequence
  Description of Artificial Sequence: Synthetic oligonucleotide
  Target: SCN10A; (-) strand; PAM type: NNGRRT; PAM sequence: AAGAAT
aactaagacacacaaaaaga

SEQ ID NO: 7907 - DNA, 20 bp, Artificial Sequence
  Description of Artificial Sequence: Synthetic oligonucleotide
  Target: SCN10A; (-) strand; PAM type: NNGRRT; PAM sequence: ATGGAT
aatttttaaaacaacaagat

SEQ ID NO: 7908 - DNA, 20 bp, Artificial Sequence
  Description of Artificial Sequence: Synthetic oligonucleotide
  Target: SCN10A; (-) strand; PAM type: NNGRRT; PAM sequence: AAGAAT
catctcaaaaaaaaaaaaaa

SEQ ID NO: 7909 - DNA, 20 bp, Artificial Sequence
  Description of Artificial Sequence: Synthetic oligonucleotide
  Target: SCN10A; (-) strand; PAM type: NNGRRT; PAM sequence: AAGAGT
tgcactccagcctgggcaac

SEQ ID NO: 7910 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tactcaggagactgaggcag

SEQ ID NO: 7911 - DNA, 20 bp, Artificial Sequence
  Description of Artificial Sequence: Synthetic oligonucleotide
  Target: SCN10A; (-) strand; PAM type: NNGRRT; PAM sequence: AAGAAT
aatctctgaattgccagata

SEQ ID NO: 7912 - DNA, 20 bp, Artificial Sequence
  Description of Artificial Sequence: Synthetic oligonucleotide
  Target: SCN10A; (-) strand; PAM type: NNGRRT; PAM sequence: CTGAAT
tccaaactaagaagaaatct

SEQ ID NO: 7913 - DNA, 20 bp, Artificial Sequence
  Description of Artificial Sequence: Synthetic oligonucleotide
  Target: SCN10A; (-) strand; PAM type: NNGRRT; PAM sequence: ATGGAT
atcaaactagctccccaaca

SEQ ID NO: 7914 - DNA, 20 bp, Artificial Sequence
  Description of Artificial Sequence: Synthetic oligonucleotide
  Target: SCN10A; (-) strand; PAM type: NNGRRT; PAM sequence: GAGGGT
attctggtaatatgacaaaa

SEQ ID NO: 7915 - DNA, 20 bp, Artificial Sequence
  Description of Artificial Sequence: Synthetic oligonucleotide
  Target: SCN10A; (-) strand; PAM type: NNGRRT; PAM sequence: AAGAAT
agagatcacccatgaaacaa

SEQ ID NO: 7916 - DNA, 20 bp, Artificial Sequence
  Description of Artificial Sequence: Synthetic oligonucleotide
  Target: SCN10A; (-) strand; PAM type: NNGRRT; PAM sequence: GGGGAT
ctcaggaagccccatcccca

SEQ ID NO: 7917 - DNA, 20 bp, Artificial Sequence
  Description of Artificial Sequence: Synthetic oligonucleotide
  Target: SCN10A; (-) strand; PAM type: NNGRRT; PAM sequence: CTGAGT
atcctggctaaccagacgtc

SEQ ID NO: 7918 - DNA, 20 bp, Artificial Sequence
  Description of Artificial Sequence: Synthetic oligonucleotide
  Target: SCN10A; (-) strand; PAM type: NNGRRT; PAM sequence: CAGAAT
gccattaaagcaactcatga

SEQ ID NO: 7919 - DNA, 20 bp, Artificial Sequence
  Description of Artificial Sequence: Synthetic oligonucleotide
  Target: SCN10A; (-) strand; PAM type: NNGRRT; PAM sequence: TAGGGT
aatatttaccctggccaact

SEQ ID NO: 7920 - DNA, 20 bp, Artificial Sequence
  Description of Artificial Sequence: Synthetic oligonucleotide
  Target: SCN10A; (-) strand; PAM type: NNGRRT; PAM sequence: CTGAGT
aatccctacccaagaagggt

SEQ ID NO: 7921 - DNA, 20 bp, Artificial Sequence
  Description of Artificial Sequence: Synthetic oligonucleotide
  Target: SCN10A; (-) strand; PAM type: NNGRRT; PAM sequence: AAGGGT
cacagcaatccctacccaag

SEQ ID NO: 7922 - DNA, 20 bp, Artificial Sequence
  Description of Artificial Sequence: Synthetic oligonucleotide
  Target: SCN10A; (-) strand; PAM type: NNGRRT; PAM sequence: CTGAGT
ctcacagcctggggcaaggt

SEQ ID NO: 7923 - DNA, 20 bp, Artificial Sequence
  Description of Artificial Sequence: Synthetic oligonucleotide
  Target: SCN10A; (-) strand; PAM type: NNGRRT; PAM sequence: AGGGAT
ggaactgcaagcagacagtg

SEQ ID NO: 7924 - DNA, 20 bp, Artificial Sequence
  Description of Artificial Sequence: Synthetic oligonucleotide
  Target: SCN10A; (-) strand; PAM type: NNGRRT; PAM sequence: CAGAAT
tgggcacaaattttcttgag

SEQ ID NO: 7925 - DNA, 20 bp, Artificial Sequence
  Description of Artificial Sequence: Synthetic oligonucleotide
  Target: SCN10A; (-) strand; PAM type: NNGRRT; PAM sequence: CAGGAT
gtggaatcagggaggggtca

SEQ ID NO: 7926 - DNA, 20 bp, Artificial Sequence
  Description of Artificial Sequence: Synthetic oligonucleotide
  Target: SCN10A; (-) strand; PAM type: NNGRRT; PAM sequence: AGGGGT
ggcagccagtggaatcaggg

SEQ ID NO: 7927 - DNA, 20 bp, Artificial Sequence
  Description of Artificial Sequence: Synthetic oligonucleotide
  Target: SCN10A; (-) strand; PAM type: NNGRRT; PAM sequence: TGGAAT
cccttggggaaggcagccag

SEQ ID NO: 7928 - DNA, 20 bp, Artificial Sequence
  Description of Artificial Sequence: Synthetic oligonucleotide
  Target: SCN10A; (-) strand; PAM type: NNGRRT; PAM sequence: GGGAAT
cagtctccagcttgagacca

SEQ ID NO: 7929 - DNA, 20 bp, Artificial Sequence
  Description of Artificial Sequence: Synthetic oligonucleotide
  Target: SCN10A; (-) strand; PAM type: NNGRRT; PAM sequence: TGGAAT
gagaagaatttacccttacc

SEQ ID NO: 7930 - DNA, 20 bp, Artificial Sequence
  Description of Artificial Sequence: Synthetic oligonucleotide
  Target: SCN10A; (-) strand; PAM type: NNGRRT; PAM sequence: AAGAAT
gaaaatccagatcacaggag

SEQ ID NO: 7931 - DNA, 20 bp, Artificial Sequence
  Description of Artificial Sequence: Synthetic oligonucleotide
  Target: SCN10A; (-) strand; PAM type: NNGRRT; PAM sequence: CTGGGT
cctccaaacatacatcccaa

SEQ ID NO: 7932 - DNA, 20 bp, Artificial Sequence
  Description of Artificial Sequence: Synthetic oligonucleotide
  Target: SCN10A; (-) strand; PAM type: NNGRRT; PAM sequence: AAGAAT
gaatataccaggagaactga

SEQ ID NO: 7933 - DNA, 20 bp, Artificial Sequence
  Description of Artificial Sequence: Synthetic oligonucleotide
  Target: SCN10A; (-) strand; PAM type: NNGRRT; PAM sequence: AGGAAT
tttgctccaagaaccactgc

SEQ ID NO: 7934 - DNA, 20 bp, Artificial Sequence
  Description of Artificial Sequence: Synthetic oligonucleotide
  Target: SCN10A; (-) strand; PAM type: NNGRRT; PAM sequence: CAGAGT
acatgcaggtcccacttgga

SEQ ID NO: 7935 - DNA, 20 bp, Artificial Sequence
  Description of Artificial Sequence: Synthetic oligonucleotide
  Target: SCN10A; (-) strand; PAM type: NNGRRT; PAM sequence: GTGGGT
ataggagaggggacaaaatg

SEQ ID NO: 7936 - DNA, 20 bp, Artificial Sequence
  Description of Artificial Sequence: Synthetic oligonucleotide
  Target: SCN10A; (-) strand; PAM type: NNGRRT; PAM sequence: GTGAGT
tttagcgtcattaccctggc

SEQ ID NO: 7937 - DNA, 20 bp, Artificial Sequence
  Description of Artificial Sequence: Synthetic oligonucleotide
  Target: SCN10A; (-) strand; PAM type: NNGRRT; PAM sequence: CTGGAT
tgagagatccttggaactgg

SEQ ID NO: 7938 - DNA, 20 bp, Artificial Sequence
  Description of Artificial Sequence: Synthetic oligonucleotide
  Target: SCN10A; (-) strand; PAM type: NNGRRT; PAM sequence: ATGAGT
ggcaagaggattttgtctaa

SEQ ID NO: 7939 - DNA, 20 bp, Artificial Sequence
  Description of Artificial Sequence: Synthetic oligonucleotide
  Target: SCN10A; (-) strand; PAM type: NNGRRT; PAM sequence: GAGGAT
cttgataaagatactggcaa

SEQ ID NO: 7940 - DNA, 20 bp, Artificial Sequence
  Description of Artificial Sequence: Synthetic oligonucleotide
  Target: SCN10A; (-) strand; PAM type: NNGRRT; PAM sequence: CTGAGT
ctcctggaagaaggaacccc

SEQ ID NO: 7941 - DNA, 20 bp, Artificial Sequence
  Description of Artificial Sequence: Synthetic oligonucleotide
  Target: SCN10A; (-) strand; PAM type: NNGRRT; PAM sequence: GAGAAT
gccctggcagacataaacag

SEQ ID NO: 7942 - DNA, 20 bp, Artificial Sequence
  Description of Artificial Sequence: Synthetic oligonucleotide
  Target: SCN10A; (-) strand; PAM type: NNGRRT; PAM sequence: CAGGAT
gatgagcctccagcttcttg

SEQ ID NO: 7943 - DNA, 20 bp, Artificial Sequence
  Description of Artificial Sequence: Synthetic oligonucleotide
  Target: SCN10A; (-) strand; PAM type: NNGRRT; PAM sequence: GGGAGT
cactccagtttctaaaaact

SEQ ID NO: 7944 - DNA, 20 bp, Artificial Sequence
  Description of Artificial Sequence: Synthetic oligonucleotide
  Target: SCN10A; (-) strand; PAM type: NNGRRT; PAM sequence: CTGGGT
cagcatagcttggcttgctt

SEQ ID NO: 7945 - DNA, 20 bp, Artificial Sequence
  Description of Artificial Sequence: Synthetic oligonucleotide
  Target: SCN10A; (-) strand; PAM type: NNGRRT; PAM sequence: ATGGAT
cagaaacagtttctcattga

SEQ ID NO: 7946 - DNA, 20 bp, Artificial Sequence
  Description of Artificial Sequence: Synthetic oligonucleotide
  Target: SCN10A; (-) strand; PAM type: NNGRRT; PAM sequence: TTGAAT
ggagcagaaacagtttctca

SEQ ID NO: 7947 - DNA, 20 bp, Artificial Sequence
  Description of Artificial Sequence: Synthetic oligonucleotide
  Target: SCN10A; (-) strand; PAM type: NNGRRT; PAM sequence: GGGAGT
gagcagaagtgaatagggag

SEQ ID NO: 7948 - DNA, 20 bp, Artificial Sequence
  Description of Artificial Sequence: Synthetic oligonucleotide
  Target: SCN10A; (-) strand; PAM type: NNGRRT; PAM sequence: GTGAAT
aaacttaacgaggagcagaa

SEQ ID NO: 7949 - DNA, 20 bp, Artificial Sequence
  Description of Artificial Sequence: Synthetic oligonucleotide
  Target: SCN10A; (-) strand; PAM type: NNGRRT; PAM sequence: CAGGAT
cggggtttcaccgcgttagc

SEQ ID NO: 7950 - DNA, 20 bp, Artificial Sequence
  Description of Artificial Sequence: Synthetic oligonucleotide
  Target: SCN10A; (-) strand; PAM type: NNGRRT; PAM sequence: CGGGGT
ttttgtatttttagtagaga

SEQ ID NO: 7951 - DNA, 20 bp, Artificial Sequence
  Description of Artificial Sequence: Synthetic oligonucleotide
  Target: SCN10A; (-) strand; PAM type: NNGRRT; PAM sequence: CGGAGT
cattctcccgcctcagcctc

SEQ ID NO: 7952 - DNA, 20 bp, Artificial Sequence
  Description of Artificial Sequence: Synthetic oligonucleotide
  Target: SCN10A; (-) strand; PAM type: NNGRRT; PAM sequence: CCGGGT
ctcactgcaagctccgcctc

SEQ ID NO: 7953 - DNA, 20 bp, Artificial Sequence
  Description of Artificial Sequence: Synthetic oligonucleotide
  Target: SCN10A; (-) strand; PAM type: NNGRRT; PAM sequence: TGGAGT
tcttgctctgtcacccagac

SEQ ID NO: 7954 - DNA, 20 bp, Artificial Sequence
  Description of Artificial Sequence: Synthetic oligonucleotide
  Target: SCN10A; (-) strand; PAM type: NNGRRT; PAM sequence: AAGGGT
gcttctagtaactttattag

SEQ ID NO: 7955 - DNA, 20 bp, Artificial Sequence
  Description of Artificial Sequence: Synthetic oligonucleotide
  Target: SCN10A; (-) strand; PAM type: NNGRRT; PAM sequence: CTGGGT
aggctgttggcctcaaactc

SEQ ID NO: 7956 - DNA, 20 bp, Artificial Sequence
  Description of Artificial Sequence: Synthetic oligonucleotide
  Target: SCN10A; (-) strand; PAM type: NNGRRT; PAM sequence: TTGAAT
atcgcatatatgtttcttgt

SEQ ID NO: 7957 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ggattccttttgcctcttcc

SEQ ID NO: 7958 - DNA, 20 bp, Artificial Sequence
  Description of Artificial Sequence: Synthetic oligonucleotide
  Target: SCN10A; (-) strand; PAM type: NNGRRT; PAM sequence: TTGGAT
ttttcttcttcattcttttt

SEQ ID NO: 7959 - DNA, 20 bp, Artificial Sequence
  Description of Artificial Sequence: Synthetic oligonucleotide
  Target: SCN10A; (-) strand; PAM type: NNGRRT; PAM sequence: TAGAGT
tttcctatgggaatcacagc

SEQ ID NO: 7960 - DNA, 20 bp, Artificial Sequence
  Description of Artificial Sequence: Synthetic oligonucleotide
  Target: SCN10A; (-) strand; PAM type: NNGRRT; PAM sequence: GGGAAT
gtgtatcatttttttcctat

SEQ ID NO: 7961 - DNA, 20 bp, Artificial Sequence
  Description of Artificial Sequence: Synthetic oligonucleotide
  Target: SCN10A; (-) strand; PAM type: NNGRRT; PAM sequence: AAGGAT
ttgctttccttggagttaat

SEQ ID NO: 7962 - DNA, 20 bp, Artificial Sequence
  Description of Artificial Sequence: Synthetic oligonucleotide
  Target: SCN10A; (-) strand; PAM type: NNGRRT; PAM sequence: TGGAGT
cacaatgtttttgctttcct

SEQ ID NO: 7963 - DNA, 20 bp, Artificial Sequence
  Description of Artificial Sequence: Synthetic oligonucleotide
  Target: SCN10A; (-) strand; PAM type: NNGRRT; PAM sequence: CAGAGT
gttcataatttaaaaggtca

SEQ ID NO: 7964 - DNA, 20 bp, Artificial Sequence
  Description of Artificial Sequence: Synthetic oligonucleotide
  Target: SCN10A; (-) strand; PAM type: NNGRRT; PAM sequence: AAGAGT
tttctaatttagaaaacata

SEQ ID NO: 7965 - DNA, 20 bp, Artificial Sequence
  Description of Artificial Sequence: Synthetic oligonucleotide
  Target: SCN10A; (-) strand; PAM type: NNGRRT; PAM sequence: CTGAGT
cttcccaacaacctataatt

SEQ ID NO: 7966 - DNA, 20 bp, Artificial Sequence
  Description of Artificial Sequence: Synthetic oligonucleotide
  Target: SCN10A; (-) strand; PAM type: NNGRRT; PAM sequence: CTGGGT
gagcactctctccataattt

SEQ ID NO: 7967 - DNA, 20 bp, Artificial Sequence
  Description of Artificial Sequence: Synthetic oligonucleotide
  Target: SCN10A; (-) strand; PAM type: NNGRRT; PAM sequence: GAGGAT
gagccaaataccaccaaaga

SEQ ID NO: 7968 - DNA, 20 bp, Artificial Sequence
  Description of Artificial Sequence: Synthetic oligonucleotide
  Target: SCN10A; (-) strand; PAM type: NNGRRT; PAM sequence: CTGAAT
gggcttattaaaaattacat

SEQ ID NO: 7969 - DNA, 20 bp, Artificial Sequence
  Description of Artificial Sequence: Synthetic oligonucleotide
  Target: SCN10A; (-) strand; PAM type: NNGRRT; PAM sequence: CGGGAT
tgttttcagagcctgaatat

SEQ ID NO: 7970 - DNA, 20 bp, Artificial Sequence
  Description of Artificial Sequence: Synthetic oligonucleotide
  Target: SCN10A; (-) strand; PAM type: NNGRRT; PAM sequence: CTGAAT
tgaatctttgttttcagagc

SEQ ID NO: 7971 - DNA, 20 bp, Artificial Sequence
  Description of Artificial Sequence: Synthetic oligonucleotide
  Target: SCN10A; (-) strand; PAM type: NNGRRT; PAM sequence: ATGAAT
ccattcagaatttgaatatt

SEQ ID NO: 7972 - DNA, 20 bp, Artificial Sequence
  Description of Artificial Sequence: Synthetic oligonucleotide
  Target: SCN10A; (-) strand; PAM type: NNGRRT; PAM sequence: TTGAAT
ctcagtgatccattcagaat

SEQ ID NO: 7973 - DNA, 20 bp, Artificial Sequence
  Description of Artificial Sequence: Synthetic oligonucleotide
  Target: SCN10A; (-) strand; PAM type: NNGRRT; PAM sequence: CAGAAT
gggtatctcagtgatccatt

SEQ ID NO: 7974 - DNA, 20 bp, Artificial Sequence
  Description of Artificial Sequence: Synthetic oligonucleotide
  Target: SCN10A; (-) strand; PAM type: NNGRRT; PAM sequence: TTGGGT
accatttttatgaatacaag

SEQ ID NO: 7975 - DNA, 20 bp, Artificial Sequence
  Description of Artificial Sequence: Synthetic oligonucleotide
  Target: SCN10A; (-) strand; PAM type: NNGRRT; PAM sequence: ATGAAT
tgttttaaattaccattttt

SEQ ID NO: 7976 - DNA, 20 bp, Artificial Sequence
  Description of Artificial Sequence: Synthetic oligonucleotide
  Target: SCN10A; (-) strand; PAM type: NNGRRT; PAM sequence: AGGAAT
tacacagagttttaaaaata

SEQ ID NO: 7977 - DNA, 20 bp, Artificial Sequence
  Description of Artificial Sequence: Synthetic oligonucleotide
  Target: SCN10A; (-) strand; PAM type: NNGRRT; PAM sequence: CAGAGT
gcaaatgggaagggcttaca

SEQ ID NO: 7978 - DNA, 20 bp, Artificial Sequence
  Description of Artificial Sequence: Synthetic oligonucleotide
  Target: SCN10A; (-) strand; PAM type: NNGRRT; PAM sequence: CTGAAT
agagaggctgctctcccaca

SEQ ID NO: 7979 - DNA, 20 bp, Artificial Sequence
  Description of Artificial Sequence: Synthetic oligonucleotide
  Target: SCN10A; (-) strand; PAM type: NNGRRT; PAM sequence: GTGAGT
ctactgggctgaaatgaaaa

SEQ ID NO: 7980 - DNA, 20 bp, Artificial Sequence
  Description of Artificial Sequence: Synthetic oligonucleotide
  Target: SCN10A; (-) strand; PAM type: NNGRRT; PAM sequence: GTGAAT
tgaggtacacagtggaaatt

SEQ ID NO: 7981 - DNA, 20 bp, Artificial Sequence
  Description of Artificial Sequence: Synthetic oligonucleotide
  Target: SCN10A; (-) strand; PAM type: NNGRRT; PAM sequence: GGGGGT
cttattcacggaacgcagct

SEQ ID NO: 7982 - DNA, 20 bp, Artificial Sequence
  Description of Artificial Sequence: Synthetic oligonucleotide
  Target: SCN10A; (-) strand; PAM type: NNGRRT; PAM sequence: CTGAAT
gtggtgatagttccacaata

SEQ ID NO: 7983 - DNA, 20 bp, Artificial Sequence
  Description of Artificial Sequence: Synthetic oligonucleotide
  Target: SCN10A; (-) strand; PAM type: NNGRRT; PAM sequence: CGGGAT
ttaatgggtacatttctgtt

SEQ ID NO: 7984 - DNA, 20 bp, Artificial Sequence
  Description of Artificial Sequence: Synthetic oligonucleotide
  Target: SCN10A; (-) strand; PAM type: NNGRRT; PAM sequence: ATGGGT
gaatggggagttattattta

SEQ ID NO: 7985 - DNA, 20 bp, Artificial Sequence
  Description of Artificial Sequence: Synthetic oligonucleotide
  Target: SCN10A; (-) strand; PAM type: NNGRRT; PAM sequence: GGGAGT
gttgccagagagggggaatg

SEQ ID NO: 7986 - DNA, 20 bp, Artificial Sequence
  Description of Artificial Sequence: Synthetic oligonucleotide
  Target: SCN10A; (-) strand; PAM type: NNGRRT; PAM sequence: GGGAAT
aatggaagttgccagagagg

SEQ ID NO: 7987 - DNA, 20 bp, Artificial Sequence
  Description of Artificial Sequence: Synthetic oligonucleotide
  Target: SCN10A; (-) strand; PAM type: NNGRRT; PAM sequence: TAGAAT
aaattcatggagacagaaag

SEQ ID NO: 7988 - DNA, 20 bp, Artificial Sequence
  Description of Artificial Sequence: Synthetic oligonucleotide
  Target: SCN10A; (-) strand; PAM type: NNGRRT; PAM sequence: ATGAAT
aatatcattcagttttaaaa

SEQ ID NO: 7989 - DNA, 20 bp, Artificial Sequence
  Description of Artificial Sequence: Synthetic oligonucleotide
  Target: SCN10A; (-) strand; PAM type: NNGRRT; PAM sequence: TTGAAT
tgtagtatatatgtaaacaa

SEQ ID NO: 7990 - DNA, 20 bp, Artificial Sequence
  Description of Artificial Sequence: Synthetic oligonucleotide
  Target: SCN10A; (-) strand; PAM type: NNGRRT; PAM sequence: ATGGAT
atatgtccatcaacagatga

SEQ ID NO: 7991 - DNA, 20 bp, Artificial Sequence
  Description of Artificial Sequence: Synthetic oligonucleotide
  Target: SCN10A; (-) strand; PAM type: NNGRRT; PAM sequence: ATGAAT
ccaaatatgtccatcaacag

SEQ ID NO: 7992 - DNA, 20 bp, Artificial Sequence
  Description of Artificial Sequence: Synthetic oligonucleotide
  Target: SCN10A; (-) strand; PAM type: NNGRRT; PAM sequence: ATGAAT
ttttatagttgaacaaaact

SEQ ID NO: 7993 - DNA, 20 bp, Artificial Sequence
  Description of Artificial Sequence: Synthetic oligonucleotide
  Target: SCN10A; (-) strand; PAM type: NNGRRT; PAM sequence: TAGAGT
ttgagaagacaacaaaacta

SEQ ID NO: 7994 - DNA, 20 bp, Artificial Sequence
  Description of Artificial Sequence: Synthetic oligonucleotide
  Target: SCN10A; (-) strand; PAM type: NNGRRT; PAM sequence: TTGAAT
caaccccacttttaaaccaa

SEQ ID NO: 7995 - DNA, 20 bp, Artificial Sequence
  Description of Artificial Sequence: Synthetic oligonucleotide
  Target: SCN10A; (-) strand; PAM type: NNGRRT; PAM sequence: TTGAAT
atgacaatgaataatgataa

SEQ ID NO: 7996 - DNA, 20 bp, Artificial Sequence
  Description of Artificial Sequence: Synthetic oligonucleotide
  Target: SCN10A; (-) strand; PAM type: NNGRRT; PAM sequence: ATGAAT
agaaaatgggagccatgaca

SEQ ID NO: 7997 - DNA, 20 bp, Artificial Sequence
  Description of Artificial Sequence: Synthetic oligonucleotide
  Target: SCN10A; (-) strand; PAM type: NNGRRT; PAM sequence: GTGGAT
gagacaagtggataatggat

SEQ ID NO: 7998 - DNA, 20 bp, Artificial Sequence
  Description of Artificial Sequence: Synthetic oligonucleotide
  Target: SCN10A; (-) strand; PAM type: NNGRRT; PAM sequence: ATGGAT
tgtcatgagacaagtggata

SEQ ID NO: 7999 - DNA, 20 bp, Artificial Sequence
  Description of Artificial Sequence: Synthetic oligonucleotide
  Target: SCN10A; (-) strand; PAM type: NNGRRT; PAM sequence: GTGGAT
atctgtttgtcatgagacaa

SEQ ID NO: 8000 - DNA, 20 bp, Artificial Sequence
  Description of Artificial Sequence: Synthetic oligonucleotide
  Target: SCN10A; (-) strand; PAM type: NNGRRT; PAM sequence: ATGAAT
ccattgtaaaaatacaaagc

SEQ ID NO: 8001 - DNA, 20 bp, Artificial Sequence
  Description of Artificial Sequence: Synthetic oligonucleotide
  Target: SCN10A; (-) strand; PAM type: NNGRRT; PAM sequence: ATGAAT
ataaggtcacaatgtaagta

SEQ ID NO: 8002 - DNA, 20 bp, Artificial Sequence
  Description of Artificial Sequence: Synthetic oligonucleotide
  Target: SCN10A; (-) strand; PAM type: NNGRRT; PAM sequence: AAGAGT
taatatcacaattcaaaaaa

SEQ ID NO: 8003 - DNA, 20 bp, Artificial Sequence
  Description of Artificial Sequence: Synthetic oligonucleotide
  Target: SCN10A; (-) strand; PAM type: NNGRRT; PAM sequence: TGGAGT
ttcattcataatggttaaca

SEQ ID NO: 8004 - DNA, 20 bp, Artificial Sequence
  Description of Artificial Sequence: Synthetic oligonucleotide
  Target: SCN10A; (-) strand; PAM type: NNGRRT; PAM sequence: TAGAAT
aagattaattattatattca

SEQ ID NO: 8005 - DNA, 20 bp, Artificial Sequence
  Description of Artificial Sequence: Synthetic oligonucleotide
  Target: SCN10A; (-) strand; PAM type: NNGRRT; PAM sequence: AAGGAT
tgtttctcaacaagtgatct

SEQ ID NO: 8006 - DNA, 20 bp, Artificial Sequence
  Description of Artificial Sequence: Synthetic oligonucleotide
  Target: SCN10A; (-) strand; PAM type: NNGRRT; PAM sequence: TGGGAT
tctttcataaactgtccctt

SEQ ID NO: 8007 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ggttccagctgatcattttg

SEQ ID NO: 8008 - DNA, 20 bp, Artificial Sequence
  Description of Artificial Sequence: Synthetic oligonucleotide
  Target: SCN10A; (-) strand; PAM type: NNGRRT; PAM sequence: ATGGGT
tgttgagactttcatcatga

SEQ ID NO: 8009 - DNA, 20 bp, Artificial Sequence
  Description of Artificial Sequence: Synthetic oligonucleotide
  Target: SCN10A; (-) strand; PAM type: NNGRRT; PAM sequence: ATGAAT
tgtttgttgagactttcatc

SEQ ID NO: 8010 - DNA, 20 bp, Artificial Sequence
  Description of Artificial Sequence: Synthetic oligonucleotide
  Target: SCN10A; (-) strand; PAM type: NNGRRT; PAM sequence: GAGAGT
ttcactattatgatgtttat

SEQ ID NO: 8011 - DNA, 20 bp, Artificial Sequence
  Description of Artificial Sequence: Synthetic oligonucleotide
  Target: SCN10A; (-) strand; PAM type: NNGRRT; PAM sequence: TTGAAT
tttttatttttcctgtctta

SEQ ID NO: 8012 - DNA, 20 bp, Artificial Sequence
  Description of Artificial Sequence: Synthetic oligonucleotide
  Target: SCN10A; (-) strand; PAM type: NNGRRT; PAM sequence: TTGAAT
ttgcaattttggttgcccta

SEQ ID NO: 8013 - DNA, 20 bp, Artificial Sequence
  Description of Artificial Sequence: Synthetic oligonucleotide
  Target: SCN10A; (-) strand; PAM type: NNGRRT; PAM sequence: AAGAAT
aattgatttatcaccacagg

SEQ ID NO: 8014 - DNA, 20 bp, Artificial Sequence
  Description of Artificial Sequence: Synthetic oligonucleotide
  Target: SCN10A; (-) strand; PAM type: NNGRRT; PAM sequence: CTGAAT
aaactttgtttggtaatgca

SEQ ID NO: 8015 - DNA, 20 bp, Artificial Sequence
  Description of Artificial Sequence: Synthetic oligonucleotide
  Target: SCN10A; (-) strand; PAM type: NNGRRT; PAM sequence: AAGGGT
ttacttttccatatcagttt

SEQ ID NO: 8016 - DNA, 20 bp, Artificial Sequence
  Description of Artificial Sequence: Synthetic oligonucleotide
  Target: SCN10A; (-) strand; PAM type: NNGRRT; PAM sequence: GTGGAT
acatcctgagtcaacaccac

SEQ ID NO: 8017 - DNA, 20 bp, Artificial Sequence
  Description of Artificial Sequence: Synthetic oligonucleotide
  Target: SCN10A; (-) strand; PAM type: NNGRRT; PAM sequence: CTGAGT
agtaatctcattgtcacatc

SEQ ID NO: 8018 - DNA, 20 bp, Artificial Sequence
  Description of Artificial Sequence: Synthetic oligonucleotide
  Target: SCN10A; (-) strand; PAM type: NNGRRT; PAM sequence: CTGAAT
gcaccagattcccatgtcta

SEQ ID NO: 8019 - DNA, 20 bp, Artificial Sequence
  Description of Artificial Sequence: Synthetic oligonucleotide
  Target: SCN10A; (-) strand; PAM type: NNGRRT; PAM sequence: ATGGAT
ggcttccaatatttttccat

SEQ ID NO: 8020 - DNA, 20 bp, Artificial Sequence
  Description of Artificial Sequence: Synthetic oligonucleotide
  Target: SCN10A; (-) strand; PAM type: NNGRRT; PAM sequence: TAGAAT
atttaggtatttcaatctcc

SEQ ID NO: 8021 - DNA, 20 bp, Artificial Sequence
  Description of Artificial Sequence: Synthetic oligonucleotide
  Target: SCN10A; (-) strand; PAM type: NNGRRT; PAM sequence: ATGGAT
tgtttttgggatttgcccaa

SEQ ID NO: 8022 - DNA, 20 bp, Artificial Sequence
  Description of Artificial Sequence: Synthetic oligonucleotide
  Target: SCN10A; (-) strand; PAM type: NNGRRT; PAM sequence: TGGGAT
atgttttaaaattatgtttt

SEQ ID NO: 8023 - DNA, 20 bp, Artificial Sequence
  Description of Artificial Sequence: Synthetic oligonucleotide
  Target: SCN10A; (-) strand; PAM type: NNGRRT; PAM sequence: GTGGGT
aatctactgcaaacggggaa

SEQ ID NO: 8024 - DNA, 20 bp, Artificial Sequence
  Description of Artificial Sequence: Synthetic oligonucleotide
  Target: SCN10A; (-) strand; PAM type: NNGRRT; PAM sequence: CTGAAT
aaagaacatgtgaaatgaag

SEQ ID NO: 8025 - DNA, 20 bp, Artificial Sequence
  Description of Artificial Sequence: Synthetic oligonucleotide
  Target: SCN10A; (-) strand; PAM type: NNGRRT; PAM sequence: GAGAAT
ctccccatgccctggtttca

SEQ ID NO: 8026 - DNA, 20 bp, Artificial Sequence
  Description of Artificial Sequence: Synthetic oligonucleotide
  Target: SCN10A; (-) strand; PAM type: NNGRRT; PAM sequence: GGGGGT
accagaaggtaaagagagca

SEQ ID NO: 8027 - DNA, 20 bp, Artificial Sequence
  Description of Artificial Sequence: Synthetic oligonucleotide
  Target: SCN10A; (-) strand; PAM type: NNGRRT; PAM sequence: AGGAAT
gcattaaattgtagccagtg

SEQ ID NO: 8028 - DNA, 20 bp, Artificial Sequence
  Description of Artificial Sequence: Synthetic oligonucleotide
  Target: SCN10A; (-) strand; PAM type: NNGRRT; PAM sequence: TGGGAT
aggaagataataaatgtcct

SEQ ID NO: 8029 - DNA, 20 bp, Artificial Sequence
  Description of Artificial Sequence: Synthetic oligonucleotide
  Target: SCN10A; (-) strand; PAM type: NNGRRT; PAM sequence: TTGGAT
gggaatttatgtgacaggta

SEQ ID NO: 8030 - DNA, 20 bp, Artificial Sequence
  Description of Artificial Sequence: Synthetic oligonucleotide
  Target: SCN10A; (-) strand; PAM type: NNGRRT; PAM sequence: GGGAAT
acctatatggtcacaatcct

SEQ ID NO: 8031 - DNA, 20 bp, Artificial Sequence
  Description of Artificial Sequence: Synthetic oligonucleotide
  Target: SCN10A; (-) strand; PAM type: NNGRRT; PAM sequence: TTGGAT
tgccaaatcgtcttccaaag

SEQ ID NO: 8032 - DNA, 20 bp, Artificial Sequence
  Description of Artificial Sequence: Synthetic oligonucleotide
  Target: SCN10A; (-) strand; PAM type: NNGRRT; PAM sequence: AGGGGT
aagtagaattgccaggtcaa

SEQ ID NO: 8033 - DNA, 20 bp, Artificial Sequence
  Description of Artificial Sequence: Synthetic oligonucleotide
  Target: SCN10A; (-) strand; PAM type: NNGRRT; PAM sequence: TAGAAT
taaggatgaatttctagaag

SEQ ID NO: 8034 - DNA, 20 bp, Artificial Sequence
  Description of Artificial Sequence: Synthetic oligonucleotide
  Target: SCN10A; (-) strand; PAM type: NNGRRT; PAM sequence: ATGAAT
taatatgagtaaaattaagg

SEQ ID NO: 8035 - DNA, 20 bp, Artificial Sequence
  Description of Artificial Sequence: Synthetic oligonucleotide
  Target: SCN10A; (-) strand; PAM type: NNGRRT; PAM sequence: AAGGAT
cacataatatgagtaaaatt

SEQ ID NO: 8036 - DNA, 20 bp, Artificial Sequence
  Description of Artificial Sequence: Synthetic oligonucleotide
  Target: SCN10A; (-) strand; PAM type: NNGRRT; PAM sequence: ATGAGT
tgtatctttgtacacataat

SEQ ID NO: 8037 - DNA, 20 bp, Artificial Sequence
  Description of Artificial Sequence: Synthetic oligonucleotide
  Target: SCN10A; (-) strand; PAM type: NNGRRT; PAM sequence: GTGAGT
caccacatattaattttttg

SEQ ID NO: 8038 - DNA, 20 bp, Artificial Sequence
  Description of Artificial Sequence: Synthetic oligonucleotide
  Target: SCN10A; (-) strand; PAM type: NNGRRT; PAM sequence: ATGGAT
gctgaacagatttcatttgc

SEQ ID NO: 8039 - DNA, 20 bp, Artificial Sequence
  Description of Artificial Sequence: Synthetic oligonucleotide
  Target: SCN10A; (-) strand; PAM type: NNGRRT; PAM sequence: TAGAAT
attagaagattcataattgt

SEQ ID NO: 8040 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ttaaaggatgtctcatgtga

SEQ ID NO: 8041 - DNA, 20 bp, Artificial Sequence
  Description of Artificial Sequence: Synthetic oligonucleotide
  Target: SCN10A; (-) strand; PAM type: NNGRRT; PAM sequence: AAGGAT
taaagtacctaaatgaatta

SEQ ID NO: 8042 - DNA, 20 bp, Artificial Sequence
  Description of Artificial Sequence: Synthetic oligonucleotide
  Target: SCN10A; (-) strand; PAM type: NNGRRT; PAM sequence: ATGAAT
agaaattttaaagtacctaa

SEQ ID NO: 8043 - DNA, 20 bp, Artificial Sequence
  Description of Artificial Sequence: Synthetic oligonucleotide
  Target: SCN10A; (-) strand; PAM type: NNGRRT; PAM sequence: AAGGAT
agacctaacaaaactagaaa

SEQ ID NO: 8044 - DNA, 20 bp, Artificial Sequence
  Description of Artificial Sequence: Synthetic oligonucleotide
  Target: SCN10A; (-) strand; PAM type: NNGRRT; PAM sequence: TAGAAT
taagtcacagcatggaagca

SEQ ID NO: 8045 - DNA, 20 bp, Artificial Sequence
  Description of Artificial Sequence: Synthetic oligonucleotide
  Target: SCN10A; (-) strand; PAM type: NNGRRT; PAM sequence: GGGAAT
gttaaagacatacatattca

SEQ ID NO: 8046 - DNA, 20 bp, Artificial Sequence
  Description of Artificial Sequence: Synthetic oligonucleotide
  Target: SCN10A; (-) strand; PAM type: NNGRRT; PAM sequence: GAGAGT
aacagtttaatcagaaccta

SEQ ID NO: 8047 - DNA, 20 bp, Artificial Sequence
  Description of Artificial Sequence: Synthetic oligonucleotide
  Target: SCN10A; (-) strand; PAM type: NNGRRT; PAM sequence: AAGAAT
atttttaaaaatctctctta

SEQ ID NO: 8048 - DNA, 20 bp, Artificial Sequence
  Description of Artificial Sequence: Synthetic oligonucleotide
  Target: SCN10A; (-) strand; PAM type: NNGRRT; PAM sequence: TAGAGT
attctctgatcataatgaaa

SEQ ID NO: 8049 - DNA, 20 bp, Artificial Sequence
  Description of Artificial Sequence: Synthetic oligonucleotide
  Target: SCN10A; (-) strand; PAM type: NNGRRT; PAM sequence: AGGAAT
aggataaataaaaacattgt

SEQ ID NO: 8050 - DNA, 20 bp, Artificial Sequence
  Description of Artificial Sequence: Synthetic oligonucleotide
  Target: SCN10A; (-) strand; PAM type: NNGRRT; PAM sequence: GAGGAT
atcagaaattattagagtag

SEQ ID NO: 8051 - DNA, 20 bp, Artificial Sequence
  Description of Artificial Sequence: Synthetic oligonucleotide
  Target: SCN10A; (-) strand; PAM type: NNGRRT; PAM sequence: TAGAGT
atttataaatcagaaattat

SEQ ID NO: 8052 - DNA, 20 bp, Artificial Sequence
  Description of Artificial Sequence: Synthetic oligonucleotide
  Target: SCN10A; (-) strand; PAM type: NNGRRT; PAM sequence: TGGAAT
gattttaatatcagagaaag

SEQ ID NO: 8053 - DNA, 20 bp, Artificial Sequence
  Description of Artificial Sequence: Synthetic oligonucleotide
  Target: SCN10A; (-) strand; PAM type: NNGRRT; PAM sequence: CAGGAT
gcaaaggcaaacaaagaaag

SEQ ID NO: 8054 - DNA, 20 bp, Artificial Sequence
  Description of Artificial Sequence: Synthetic oligonucleotide
  Target: SCN10A; (-) strand; PAM type: NNGRRT; PAM sequence: TAGAAT
atacagaaaggctaaaatta

SEQ ID NO: 8055 - DNA, 20 bp, Artificial Sequence
  Description of Artificial Sequence: Synthetic oligonucleotide
  Target: SCN10A; (-) strand; PAM type: NNGRRT; PAM sequence: TTGAAT
aagcaatacccaactctatg

SEQ ID NO: 8056 - DNA, 20 bp, Artificial Sequence
  Description of Artificial Sequence: Synthetic oligonucleotide
  Target: SCN10A; (-) strand; PAM type: NNGRRT; PAM sequence: ATGGAT
tgtcatgtcactaaatataa

SEQ ID NO: 8057 - DNA, 20 bp, Artificial Sequence
  Description of Artificial Sequence: Synthetic oligonucleotide
  Target: SCN10A; (-) strand; PAM type: NNGRRT; PAM sequence: AAGAAT
taacatggtcacatttattt

SEQ ID NO: 8058 - DNA, 20 bp, Artificial Sequence
  Description of Artificial Sequence: Synthetic oligonucleotide
  Target: SCN10A; (-) strand; PAM type: NNGRRT; PAM sequence: TCGAAT
aactcaaataagaaaatcgc

SEQ ID NO: 8059 - DNA, 20 bp, Artificial Sequence
  Description of Artificial Sequence: Synthetic oligonucleotide
  Target: SCN10A; (-) strand; PAM type: NNGRRT; PAM sequence: TTGAGT
ggccaaatgcgttgttgatg

SEQ ID NO: 8060 - DNA, 20 bp, Artificial Sequence
  Description of Artificial Sequence: Synthetic oligonucleotide
  Target: SCN10A; (-) strand; PAM type: NNGRRT; PAM sequence: GAGGAT
agcttcttgtgcagttgtaa

SEQ ID NO: 8061 - DNA, 20 bp, Artificial Sequence
  Description of Artificial Sequence: Synthetic oligonucleotide
  Target: SCN10A; (-) strand; PAM type: NNGRRT; PAM sequence: ATGAGT
tgaccgtagaatggtcaacg

SEQ ID NO: 8062 - DNA, 20 bp, Artificial Sequence
  Description of Artificial Sequence: Synthetic oligonucleotide
  Target: SCN10A; (-) strand; PAM type: NNGRRT; PAM sequence: TAGAAT
cttcaactgccgaatgaccg

SEQ ID NO: 8063 - DNA, 20 bp, Artificial Sequence
  Description of Artificial Sequence: Synthetic oligonucleotide
  Target: SCN10A; (-) strand; PAM type: NNGRRT; PAM sequence: CCGAAT
tttccaatttgcttcaactg

SEQ ID NO: 8064 - DNA, 20 bp, Artificial Sequence
  Description of Artificial Sequence: Synthetic oligonucleotide
  Target: SCN10A; (-) strand; PAM type: NNGRRT; PAM sequence: TAGAAT
aatagttcatttttgttgca

SEQ ID NO: 8065 - DNA, 20 bp, Artificial Sequence
  Description of Artificial Sequence: Synthetic oligonucleotide
  Target: SCN10A; (-) strand; PAM type: NNGRRT; PAM sequence: TTGGGT
acgactttttttggtgcaag

SEQ ID NO: 8066 - DNA, 20 bp, Artificial Sequence
  Description of Artificial Sequence: Synthetic oligonucleotide
  Target: SCN10A; (-) strand; PAM type: NNGRRT; PAM sequence: TGGGAT
ctcagatgtaatggctttgc

SEQ ID NO: 8067 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tgcagtcggttgttgtggag

SEQ ID NO: 8068 - DNA, 20 bp, Artificial Sequence
  Description of Artificial Sequence: Synthetic oligonucleotide
  Target: SCN10A; (-) strand; PAM type: NNGRRT; PAM sequence: GTGGAT
tgagaggtcaggtgaatatg

SEQ ID NO: 8069 - DNA, 20 bp, Artificial Sequence
  Description of Artificial Sequence: Synthetic oligonucleotide
  Target: SCN10A; (-) strand; PAM type: NNGRRT; PAM sequence: GTGAAT
gttggttggtgagaggtcag

SEQ ID NO: 8070 - DNA, 20 bp, Artificial Sequence
  Description of Artificial Sequence: Synthetic oligonucleotide
  Target: SCN10A; (-) strand; PAM type: NNGRRT; PAM sequence: TGGGAT
tagcataaaaatccatgctt

SEQ ID NO: 8071 - DNA, 20 bp, Artificial Sequence
  Description of Artificial Sequence: Synthetic oligonucleotide
  Target: SCN10A; (-) strand; PAM type: NNGRRT; PAM sequence: ATGAGT
cacatttttgccaatgagaa

SEQ ID NO: 8072 - DNA, 20 bp, Artificial Sequence
  Description of Artificial Sequence: Synthetic oligonucleotide
  Target: SCN10A; (-) strand; PAM type: NNGRRT; PAM sequence: TGGGGT
tgaaaaggtacaaaagtaat

SEQ ID NO: 8073 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tgacaaactctaaatactgg

SEQ ID NO: 8074 - DNA, 20 bp, Artificial Sequence
  Description of Artificial Sequence: Synthetic oligonucleotide
  Target: SCN10A; (-) strand; PAM type: NNGRRT; PAM sequence: TAGGAT
ttacttataaagacaaccac

SEQ ID NO: 8075 - DNA, 20 bp, Artificial Sequence
  Description of Artificial Sequence: Synthetic oligonucleotide
  Target: SCN10A; (-) strand; PAM type: NNGRRT; PAM sequence: AGGAAT
atggataaaacagagaggaa

SEQ ID NO: 8076 - DNA, 20 bp, Artificial Sequence
  Description of Artificial Sequence: Synthetic oligonucleotide
  Target: SCN10A; (-) strand; PAM type: NNGRRT; PAM sequence: ATGGAT
ttattaaatacagtcagata

SEQ ID NO: 8077 - DNA, 20 bp, Artificial Sequence
  Description of Artificial Sequence: Synthetic oligonucleotide
  Target: SCN10A; (-) strand; PAM type: NNGRRT; PAM sequence: AAGAGT
tctataataacaagaagtta

SEQ ID NO: 8078 - DNA, 20 bp, Artificial Sequence
  Description of Artificial Sequence: Synthetic oligonucleotide
  Target: SCN10A; (-) strand; PAM type: NNGRRT; PAM sequence: CAGAGT
aagaggaaagaacatgtgag

SEQ ID NO: 8079 - DNA, 20 bp, Artificial Sequence
  Description of Artificial Sequence: Synthetic oligonucleotide
  Target: SCN10A; (-) strand; PAM type: NNGRRT; PAM sequence: GAGAAT
ctccagagggggataaaaat

SEQ ID NO: 8080 - DNA, 20 bp, Artificial Sequence
  Description of Artificial Sequence: Synthetic oligonucleotide
  Target: SCN10A; (-) strand; PAM type: NNGRRT; PAM sequence: GGGGAT
aaaccacggtgcctccagag

SEQ ID NO: 8081 - DNA, 20 bp, Artificial Sequence
  Description of Artificial Sequence: Synthetic oligonucleotide
  Target: SCN10A; (-) strand; PAM type: NNGRRT; PAM sequence: CAGGGT
tggtaaatcacttagcagat

SEQ ID NO: 8082 - DNA, 20 bp, Artificial Sequence
  Description of Artificial Sequence: Synthetic oligonucleotide
  Target: SCN10A; (-) strand; PAM type: NNGRRT; PAM sequence: GTGGGT
aaacacttggaagaccaaaa

SEQ ID NO: 8083 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tatacaagaacaaagagaaa

SEQ ID NO: 8084 - DNA, 20 bp, Artificial Sequence
  Description of Artificial Sequence: Synthetic oligonucleotide
  Target: SCN10A; (-) strand; PAM type: NNGRRT; PAM sequence: TAGAAT
ccaccctctcaaaatgccaa

SEQ ID NO: 8085 - DNA, 20 bp, Artificial Sequence
  Description of Artificial Sequence: Synthetic oligonucleotide
  Target: SCN10A; (-) strand; PAM type: NNGRRT; PAM sequence: TAGAAT
ttgtggttaaatatggaaga

SEQ ID NO: 8086 - DNA, 20 bp, Artificial Sequence
  Description of Artificial Sequence: Synthetic oligonucleotide
  Target: SCN10A; (-) strand; PAM type: NNGRRT; PAM sequence: GGGAGT
ttttgcaaaatgagttattt

SEQ ID NO: 8087 - DNA, 20 bp, Artificial Sequence
  Description of Artificial Sequence: Synthetic oligonucleotide
  Target: SCN10A; (-) strand; PAM type: NNGRRT; PAM sequence: ATGAGT
gtaaaacatttttttgcaaa

SEQ ID NO: 8088 - DNA, 20 bp, Artificial Sequence
  Description of Artificial Sequence: Synthetic oligonucleotide
  Target: SCN10A; (-) strand; PAM type: NNGRRT; PAM sequence: TGGAGT
taaaatgtctatgcttcttt

SEQ ID NO: 8089 - DNA, 20 bp, Artificial Sequence
  Description of Artificial Sequence: Synthetic oligonucleotide
  Target: SCN10A; (-) strand; PAM type: NNGRRT; PAM sequence: GAGAGT
agacatctataagctagaaa

SEQ ID NO: 8090 - DNA, 20 bp, Artificial Sequence
  Description of Artificial Sequence: Synthetic oligonucleotide
  Target: SCN10A; (-) strand; PAM type: NNGRRT; PAM sequence: AAGAGT
attgggttaaatgaagtcac

SEQ ID NO: 8091 - DNA, 20 bp, Artificial Sequence
  Description of Artificial Sequence: Synthetic oligonucleotide
  Target: SCN10A; (-) strand; PAM type: NNGRRT; PAM sequence: TTGGGT
ttgggcctctaaggaggtga

SEQ ID NO: 8092 - DNA, 20 bp, Artificial Sequence
  Description of Artificial Sequence: Synthetic oligonucleotide
  Target: SCN10A; (-) strand; PAM type: NNGRRT; PAM sequence: GTGAAT
gtcacacaagctgctatgga

SEQ ID NO: 8093 - DNA, 20 bp, Artificial Sequence
  Description of Artificial Sequence: Synthetic oligonucleotide
  Target: SCN10A; (-) strand; PAM type: NNGRRT; PAM sequence: TGGAGT
agttgtcacacaagctgcta

SEQ ID NO: 8094 - DNA, 20 bp, Artificial Sequence
  Description of Artificial Sequence: Synthetic oligonucleotide
  Target: SCN10A; (-) strand; PAM type: NNGRRT; PAM sequence: ATGGGT
gtcacgttccattttatggc

SEQ ID NO: 8095 - DNA, 20 bp, Artificial Sequence
  Description of Artificial Sequence: Synthetic oligonucleotide
  Target: SCN10A; (-) strand; PAM type: NNGRRT; PAM sequence: GAGGAT
ggcctccagggcagaagagg

SEQ ID NO: 8096 - DNA, 20 bp, Artificial Sequence
  Description of Artificial Sequence: Synthetic oligonucleotide
  Target: SCN10A; (-) strand; PAM type: NNGRRT; PAM sequence: GAGAAT
gaaaaagtaccaaaaattag

SEQ ID NO: 8097 - DNA, 20 bp, Artificial Sequence
  Description of Artificial Sequence: Synthetic oligonucleotide
  Target: SCN10A; (-) strand; PAM type: NNGRRT; PAM sequence: AGGAAT
aaaactaaactattttgttt

SEQ ID NO: 8098 - DNA, 20 bp, Artificial Sequence
  Description of Artificial Sequence: Synthetic oligonucleotide
  Target: SCN10A; (-) strand; PAM type: NNGRRT; PAM sequence: AAGGAT
aacaaaaaaagccaaatgca

SEQ ID NO: 8099 - DNA, 20 bp, Artificial Sequence
  Description of Artificial Sequence: Synthetic oligonucleotide
  Target: SCN10A; (-) strand; PAM type: NNGRRT; PAM sequence: ATGAGT
agtgctgcacaacaataagg

SEQ ID NO: 8100 - DNA, 20 bp, Artificial Sequence
  Description of Artificial Sequence: Synthetic oligonucleotide
  Target: SCN10A; (-) strand; PAM type: NNGRRT; PAM sequence: AAGGAT
ctttagtgctgcacaacaat

SEQ ID NO: 8101 - DNA, 20 bp, Artificial Sequence
  Description of Artificial Sequence: Synthetic oligonucleotide
  Target: SCN10A; (-) strand; PAM type: NNGRRT; PAM sequence: TTGAGT
cactcaaatgtccataaact

SEQ ID NO: 8102 - DNA, 20 bp, Artificial Sequence
  Description of Artificial Sequence: Synthetic oligonucleotide
  Target: SCN10A; (-) strand; PAM type: NNGRRT; PAM sequence: AGGGGT
gacaacctctttggaaagca

SEQ ID NO: 8103 - DNA, 20 bp, Artificial Sequence
  Description of Artificial Sequence: Synthetic oligonucleotide
  Target: SCN10A; (-) strand; PAM type: NNGRRT; PAM sequence: GGGAGT
gaaactcacacactgctggt

SEQ ID NO: 8104 - DNA, 20 bp, Artificial Sequence
  Description of Artificial Sequence: Synthetic oligonucleotide
  Target: SCN10A; (-) strand; PAM type: NNGRRT; PAM sequence: GGGAAT
gtgtcacaataccaagtatt

SEQ ID NO: 8105 - DNA, 20 bp, Artificial Sequence
  Description of Artificial Sequence: Synthetic oligonucleotide
  Target: SCN10A; (-) strand; PAM type: NNGRRT; PAM sequence: AAGAGT
cttaacctttttttaaatca

SEQ ID NO: 8106 - DNA, 20 bp, Artificial Sequence
  Description of Artificial Sequence: Synthetic oligonucleotide
  Target: SCN10A; (-) strand; PAM type: NNGRRT; PAM sequence: TTGAAT
cttgtaaaatagcacaaaat

SEQ ID NO: 8107 - DNA, 20 bp, Artificial Sequence
  Description of Artificial Sequence: Synthetic oligonucleotide
  Target: SCN10A; (-) strand; PAM type: NNGRRT; PAM sequence: CAGAGT
aaaaagcaagtgcttatatt

SEQ ID NO: 8108 - DNA, 20 bp, Artificial Sequence
  Description of Artificial Sequence: Synthetic oligonucleotide
  Target: SCN10A; (-) strand; PAM type: NNGRRT; PAM sequence: AAGAAT
cattttagtatactataatt

SEQ ID NO: 8109 - DNA, 20 bp, Artificial Sequence
  Description of Artificial Sequence: Synthetic oligonucleotide
  Target: SCN10A; (-) strand; PAM type: NNGRRT; PAM sequence: AGGAAT
tttgaaaggaaaaaacaaag

SEQ ID NO: 8110 - DNA, 20 bp, Artificial Sequence
  Description of Artificial Sequence: Synthetic oligonucleotide
  Target: SCN10A; (-) strand; PAM type: NNGRRT; PAM sequence: GTGGAT
atgaagccgacttgatcgtg

SEQ ID NO: 8111 - DNA, 20 bp, Artificial Sequence
  Description of Artificial Sequence: Synthetic oligonucleotide
  Target: SCN10A; (-) strand; PAM type: NNGRRT; PAM sequence: ATGGAT
tcattggttctgtttgtgtg

SEQ ID NO: 8112 - DNA, 20 bp, Artificial Sequence
  Description of Artificial Sequence: Synthetic oligonucleotide
  Target: SCN10A; (-) strand; PAM type: NNGRRT; PAM sequence: TTGAAT
gcttttagcatgaatgggtg

SEQ ID NO: 8113 - DNA, 20 bp, Artificial Sequence
  Description of Artificial Sequence: Synthetic oligonucleotide
  Target: SCN10A; (-) strand; PAM type: NNGRRT; PAM sequence: ATGGGT
attgagagcttttagcatga

SEQ ID NO: 8114 - DNA, 20 bp, Artificial Sequence
  Description of Artificial Sequence: Synthetic oligonucleotide
  Target: SCN10A; (-) strand; PAM type: NNGRRT; PAM sequence: ATGAAT
gtttattgagagcttttagc

SEQ ID NO: 8115 - DNA, 20 bp, Artificial Sequence
  Description of Artificial Sequence: Synthetic oligonucleotide
  Target: SCN10A; (-) strand; PAM type: NNGRRT; PAM sequence: AAGAGT
cttccaatactatgttgaat

SEQ ID NO: 8116 - DNA, 20 bp, Artificial Sequence
  Description of Artificial Sequence: Synthetic oligonucleotide
  Target: SCN10A; (-) strand; PAM type: NNGRRT; PAM sequence: TTGAAT
ccagaacttccaatactatg

SEQ ID NO: 8117 - DNA, 20 bp, Artificial Sequence
  Description of Artificial Sequence: Synthetic oligonucleotide
  Target: SCN10A; (-) strand; PAM type: NNGRRT; PAM sequence: TTGAAT
ttgacttcctcttttcctat

SEQ ID NO: 8118 - DNA, 20 bp, Artificial Sequence
  Description of Artificial Sequence: Synthetic oligonucleotide
  Target: SCN10A; (-) strand; PAM type: NNGRRT; PAM sequence: TGGGGT
gagattttgggctgagatga

SEQ ID NO: 8119 - DNA, 20 bp, Artificial Sequence
  Description of Artificial Sequence: Synthetic oligonucleotide
  Target: SCN10A; (-) strand; PAM type: NNGRRT; PAM sequence: GGGAAT
tttgtctgttattggtgtat

SEQ ID NO: 8120 - DNA, 20 bp, Artificial Sequence
  Description of Artificial Sequence: Synthetic oligonucleotide
  Target: SCN10A; (-) strand; PAM type: NNGRRT; PAM sequence: GGGAGT
tctttgttgcaattgtgaat

SEQ ID NO: 8121 - DNA, 20 bp, Artificial Sequence
  Description of Artificial Sequence: Synthetic oligonucleotide
  Target: SCN10A; (-) strand; PAM type: NNGRRT; PAM sequence: GTGAAT
ttattctctttgttgcaatt

SEQ ID NO: 8122 - DNA, 20 bp, Artificial Sequence
  Description of Artificial Sequence: Synthetic oligonucleotide
  Target: SCN10A; (-) strand; PAM type: NNGRRT; PAM sequence: TGGAAT
atttttcctatccatgagca

SEQ ID NO: 8123 - DNA, 20 bp, Artificial Sequence
  Description of Artificial Sequence: Synthetic oligonucleotide
  Target: SCN10A; (-) strand; PAM type: NNGRRT; PAM sequence: TTGAAT
gtagcttgatggggataaca

SEQ ID NO: 8124 - DNA, 20 bp, Artificial Sequence
  Description of Artificial Sequence: Synthetic oligonucleotide
  Target: SCN10A; (-) strand; PAM type: NNGRRT; PAM sequence: GGGGAT
aaagtcagtggtagcttgat

SEQ ID NO: 8125 - DNA, 20 bp, Artificial Sequence
  Description of Artificial Sequence: Synthetic oligonucleotide
  Target: SCN10A; (-) strand; PAM type: NNGRRT; PAM sequence: TAGAAT
ccaactttcttctttttgct

SEQ ID NO: 8126 - DNA, 20 bp, Artificial Sequence
  Description of Artificial Sequence: Synthetic oligonucleotide
  Target: SCN10A; (-) strand; PAM type: NNGRRT; PAM sequence: GGGAAT
cccacaccatttattaaata

SEQ ID NO: 8127 - DNA, 20 bp, Artificial Sequence
  Description of Artificial Sequence: Synthetic oligonucleotide
  Target: SCN10A; (-) strand; PAM type: NNGRRT; PAM sequence: AGGGAT
ttttgtgtaaggtataagga

SEQ ID NO: 8128 - DNA, 20 bp, Artificial Sequence
  Description of Artificial Sequence: Synthetic oligonucleotide
  Target: SCN10A; (-) strand; PAM type: NNGRRT; PAM sequence: TTGAGT
gtttaagtctttaatctatc

SEQ ID NO: 8129 - DNA, 20 bp, Artificial Sequence
  Description of Artificial Sequence: Synthetic oligonucleotide
  Target: SCN10A; (-) strand; PAM type: NNGRRT; PAM sequence: TAGGGT
gtattgcctaggttttcttc

SEQ ID NO: 8130 - DNA, 20 bp, Artificial Sequence
  Description of Artificial Sequence: Synthetic oligonucleotide
  Target: SCN10A; (-) strand; PAM type: NNGRRT; PAM sequence: AAGGGT
ttgcccatgcctatgtcctg

SEQ ID NO: 8131 - DNA, 20 bp, Artificial Sequence
  Description of Artificial Sequence: Synthetic oligonucleotide
  Target: SCN10A; (-) strand; PAM type: NNGRRT; PAM sequence: TTGGAT
gcagaagctctttagtttaa

SEQ ID NO: 8132 - DNA, 20 bp, Artificial Sequence
  Description of Artificial Sequence: Synthetic oligonucleotide
  Target: SCN10A; (-) strand; PAM type: NNGRRT; PAM sequence: CTGGAT
gtttaagttttttgtagatt

SEQ ID NO: 8133 - DNA, 20 bp, Artificial Sequence
  Description of Artificial Sequence: Synthetic oligonucleotide
  Target: SCN10A; (-) strand; PAM type: NNGRRT; PAM sequence: TGGAGT
atcctttgcccactttttga

SEQ ID NO: 8134 - DNA, 20 bp, Artificial Sequence
  Description of Artificial Sequence: Synthetic oligonucleotide
  Target: SCN10A; (-) strand; PAM type: NNGRRT; PAM sequence: AGGAAT
tttctggttctagatccttg

SEQ ID NO: 8135 - DNA, 20 bp, Artificial Sequence
  Description of Artificial Sequence: Synthetic oligonucleotide
  Target: SCN10A; (-) strand; PAM type: NNGRRT; PAM sequence: CTGGGT
tatacccagtaatggaattg

SEQ ID NO: 8136 - DNA, 20 bp, Artificial Sequence
  Description of Artificial Sequence: Synthetic oligonucleotide
  Target: SCN10A; (-) strand; PAM type: NNGRRT; PAM sequence: TGGAAT
tttgggtatatacccagtaa

SEQ ID NO: 8137 - DNA, 20 bp, Artificial Sequence
  Description of Artificial Sequence: Synthetic oligonucleotide
  Target: SCN10A; (-) strand; PAM type: NNGRRT; PAM sequence: TTGGGT
gtagaataatttataatcct

SEQ ID NO: 8138 - DNA, 20 bp, Artificial Sequence
  Description of Artificial Sequence: Synthetic oligonucleotide
  Target: SCN10A; (-) strand; PAM type: NNGRRT; PAM sequence: TAGAAT
gcatgcttgtatctttatag

SEQ ID NO: 8139 - DNA, 20 bp, Artificial Sequence
  Description of Artificial Sequence: Synthetic oligonucleotide
  Target: SCN10A; (-) strand; PAM type: NNGRRT; PAM sequence: TTGGGT
agtctatcactgatgggcgt

SEQ ID NO: 8140 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tgttcttatgtcagtttgct

SEQ ID NO: 8141 - DNA, 20 bp, Artificial Sequence
  Description of Artificial Sequence: Synthetic oligonucleotide
  Target: SCN10A; (-) strand; PAM type: NNGRRT; PAM sequence: ATGAGT
tcattgttcatctcccacct

SEQ ID NO: 8142 - DNA, 20 bp, Artificial Sequence
  Description of Artificial Sequence: Synthetic oligonucleotide
  Target: SCN10A; (-) strand; PAM type: NNGRRT; PAM sequence: TGGGGT
ttaaattttactttaagttc

SEQ ID NO: 8143 - DNA, 20 bp, Artificial Sequence
  Description of Artificial Sequence: Synthetic oligonucleotide
  Target: SCN10A; (-) strand; PAM type: NNGRRT; PAM sequence: GTGGAT
cacacaagaatcaattctag

SEQ ID NO: 8144 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tccaactttgcaccacacac

SEQ ID NO: 8145 - DNA, 20 bp, Artificial Sequence
  Description of Artificial Sequence: Synthetic oligonucleotide
  Target: SCN10A; (-) strand; PAM type: NNGRRT; PAM sequence: AGGAAT
aaaaatgatgctgaagaatt

SEQ ID NO: 8146 - DNA, 20 bp, Artificial Sequence
  Description of Artificial Sequence: Synthetic oligonucleotide
  Target: SCN10A; (-) strand; PAM type: NNGRRT; PAM sequence: AAGAAT
gtcttcaaaaaatgatgctg

SEQ ID NO: 8147 - DNA, 20 bp, Artificial Sequence
  Description of Artificial Sequence: Synthetic oligonucleotide
  Target: SCN10A; (-) strand; PAM type: NNGRRT; PAM sequence: CAGAAT
gccattggtgtaagattggt

SEQ ID NO: 8148 - DNA, 20 bp, Artificial Sequence
  Description of Artificial Sequence: Synthetic oligonucleotide
  Target: SCN10A; (-) strand; PAM type: NNGRRT; PAM sequence: CTGGAT
aagtgggagaactcattcta

SEQ ID NO: 8149 - DNA, 20 bp, Artificial Sequence
  Description of Artificial Sequence: Synthetic oligonucleotide
  Target: SCN10A; (-) strand; PAM type: NNGRRT; PAM sequence: AGGAAT
ttttaaaatgtcaagtatct

SEQ ID NO: 8150 - DNA, 20 bp, Artificial Sequence
  Description of Artificial Sequence: Synthetic oligonucleotide
  Target: SCN10A; (-) strand; PAM type: NNGRRT; PAM sequence: CTGGGT
aaaagagtatagtaaggtag

SEQ ID NO: 8151 - DNA, 20 bp, Artificial Sequence
  Description of Artificial Sequence: Synthetic oligonucleotide
  Target: SCN10A; (-) strand; PAM type: NNGRRT; PAM sequence: AAGAGT
taaacagtaagaattaataa

SEQ ID NO: 8152 - DNA, 20 bp, Artificial Sequence
  Description of Artificial Sequence: Synthetic oligonucleotide
  Target: SCN10A; (-) strand; PAM type: NNGRRT; PAM sequence: AAGAAT
ataacctagagataaacagt

SEQ ID NO: 8153 - DNA, 20 bp, Artificial Sequence
  Description of Artificial Sequence: Synthetic oligonucleotide
  Target: SCN10A; (-) strand; PAM type: NNGRRT; PAM sequence: AAGGGT
gggattgcatcactctgata

SEQ ID NO: 8154 - DNA, 20 bp, Artificial Sequence
  Description of Artificial Sequence: Synthetic oligonucleotide
  Target: SCN10A; (-) strand; PAM type: NNGRRT; PAM sequence: GGGGAT
aagtataataattttaaaaa

SEQ ID NO: 8155 - DNA, 20 bp, Artificial Sequence
  Description of Artificial Sequence: Synthetic oligonucleotide
  Target: SCN10A; (-) strand; PAM type: NNGRRT; PAM sequence: ACGGGT
gtgcagcaaaccaccatggc

SEQ ID NO: 8156 - DNA, 20 bp, Artificial Sequence
  Description of Artificial Sequence: Synthetic oligonucleotide
  Target: SCN10A; (-) strand; PAM type: NNGRRT; PAM sequence: AAGGGT
ctaatgtaaatgacgggttg

SEQ ID NO: 8157 - DNA, 20 bp, Artificial Sequence
  Description of Artificial Sequence: Synthetic oligonucleotide
  Target: SCN10A; (-) strand; PAM type: NNGRRT; PAM sequence: ACGGGT
agaaatacctaatgtaaatg

SEQ ID NO: 8158 - DNA, 20 bp, Artificial Sequence
  Description of Artificial Sequence: Synthetic oligonucleotide
  Target: SCN10A; (-) strand; PAM type: NNGRRT; PAM sequence: AGGGAT
gaggggtggggggctagggg

SEQ ID NO: 8159 - DNA, 20 bp, Artificial Sequence
  Description of Artificial Sequence: Synthetic oligonucleotide
  Target: SCN10A; (-) strand; PAM type: NNGRRT; PAM sequence: AGGGGT
gaacacactggggcctgttg

SEQ ID NO: 8160 - DNA, 20 bp, Artificial Sequence
  Description of Artificial Sequence: Synthetic oligonucleotide
  Target: SCN10A; (-) strand; PAM type: NNGRRT; PAM sequence: GGGAGT
gtatgttctcactcataagt

SEQ ID NO: 8161 - DNA, 20 bp, Artificial Sequence
  Description of Artificial Sequence: Synthetic oligonucleotide
  Target: SCN10A; (-) strand; PAM type: NNGRRT; PAM sequence: ATGGAT
ttcatgtcctttgcagggac

SEQ ID NO: 8162 - DNA, 20 bp, Artificial Sequence
  Description of Artificial Sequence: Synthetic oligonucleotide
  Target: SCN10A; (-) strand; PAM type: NNGRRT; PAM sequence: ATGAGT
ctatgcagtcataaaaaagg

SEQ ID NO: 8163 - DNA, 20 bp, Artificial Sequence
  Description of Artificial Sequence: Synthetic oligonucleotide
  Target: SCN10A; (-) strand; PAM type: NNGRRT; PAM sequence: AAGGAT
aatgctatgcagtcataaaa

SEQ ID NO: 8164 - DNA, 20 bp, Artificial Sequence
  Description of Artificial Sequence: Synthetic oligonucleotide
  Target: SCN10A; (-) strand; PAM type: NNGRRT; PAM sequence: TGGAAT
aatgtggcacatatacacca

SEQ ID NO: 8165 - DNA, 20 bp, Artificial Sequence
  Description of Artificial Sequence: Synthetic oligonucleotide
  Target: SCN10A; (-) strand; PAM type: NNGRRT; PAM sequence: GGGAAT
ttagaaaagttgaaatagaa

SEQ ID NO: 8166 - DNA, 20 bp, Artificial Sequence
  Description of Artificial Sequence: Synthetic oligonucleotide
  Target: SCN10A; (-) strand; PAM type: NNGRRT; PAM sequence: AAGGAT
ttattaatagattaaaggaa

SEQ ID NO: 8167 - DNA, 20 bp, Artificial Sequence
  Description of Artificial Sequence: Synthetic oligonucleotide
  Target: SCN10A; (-) strand; PAM type: NNGRRT; PAM sequence: AGGGAT
tccatatccacacatctggg

SEQ ID NO: 8168 - DNA, 20 bp, Artificial Sequence
  Description of Artificial Sequence: Synthetic oligonucleotide
  Target: SCN10A; (-) strand; PAM type: NNGRRT; PAM sequence: GGGAGT
cccctatagtttcagaatct

SEQ ID NO: 8169 - DNA, 20 bp, Artificial Sequence
  Description of Artificial Sequence: Synthetic oligonucleotide
  Target: SCN10A; (-) strand; PAM type: NNGRRT; PAM sequence: CAGAAT
gggtgaaacccctatagttt

SEQ ID NO: 8170 - DNA, 20 bp, Artificial Sequence
  Description of Artificial Sequence: Synthetic oligonucleotide
  Target: SCN10A; (-) strand; PAM type: NNGRRT; PAM sequence: GTGGGT
tattctatttccctaggtta

SEQ ID NO: 8171 - DNA, 20 bp, Artificial Sequence
  Description of Artificial Sequence: Synthetic oligonucleotide
  Target: SCN10A; (-) strand; PAM type: NNGRRT; PAM sequence: TGGAGT
gaactaagaacaaatggctc

SEQ ID NO: 8172 - DNA, 20 bp, Artificial Sequence
  Description of Artificial Sequence: Synthetic oligonucleotide
  Target: SCN10A; (-) strand; PAM type: NNGRRT; PAM sequence: ATGAGT
gtctaaggtggcctgggaag

SEQ ID NO: 8173 - DNA, 20 bp, Artificial Sequence
  Description of Artificial Sequence: Synthetic oligonucleotide
  Target: SCN10A; (-) strand; PAM type: NNGRRT; PAM sequence: CTGAGT
tggggagattttttaaatgc

SEQ ID NO: 8174 - DNA, 20 bp, Artificial Sequence
  Description of Artificial Sequence: Synthetic oligonucleotide
  Target: SCN10A; (-) strand; PAM type: NNGRRT; PAM sequence: CTGAAT
catgcctcatgtgggtaatg

SEQ ID NO: 8175 - DNA, 20 bp, Artificial Sequence
  Description of Artificial Sequence: Synthetic oligonucleotide
  Target: SCN10A; (-) strand; PAM type: NNGRRT; PAM sequence: GTGGGT
tttatcctgccatgcctcat

SEQ ID NO: 8176 - DNA, 20 bp, Artificial Sequence
  Description of Artificial Sequence: Synthetic oligonucleotide
  Target: SCN10A; (-) strand; PAM type: NNGRRT; PAM sequence: GTGAGT
gaccttccagagaaaattga

SEQ ID NO: 8177 - DNA, 20 bp, Artificial Sequence
  Description of Artificial Sequence: Synthetic oligonucleotide
  Target: SCN10A; (-) strand; PAM type: NNGRRT; PAM sequence: TTGAGT
aactgaccttccagagaaaa

SEQ ID NO: 8178 - DNA, 20 bp, Artificial Sequence
  Description of Artificial Sequence: Synthetic oligonucleotide
  Target: SCN10A; (-) strand; PAM type: NNGRRT; PAM sequence: ATGAAT
gctaatattggctaagattt

SEQ ID NO: 8179 - DNA, 20 bp, Artificial Sequence
  Description of Artificial Sequence: Synthetic oligonucleotide
  Target: SCN10A; (-) strand; PAM type: NNGRRT; PAM sequence: AAGAGT
gagtttgttatcaaacagat

SEQ ID NO: 8180 - DNA, 20 bp, Artificial Sequence
  Description of Artificial Sequence: Synthetic oligonucleotide
  Target: SCN10A; (-) strand; PAM type: NNGRRT; PAM sequence: CAGAGT
ctgtttccttctatcttgct

SEQ ID NO: 8181 - DNA, 20 bp, Artificial Sequence
  Description of Artificial Sequence: Synthetic oligonucleotide
  Target: SCN10A; (-) strand; PAM type: NNGRRT; PAM sequence: GGGAGT
cagaaggacattttggaaaa

SEQ ID NO: 8182 - DNA, 20 bp, Artificial Sequence
  Description of Artificial Sequence: Synthetic oligonucleotide
  Target: SCN10A; (-) strand; PAM type: NNGRRT; PAM sequence: TAGAAT
tctaacttttctttgtcttt

SEQ ID NO: 8183 - DNA, 20 bp, Artificial Sequence
  Description of Artificial Sequence: Synthetic oligonucleotide
  Target: SCN10A; (-) strand; PAM type: NNGRRT; PAM sequence: TGGGGT
cactccagcctaatcctact

SEQ ID NO: 8184 - DNA, 20 bp, Artificial Sequence
  Description of Artificial Sequence: Synthetic oligonucleotide
  Target: SCN10A; (-) strand; PAM type: NNGRRT; PAM sequence: CAGAGT
tattctccactctagctatt

SEQ ID NO: 8185 - DNA, 20 bp, Artificial Sequence
  Description of Artificial Sequence: Synthetic oligonucleotide
  Target: SCN10A; (-) strand; PAM type: NNGRRT; PAM sequence: ATGAGT
acttctgctcaaattgaaaa

SEQ ID NO: 8186 - DNA, 20 bp, Artificial Sequence
  Description of Artificial Sequence: Synthetic oligonucleotide
  Target: SCN10A; (-) strand; PAM type: NNGRRT; PAM sequence: TAGAAT
ggaaaatgtggtttaattaa

SEQ ID NO: 8187 - DNA, 20 bp, Artificial Sequence
  Description of Artificial Sequence: Synthetic oligonucleotide
  Target: SCN10A; (-) strand; PAM type: NNGRRT; PAM sequence: TTGGAT
acacgattttagtttaatcc

SEQ ID NO: 8188 - DNA, 20 bp, Artificial Sequence
  Description of Artificial Sequence: Synthetic oligonucleotide
  Target: SCN10A; (-) strand; PAM type: NNGRRT; PAM sequence: TAGAAT
atattacttttaaatatttg

SEQ ID NO: 8189 - DNA, 20 bp, Artificial Sequence
  Description of Artificial Sequence: Synthetic oligonucleotide
  Target: SCN10A; (-) strand; PAM type: NNGRRT; PAM sequence: ATGAAT
taattctaatcacatttgct

SEQ ID NO: 8190 - DNA, 20 bp, Artificial Sequence
  Description of Artificial Sequence: Synthetic oligonucleotide
  Target: SCN10A; (-) strand; PAM type: NNGRRT; PAM sequence: TAGAAT
actccagccccaaaagatac

SEQ ID NO: 8191 - DNA, 20 bp, Artificial Sequence
  Description of Artificial Sequence: Synthetic oligonucleotide
  Target: SCN10A; (-) strand; PAM type: NNGRRT; PAM sequence: GGGGGT
ctggacagaaaagctgttga

SEQ ID NO: 8192 - DNA, 20 bp, Artificial Sequence
  Description of Artificial Sequence: Synthetic oligonucleotide
  Target: SCN10A; (-) strand; PAM type: NNGRRT; PAM sequence: TAGAGT
atgagtaaataattgcttgg

SEQ ID NO: 8193 - DNA, 20 bp, Artificial Sequence
  Description of Artificial Sequence: Synthetic oligonucleotide
  Target: SCN10A; (-) strand; PAM type: NNGRRT; PAM sequence: ATGAGT
tctcttcatcttgagatttg

SEQ ID NO: 8194 - DNA, 20 bp, Artificial Sequence
  Description of Artificial Sequence: Synthetic oligonucleotide
  Target: SCN10A; (-) strand; PAM type: NNGRRT; PAM sequence: GTGAAT
taaaaagaaccaagtgacca

SEQ ID NO: 8195 - DNA, 20 bp, Artificial Sequence
  Description of Artificial Sequence: Synthetic oligonucleotide
  Target: SCN10A; (-) strand; PAM type: NNGRRT; PAM sequence: CTGGAT
ggattctggttgaattacat

SEQ ID NO: 8196 - DNA, 20 bp, Artificial Sequence
  Description of Artificial Sequence: Synthetic oligonucleotide
  Target: SCN10A; (-) strand; PAM type: NNGRRT; PAM sequence: TTGAAT
ctcctctttatggattctgg

SEQ ID NO: 8197 - DNA, 20 bp, Artificial Sequence
  Description of Artificial Sequence: Synthetic oligonucleotide
  Target: SCN10A; (-) strand; PAM type: NNGRRT; PAM sequence: ATGGAT
aaacatacaaactcctcttt

SEQ ID NO: 8198 - DNA, 20 bp, Artificial Sequence
  Description of Artificial Sequence: Synthetic oligonucleotide
  Target: SCN10A; (-) strand; PAM type: NNGRRT; PAM sequence: TTGGGT
tctcaatgtgtcgtctctgc

SEQ ID NO: 8199 - DNA, 20 bp, Artificial Sequence
  Description of Artificial Sequence: Synthetic oligonucleotide
  Target: SCN10A; (-) strand; PAM type: NNGRRT; PAM sequence: CAGGGT
gaagtagggtggaaagtaat

SEQ ID NO: 8200 - DNA, 20 bp, Artificial Sequence
  Description of Artificial Sequence: Synthetic oligonucleotide
  Target: SCN10A; (-) strand; PAM type: NNGRRT; PAM sequence: TAGGGT
cagtatctacagtgaggaag

SEQ ID NO: 8201 - DNA, 20 bp, Artificial Sequence
  Description of Artificial Sequence: Synthetic oligonucleotide
  Target: SCN10A; (-) strand; PAM type: NNGRRT; PAM sequence: AAGGAT
tgaattttcagattctacag

SEQ ID NO: 8202 - DNA, 20 bp, Artificial Sequence
  Description of Artificial Sequence: Synthetic oligonucleotide
  Target: SCN10A; (-) strand; PAM type: NNGRRT; PAM sequence: TTGAAT
tacgttttctgagctgaatc

SEQ ID NO: 8203 - DNA, 20 bp, Artificial Sequence
  Description of Artificial Sequence: Synthetic oligonucleotide
  Target: SCN10A; (-) strand; PAM type: NNGRRT; PAM sequence: CTGAAT
caagaattacgttttctgag

SEQ ID NO: 8204 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tttctttctggctggccagc

SEQ ID NO: 8205 - DNA, 20 bp, Artificial Sequence
  Description of Artificial Sequence: Synthetic oligonucleotide
  Target: SCN10A; (-) strand; PAM type: NNGRRT; PAM sequence: TTGGAT
cctaactctgaggcagattg

SEQ ID NO: 8206 - DNA, 20 bp, Artificial Sequence
  Description of Artificial Sequence: Synthetic oligonucleotide
  Target: SCN10A; (-) strand; PAM type: NNGRRT; PAM sequence: AAGAGT
cttagaaggcttcagtaaaa

SEQ ID NO: 8207 - DNA, 20 bp, Artificial Sequence
  Description of Artificial Sequence: Synthetic oligonucleotide
  Target: SCN10A; (-) strand; PAM type: NNGRRT; PAM sequence: AAGAAT
cttgcaggaggttgatgtac

SEQ ID NO: 8208 - DNA, 20 bp, Artificial Sequence
  Description of Artificial Sequence: Synthetic oligonucleotide
  Target: SCN10A; (-) strand; PAM type: NNGRRT; PAM sequence: AAGGAT
ctaagatccttggtcatcgg

SEQ ID NO: 8209 - DNA, 20 bp, Artificial Sequence
  Description of Artificial Sequence: Synthetic oligonucleotide
  Target: SCN10A; (-) strand; PAM type: NNGRRT; PAM sequence: CTGGGT
tttggtttcctaagatcttc

SEQ ID NO: 8210 - DNA, 20 bp, Artificial Sequence
  Description of Artificial Sequence: Synthetic oligonucleotide
  Target: SCN10A; (-) strand; PAM type: NNGRRT; PAM sequence: GGGGAT
aatgtcagaagctgctttca

SEQ ID NO: 8211 - DNA, 20 bp, Artificial Sequence
  Description of Artificial Sequence: Synthetic oligonucleotide
  Target: SCN10A; (-) strand; PAM type: NNGRRT; PAM sequence: ATGAAT
attggtcaaatgtctactat

SEQ ID NO: 8212 - DNA, 20 bp, Artificial Sequence
  Description of Artificial Sequence: Synthetic oligonucleotide
  Target: SCN10A; (-) strand; PAM type: NNGRRT; PAM sequence: ATGAGT
tttgggcagatgagataggc

SEQ ID NO: 8213 - DNA, 20 bp, Artificial Sequence
  Description of Artificial Sequence: Synthetic oligonucleotide
  Target: SCN10A; (-) strand; PAM type: NNGRRT; PAM sequence: GTGGAT
agactaatctagacacacct

SEQ ID NO: 8214 - DNA, 20 bp, Artificial Sequence
  Description of Artificial Sequence: Synthetic oligonucleotide
  Target: SCN10A; (-) strand; PAM type: NNGRRT; PAM sequence: TTGGAT
ttatgcaacacacaggtggt

SEQ ID NO: 8215 - DNA, 20 bp, Artificial Sequence
  Description of Artificial Sequence: Synthetic oligonucleotide
  Target: SCN10A; (-) strand; PAM type: NNGRRT; PAM sequence: TTGAAT
gcaacagagcccttatccaa

SEQ ID NO: 8216 - DNA, 20 bp, Artificial Sequence
  Description of Artificial Sequence: Synthetic oligonucleotide
  Target: SCN10A; (-) strand; PAM type: NNGRRT; PAM sequence: AGGAAT
tttaaaaacatggttgtata

SEQ ID NO: 8217 - DNA, 20 bp, Artificial Sequence
  Description of Artificial Sequence: Synthetic oligonucleotide
  Target: SCN10A; (-) strand; PAM type: NNGRRT; PAM sequence: GAGGAT
gaggatcttgctgagagggt

SEQ ID NO: 8218 - DNA, 20 bp, Artificial Sequence
  Description of Artificial Sequence: Synthetic oligonucleotide
  Target: SCN10A; (-) strand; PAM type: NNGRRT; PAM sequence: GAGGGT
agagatgaggatcttgctga

SEQ ID NO: 8219 - DNA, 20 bp, Artificial Sequence
  Description of Artificial Sequence: Synthetic oligonucleotide
  Target: SCN10A; (-) strand; PAM type: NNGRRT; PAM sequence: GAGGAT
gcactgtcagtcccagagat

SEQ ID NO: 8220 - DNA, 20 bp, Artificial Sequence
  Description of Artificial Sequence: Synthetic oligonucleotide
  Target: SCN10A; (-) strand; PAM type: NNGRRT; PAM sequence: GAGGAT
ataacacctcttaccagcct

SEQ ID NO: 8221 - DNA, 20 bp, Artificial Sequence
  Description of Artificial Sequence: Synthetic oligonucleotide
  Target: SCN10A; (-) strand; PAM type: NNGRRT; PAM sequence: CAGAGT
taacttcaccatcctgttgc

SEQ ID NO: 8222 - DNA, 20 bp, Artificial Sequence
  Description of Artificial Sequence: Synthetic oligonucleotide
  Target: SCN10A; (-) strand; PAM type: NNGRRT; PAM sequence: AAGGAT
cagaagaaacattacaaaac

SEQ ID NO: 8223 - DNA, 20 bp, Artificial Sequence
  Description of Artificial Sequence: Synthetic oligonucleotide
  Target: SCN10A; (-) strand; PAM type: NNGRRT; PAM sequence: GAGGAT
ctcagagggagaaaccagga

SEQ ID NO: 8224 - DNA, 20 bp, Artificial Sequence
  Description of Artificial Sequence: Synthetic oligonucleotide
  Target: SCN10A; (-) strand; PAM type: NNGRRT; PAM sequence: AAGAGT
tcttcctcctctcccatgcc

SEQ ID NO: 8225 - DNA, 20 bp, Artificial Sequence
  Description of Artificial Sequence: Synthetic oligonucleotide
  Target: SCN10A; (-) strand; PAM type: NNGRRT; PAM sequence: CTGAAT
gcagagtaaataaaaaggca

SEQ ID NO: 8226 - DNA, 20 bp, Artificial Sequence
  Description of Artificial Sequence: Synthetic oligonucleotide
  Target: SCN10A; (-) strand; PAM type: NNGRRT; PAM sequence: CAGAGT
gccatctcaaatatggctag

SEQ ID NO: 8227 - DNA, 20 bp, Artificial Sequence
  Description of Artificial Sequence: Synthetic oligonucleotide
  Target: SCN10A; (-) strand; PAM type: NNGRRT; PAM sequence: AGGAAT
tgtttgggagttaggaggac

SEQ ID NO: 8228 - DNA, 20 bp, Artificial Sequence
  Description of Artificial Sequence: Synthetic oligonucleotide
  Target: SCN10A; (-) strand; PAM type: NNGRRT; PAM sequence: GGGAGT
aaaatggtgaatgcatgttt

SEQ ID NO: 8229 - DNA, 20 bp, Artificial Sequence
  Description of Artificial Sequence: Synthetic oligonucleotide
  Target: SCN10A; (-) strand; PAM type: NNGRRT; PAM sequence: GTGAAT
gttctacgagccaaaaaatg

SEQ ID NO: 8230 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tccctgaaatcaaaaagttt

SEQ ID NO: 8231 - DNA, 20 bp, Artificial Sequence
  Description of Artificial Sequence: Synthetic oligonucleotide
  Target: SCN10A; (-) strand; PAM type: NNGRRT; PAM sequence: GAGAGT
tggggtcctcaataaggttt

SEQ ID NO: 8232 - DNA, 20 bp, Artificial Sequence
  Description of Artificial Sequence: Synthetic oligonucleotide
  Target: SCN10A; (-) strand; PAM type: NNGRRT; PAM sequence: TGGGGT
caacataaacaaaagttatt

SEQ ID NO: 8233 - DNA, 20 bp, Artificial Sequence
  Description of Artificial Sequence: Synthetic oligonucleotide
  Target: SCN10A; (-) strand; PAM type: NNGRRT; PAM sequence: TTGAAT
gttttaaaatttcctgagtt

SEQ ID NO: 8234 - DNA, 20 bp, Artificial Sequence
  Description of Artificial Sequence: Synthetic oligonucleotide
  Target: SCN10A; (-) strand; PAM type: NNGRRT; PAM sequence: CTGAGT
ttcccgtgttttaaaatttc

SEQ ID NO: 8235 - DNA, 20 bp, Artificial Sequence
  Description of Artificial Sequence: Synthetic oligonucleotide
  Target: SCN10A; (-) strand; PAM type: NNGRRT; PAM sequence: TGGAAT
gtcatcactctaaaagctac

SEQ ID NO: 8236 - DNA, 20 bp, Artificial Sequence
  Description of Artificial Sequence: Synthetic oligonucleotide
  Target: SCN10A; (-) strand; PAM type: NNGRRT; PAM sequence: GGGGAT
gaatatagaggctattgatg

SEQ ID NO: 8237 - DNA, 20 bp, Artificial Sequence
  Description of Artificial Sequence: Synthetic oligonucleotide
  Target: SCN10A; (-) strand; PAM type: NNGRRT; PAM sequence: GTGAAT
tctcttatgatcatacattg

SEQ ID NO: 8238 - DNA, 20 bp, Artificial Sequence
  Description of Artificial Sequence: Synthetic oligonucleotide
  Target: SCN10A; (-) strand; PAM type: NNGRRT; PAM sequence: TTGGAT
aaactattgtataacaatac

SEQ ID NO: 8239 - DNA, 20 bp, Artificial Sequence
  Description of Artificial Sequence: Synthetic oligonucleotide
  Target: SCN10A; (-) strand; PAM type: NNGRRT; PAM sequence: GTGGGT
gtgtccccaaaactgtttta

SEQ ID NO: 8240 - DNA, 20 bp, Artificial Sequence
  Description of Artificial Sequence: Synthetic oligonucleotide
  Target: SCN10A; (-) strand; PAM type: NNGRRT; PAM sequence: ATGAAT
cggtgaggacagaaagcagg

SEQ ID NO: 8241 - DNA, 20 bp, Artificial Sequence
  Description of Artificial Sequence: Synthetic oligonucleotide
  Target: SCN10A; (-) strand; PAM type: NNGRRT; PAM sequence: CAGGAT
atggcggtgaggacagaaag

SEQ ID NO: 8242 - DNA, 20 bp, Artificial Sequence
  Description of Artificial Sequence: Synthetic oligonucleotide
  Target: SCN10A; (-) strand; PAM type: NNGRRT; PAM sequence: TTGGGT
gcctggggcctccagaggag

SEQ ID NO: 8243 - DNA, 20 bp, Artificial Sequence
  Description of Artificial Sequence: Synthetic oligonucleotide
  Target: SCN10A; (-) strand; PAM type: NNGRRT; PAM sequence: AGGAGT
ctctggcctggggcctccag

SEQ ID NO: 8244 - DNA, 20 bp, Artificial Sequence
  Description of Artificial Sequence: Synthetic oligonucleotide
  Target: SCN10A; (-) strand; PAM type: NNGRRT; PAM sequence: TTGGAT
agggaaagttggctgttccc

SEQ ID NO: 8245 - DNA, 20 bp, Artificial Sequence
  Description of Artificial Sequence: Synthetic oligonucleotide
  Target: SCN10A; (-) strand; PAM type: NNGRRT; PAM sequence: TTGAAT
taacttatttgatgatctct

SEQ ID NO: 8246 - DNA, 20 bp, Artificial Sequence
  Description of Artificial Sequence: Synthetic oligonucleotide
  Target: SCN10A; (-) strand; PAM type: NNGRRT; PAM sequence: CTGGGT
ccagaaagtcctccttggcc

SEQ ID NO: 8247 - DNA, 20 bp, Artificial Sequence
  Description of Artificial Sequence: Synthetic oligonucleotide
  Target: SCN10A; (-) strand; PAM type: NNGRRT; PAM sequence: AGGAAT
accgggtaagagctactagt

SEQ ID NO: 8248 - DNA, 20 bp, Artificial Sequence
  Description of Artificial Sequence: Synthetic oligonucleotide
  Target: SCN10A; (-) strand; PAM type: NNGRRT; PAM sequence: CCGGGT
gatccgttctacagcacaca

SEQ ID NO: 8249 - DNA, 20 bp, Artificial Sequence
  Description of Artificial Sequence: Synthetic oligonucleotide
  Target: SCN10A; (-) strand; PAM type: NNGRRT; PAM sequence: GAGGAT
aactgatcggggagcccctg

SEQ ID NO: 8250 - DNA, 20 bp, Artificial Sequence
  Description of Artificial Sequence: Synthetic oligonucleotide
  Target: SCN10A; (-) strand; PAM type: NNGRRT; PAM sequence: CGGAGT
caacttccgtcgctttactc

SEQ ID NO: 8251 - DNA, 20 bp, Artificial Sequence
  Description of Artificial Sequence: Synthetic oligonucleotide
  Target: SCN10A; (-) strand; PAM type: NNGRRT; PAM sequence: TTGGAT
tgagaagatggaattcccca

SEQ ID NO: 8252 - DNA, 20 bp, Artificial Sequence
  Description of Artificial Sequence: Synthetic oligonucleotide
  Target: SCN10A; (-) strand; PAM type: NNGRRT; PAM sequence: TGGAAT
cctgaagaagaatgagaaga

SEQ ID NO: 8253 - DNA, 20 bp, Artificial Sequence
  Description of Artificial Sequence: Synthetic oligonucleotide
  Target: SCN10A; (-) strand; PAM type: NNGRRT; PAM sequence: AAGAAT
agtataaatacttcctgaag

SEQ ID NO: 8254 - DNA, 20 bp, Artificial Sequence
  Description of Artificial Sequence: Synthetic oligonucleotide
  Target: SCN10A; (-) strand; PAM type: NNGRRT; PAM sequence: AAGAGT
gtggttatgtccactcttat

SEQ ID NO: 8255 - DNA, 20 bp, Artificial Sequence
  Description of Artificial Sequence: Synthetic oligonucleotide
  Target: SCN10A; (-) strand; PAM type: NNGRRT; PAM sequence: GAGGGT
ttcagggaggggccagatat

SEQ ID NO: 8256 - DNA, 20 bp, Artificial Sequence
  Description of Artificial Sequence: Synthetic oligonucleotide
  Target: SCN10A; (-) strand; PAM type: NNGRRT; PAM sequence: GTGAGT
gttcctgggaggagccaagt

SEQ ID NO: 8257 - DNA, 20 bp, Artificial Sequence
  Description of Artificial Sequence: Synthetic oligonucleotide
  Target: SCN10A; (-) strand; PAM type: NNGRRT; PAM sequence: ATGGGT
cctgaatgccttgcagggga

SEQ ID NO: 8258 - DNA, 20 bp, Artificial Sequence
  Description of Artificial Sequence: Synthetic oligonucleotide
  Target: SCN10A; (-) strand; PAM type: NNGRRT; PAM sequence: GGGAAT
ctcccctgaatgccttgcag

SEQ ID NO: 8259 - DNA, 20 bp, Artificial Sequence
  Description of Artificial Sequence: Synthetic oligonucleotide
  Target: SCN10A; (-) strand; PAM type: NNGRRT; PAM sequence: CTGAAT
ggttgaataaacagcctccc

SEQ ID NO: 8260 - DNA, 20 bp, Artificial Sequence
  Description of Artificial Sequence: Synthetic oligonucleotide
  Target: SCN10A; (-) strand; PAM type: NNGRRT; PAM sequence: TTGAAT
ctgaggcacctggaggaggg

SEQ ID NO: 8261 - DNA, 20 bp, Artificial Sequence
  Description of Artificial Sequence: Synthetic oligonucleotide
  Target: SCN10A; (-) strand; PAM type: NNGRRT; PAM sequence: GAGGGT
taaccctgaggcacctggag

SEQ ID NO: 8262 - DNA, 20 bp, Artificial Sequence
  Description of Artificial Sequence: Synthetic oligonucleotide
  Target: SCN10A; (-) strand; PAM type: NNGRRT; PAM sequence: TAGGAT
gctaaatctggtggtggtgg

SEQ ID NO: 8263 - DNA, 20 bp, Artificial Sequence
  Description of Artificial Sequence: Synthetic oligonucleotide
  Target: SCN10A; (-) strand; PAM type: NNGRRT; PAM sequence: GAGAGT
aaagtctttgatgaatatgg

SEQ ID NO: 8264 - DNA, 20 bp, Artificial Sequence
  Description of Artificial Sequence: Synthetic oligonucleotide
  Target: SCN10A; (-) strand; PAM type: NNGRRT; PAM sequence: ATGAAT
actataaaccaaagtctttg

SEQ ID NO: 8265 - DNA, 20 bp, Artificial Sequence
  Description of Artificial Sequence: Synthetic oligonucleotide
  Target: SCN10A; (-) strand; PAM type: NNGRRT; PAM sequence: TGGAGT
aatgaaattctccaataatc

SEQ ID NO: 8266 - DNA, 20 bp, Artificial Sequence
  Description of Artificial Sequence: Synthetic oligonucleotide
  Target: SCN10A; (-) strand; PAM type: NNGRRT; PAM sequence: GGGAGT
gggatttaggataagggtga

SEQ ID NO: 8267 - DNA, 20 bp, Artificial Sequence
  Description of Artificial Sequence: Synthetic oligonucleotide
  Target: SCN10A; (-) strand; PAM type: NNGRRT; PAM sequence: AAGGGT
ttagccttgggatttaggat

SEQ ID NO: 8268 - DNA, 20 bp, Artificial Sequence
  Description of Artificial Sequence: Synthetic oligonucleotide
  Target: SCN10A; (-) strand; PAM type: NNGRRT; PAM sequence: TAGGAT
attgacttagccttgggatt

SEQ ID NO: 8269 - DNA, 20 bp, Artificial Sequence
  Description of Artificial Sequence: Synthetic oligonucleotide
  Target: SCN10A; (-) strand; PAM type: NNGRRT; PAM sequence: TGGGAT
gttctagattgacttagcct

SEQ ID NO: 8270 - DNA, 20 bp, Artificial Sequence
  Description of Artificial Sequence: Synthetic oligonucleotide
  Target: SCN10A; (-) strand; PAM type: NNGRRT; PAM sequence: AGGGAT
actagaagaaactgctgact

SEQ ID NO: 8271 - DNA, 20 bp, Artificial Sequence
  Description of Artificial Sequence: Synthetic oligonucleotide
  Target: SCN10A; (-) strand; PAM type: NNGRRT; PAM sequence: AAGAGT
aagacagggaatagtgagaa

SEQ ID NO: 8272 - DNA, 20 bp, Artificial Sequence
  Description of Artificial Sequence: Synthetic oligonucleotide
  Target: SCN10A; (-) strand; PAM type: NNGRRT; PAM sequence: GGGAAT
gcttactgcaagggaagaca

SEQ ID NO: 8273 - DNA, 20 bp, Artificial Sequence
  Description of Artificial Sequence: Synthetic oligonucleotide
  Target: SCN10A; (-) strand; PAM type: NNGRRT; PAM sequence: CAGAGT
gtttgatggtatgaagttgg

SEQ ID NO: 8274 - DNA, 20 bp, Artificial Sequence
  Description of Artificial Sequence: Synthetic oligonucleotide
  Target: SCN10A; (-) strand; PAM type: NNGRRT; PAM sequence: GTGAGT
aaagaaggctgcagacacag

SEQ ID NO: 8275 - DNA, 20 bp, Artificial Sequence
  Description of Artificial Sequence: Synthetic oligonucleotide
  Target: SCN10A; (-) strand; PAM type: NNGRRT; PAM sequence: TAGAAT
agagggaaaggaatggtcct

SEQ ID NO: 8276 - DNA, 20 bp, Artificial Sequence
  Description of Artificial Sequence: Synthetic oligonucleotide
  Target: SCN10A; (-) strand; PAM type: NNGRRT; PAM sequence: AGGAAT
aagatcctaagcagagggaa

SEQ ID NO: 8277 - DNA, 20 bp, Artificial Sequence
  Description of Artificial Sequence: Synthetic oligonucleotide
  Target: SCN10A; (-) strand; PAM type: NNGRRT; PAM sequence: CTGGAT
caggagagaggagggaagac

SEQ ID NO: 8278 - DNA, 20 bp, Artificial Sequence
  Description of Artificial Sequence: Synthetic oligonucleotide
  Target: SCN10A; (-) strand; PAM type: NNGRRT; PAM sequence: GTGAGT
ctgaaaagtgactggaaaca

SEQ ID NO: 8279 - DNA, 20 bp, Artificial Sequence
  Description of Artificial Sequence: Synthetic oligonucleotide
  Target: SCN10A; (-) strand; PAM type: NNGRRT; PAM sequence: CCGGGT
ttgcaccactgcactctagt

SEQ ID NO: 8280 - DNA, 20 bp, Artificial Sequence
  Description of Artificial Sequence: Synthetic oligonucleotide
  Target: SCN10A; (-) strand; PAM type: NNGRRT; PAM sequence: GAGAAT
tattcgggaggctgaggtgg

SEQ ID NO: 8281 - DNA, 20 bp, Artificial Sequence
  Description of Artificial Sequence: Synthetic oligonucleotide
  Target: SCN10A; (-) strand; PAM type: NNGRRT; PAM sequence: CCGAGT
aaaaattttttcaaaactag

SEQ ID NO: 8282 - DNA, 20 bp, Artificial Sequence
  Description of Artificial Sequence: Synthetic oligonucleotide
  Target: SCN10A; (-) strand; PAM type: NNGRRT; PAM sequence: GAGAGT
gagaaagttaggaaaaccaa

SEQ ID NO: 8283 - DNA, 20 bp, Artificial Sequence
  Description of Artificial Sequence: Synthetic oligonucleotide
  Target: SCN10A; (-) strand; PAM type: NNGRRT; PAM sequence: TAGAGT
attattctgaaaacaaaaga

SEQ ID NO: 8284 - DNA, 20 bp, Artificial Sequence
  Description of Artificial Sequence: Synthetic oligonucleotide
  Target: SCN10A; (-) strand; PAM type: NNGRRT; PAM sequence: TGGAAT
atccagagtctgaaatacag

SEQ ID NO: 8285 - DNA, 20 bp, Artificial Sequence
  Description of Artificial Sequence: Synthetic oligonucleotide
  Target: SCN10A; (-) strand; PAM type: NNGRRT; PAM sequence: CAGAGT
tgcatgaaaattgcttaatc

SEQ ID NO: 8286 - DNA, 20 bp, Artificial Sequence
  Description of Artificial Sequence: Synthetic oligonucleotide
  Target: SCN10A; (-) strand; PAM type: NNGRRT; PAM sequence: CTGAGT
agagattgtggcaaacatac

SEQ ID NO: 8287 - DNA, 20 bp, Artificial Sequence
  Description of Artificial Sequence: Synthetic oligonucleotide
  Target: SCN10A; (-) strand; PAM type: NNGRRT; PAM sequence: GGGAAT
taaatgagaagtgaagatat

SEQ ID NO: 8288 - DNA, 20 bp, Artificial Sequence
  Description of Artificial Sequence: Synthetic oligonucleotide
  Target: SCN10A; (-) strand; PAM type: NNGRRT; PAM sequence: ATGAGT
aaagaagtgaggagataatt

SEQ ID NO: 8289 - DNA, 20 bp, Artificial Sequence
  Description of Artificial Sequence: Synthetic oligonucleotide
  Target: SCN10A; (-) strand; PAM type: NNGRRT; PAM sequence: TGGAAT
actagatgtttgattgtatg

SEQ ID NO: 8290 - DNA, 20 bp, Artificial Sequence
  Description of Artificial Sequence: Synthetic oligonucleotide
  Target: SCN10A; (-) strand; PAM type: NNGRRT; PAM sequence: GGGAAT
taggttagaaaggactaaag

SEQ ID NO: 8291 - DNA, 20 bp, Artificial Sequence
  Description of Artificial Sequence: Synthetic oligonucleotide
  Target: SCN10A; (-) strand; PAM type: NNGRRT; PAM sequence: GAGAAT
atatcatttggccactgttg

SEQ ID NO: 8292 - DNA, 20 bp, Artificial Sequence
  Description of Artificial Sequence: Synthetic oligonucleotide
  Target: SCN10A; (-) strand; PAM type: NNGRRT; PAM sequence: TAGAAT
ttgagtgctatggagagctt

SEQ ID NO: 8293 - DNA, 20 bp, Artificial Sequence
  Description of Artificial Sequence: Synthetic oligonucleotide
  Target: SCN10A; (-) strand; PAM type: NNGRRT; PAM sequence: TTGAGT
agcgcacagtttgggttatc

SEQ ID NO: 8294 - DNA, 20 bp, Artificial Sequence
  Description of Artificial Sequence: Synthetic oligonucleotide
  Target: SCN10A; (-) strand; PAM type: NNGRRT; PAM sequence: TTGGGT
tggagaggtcagcgcacagt

SEQ ID NO: 8295 - DNA, 20 bp, Artificial Sequence
  Description of Artificial Sequence: Synthetic oligonucleotide
  Target: SCN10A; (-) strand; PAM type: NNGRRT; PAM sequence: AAGGAT
aaaaagaatgggtcaaattc

SEQ ID NO: 8296 - DNA, 20 bp, Artificial Sequence
  Description of Artificial Sequence: Synthetic oligonucleotide
  Target: SCN10A; (-) strand; PAM type: NNGRRT; PAM sequence: ATGGGT
aagccttaacataaaaaaga

SEQ ID NO: 8297 - DNA, 20 bp, Artificial Sequence
  Description of Artificial Sequence: Synthetic oligonucleotide
  Target: SCN10A; (-) strand; PAM type: NNGRRT; PAM sequence: AAGAAT
ggaaaagccttaacataaaa

SEQ ID NO: 8298 - DNA, 20 bp, Artificial Sequence
  Description of Artificial Sequence: Synthetic oligonucleotide
  Target: SCN10A; (-) strand; PAM type: NNGRRT; PAM sequence: GGGAAT
ataattttaggcaaaggaag

SEQ ID NO: 8299 - DNA, 20 bp, Artificial Sequence
  Description of Artificial Sequence: Synthetic oligonucleotide
  Target: SCN10A; (-) strand; PAM type: NNGRRT; PAM sequence: GAGGAT
ccaagagtacaagaataaga

SEQ ID NO: 8300 - DNA, 20 bp, Artificial Sequence
  Description of Artificial Sequence: Synthetic oligonucleotide
  Target: SCN10A; (-) strand; PAM type: NNGRRT; PAM sequence: AAGAAT
tgtctcaaagccaagagtac

SEQ ID NO: 8301 - DNA, 20 bp, Artificial Sequence
  Description of Artificial Sequence: Synthetic oligonucleotide
  Target: SCN10A; (-) strand; PAM type: NNGRRT; PAM sequence: AAGAGT
gaagaaattgtctcaaagcc

SEQ ID NO: 8302 - DNA, 20 bp, Artificial Sequence
  Description of Artificial Sequence: Synthetic oligonucleotide
  Target: SCN10A; (-) strand; PAM type: NNGRRT; PAM sequence: AGGAAT
gagttatgggaacatgaaac

SEQ ID NO: 8303 - DNA, 20 bp, Artificial Sequence
  Description of Artificial Sequence: Synthetic oligonucleotide
  Target: SCN10A; (-) strand; PAM type: NNGRRT; PAM sequence: GAGAGT
atgtttatagagaaagtgca

SEQ ID NO: 8304 - DNA, 20 bp, Artificial Sequence
  Description of Artificial Sequence: Synthetic oligonucleotide
  Target: SCN10A; (-) strand; PAM type: NNGRRT; PAM sequence: GTGAGT
caatgctgaacaaaatagat

SEQ ID NO: 8305 - DNA, 20 bp, Artificial Sequence
  Description of Artificial Sequence: Synthetic oligonucleotide
  Target: SCN10A; (-) strand; PAM type: NNGRRT; PAM sequence: TTGGAT
ggttccttatattcctatta

SEQ ID NO: 8306 - DNA, 20 bp, Artificial Sequence
  Description of Artificial Sequence: Synthetic oligonucleotide
  Target: SCN10A; (-) strand; PAM type: NNGRRT; PAM sequence: TGGGGT
tgccaccatctgcttgactt

SEQ ID NO: 8307 - DNA, 20 bp, Artificial Sequence
  Description of Artificial Sequence: Synthetic oligonucleotide
  Target: SCN10A; (-) strand; PAM type: NNGRRT; PAM sequence: AGGGGT
gcaagcaggatctccatcat

SEQ ID NO: 8308 - DNA, 20 bp, Artificial Sequence
  Description of Artificial Sequence: Synthetic oligonucleotide
  Target: SCN10A; (-) strand; PAM type: NNGRRT; PAM sequence: CAGGAT
ctaggtatggtgggagcaag

SEQ ID NO: 8309 - DNA, 20 bp, Artificial Sequence
  Description of Artificial Sequence: Synthetic oligonucleotide
  Target: SCN10A; (-) strand; PAM type: NNGRRT; PAM sequence: TTGGAT
gtgtctatatcacagaggta

SEQ ID NO: 8310 - DNA, 20 bp, Artificial Sequence
  Description of Artificial Sequence: Synthetic oligonucleotide
  Target: SCN10A; (-) strand; PAM type: NNGRRT; PAM sequence: TTGGGT
gagcctcctacatatgggta

SEQ ID NO: 8311 - DNA, 20 bp, Artificial Sequence
  Description of Artificial Sequence: Synthetic oligonucleotide
  Target: SCN10A; (-) strand; PAM type: NNGRRT; PAM sequence: ATGGGT
accagcagagcctcctacat

SEQ ID NO: 8312 - DNA, 20 bp, Artificial Sequence
  Description of Artificial Sequence: Synthetic oligonucleotide
  Target: SCN10A; (-) strand; PAM type: NNGRRT; PAM sequence: GTGAGT
agaggaatggtgtcagagca

SEQ ID NO: 8313 - DNA, 20 bp, Artificial Sequence
  Description of Artificial Sequence: Synthetic oligonucleotide
  Target: SCN10A; (-) strand; PAM type: NNGRRT; PAM sequence: AGGAAT
aatggaggacattaaggaag

SEQ ID NO: 8314 - DNA, 20 bp, Artificial Sequence
  Description of Artificial Sequence: Synthetic oligonucleotide
  Target: SCN10A; (-) strand; PAM type: NNGRRT; PAM sequence: GAGGGT
aataggcaggaggagaggaa

SEQ ID NO: 8315 - DNA, 20 bp, Artificial Sequence
  Description of Artificial Sequence: Synthetic oligonucleotide
  Target: SCN10A; (-) strand; PAM type: NNGRRT; PAM sequence: CAGAAT
cataaatacaccatgttaat

SEQ ID NO: 8316 - DNA, 20 bp, Artificial Sequence
  Description of Artificial Sequence: Synthetic oligonucleotide
  Target: SCN10A; (-) strand; PAM type: NNGRRT; PAM sequence: TTGAAT
gacactgaagtcaacagtgt

SEQ ID NO: 8317 - DNA, 20 bp, Artificial Sequence
  Description of Artificial Sequence: Synthetic oligonucleotide
  Target: SCN10A; (-) strand; PAM type: NNGRRT; PAM sequence: AAGAAT
atctttgtttctcagaaggg

SEQ ID NO: 8318 - DNA, 20 bp, Artificial Sequence
  Description of Artificial Sequence: Synthetic oligonucleotide
  Target: SCN10A; (-) strand; PAM type: NNGRRT; PAM sequence: TGGGAT
gttactaaacaactgagtcc

SEQ ID NO: 8319 - DNA, 20 bp, Artificial Sequence
  Description of Artificial Sequence: Synthetic oligonucleotide
  Target: SCN10A; (-) strand; PAM type: NNGRRT; PAM sequence: CTGAGT
cttgcattgttactaaacaa

SEQ ID NO: 8320 - DNA, 20 bp, Artificial Sequence
  Description of Artificial Sequence: Synthetic oligonucleotide
  Target: SCN10A; (-) strand; PAM type: NNGRRT; PAM sequence: GAGAAT
ttgcattccagtgtcactga

SEQ ID NO: 8321 - DNA, 20 bp, Artificial Sequence
  Description of Artificial Sequence: Synthetic oligonucleotide
  Target: SCN10A; (-) strand; PAM type: NNGRRT; PAM sequence: TGGAAT
caagctccagctccaggacc

SEQ ID NO: 8322 - DNA, 20 bp, Artificial Sequence
  Description of Artificial Sequence: Synthetic oligonucleotide
  Target: SCN10A; (-) strand; PAM type: NNGRRT; PAM sequence: CTGAGT
gcatgaagtcagtctcatag

SEQ ID NO: 8323 - DNA, 20 bp, Artificial Sequence
  Description of Artificial Sequence: Synthetic oligonucleotide
  Target: SCN10A; (-) strand; PAM type: NNGRRT; PAM sequence: CAGAAT
tggagggatttatggtagcc

SEQ ID NO: 8324 - DNA, 20 bp, Artificial Sequence
  Description of Artificial Sequence: Synthetic oligonucleotide
  Target: SCN10A; (-) strand; PAM type: NNGRRT; PAM sequence: AGGGAT
acaattttgtccttagctgg

SEQ ID NO: 8325 - DNA, 20 bp, Artificial Sequence
  Description of Artificial Sequence: Synthetic oligonucleotide
  Target: SCN10A; (-) strand; PAM type: NNGRRT; PAM sequence: AGGGAT
atagagaaccacttcaatca

SEQ ID NO: 8326 - DNA, 20 bp, Artificial Sequence
  Description of Artificial Sequence: Synthetic oligonucleotide
  Target: SCN10A; (-) strand; PAM type: NNGRRT; PAM sequence: GGGAAT
aaagacactgggtaatagat

SEQ ID NO: 8327 - DNA, 20 bp, Artificial Sequence
  Description of Artificial Sequence: Synthetic oligonucleotide
  Target: SCN10A; (-) strand; PAM type: NNGRRT; PAM sequence: CTGGGT
cagaatgtcatgtaaagaca

SEQ ID NO: 8328 - DNA, 20 bp, Artificial Sequence
  Description of Artificial Sequence: Synthetic oligonucleotide
  Target: SCN10A; (-) strand; PAM type: NNGRRT; PAM sequence: CAGAAT
ttgcaccccaatagttttct

SEQ ID NO: 8329 - DNA, 20 bp, Artificial Sequence
  Description of Artificial Sequence: Synthetic oligonucleotide
  Target: SCN10A; (-) strand; PAM type: NNGRRT; PAM sequence: AAGAGT
tctgagcccagtttgcccat

SEQ ID NO: 8330 - DNA, 20 bp, Artificial Sequence
  Description of Artificial Sequence: Synthetic oligonucleotide
  Target: SCN10A; (-) strand; PAM type: NNGRRT; PAM sequence: TAGAGT
ggccactgaagtaagttctg

SEQ ID NO: 8331 - DNA, 20 bp, Artificial Sequence
  Description of Artificial Sequence: Synthetic oligonucleotide
  Target: SCN10A; (-) strand; PAM type: NNGRRT; PAM sequence: AGGGAT
ctgcaccttgctcatttccc

SEQ ID NO: 8332 - DNA, 20 bp, Artificial Sequence
  Description of Artificial Sequence: Synthetic oligonucleotide
  Target: SCN10A; (-) strand; PAM type: NNGRRT; PAM sequence: AGGGAT
attcaactagactctaaaat

SEQ ID NO: 8333 - DNA, 20 bp, Artificial Sequence
  Description of Artificial Sequence: Synthetic oligonucleotide
  Target: SCN10A; (-) strand; PAM type: NNGRRT; PAM sequence: AAGGAT
tttgatatggctacctcaca

SEQ ID NO: 8334 - DNA, 20 bp, Artificial Sequence
  Description of Artificial Sequence: Synthetic oligonucleotide
  Target: SCN10A; (-) strand; PAM type: NNGRRT; PAM sequence: GTGAGT
ctcagccattaatccaagaa

SEQ ID NO: 8335 - DNA, 20 bp, Artificial Sequence
  Description of Artificial Sequence: Synthetic oligonucleotide
  Target: SCN10A; (-) strand; PAM type: NNGRRT; PAM sequence: TTGGAT
taaactagaatagatatttc

SEQ ID NO: 8336 - DNA, 20 bp, Artificial Sequence
  Description of Artificial Sequence: Synthetic oligonucleotide
  Target: SCN10A; (-) strand; PAM type: NNGRRT; PAM sequence: TAGAAT
ggccgagcttggagctaaac

SEQ ID NO: 8337 - DNA, 20 bp, Artificial Sequence
  Description of Artificial Sequence: Synthetic oligonucleotide
  Target: SCN10A; (-) strand; PAM type: NNGRRT; PAM sequence: GGGAAT
ggaacagctattaaacttaa

SEQ ID NO: 8338 - DNA, 20 bp, Artificial Sequence
  Description of Artificial Sequence: Synthetic oligonucleotide
  Target: SCN10A; (-) strand; PAM type: NNGRRT; PAM sequence: CCGAAT
ttgggagggctgaatgccca

SEQ ID NO: 8339 - DNA, 20 bp, Artificial Sequence
  Description of Artificial Sequence: Synthetic oligonucleotide
  Target: SCN10A; (-) strand; PAM type: NNGRRT; PAM sequence: CTGAAT
gttggttcatcttgggaggg

SEQ ID NO: 8340 - DNA, 20 bp, Artificial Sequence
  Description of Artificial Sequence: Synthetic oligonucleotide
  Target: SCN10A; (-) strand; PAM type: NNGRRT; PAM sequence: CAGAGT
ctgcactccagcctggacaa

SEQ ID NO: 8341 - DNA, 20 bp, Artificial Sequence
  Description of Artificial Sequence: Synthetic oligonucleotide
  Target: SCN10A; (-) strand; PAM type: NNGRRT; PAM sequence: GAGGAT
tacttgggaggctgaggtgg

SEQ ID NO: 8342 - DNA, 20 bp, Artificial Sequence
  Description of Artificial Sequence: Synthetic oligonucleotide
  Target: SCN10A; (+) strand; PAM type: NNGRRT; PAM sequence: CAGAAT
tttgtgtggctttctgtaaa

SEQ ID NO: 8343 - DNA, 20 bp, Artificial Sequence
  Description of Artificial Sequence: Synthetic oligonucleotide
  Target: SCN10A; (+) strand; PAM type: NNGRRT; PAM sequence: TTGAAT
tttctgtaaacagaatttat

SEQ ID NO: 8344 - DNA, 20 bp, Artificial Sequence
  Description of Artificial Sequence: Synthetic oligonucleotide
  Target: SCN10A; (+) strand; PAM type: NNGRRT; PAM sequence: CAGAGT
ttgactgacactctttttcc

SEQ ID NO: 8345 - DNA, 20 bp, Artificial Sequence
  Description of Artificial Sequence: Synthetic oligonucleotide
  Target: SCN10A; (+) strand; PAM type: NNGRRT; PAM sequence: ATGAAT
atttaaatttaatgtaattt

SEQ ID NO: 8346 - DNA, 20 bp, Artificial Sequence
  Description of Artificial Sequence: Synthetic oligonucleotide
  Target: SCN10A; (+) strand; PAM type: NNGRRT; PAM sequence: TTGAAT
atttatgaatatttttgttt

SEQ ID NO: 8347 - DNA, 20 bp, Artificial Sequence
  Description of Artificial Sequence: Synthetic oligonucleotide
  Target: SCN10A; (+) strand; PAM type: NNGRRT; PAM sequence: CCGGGT
attctgtatgtctctatatc

SEQ ID NO: 8348 - DNA, 20 bp, Artificial Sequence
  Description of Artificial Sequence: Synthetic oligonucleotide
  Target: SCN10A; (+) strand; PAM type: NNGRRT; PAM sequence: TAGGAT
tattattatactttaagttt

SEQ ID NO: 8349 - DNA, 20 bp, Artificial Sequence
  Description of Artificial Sequence: Synthetic oligonucleotide
  Target: SCN10A; (+) strand; PAM type: NNGRRT; PAM sequence: ATGAGT
ttattgttcaattcccacct

SEQ ID NO: 8350 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tgtccttgcgatagtttgct

SEQ ID NO: 8351 - DNA, 20 bp, Artificial Sequence
  Description of Artificial Sequence: Synthetic oligonucleotide
  Target: SCN10A; (+) strand; PAM type: NNGRRT; PAM sequence: TTGGGT
agtctatcactgttggacat

SEQ ID NO: 8352 - DNA, 20 bp, Artificial Sequence
  Description of Artificial Sequence: Synthetic oligonucleotide
  Target: SCN10A; (+) strand; PAM type: NNGRRT; PAM sequence: GTGAAT
ggttccaagtctttgctatt

SEQ ID NO: 8353 - DNA, 20 bp, Artificial Sequence
  Description of Artificial Sequence: Synthetic oligonucleotide
  Target: SCN10A; (+) strand; PAM type: NNGRRT; PAM sequence: TTGGGT
gcagtatgatttataatcct

SEQ ID NO: 8354 - DNA, 20 bp, Artificial Sequence
  Description of Artificial Sequence: Synthetic oligonucleotide
  Target: SCN10A; (+) strand; PAM type: NNGRRT; PAM sequence: TGGGAT
tttgggtatatacccagtaa

SEQ ID NO: 8355 - DNA, 20 bp, Artificial Sequence
  Description of Artificial Sequence: Synthetic oligonucleotide
  Target: SCN10A; (+) strand; PAM type: NNGRRT; PAM sequence: CTGGGT
tatacccagtaatgggatgg

SEQ ID NO: 8356 - DNA, 20 bp, Artificial Sequence
  Description of Artificial Sequence: Synthetic oligonucleotide
  Target: SCN10A; (+) strand; PAM type: NNGRRT; PAM sequence: AGGAAT
tttctggttctagatccctg

SEQ ID NO: 8357 - DNA, 20 bp, Artificial Sequence
  Description of Artificial Sequence: Synthetic oligonucleotide
  Target: SCN10A; (+) strand; PAM type: NNGRRT; PAM sequence: TGGGAT
atccttcgcccactttttga

SEQ ID NO: 8358 - DNA, 20 bp, Artificial Sequence
  Description of Artificial Sequence: Synthetic oligonucleotide
  Target: SCN10A; (+) strand; PAM type: NNGRRT; PAM sequence: TTGAGT
ttttttccttgtaaatttgt

SEQ ID NO: 8359 - DNA, 20 bp, Artificial Sequence
  Description of Artificial Sequence: Synthetic oligonucleotide
  Target: SCN10A; (+) strand; PAM type: NNGRRT; PAM sequence: CTGGAT
gtttgagttcattgtagatt

SEQ ID NO: 8360 - DNA, 20 bp, Artificial Sequence
  Description of Artificial Sequence: Synthetic oligonucleotide
  Target: SCN10A; (+) strand; PAM type: NNGRRT; PAM sequence: ATGAGT
ggatattagcccttcgtcag

SEQ ID NO: 8361 - DNA, 20 bp, Artificial Sequence
  Description of Artificial Sequence: Synthetic oligonucleotide
  Target: SCN10A; (+) strand; PAM type: NNGRRT; PAM sequence: CTGAAT
tccttgcccatgcctatgtc

SEQ ID NO: 8362 - DNA, 20 bp, Artificial Sequence
  Description of Artificial Sequence: Synthetic oligonucleotide
  Target: SCN10A; (+) strand; PAM type: NNGRRT; PAM sequence: TAGGGT
gtattgcctaggttctcttc

SEQ ID NO: 8363 - DNA, 20 bp, Artificial Sequence
  Description of Artificial Sequence: Synthetic oligonucleotide
  Target: SCN10A; (+) strand; PAM type: NNGRRT; PAM sequence: TTGAAT
atttaagtctttaatccatc

SEQ ID NO: 8364 - DNA, 20 bp, Artificial Sequence
  Description of Artificial Sequence: Synthetic oligonucleotide
  Target: SCN10A; (+) strand; PAM type: NNGRRT; PAM sequence: AGGGAT
ttttgtataaggtgtaagga

SEQ ID NO: 8365 - DNA, 20 bp, Artificial Sequence
  Description of Artificial Sequence: Synthetic oligonucleotide
  Target: SCN10A; (+) strand; PAM type: NNGRRT; PAM sequence: GGGAAT
ccagcaccatttattaaata

SEQ ID NO: 8366 - DNA, 20 bp, Artificial Sequence
  Description of Artificial Sequence: Synthetic oligonucleotide
  Target: SCN10A; (+) strand; PAM type: NNGRRT; PAM sequence: ATGAGT
gacaaacagagagccaaatc

SEQ ID NO: 8367 - DNA, 20 bp, Artificial Sequence
  Description of Artificial Sequence: Synthetic oligonucleotide
  Target: SCN10A; (+) strand; PAM type: NNGRRT; PAM sequence: GAGAAT
ccattcacaattgcttcaaa

SEQ ID NO: 8368 - DNA, 20 bp, Artificial Sequence
  Description of Artificial Sequence: Synthetic oligonucleotide
  Target: SCN10A; (+) strand; PAM type: NNGRRT; PAM sequence: AGGAAT
tcaaagagaataaaatacct

SEQ ID NO: 8369 - DNA, 20 bp, Artificial Sequence
  Description of Artificial Sequence: Synthetic oligonucleotide
  Target: SCN10A; (+) strand; PAM type: NNGRRT; PAM sequence: AGGGAT
acctaggaatgcaacttaca

SEQ ID NO: 8370 - DNA, 20 bp, Artificial Sequence
  Description of Artificial Sequence: Synthetic oligonucleotide
  Target: SCN10A; (+) strand; PAM type: NNGRRT; PAM sequence: GAGGAT
cactgctcagtgaaataaaa

SEQ ID NO: 8371 - DNA, 20 bp, Artificial Sequence
  Description of Artificial Sequence: Synthetic oligonucleotide
  Target: SCN10A; (+) strand; PAM type: NNGRRT; PAM sequence: AAGAAT
aagaggatacaaacaaatgg

SEQ ID NO: 8372 - DNA, 20 bp, Artificial Sequence
  Description of Artificial Sequence: Synthetic oligonucleotide
  Target: SCN10A; (+) strand; PAM type: NNGRRT; PAM sequence: ATGGGT
tggaagaatactccatgctc

SEQ ID NO: 8373 - DNA, 20 bp, Artificial Sequence
  Description of Artificial Sequence: Synthetic oligonucleotide
  Target: SCN10A; (+) strand; PAM type: NNGRRT; PAM sequence: AAGAAT
actccatgctcatgggtagg

SEQ ID NO: 8374 - DNA, 20 bp, Artificial Sequence
  Description of Artificial Sequence: Synthetic oligonucleotide
  Target: SCN10A; (+) strand; PAM type: NNGRRT; PAM sequence: CAGAAT
gctaccaatgactttcttct

SEQ ID NO: 8375 - DNA, 20 bp, Artificial Sequence
  Description of Artificial Sequence: Synthetic oligonucleotide
  Target: SCN10A; (+) strand; PAM type: NNGRRT; PAM sequence: ACGGGT
agaaatacctaatgtagatg

SEQ ID NO: 8376 - DNA, 20 bp, Artificial Sequence
  Description of Artificial Sequence: Synthetic oligonucleotide
  Target: SCN10A; (+) strand; PAM type: NNGRRT; PAM sequence: ATGGGT
ctaatgtagatgacgggttg

SEQ ID NO: 8377 - DNA, 20 bp, Artificial Sequence
  Description of Artificial Sequence: Synthetic oligonucleotide
  Target: SCN10A; (+) strand; PAM type: NNGRRT; PAM sequence: TAGAAT
tacattgtgcacatgtaccc

SEQ ID NO: 8378 - DNA, 20 bp, Artificial Sequence
  Description of Artificial Sequence: Synthetic oligonucleotide
  Target: SCN10A; (+) strand; PAM type: NNGRRT; PAM sequence: AGGAAT
attttaaaaaaagaaaaaaa

SEQ ID NO: 8379 - DNA, 20 bp, Artificial Sequence
  Description of Artificial Sequence: Synthetic oligonucleotide
  Target: SCN10A; (+) strand; PAM type: NNGRRT; PAM sequence: GTGGAT
tacctactattctgtgttaa

SEQ ID NO: 8380 - DNA, 20 bp, Artificial Sequence
  Description of Artificial Sequence: Synthetic oligonucleotide
  Target: SCN10A; (+) strand; PAM type: NNGRRT; PAM sequence: CTGAAT
ttctgtgttaagtggatgtt

SEQ ID NO: 8381 - DNA, 20 bp, Artificial Sequence
  Description of Artificial Sequence: Synthetic oligonucleotide
  Target: SCN10A; (+) strand; PAM type: NNGRRT; PAM sequence: GTGGGT
agattctagttttacctctt

SEQ ID NO: 8382 - DNA, 20 bp, Artificial Sequence
  Description of Artificial Sequence: Synthetic oligonucleotide
  Target: SCN10A; (+) strand; PAM type: NNGRRT; PAM sequence: TGGGGT
ctagttttacctcttgtggg

SEQ ID NO: 8383 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ttcaaaagataatcttgcat

SEQ ID NO: 8384 - DNA, 20 bp, Artificial Sequence
  Description of Artificial Sequence: Synthetic oligonucleotide
  Target: SCN10A; (+) strand; PAM type: NNGRRT; PAM sequence: ATGGAT
ttgtgcagaaaaaatgagaa

SEQ ID NO: 8385 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gagaaatggattagtttccc

SEQ ID NO: 8386 - DNA, 20 bp, Artificial Sequence
  Description of Artificial Sequence: Synthetic oligonucleotide
  Target: SCN10A; (+) strand; PAM type: NNGRRT; PAM sequence: TTGGAT
tattttagcaacaccagtca

SEQ ID NO: 8387 - DNA, 20 bp, Artificial Sequence
  Description of Artificial Sequence: Synthetic oligonucleotide
  Target: SCN10A; (+) strand; PAM type: NNGRRT; PAM sequence: CTGAAT
ggattagggctcaccttcat

SEQ ID NO: 8388 - DNA, 20 bp, Artificial Sequence
  Description of Artificial Sequence: Synthetic oligonucleotide
  Target: SCN10A; (+) strand; PAM type: NNGRRT; PAM sequence: TTGAAT
aagcataattcaacataaag

SEQ ID NO: 8389 - DNA, 20 bp, Artificial Sequence
  Description of Artificial Sequence: Synthetic oligonucleotide
  Target: SCN10A; (+) strand; PAM type: NNGRRT; PAM sequence: GAGAAT
ctcaaagtaaaaatactttt

SEQ ID NO: 8390 - DNA, 20 bp, Artificial Sequence
  Description of Artificial Sequence: Synthetic oligonucleotide
  Target: SCN10A; (+) strand; PAM type: NNGRRT; PAM sequence: TGGGAT
tggctttttcatcatccaca

SEQ ID NO: 8391 - DNA, 20 bp, Artificial Sequence
  Description of Artificial Sequence: Synthetic oligonucleotide
  Target: SCN10A; (+) strand; PAM type: NNGRRT; PAM sequence: CCGGGT
cacagtcagtatctgtgctc

SEQ ID NO: 8392 - DNA, 20 bp, Artificial Sequence
  Description of Artificial Sequence: Synthetic oligonucleotide
  Target: SCN10A; (+) strand; PAM type: NNGRRT; PAM sequence: AAGAGT
gttcagtggtacgagagagg

SEQ ID NO: 8393 - DNA, 20 bp, Artificial Sequence
  Description of Artificial Sequence: Synthetic oligonucleotide
  Target: SCN10A; (+) strand; PAM type: NNGRRT; PAM sequence: TAGAAT
atttggttgaactcatcttt

SEQ ID NO: 8394 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tagaataaatcaggcattca

SEQ ID NO: 8395 - DNA, 20 bp, Artificial Sequence
  Description of Artificial Sequence: Synthetic oligonucleotide
  Target: SCN10A; (+) strand; PAM type: NNGRRT; PAM sequence: GTGGAT
catcttattaacctgcatct

SEQ ID NO: 8396 - DNA, 20 bp, Artificial Sequence
  Description of Artificial Sequence: Synthetic oligonucleotide
  Target: SCN10A; (+) strand; PAM type: NNGRRT; PAM sequence: ATGAAT
aatgatcaaatatatagaca

SEQ ID NO: 8397 - DNA, 20 bp, Artificial Sequence
  Description of Artificial Sequence: Synthetic oligonucleotide
  Target: SCN10A; (+) strand; PAM type: NNGRRT; PAM sequence: TTGAAT
acaatgaattggctatatat

SEQ ID NO: 8398 - DNA, 20 bp, Artificial Sequence
  Description of Artificial Sequence: Synthetic oligonucleotide
  Target: SCN10A; (+) strand; PAM type: NNGRRT; PAM sequence: GGGAAT
gaatctttgtgattgtggct

SEQ ID NO: 8399 - DNA, 20 bp, Artificial Sequence
  Description of Artificial Sequence: Synthetic oligonucleotide
  Target: SCN10A; (+) strand; PAM type: NNGRRT; PAM sequence: AAGAGT
attgtggctgggaatgggcc

SEQ ID NO: 8400 - DNA, 20 bp, Artificial Sequence
  Description of Artificial Sequence: Synthetic oligonucleotide
  Target: SCN10A; (+) strand; PAM type: NNGRRT; PAM sequence: GGGAGT
ctatgtcctatgttgttata

SEQ ID NO: 8401 - DNA, 20 bp, Artificial Sequence
  Description of Artificial Sequence: Synthetic oligonucleotide
  Target: SCN10A; (+) strand; PAM type: NNGRRT; PAM sequence: CAGGAT
tacgtaattaataacatttg

SEQ ID NO: 8402 - DNA, 20 bp, Artificial Sequence
  Description of Artificial Sequence: Synthetic oligonucleotide
  Target: SCN10A; (+) strand; PAM type: NNGRRT; PAM sequence: ATGAAT
taattaataacatttgcagg

SEQ ID NO: 8403 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ctggccataccttttatcta

SEQ ID NO: 8404 - DNA, 20 bp, Artificial Sequence
  Description of Artificial Sequence: Synthetic oligonucleotide
  Target: SCN10A; (+) strand; PAM type: NNGRRT; PAM sequence: TGGAGT
tcttctgattatattaacta

SEQ ID NO: 8405 - DNA, 20 bp, Artificial Sequence
  Description of Artificial Sequence: Synthetic oligonucleotide
  Target: SCN10A; (+) strand; PAM type: NNGRRT; PAM sequence: TGGAAT
tatgagatgtgaacagactc

SEQ ID NO: 8406 - DNA, 20 bp, Artificial Sequence
  Description of Artificial Sequence: Synthetic oligonucleotide
  Target: SCN10A; (+) strand; PAM type: NNGRRT; PAM sequence: AAGAGT
cagccatttcagcctcagaa

SEQ ID NO: 8407 - DNA, 20 bp, Artificial Sequence
  Description of Artificial Sequence: Synthetic oligonucleotide
  Target: SCN10A; (+) strand; PAM type: NNGRRT; PAM sequence: TGGAGT
tataaatggggcaggcacca

SEQ ID NO: 8408 - DNA, 20 bp, Artificial Sequence
  Description of Artificial Sequence: Synthetic oligonucleotide
  Target: SCN10A; (+) strand; PAM type: NNGRRT; PAM sequence: TAGGAT
cagacaattggtggaaaagt

SEQ ID NO: 8409 - DNA, 20 bp, Artificial Sequence
  Description of Artificial Sequence: Synthetic oligonucleotide
  Target: SCN10A; (+) strand; PAM type: NNGRRT; PAM sequence: CAGGAT
aatctcaaactgaaaaatat

SEQ ID NO: 8410 - DNA, 20 bp, Artificial Sequence
  Description of Artificial Sequence: Synthetic oligonucleotide
  Target: SCN10A; (+) strand; PAM type: NNGRRT; PAM sequence: AGGGGT
tatcaggatcccagaaagtg

SEQ ID NO: 8411 - DNA, 20 bp, Artificial Sequence
  Description of Artificial Sequence: Synthetic oligonucleotide
  Target: SCN10A; (+) strand; PAM type: NNGRRT; PAM sequence: ATGGAT
atttaaaaatattaatttta

SEQ ID NO: 8412 - DNA, 20 bp, Artificial Sequence
  Description of Artificial Sequence: Synthetic oligonucleotide
  Target: SCN10A; (+) strand; PAM type: NNGRRT; PAM sequence: CTGGGT
cataggccacaggtgttacc

SEQ ID NO: 8413 - DNA, 20 bp, Artificial Sequence
  Description of Artificial Sequence: Synthetic oligonucleotide
  Target: SCN10A; (+) strand; PAM type: NNGRRT; PAM sequence: AGGGAT
acaacaaaaataaaaggaca

SEQ ID NO: 8414 - DNA, 20 bp, Artificial Sequence
  Description of Artificial Sequence: Synthetic oligonucleotide
  Target: SCN10A; (+) strand; PAM type: NNGRRT; PAM sequence: GAGAGT
aggacaagggatattttctg

SEQ ID NO: 8415 - DNA, 20 bp, Artificial Sequence
  Description of Artificial Sequence: Synthetic oligonucleotide
  Target: SCN10A; (+) strand; PAM type: NNGRRT; PAM sequence: CTGGGT
atgcattggtgaggctgtag

SEQ ID NO: 8416 - DNA, 20 bp, Artificial Sequence
  Description of Artificial Sequence: Synthetic oligonucleotide
  Target: SCN10A; (+) strand; PAM type: NNGRRT; PAM sequence: AAGAGT
gggtgtgatctgcaatggga

SEQ ID NO: 8417 - DNA, 20 bp, Artificial Sequence
  Description of Artificial Sequence: Synthetic oligonucleotide
  Target: SCN10A; (+) strand; PAM type: NNGRRT; PAM sequence: TGGAGT
ataactgaacatatccaggc

SEQ ID NO: 8418 - DNA, 20 bp, Artificial Sequence
  Description of Artificial Sequence: Synthetic oligonucleotide
  Target: SCN10A; (+) strand; PAM type: NNGRRT; PAM sequence: GGGAAT
tgacactctcataggacggt

SEQ ID NO: 8419 - DNA, 20 bp, Artificial Sequence
  Description of Artificial Sequence: Synthetic oligonucleotide
  Target: SCN10A; (+) strand; PAM type: NNGRRT; PAM sequence: GGGAGT
aagcagtttcagatttgtct

SEQ ID NO: 8420 - DNA, 20 bp, Artificial Sequence
  Description of Artificial Sequence: Synthetic oligonucleotide
  Target: SCN10A; (+) strand; PAM type: NNGRRT; PAM sequence: GTGAAT
gtacacaattttcatttgct

SEQ ID NO: 8421 - DNA, 20 bp, Artificial Sequence
  Description of Artificial Sequence: Synthetic oligonucleotide
  Target: SCN10A; (+) strand; PAM type: NNGRRT; PAM sequence: GGGAGT
atgcaacaaaaccttcatct

SEQ ID NO: 8422 - DNA, 20 bp, Artificial Sequence
  Description of Artificial Sequence: Synthetic oligonucleotide
  Target: SCN10A; (+) strand; PAM type: NNGRRT; PAM sequence: TGGGGT
tcctcagctctgggcacaca

SEQ ID NO: 8423 - DNA, 20 bp, Artificial Sequence
  Description of Artificial Sequence: Synthetic oligonucleotide
  Target: SCN10A; (+) strand; PAM type: NNGRRT; PAM sequence: GAGAGT
tgggcacacatggggtgtta

SEQ ID NO: 8424 - DNA, 20 bp, Artificial Sequence
  Description of Artificial Sequence: Synthetic oligonucleotide
  Target: SCN10A; (+) strand; PAM type: NNGRRT; PAM sequence: TTGAAT
acatagctccgataggcctt

SEQ ID NO: 8425 - DNA, 20 bp, Artificial Sequence
  Description of Artificial Sequence: Synthetic oligonucleotide
  Target: SCN10A; (+) strand; PAM type: NNGRRT; PAM sequence: GAGAGT
atgtcttcttgcttccatcg

SEQ ID NO: 8426 - DNA, 20 bp, Artificial Sequence
  Description of Artificial Sequence: Synthetic oligonucleotide
  Target: SCN10A; (+) strand; PAM type: NNGRRT; PAM sequence: TAGGAT
gagtggttgctattggttca

SEQ ID NO: 8427 - DNA, 20 bp, Artificial Sequence
  Description of Artificial Sequence: Synthetic oligonucleotide
  Target: SCN10A; (+) strand; PAM type: NNGRRT; PAM sequence: GAGAAT
ctcctccatatttgccttca

SEQ ID NO: 8428 - DNA, 20 bp, Artificial Sequence
  Description of Artificial Sequence: Synthetic oligonucleotide
  Target: SCN10A; (+) strand; PAM type: NNGRRT; PAM sequence: CCGGAT
ccttcagagaatccaactcc

SEQ ID NO: 8429 - DNA, 20 bp, Artificial Sequence
  Description of Artificial Sequence: Synthetic oligonucleotide
  Target: SCN10A; (+) strand; PAM type: NNGRRT; PAM sequence: AAGGAT
acattcttggtgaaagcaaa

SEQ ID NO: 8430 - DNA, 20 bp, Artificial Sequence
  Description of Artificial Sequence: Synthetic oligonucleotide
  Target: SCN10A; (+) strand; PAM type: NNGRRT; PAM sequence: GTGGAT
gcaaaaaggatgtccaagca

SEQ ID NO: 8431 - DNA, 20 bp, Artificial Sequence
  Description of Artificial Sequence: Synthetic oligonucleotide
  Target: SCN10A; (+) strand; PAM type: NNGRRT; PAM sequence: CTGGAT
gggaccaaaggcaggtccat

SEQ ID NO: 8432 - DNA, 20 bp, Artificial Sequence
  Description of Artificial Sequence: Synthetic oligonucleotide
  Target: SCN10A; (+) strand; PAM type: NNGRRT; PAM sequence: TTGGGT
tctggatcagtatatttcga

SEQ ID NO: 8433 - DNA, 20 bp, Artificial Sequence
  Description of Artificial Sequence: Synthetic oligonucleotide
  Target: SCN10A; (+) strand; PAM type: NNGRRT; PAM sequence: TGGGAT
agtatatttcgattgggttt

SEQ ID NO: 8434 - DNA, 20 bp, Artificial Sequence
  Description of Artificial Sequence: Synthetic oligonucleotide
  Target: SCN10A; (+) strand; PAM type: NNGRRT; PAM sequence: GAGAGT
gggattctcaggggaccaga

SEQ ID NO: 8435 - DNA, 20 bp, Artificial Sequence
  Description of Artificial Sequence: Synthetic oligonucleotide
  Target: SCN10A; (+) strand; PAM type: NNGRRT; PAM sequence: CTGAGT
agagcagaaaaggtaataaa

SEQ ID NO: 8436 - DNA, 20 bp, Artificial Sequence
  Description of Artificial Sequence: Synthetic oligonucleotide
  Target: SCN10A; (+) strand; PAM type: NNGRRT; PAM sequence: CTGGGT
ggtaataaactgagtggcct

SEQ ID NO: 8437 - DNA, 20 bp, Artificial Sequence
  Description of Artificial Sequence: Synthetic oligonucleotide
  Target: SCN10A; (+) strand; PAM type: NNGRRT; PAM sequence: CAGAAT
gtggccacattgaagttctc

SEQ ID NO: 8438 - DNA, 20 bp, Artificial Sequence
  Description of Artificial Sequence: Synthetic oligonucleotide
  Target: SCN10A; (+) strand; PAM type: NNGRRT; PAM sequence: TGGGGT
gccattgctgttgggcagat

SEQ ID NO: 8439 - DNA, 20 bp, Artificial Sequence
  Description of Artificial Sequence: Synthetic oligonucleotide
  Target: SCN10A; (+) strand; PAM type: NNGRRT; PAM sequence: GAGGAT
cagtaggggggccctgtgtt

SEQ ID NO: 8440 - DNA, 20 bp, Artificial Sequence
  Description of Artificial Sequence: Synthetic oligonucleotide
  Target: SCN10A; (+) strand; PAM type: NNGRRT; PAM sequence: TAGAGT
aaagctggacataccgaaga

SEQ ID NO: 8441 - DNA, 20 bp, Artificial Sequence
  Description of Artificial Sequence: Synthetic oligonucleotide
  Target: SCN10A; (+) strand; PAM type: NNGRRT; PAM sequence: AGGAAT
tagagtagatgaacatgaca

SEQ ID NO: 8442 - DNA, 20 bp, Artificial Sequence
  Description of Artificial Sequence: Synthetic oligonucleotide
  Target: SCN10A; (+) strand; PAM type: NNGRRT; PAM sequence: GCGGAT
atgagggcaaagagcagtgt

SEQ ID NO: 8443 - DNA, 20 bp, Artificial Sequence
  Description of Artificial Sequence: Synthetic oligonucleotide
  Target: SCN10A; (+) strand; PAM type: NNGRRT; PAM sequence: TCGGAT
gtgcggatccccttggccgc

SEQ ID NO: 8444 - DNA, 20 bp, Artificial Sequence
  Description of Artificial Sequence: Synthetic oligonucleotide
  Target: SCN10A; (+) strand; PAM type: NNGRRT; PAM sequence: GAGGAT
ttggccgctcggatcagtct

SEQ ID NO: 8445 - DNA, 20 bp, Artificial Sequence
  Description of Artificial Sequence: Synthetic oligonucleotide
  Target: SCN10A; (+) strand; PAM type: NNGRRT; PAM sequence: GCGGAT
atgcggccaattcgggccag

SEQ ID NO: 8446 - DNA, 20 bp, Artificial Sequence
  Description of Artificial Sequence: Synthetic oligonucleotide
  Target: SCN10A; (+) strand; PAM type: NNGRRT; PAM sequence: AAGAAT
aagtaactttgaagtgactt

SEQ ID NO: 8447 - DNA, 20 bp, Artificial Sequence
  Description of Artificial Sequence: Synthetic oligonucleotide
  Target: SCN10A; (+) strand; PAM type: NNGRRT; PAM sequence: TAGAAT
atgttatctttgcctccgcc

SEQ ID NO: 8448 - DNA, 20 bp, Artificial Sequence
  Description of Artificial Sequence: Synthetic oligonucleotide
  Target: SCN10A; (+) strand; PAM type: NNGRRT; PAM sequence: TTGGGT
cctccctgatactgcagcct

SEQ ID NO: 8449 - DNA, 20 bp, Artificial Sequence
  Description of Artificial Sequence: Synthetic oligonucleotide
  Target: SCN10A; (+) strand; PAM type: NNGRRT; PAM sequence: GAGGAT
tgttaattacaagggggcct

SEQ ID NO: 8450 - DNA, 20 bp, Artificial Sequence
  Description of Artificial Sequence: Synthetic oligonucleotide
  Target: SCN10A; (+) strand; PAM type: NNGRRT; PAM sequence: AGGGAT
tggctgacagctaaagcata

SEQ ID NO: 8451 - DNA, 20 bp, Artificial Sequence
  Description of Artificial Sequence: Synthetic oligonucleotide
  Target: SCN10A; (+) strand; PAM type: NNGRRT; PAM sequence: TTGAAT
acagctaaagcataagggat

SEQ ID NO: 8452 - DNA, 20 bp, Artificial Sequence
  Description of Artificial Sequence: Synthetic oligonucleotide
  Target: SCN10A; (+) strand; PAM type: NNGRRT; PAM sequence: GGGAGT
ctggagataggtttttttgg

SEQ ID NO: 8453 - DNA, 20 bp, Artificial Sequence
  Description of Artificial Sequence: Synthetic oligonucleotide
  Target: SCN10A; (+) strand; PAM type: NNGRRT; PAM sequence: AAGAAT
tgaacaaagttggaaatata

SEQ ID NO: 8454 - DNA, 20 bp, Artificial Sequence
  Description of Artificial Sequence: Synthetic oligonucleotide
  Target: SCN10A; (+) strand; PAM type: NNGRRT; PAM sequence: GAGGGT
ggcaaggcctttaggtaaga

SEQ ID NO: 8455 - DNA, 20 bp, Artificial Sequence
  Description of Artificial Sequence: Synthetic oligonucleotide
  Target: SCN10A; (+) strand; PAM type: NNGRRT; PAM sequence: AGGGAT
atctcacaggaaaaatggtg

SEQ ID NO: 8456 - DNA, 20 bp, Artificial Sequence
  Description of Artificial Sequence: Synthetic oligonucleotide
  Target: SCN10A; (+) strand; PAM type: NNGRRT; PAM sequence: ATGGGT
tgctctttgttgttatgcac

SEQ ID NO: 8457 - DNA, 20 bp, Artificial Sequence
  Description of Artificial Sequence: Synthetic oligonucleotide
  Target: SCN10A; (+) strand; PAM type: NNGRRT; PAM sequence: TTGGAT
cttgggaaataattataatt

SEQ ID NO: 8458 - DNA, 20 bp, Artificial Sequence
  Description of Artificial Sequence: Synthetic oligonucleotide
  Target: SCN10A; (+) strand; PAM type: NNGRRT; PAM sequence: GTGAAT
atctttgtggaagaccttct

SEQ ID NO: 8459 - DNA, 20 bp, Artificial Sequence
  Description of Artificial Sequence: Synthetic oligonucleotide
  Target: SCN10A; (+) strand; PAM type: NNGRRT; PAM sequence: TAGGGT
taggacatgttcccatcgtg

SEQ ID NO: 8460 - DNA, 20 bp, Artificial Sequence
  Description of Artificial Sequence: Synthetic oligonucleotide
  Target: SCN10A; (+) strand; PAM type: NNGRRT; PAM sequence: CAGGAT
cagcacattttaatttgctc

SEQ ID NO: 8461 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tccaggatcttattttaagg

SEQ ID NO: 8462 - DNA, 20 bp, Artificial Sequence
  Description of Artificial Sequence: Synthetic oligonucleotide
  Target: SCN10A; (+) strand; PAM type: NNGRRT; PAM sequence: GAGGGT
aagaaagggaggtaaggaga

SEQ ID NO: 8463 - DNA, 20 bp, Artificial Sequence
  Description of Artificial Sequence: Synthetic oligonucleotide
  Target: SCN10A; (+) strand; PAM type: NNGRRT; PAM sequence: GTGGGT
gagggtagaaagattgatat

SEQ ID NO: 8464 - DNA, 20 bp, Artificial Sequence
  Description of Artificial Sequence: Synthetic oligonucleotide
  Target: SCN10A; (+) strand; PAM type: NNGRRT; PAM sequence: AGGGAT
gcttattttccagctctata

SEQ ID NO: 8465 - DNA, 20 bp, Artificial Sequence
  Description of Artificial Sequence: Synthetic oligonucleotide
  Target: SCN10A; (+) strand; PAM type: NNGRRT; PAM sequence: GCGGAT
tataagggattcctgcccca

SEQ ID NO: 8466 - DNA, 20 bp, Artificial Sequence
  Description of Artificial Sequence: Synthetic oligonucleotide
  Target: SCN10A; (+) strand; PAM type: NNGRRT; PAM sequence: TGGAAT
tataaaatcaaaatagcctt

SEQ ID NO: 8467 - DNA, 20 bp, Artificial Sequence
  Description of Artificial Sequence: Synthetic oligonucleotide
  Target: SCN10A; (+) strand; PAM type: NNGRRT; PAM sequence: AGGAAT
gacatgattgcatttatata

SEQ ID NO: 8468 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tagtcaaactcatgggagca

SEQ ID NO: 8469 - DNA, 20 bp, Artificial Sequence
  Description of Artificial Sequence: Synthetic oligonucleotide
  Target: SCN10A; (+) strand; PAM type: NNGRRT; PAM sequence: TAGAAT
aaactcatgggagcagagaa

SEQ ID NO: 8470 - DNA, 20 bp, Artificial Sequence
  Description of Artificial Sequence: Synthetic oligonucleotide
  Target: SCN10A; (+) strand; PAM type: NNGRRT; PAM sequence: ATGAAT
caaacttccagttatgtgac

SEQ ID NO: 8471 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tctacctaaaaatttgccaa

SEQ ID NO: 8472 - DNA, 20 bp, Artificial Sequence
  Description of Artificial Sequence: Synthetic oligonucleotide
  Target: SCN10A; (+) strand; PAM type: NNGRRT; PAM sequence: ATGGGT
ttgatggtggtgatggtttc

SEQ ID NO: 8473 - DNA, 20 bp, Artificial Sequence
  Description of Artificial Sequence: Synthetic oligonucleotide
  Target: SCN10A; (+) strand; PAM type: NNGRRT; PAM sequence: GTGGAT
acatgtatagctttttacat

SEQ ID NO: 8474 - DNA, 20 bp, Artificial Sequence
  Description of Artificial Sequence: Synthetic oligonucleotide
  Target: SCN10A; (+) strand; PAM type: NNGRRT; PAM sequence: CAGGAT
gacatgaaaagtaagcaggt

SEQ ID NO: 8475 - DNA, 20 bp, Artificial Sequence
  Description of Artificial Sequence: Synthetic oligonucleotide
  Target: SCN10A; (+) strand; PAM type: NNGRRT; PAM sequence: TAGGGT
tgagcatgatttggccttta

SEQ ID NO: 8476 - DNA, 20 bp, Artificial Sequence
  Description of Artificial Sequence: Synthetic oligonucleotide
  Target: SCN10A; (+) strand; PAM type: NNGRRT; PAM sequence: CTGAGT
ctgcataatattcttgatct

SEQ ID NO: 8477 - DNA, 20 bp, Artificial Sequence
  Description of Artificial Sequence: Synthetic oligonucleotide
  Target: SCN10A; (+) strand; PAM type: NNGRRT; PAM sequence: AAGGAT
caattttaaatgtataaaat

SEQ ID NO: 8478 - DNA, 20 bp, Artificial Sequence
  Description of Artificial Sequence: Synthetic oligonucleotide
  Target: SCN10A; (+) strand; PAM type: NNGRRT; PAM sequence: GAGAAT
taattccagaccctagactt

SEQ ID NO: 8479 - DNA, 20 bp, Artificial Sequence
  Description of Artificial Sequence: Synthetic oligonucleotide
  Target: SCN10A; (+) strand; PAM type: NNGRRT; PAM sequence: AGGAGT
tacggtctgaggttctcagg

SEQ ID NO: 8480 - DNA, 20 bp, Artificial Sequence
  Description of Artificial Sequence: Synthetic oligonucleotide
  Target: SCN10A; (+) strand; PAM type: NNGRRT; PAM sequence: CAGGGT
ctcttggaaagctgcaaata

SEQ ID NO: 8481 - DNA, 20 bp, Artificial Sequence
  Description of Artificial Sequence: Synthetic oligonucleotide
  Target: SCN10A; (+) strand; PAM type: NNGRRT; PAM sequence: CAGAAT
aagaactggttgattttgcc

SEQ ID NO: 8482 - DNA, 20 bp, Artificial Sequence
  Description of Artificial Sequence: Synthetic oligonucleotide
  Target: SCN10A; (+) strand; PAM type: NNGRRT; PAM sequence: ATGAGT
ggcatctgtgttatctgtag

SEQ ID NO: 8483 - DNA, 20 bp, Artificial Sequence
  Description of Artificial Sequence: Synthetic oligonucleotide
  Target: SCN10A; (+) strand; PAM type: NNGRRT; PAM sequence: TTGAGT
ctgtctaaattccaacagtc

SEQ ID NO: 8484 - DNA, 20 bp, Artificial Sequence
  Description of Artificial Sequence: Synthetic oligonucleotide
  Target: SCN10A; (+) strand; PAM type: NNGRRT; PAM sequence: TGGAGT
tttaagctccacttactgca

SEQ ID NO: 8485 - DNA, 20 bp, Artificial Sequence
  Description of Artificial Sequence: Synthetic oligonucleotide
  Target: SCN10A; (+) strand; PAM type: NNGRRT; PAM sequence: GGGGAT
acacactaccctgtcccttt

SEQ ID NO: 8486 - DNA, 20 bp, Artificial Sequence
  Description of Artificial Sequence: Synthetic oligonucleotide
  Target: SCN10A; (+) strand; PAM type: NNGRRT; PAM sequence: TCGAGT
atcccacttttcagtcagcc

SEQ ID NO: 8487 - DNA, 20 bp, Artificial Sequence
  Description of Artificial Sequence: Synthetic oligonucleotide
  Target: SCN10A; (+) strand; PAM type: NNGRRT; PAM sequence: AAGAGT
tgcagtgccctgcacattgc

SEQ ID NO: 8488 - DNA, 20 bp, Artificial Sequence
  Description of Artificial Sequence: Synthetic oligonucleotide
  Target: SCN10A; (+) strand; PAM type: NNGRRT; PAM sequence: GAGAGT
ttaatttgagctactttgct

SEQ ID NO: 8489 - DNA, 20 bp, Artificial Sequence
  Description of Artificial Sequence: Synthetic oligonucleotide
  Target: SCN10A; (+) strand; PAM type: NNGRRT; PAM sequence: TAGGGT
gcaaatgcaggtatagggcg

SEQ ID NO: 8490 - DNA, 20 bp, Artificial Sequence
  Description of Artificial Sequence: Synthetic oligonucleotide
  Target: SCN10A; (+) strand; PAM type: NNGRRT; PAM sequence: CAGAGT
gtttgcatcttggaaggagg

SEQ ID NO: 8491 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ttggaaggaggcagagtggc

SEQ ID NO: 8492 - DNA, 20 bp, Artificial Sequence
  Description of Artificial Sequence: Synthetic oligonucleotide
  Target: SCN10A; (+) strand; PAM type: NNGRRT; PAM sequence: GTGAGT
tgtgaacatcttactgctct

SEQ ID NO: 8493 - DNA, 20 bp, Artificial Sequence
  Description of Artificial Sequence: Synthetic oligonucleotide
  Target: SCN10A; (+) strand; PAM type: NNGRRT; PAM sequence: AGGGGT
tcccctaccccatgtacctc

SEQ ID NO: 8494 - DNA, 20 bp, Artificial Sequence
  Description of Artificial Sequence: Synthetic oligonucleotide
  Target: SCN10A; (+) strand; PAM type: NNGRRT; PAM sequence: ATGGGT
gtccctctgcctcagtaatg

SEQ ID NO: 8495 - DNA, 20 bp, Artificial Sequence
  Description of Artificial Sequence: Synthetic oligonucleotide
  Target: SCN10A; (+) strand; PAM type: NNGRRT; PAM sequence: CAGAAT
tagtttctcctaacttaaag

SEQ ID NO: 8496 - DNA, 20 bp, Artificial Sequence
  Description of Artificial Sequence: Synthetic oligonucleotide
  Target: SCN10A; (+) strand; PAM type: NNGRRT; PAM sequence: AAGAGT
ttcaaagcaaaatttcttga

SEQ ID NO: 8497 - DNA, 20 bp, Artificial Sequence
  Description of Artificial Sequence: Synthetic oligonucleotide
  Target: SCN10A; (+) strand; PAM type: NNGRRT; PAM sequence: ATGAAT
agattgttctcactaagatc

SEQ ID NO: 8498 - DNA, 20 bp, Artificial Sequence
  Description of Artificial Sequence: Synthetic oligonucleotide
  Target: SCN10A; (+) strand; PAM type: NNGRRT; PAM sequence: CAGAGT
tttacccaacttttagacat

SEQ ID NO: 8499 - DNA, 20 bp, Artificial Sequence
  Description of Artificial Sequence: Synthetic oligonucleotide
  Target: SCN10A; (+) strand; PAM type: NNGRRT; PAM sequence: AGGAAT
ccttgacaatttatccagcc

SEQ ID NO: 8500 - DNA, 20 bp, Artificial Sequence
  Description of Artificial Sequence: Synthetic oligonucleotide
  Target: SCN10A; (+) strand; PAM type: NNGRRT; PAM sequence: AAGAGT
gtcactggactgtaaactgt

SEQ ID NO: 8501 - DNA, 20 bp, Artificial Sequence
  Description of Artificial Sequence: Synthetic oligonucleotide
  Target: SCN10A; (+) strand; PAM type: NNGRRT; PAM sequence: ATGAAT
gatgctctgcaaatttgtaa

SEQ ID NO: 8502 - DNA, 20 bp, Artificial Sequence
  Description of Artificial Sequence: Synthetic oligonucleotide
  Target: SCN10A; (+) strand; PAM type: NNGRRT; PAM sequence: CAGAAT
atttgtaaatgaatggaaga

SEQ ID NO: 8503 - DNA, 20 bp, Artificial Sequence
  Description of Artificial Sequence: Synthetic oligonucleotide
  Target: SCN10A; (+) strand; PAM type: NNGRRT; PAM sequence: CTGAGT
ggaagacagaatgggcagct

SEQ ID NO: 8504 - DNA, 20 bp, Artificial Sequence
  Description of Artificial Sequence: Synthetic oligonucleotide
  Target: SCN10A; (+) strand; PAM type: NNGRRT; PAM sequence: AAGGGT
actaaattcaattctgtacc

SEQ ID NO: 8505 - DNA, 20 bp, Artificial Sequence
  Description of Artificial Sequence: Synthetic oligonucleotide
  Target: SCN10A; (+) strand; PAM type: NNGRRT; PAM sequence: CTGAAT
ttctgtaccaagggtacata

SEQ ID NO: 8506 - DNA, 20 bp, Artificial Sequence
  Description of Artificial Sequence: Synthetic oligonucleotide
  Target: SCN10A; (+) strand; PAM type: NNGRRT; PAM sequence: TGGGAT
aagggtacatactgaatgta

SEQ ID NO: 8507 - DNA, 20 bp, Artificial Sequence
  Description of Artificial Sequence: Synthetic oligonucleotide
  Target: SCN10A; (+) strand; PAM type: NNGRRT; PAM sequence: ATGAGT
tgggatgtgcaagcctctgc

SEQ ID NO: 8508 - DNA, 20 bp, Artificial Sequence
  Description of Artificial Sequence: Synthetic oligonucleotide
  Target: SCN10A; (+) strand; PAM type: NNGRRT; PAM sequence: GGGGAT
cttgccttctgcttcatggt

SEQ ID NO: 8509 - DNA, 20 bp, Artificial Sequence
  Description of Artificial Sequence: Synthetic oligonucleotide
  Target: SCN10A; (+) strand; PAM type: NNGRRT; PAM sequence: ATGGGT
ccttctgcttcatggtgggg

SEQ ID NO: 8510 - DNA, 20 bp, Artificial Sequence
  Description of Artificial Sequence: Synthetic oligonucleotide
  Target: SCN10A; (+) strand; PAM type: NNGRRT; PAM sequence: TTGGGT
ggggatgggttgctatcctg

SEQ ID NO: 8511 - DNA, 20 bp, Artificial Sequence
  Description of Artificial Sequence: Synthetic oligonucleotide
  Target: SCN10A; (+) strand; PAM type: NNGRRT; PAM sequence: AAGAAT
tatcctgttgggttagagca

SEQ ID NO: 8512 - DNA, 20 bp, Artificial Sequence
  Description of Artificial Sequence: Synthetic oligonucleotide
  Target: SCN10A; (+) strand; PAM type: NNGRRT; PAM sequence: GGGGAT
catctttcctggggcaggag

SEQ ID NO: 8513 - DNA, 20 bp, Artificial Sequence
  Description of Artificial Sequence: Synthetic oligonucleotide
  Target: SCN10A; (+) strand; PAM type: NNGRRT; PAM sequence: CTGGGT
gcaacggcatcgttaagtgg

SEQ ID NO: 8514 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ggctgggtgtgaagtttgcc

SEQ ID NO: 8515 - DNA, 20 bp, Artificial Sequence
  Description of Artificial Sequence: Synthetic oligonucleotide
  Target: SCN10A; (+) strand; PAM type: NNGRRT; PAM sequence: GGGAAT
ccctggatattctgacttta

SEQ ID NO: 8516 - DNA, 20 bp, Artificial Sequence
  Description of Artificial Sequence: Synthetic oligonucleotide
  Target: SCN10A; (+) strand; PAM type: NNGRRT; PAM sequence: TGGAGT
gatattctgactttagggaa

SEQ ID NO: 8517 - DNA, 20 bp, Artificial Sequence
  Description of Artificial Sequence: Synthetic oligonucleotide
  Target: SCN10A; (+) strand; PAM type: NNGRRT; PAM sequence: TTGGAT
gagtagcttgctagctgctc

SEQ ID NO: 8518 - DNA, 20 bp, Artificial Sequence
  Description of Artificial Sequence: Synthetic oligonucleotide
  Target: SCN10A; (+) strand; PAM type: NNGRRT; PAM sequence: AGGGAT
tcttggattagcccacggtc

SEQ ID NO: 8519 - DNA, 20 bp, Artificial Sequence
  Description of Artificial Sequence: Synthetic oligonucleotide
  Target: SCN10A; (+) strand; PAM type: NNGRRT; PAM sequence: GTGGGT
gtgctctcagagacgatgaa

SEQ ID NO: 8520 - DNA, 20 bp, Artificial Sequence
  Description of Artificial Sequence: Synthetic oligonucleotide
  Target: SCN10A; (+) strand; PAM type: NNGRRT; PAM sequence: TGGAGT
cctattatatttctataaag

SEQ ID NO: 8521 - DNA, 20 bp, Artificial Sequence
  Description of Artificial Sequence: Synthetic oligonucleotide
  Target: SCN10A; (+) strand; PAM type: NNGRRT; PAM sequence: GGGAAT
ttttattgatttctgtagca

SEQ ID NO: 8522 - DNA, 20 bp, Artificial Sequence
  Description of Artificial Sequence: Synthetic oligonucleotide
  Target: SCN10A; (+) strand; PAM type: NNGRRT; PAM sequence: AAGAAT
ttctgtagcagggaatgtta

SEQ ID NO: 8523 - DNA, 20 bp, Artificial Sequence
  Description of Artificial Sequence: Synthetic oligonucleotide
  Target: SCN10A; (+) strand; PAM type: NNGRRT; PAM sequence: TGGAAT
aataaaatttcccagtcttg

SEQ ID NO: 8524 - DNA, 20 bp, Artificial Sequence
  Description of Artificial Sequence: Synthetic oligonucleotide
  Target: SCN10A; (+) strand; PAM type: NNGRRT; PAM sequence: AAGGGT
agcaagctgggcctgggaag

SEQ ID NO: 8525 - DNA, 20 bp, Artificial Sequence
  Description of Artificial Sequence: Synthetic oligonucleotide
  Target: SCN10A; (+) strand; PAM type: NNGRRT; PAM sequence: GGGAGT
tgggaagaagggtcttagtt

SEQ ID NO: 8526 - DNA, 20 bp, Artificial Sequence
  Description of Artificial Sequence: Synthetic oligonucleotide
  Target: SCN10A; (+) strand; PAM type: NNGRRT; PAM sequence: GGGAAT
gaagggtcttagttgggagt

SEQ ID NO: 8527 - DNA, 20 bp, Artificial Sequence
  Description of Artificial Sequence: Synthetic oligonucleotide
  Target: SCN10A; (+) strand; PAM type: NNGRRT; PAM sequence: TTGGAT
agtgggaatttccttttgcc

SEQ ID NO: 8528 - DNA, 20 bp, Artificial Sequence
  Description of Artificial Sequence: Synthetic oligonucleotide
  Target: SCN10A; (+) strand; PAM type: NNGRRT; PAM sequence: GTGGGT
cggcttgtgccactgggcat

SEQ ID NO: 8529 - DNA, 20 bp, Artificial Sequence
  Description of Artificial Sequence: Synthetic oligonucleotide
  Target: SCN10A; (+) strand; PAM type: NNGRRT; PAM sequence: TTGGAT
tcaaagatgttgcctgccat

SEQ ID NO: 8530 - DNA, 20 bp, Artificial Sequence
  Description of Artificial Sequence: Synthetic oligonucleotide
  Target: SCN10A; (+) strand; PAM type: NNGRRT; PAM sequence: TAGGAT
tttggatgctggtcaggagc

SEQ ID NO: 8531 - DNA, 20 bp, Artificial Sequence
  Description of Artificial Sequence: Synthetic oligonucleotide
  Target: SCN10A; (+) strand; PAM type: NNGRRT; PAM sequence: ATGGGT
gctaggatggtccaagacct

SEQ ID NO: 8532 - DNA, 20 bp, Artificial Sequence
  Description of Artificial Sequence: Synthetic oligonucleotide
  Target: SCN10A; (+) strand; PAM type: NNGRRT; PAM sequence: TGGAGT
ggtccaagacctatgggtcc

SEQ ID NO: 8533 - DNA, 20 bp, Artificial Sequence
  Description of Artificial Sequence: Synthetic oligonucleotide
  Target: SCN10A; (+) strand; PAM type: NNGRRT; PAM sequence: AAGAGT
cgaaattagggaacaaagga

SEQ ID NO: 8534 - DNA, 20 bp, Artificial Sequence
  Description of Artificial Sequence: Synthetic oligonucleotide
  Target: SCN10A; (+) strand; PAM type: NNGRRT; PAM sequence: CAGAAT
agtgtttaccttgcttgggc

SEQ ID NO: 8535 - DNA, 20 bp, Artificial Sequence
  Description of Artificial Sequence: Synthetic oligonucleotide
  Target: SCN10A; (+) strand; PAM type: NNGRRT; PAM sequence: GAGAGT
actaaggctagcaaaaggtt

SEQ ID NO: 8536 - DNA, 20 bp, Artificial Sequence
  Description of Artificial Sequence: Synthetic oligonucleotide
  Target: SCN10A; (+) strand; PAM type: NNGRRT; PAM sequence: GTGAAT
aggctagcaaaaggttgaga

SEQ ID NO: 8537 - DNA, 20 bp, Artificial Sequence
  Description of Artificial Sequence: Synthetic oligonucleotide
  Target: SCN10A; (+) strand; PAM type: NNGRRT; PAM sequence: AAGGAT
atccactcttcttccattca

SEQ ID NO: 8538 - DNA, 20 bp, Artificial Sequence
  Description of Artificial Sequence: Synthetic oligonucleotide
  Target: SCN10A; (+) strand; PAM type: NNGRRT; PAM sequence: GAGAAT
cttcttccattcaaaggatg

SEQ ID NO: 8539 - DNA, 20 bp, Artificial Sequence
  Description of Artificial Sequence: Synthetic oligonucleotide
  Target: SCN10A; (+) strand; PAM type: NNGRRT; PAM sequence: CAGAAT
aggatggagaatctcaggaa

SEQ ID NO: 8540 - DNA, 20 bp, Artificial Sequence
  Description of Artificial Sequence: Synthetic oligonucleotide
  Target: SCN10A; (+) strand; PAM type: NNGRRT; PAM sequence: GAGGAT
ctccccctgtgccatcctcg

SEQ ID NO: 8541 - DNA, 20 bp, Artificial Sequence
  Description of Artificial Sequence: Synthetic oligonucleotide
  Target: SCN10A; (+) strand; PAM type: NNGRRT; PAM sequence: TGGAAT
tcccactcctatttactgcc

SEQ ID NO: 8542 - DNA, 20 bp, Artificial Sequence
  Description of Artificial Sequence: Synthetic oligonucleotide
  Target: SCN10A; (+) strand; PAM type: NNGRRT; PAM sequence: TAGGGT
actgcctggaatttcaacat

SEQ ID NO: 8543 - DNA, 20 bp, Artificial Sequence
  Description of Artificial Sequence: Synthetic oligonucleotide
  Target: SCN10A; (+) strand; PAM type: NNGRRT; PAM sequence: CAGGGT
ttgtaggtagatgccctctc

SEQ ID NO: 8544 - DNA, 20 bp, Artificial Sequence
  Description of Artificial Sequence: Synthetic oligonucleotide
  Target: SCN10A; (+) strand; PAM type: NNGRRT; PAM sequence: AAGAAT
aatatgatttatcttgtcct

SEQ ID NO: 8545 - DNA, 20 bp, Artificial Sequence
  Description of Artificial Sequence: Synthetic oligonucleotide
  Target: SCN10A; (+) strand; PAM type: NNGRRT; PAM sequence: TGGGGT
aagctttctttggcagccta

SEQ ID NO: 8546 - DNA, 20 bp, Artificial Sequence
  Description of Artificial Sequence: Synthetic oligonucleotide
  Target: SCN10A; (+) strand; PAM type: NNGRRT; PAM sequence: TTGGGT
ttctttggcagcctatgggg

SEQ ID NO: 8547 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ggtgatgacagggaagaagc

SEQ ID NO: 8548 - DNA, 20 bp, Artificial Sequence
  Description of Artificial Sequence: Synthetic oligonucleotide
  Target: SCN10A; (+) strand; PAM type: NNGRRT; PAM sequence: TTGAGT
gctgggatgtcaaagagaga

SEQ ID NO: 8549 - DNA, 20 bp, Artificial Sequence
  Description of Artificial Sequence: Synthetic oligonucleotide
  Target: SCN10A; (+) strand; PAM type: NNGRRT; PAM sequence: AAGGGT
aaaactttcatgtttttgcc

SEQ ID NO: 8550 - DNA, 20 bp, Artificial Sequence
  Description of Artificial Sequence: Synthetic oligonucleotide
  Target: SCN10A; (+) strand; PAM type: NNGRRT; PAM sequence: GTGGAT
ccttggcatctggctcaaat

SEQ ID NO: 8551 - DNA, 20 bp, Artificial Sequence
  Description of Artificial Sequence: Synthetic oligonucleotide
  Target: SCN10A; (+) strand; PAM type: NNGRRT; PAM sequence: TAGGGT
gcttgcttctcagtaagtct

SEQ ID NO: 8552 - DNA, 20 bp, Artificial Sequence
  Description of Artificial Sequence: Synthetic oligonucleotide
  Target: SCN10A; (+) strand; PAM type: NNGRRT; PAM sequence: TTGAAT
ctcctctcattacccatgac

SEQ ID NO: 8553 - DNA, 20 bp, Artificial Sequence
  Description of Artificial Sequence: Synthetic oligonucleotide
  Target: SCN10A; (+) strand; PAM type: NNGRRT; PAM sequence: AGGGAT
tccactgaacttgttgatgg

SEQ ID NO: 8554 - DNA, 20 bp, Artificial Sequence
  Description of Artificial Sequence: Synthetic oligonucleotide
  Target: SCN10A; (+) strand; PAM type: NNGRRT; PAM sequence: ATGGGT
aatccagttatcttgattgt

SEQ ID NO: 8555 - DNA, 20 bp, Artificial Sequence
  Description of Artificial Sequence: Synthetic oligonucleotide
  Target: SCN10A; (+) strand; PAM type: NNGRRT; PAM sequence: CAGAAT
cccattgtaatacttcttat

SEQ ID NO: 8556 - DNA, 20 bp, Artificial Sequence
  Description of Artificial Sequence: Synthetic oligonucleotide
  Target: SCN10A; (+) strand; PAM type: NNGRRT; PAM sequence: CAGAAT
aaatctaatagcttggctaa

SEQ ID NO: 8557 - DNA, 20 bp, Artificial Sequence
  Description of Artificial Sequence: Synthetic oligonucleotide
  Target: SCN10A; (+) strand; PAM type: NNGRRT; PAM sequence: TGGAGT
acagggccaattccattcac

SEQ ID NO: 8558 - DNA, 20 bp, Artificial Sequence
  Description of Artificial Sequence: Synthetic oligonucleotide
  Target: SCN10A; (+) strand; PAM type: NNGRRT; PAM sequence: GTGGAT
ggccaattccattcactgga

SEQ ID NO: 8559 - DNA, 20 bp, Artificial Sequence
  Description of Artificial Sequence: Synthetic oligonucleotide
  Target: SCN10A; (+) strand; PAM type: NNGRRT; PAM sequence: ATGGGT
taggtgatatcatgtgtggt

SEQ ID NO: 8560 - DNA, 20 bp, Artificial Sequence
  Description of Artificial Sequence: Synthetic oligonucleotide
  Target: SCN10A; (+) strand; PAM type: NNGRRT; PAM sequence: AGGAGT
cttgagatctttatgaaaaa

SEQ ID NO: 8561 - DNA, 20 bp, Artificial Sequence
  Description of Artificial Sequence: Synthetic oligonucleotide
  Target: SCN10A; (+) strand; PAM type: NNGRRT; PAM sequence: TAGAGT
tatgaaaaaaggagtgaaac

SEQ ID NO: 8562 - DNA, 20 bp, Artificial Sequence
  Description of Artificial Sequence: Synthetic oligonucleotide
  Target: SCN10A; (+) strand; PAM type: NNGRRT; PAM sequence: TCGAGT
tttttgcccaatctttaaac

SEQ ID NO: 8563 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gcccaatctttaaactcgag

SEQ ID NO: 8564 - DNA, 20 bp, Artificial Sequence
  Description of Artificial Sequence: Synthetic oligonucleotide
  Target: SCN10A; (+) strand; PAM type: NNGRRT; PAM sequence: TTGGAT
accactaccatgactgcatc

SEQ ID NO: 8565 - DNA, 20 bp, Artificial Sequence
  Description of Artificial Sequence: Synthetic oligonucleotide
  Target: SCN10A; (+) strand; PAM type: NNGRRT; PAM sequence: GGGAGT
tgcatcttggatcctgacag

SEQ ID NO: 8566 - DNA, 20 bp, Artificial Sequence
  Description of Artificial Sequence: Synthetic oligonucleotide
  Target: SCN10A; (+) strand; PAM type: NNGRRT; PAM sequence: TTGGGT
cttggatcctgacaggggag

SEQ ID NO: 8567 - DNA, 20 bp, Artificial Sequence
  Description of Artificial Sequence: Synthetic oligonucleotide
  Target: SCN10A; (+) strand; PAM type: NNGRRT; PAM sequence: TGGGGT
cctctctatacctgtaggcg

SEQ ID NO: 8568 - DNA, 20 bp, Artificial Sequence
  Description of Artificial Sequence: Synthetic oligonucleotide
  Target: SCN10A; (+) strand; PAM type: NNGRRT; PAM sequence: TAGAAT
ctatacctgtaggcgtgggg

SEQ ID NO: 8569 - DNA, 20 bp, Artificial Sequence
  Description of Artificial Sequence: Synthetic oligonucleotide
  Target: SCN10A; (+) strand; PAM type: NNGRRT; PAM sequence: TAGGGT
tgtaggcgtggggtagaata

SEQ ID NO: 8570 - DNA, 20 bp, Artificial Sequence
  Description of Artificial Sequence: Synthetic oligonucleotide
  Target: SCN10A; (+) strand; PAM type: NNGRRT; PAM sequence: CTGGGT
taaccacacaagtttaatcc

SEQ ID NO: 8571 - DNA, 20 bp, Artificial Sequence
  Description of Artificial Sequence: Synthetic oligonucleotide
  Target: SCN10A; (+) strand; PAM type: NNGRRT; PAM sequence: CAGAGT
gtatgtttactccagaagac

SEQ ID NO: 8572 - DNA, 20 bp, Artificial Sequence
  Description of Artificial Sequence: Synthetic oligonucleotide
  Target: SCN10A; (+) strand; PAM type: NNGRRT; PAM sequence: TTGGAT
cacaggcatagactgtcatg

SEQ ID NO: 8573 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ctggggctcaccaggggccg

SEQ ID NO: 8574 - DNA, 20 bp, Artificial Sequence
  Description of Artificial Sequence: Synthetic oligonucleotide
  Target: SCN10A; (+) strand; PAM type: NNGRRT; PAM sequence: ACGGAT
taaagcaagaggaaccccct

SEQ ID NO: 8575 - DNA, 20 bp, Artificial Sequence
  Description of Artificial Sequence: Synthetic oligonucleotide
  Target: SCN10A; (+) strand; PAM type: NNGRRT; PAM sequence: AAGGAT
atcagaacaggcaggagaga

SEQ ID NO: 8576 - DNA, 20 bp, Artificial Sequence
  Description of Artificial Sequence: Synthetic oligonucleotide
  Target: SCN10A; (+) strand; PAM type: NNGRRT; PAM sequence: AGGAGT
acaaaccaagcccagcatca

SEQ ID NO: 8577 - DNA, 20 bp, Artificial Sequence
  Description of Artificial Sequence: Synthetic oligonucleotide
  Target: SCN10A; (+) strand; PAM type: NNGRRT; PAM sequence: CTGAGT
ccagtgtcggaacggtggga

SEQ ID NO: 8578 - DNA, 20 bp, Artificial Sequence
  Description of Artificial Sequence: Synthetic oligonucleotide
  Target: SCN10A; (+) strand; PAM type: NNGRRT; PAM sequence: CTGGGT
ttccattgctgactccctgc

SEQ ID NO: 8579 - DNA, 20 bp, Artificial Sequence
  Description of Artificial Sequence: Synthetic oligonucleotide
  Target: SCN10A; (+) strand; PAM type: NNGRRT; PAM sequence: AGGGAT
aaagccagtttctgttctcc

SEQ ID NO: 8580 - DNA, 20 bp, Artificial Sequence
  Description of Artificial Sequence: Synthetic oligonucleotide
  Target: SCN10A; (+) strand; PAM type: NNGRRT; PAM sequence: CTGGAT
tctccagggatccagagatg

SEQ ID NO: 8581 - DNA, 20 bp, Artificial Sequence
  Description of Artificial Sequence: Synthetic oligonucleotide
  Target: SCN10A; (+) strand; PAM type: NNGRRT; PAM sequence: AAGGGT
ggatccagagatgctggata

SEQ ID NO: 8582 - DNA, 20 bp, Artificial Sequence
  Description of Artificial Sequence: Synthetic oligonucleotide
  Target: SCN10A; (+) strand; PAM type: NNGRRT; PAM sequence: GAGGGT
gatgctggataaagggtggg

SEQ ID NO: 8583 - DNA, 20 bp, Artificial Sequence
  Description of Artificial Sequence: Synthetic oligonucleotide
  Target: SCN10A; (+) strand; PAM type: NNGRRT; PAM sequence: TTGGAT
tgttggttcaaatctgagcc

SEQ ID NO: 8584 - DNA, 20 bp, Artificial Sequence
  Description of Artificial Sequence: Synthetic oligonucleotide
  Target: SCN10A; (+) strand; PAM type: NNGRRT; PAM sequence: TAGAGT
agtaaaattctttgggcttc

SEQ ID NO: 8585 - DNA, 20 bp, Artificial Sequence
  Description of Artificial Sequence: Synthetic oligonucleotide
  Target: SCN10A; (+) strand; PAM type: NNGRRT; PAM sequence: TTGGGT
ggacaattactgccttatcc

SEQ ID NO: 8586 - DNA, 20 bp, Artificial Sequence
  Description of Artificial Sequence: Synthetic oligonucleotide
  Target: SCN10A; (+) strand; PAM type: NNGRRT; PAM sequence: TAGGAT
acgaagatgttttcctccct

SEQ ID NO: 8587 - DNA, 20 bp, Artificial Sequence
  Description of Artificial Sequence: Synthetic oligonucleotide
  Target: SCN10A; (+) strand; PAM type: NNGRRT; PAM sequence: TTGGGT
gatgttttcctcccttagga

SEQ ID NO: 8588 - DNA, 20 bp, Artificial Sequence
  Description of Artificial Sequence: Synthetic oligonucleotide
  Target: SCN10A; (+) strand; PAM type: NNGRRT; PAM sequence: TTGGAT
agtttttctttaggggccct

SEQ ID NO: 8589 - DNA, 20 bp, Artificial Sequence
  Description of Artificial Sequence: Synthetic oligonucleotide
  Target: SCN10A; (+) strand; PAM type: NNGRRT; PAM sequence: TGGAAT
ggaaactgggctgagatctg

SEQ ID NO: 8590 - DNA, 20 bp, Artificial Sequence
  Description of Artificial Sequence: Synthetic oligonucleotide
  Target: SCN10A; (+) strand; PAM type: NNGRRT; PAM sequence: GTGGGT
agaaggaaagggcaagggca

SEQ ID NO: 8591 - DNA, 20 bp, Artificial Sequence
  Description of Artificial Sequence: Synthetic oligonucleotide
  Target: SCN10A; (+) strand; PAM type: NNGRRT; PAM sequence: AAGGAT
tcatgctgagaactctgacc

SEQ ID NO: 8592 - DNA, 20 bp, Artificial Sequence
  Description of Artificial Sequence: Synthetic oligonucleotide
  Target: SCN10A; (+) strand; PAM type: NNGRRT; PAM sequence: CAGGGT
tcaataatctcaaacctccc

SEQ ID NO: 8593 - DNA, 20 bp, Artificial Sequence
  Description of Artificial Sequence: Synthetic oligonucleotide
  Target: SCN10A; (+) strand; PAM type: NNGRRT; PAM sequence: AAGGAT
ttatgctcagaaccctgggc

SEQ ID NO: 8594 - DNA, 20 bp, Artificial Sequence
  Description of Artificial Sequence: Synthetic oligonucleotide
  Target: SCN10A; (+) strand; PAM type: NNGRRT; PAM sequence: TGGAAT
gggcaaggatttcctgtaag

SEQ ID NO: 8595 - DNA, 20 bp, Artificial Sequence
  Description of Artificial Sequence: Synthetic oligonucleotide
  Target: SCN10A; (+) strand; PAM type: NNGRRT; PAM sequence: CAGGAT
tatgctcagtgatctttgtt

SEQ ID NO: 8596 - DNA, 20 bp, Artificial Sequence
  Description of Artificial Sequence: Synthetic oligonucleotide
  Target: SCN10A; (+) strand; PAM type: NNGRRT; PAM sequence: GAGAGT
ttacccctcaccacaatcca

SEQ ID NO: 8597 - DNA, 20 bp, Artificial Sequence
  Description of Artificial Sequence: Synthetic oligonucleotide
  Target: SCN10A; (+) strand; PAM type: NNGRRT; PAM sequence: TTGAAT
agtaggtattattagcccca

SEQ ID NO: 8598 - DNA, 20 bp, Artificial Sequence
  Description of Artificial Sequence: Synthetic oligonucleotide
  Target: SCN10A; (+) strand; PAM type: NNGRRT; PAM sequence: ATGAAT
ggtattattagccccattga

SEQ ID NO: 8599 - DNA, 20 bp, Artificial Sequence
  Description of Artificial Sequence: Synthetic oligonucleotide
  Target: SCN10A; (+) strand; PAM type: NNGRRT; PAM sequence: AGGGGT
atgagaaaactgagactcag

SEQ ID NO: 8600 - DNA, 20 bp, Artificial Sequence
  Description of Artificial Sequence: Synthetic oligonucleotide
  Target: SCN10A; (+) strand; PAM type: NNGRRT; PAM sequence: TTGAGT
catgagccatccacaagtag

SEQ ID NO: 8601 - DNA, 20 bp, Artificial Sequence
  Description of Artificial Sequence: Synthetic oligonucleotide
  Target: SCN10A; (+) strand; PAM type: NNGRRT; PAM sequence: AGGAAT
catccacaagtagttgagtc

SEQ ID NO: 8602 - DNA, 20 bp, Artificial Sequence
  Description of Artificial Sequence: Synthetic oligonucleotide
  Target: SCN10A; (+) strand; PAM type: NNGRRT; PAM sequence: CGGGAT
ccatgtagccccttttctct

SEQ ID NO: 8603 - DNA, 20 bp, Artificial Sequence
  Description of Artificial Sequence: Synthetic oligonucleotide
  Target: SCN10A; (+) strand; PAM type: NNGRRT; PAM sequence: AGGGGT
gaacagcgcctatctacctc

SEQ ID NO: 8604 - DNA, 20 bp, Artificial Sequence
  Description of Artificial Sequence: Synthetic oligonucleotide
  Target: SCN10A; (+) strand; PAM type: NNGRRT; PAM sequence: AAGGAT
gtatggaaggcattaaatga

SEQ ID NO: 8605 - DNA, 20 bp, Artificial Sequence
  Description of Artificial Sequence: Synthetic oligonucleotide
  Target: SCN10A; (+) strand; PAM type: NNGRRT; PAM sequence: TGGGAT
tataaacatgagaggttatc

SEQ ID NO: 8606 - DNA, 20 bp, Artificial Sequence
  Description of Artificial Sequence: Synthetic oligonucleotide
  Target: SCN10A; (+) strand; PAM type: NNGRRT; PAM sequence: CAGAGT
gggattcgattcctattaat

SEQ ID NO: 8607 - DNA, 20 bp, Artificial Sequence
  Description of Artificial Sequence: Synthetic oligonucleotide
  Target: SCN10A; (+) strand; PAM type: NNGRRT; PAM sequence: GAGGGT
gccttcctccccatcccaag

SEQ ID NO: 8608 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ctccccatcccaaggagggt

SEQ ID NO: 8609 - DNA, 20 bp, Artificial Sequence
  Description of Artificial Sequence: Synthetic oligonucleotide
  Target: SCN10A; (+) strand; PAM type: NNGRRT; PAM sequence: GGGGAT
gccctgactcagtcctttgt

SEQ ID NO: 8610 - DNA, 20 bp, Artificial Sequence
  Description of Artificial Sequence: Synthetic oligonucleotide
  Target: SCN10A; (+) strand; PAM type: NNGRRT; PAM sequence: GTGAAT
gaccaagatccctttgagat

SEQ ID NO: 8611 - DNA, 20 bp, Artificial Sequence
  Description of Artificial Sequence: Synthetic oligonucleotide
  Target: SCN10A; (+) strand; PAM type: NNGRRT; PAM sequence: CTGAGT
atccctttgagatgtgaatc

SEQ ID NO: 8612 - DNA, 20 bp, Artificial Sequence
  Description of Artificial Sequence: Synthetic oligonucleotide
  Target: SCN10A; (+) strand; PAM type: NNGRRT; PAM sequence: GAGGAT
ttgagatgtgaatcctgagt

SEQ ID NO: 8613 - DNA, 20 bp, Artificial Sequence
  Description of Artificial Sequence: Synthetic oligonucleotide
  Target: SCN10A; (+) strand; PAM type: NNGRRT; PAM sequence: AAGGGT
tgcaacagcaatcacagggc

SEQ ID NO: 8614 - DNA, 20 bp, Artificial Sequence
  Description of Artificial Sequence: Synthetic oligonucleotide
  Target: SCN10A; (+) strand; PAM type: NNGRRT; PAM sequence: GTGAGT
tgatattaaagtgatgggct

SEQ ID NO: 8615 - DNA, 20 bp, Artificial Sequence
  Description of Artificial Sequence: Synthetic oligonucleotide
  Target: SCN10A; (+) strand; PAM type: NNGRRT; PAM sequence: TTGGGT
tgtacacgttgtcctcccac

SEQ ID NO: 8616 - DNA, 20 bp, Artificial Sequence
  Description of Artificial Sequence: Synthetic oligonucleotide
  Target: SCN10A; (+) strand; PAM type: NNGRRT; PAM sequence: GAGAGT
tgacctgtgaccagacaagg

SEQ ID NO: 8617 - DNA, 20 bp, Artificial Sequence
  Description of Artificial Sequence: Synthetic oligonucleotide
  Target: SCN10A; (+) strand; PAM type: NNGRRT; PAM sequence: GAGGGT
agacaagggagagtgggaag

SEQ ID NO: 8618 - DNA, 20 bp, Artificial Sequence
  Description of Artificial Sequence: Synthetic oligonucleotide
  Target: SCN10A; (+) strand; PAM type: NNGRRT; PAM sequence: GTGGGT
aagggagagtgggaaggagg

SEQ ID NO: 8619 - DNA, 20 bp, Artificial Sequence
  Description of Artificial Sequence: Synthetic oligonucleotide
  Target: SCN10A; (+) strand; PAM type: NNGRRT; PAM sequence: CTGGGT
gccaagcctaagacatggac

SEQ ID NO: 8620 - DNA, 20 bp, Artificial Sequence
  Description of Artificial Sequence: Synthetic oligonucleotide
  Target: SCN10A; (+) strand; PAM type: NNGRRT; PAM sequence: AGGAAT
gggaggtgatccaaggaagc

SEQ ID NO: 8621 - DNA, 20 bp, Artificial Sequence
  Description of Artificial Sequence: Synthetic oligonucleotide
  Target: SCN10A; (+) strand; PAM type: NNGRRT; PAM sequence: GGGAGT
atccaaggaagcaggaatga

SEQ ID NO: 8622 - DNA, 20 bp, Artificial Sequence
  Description of Artificial Sequence: Synthetic oligonucleotide
  Target: SCN10A; (+) strand; PAM type: NNGRRT; PAM sequence: AAGAAT
gcaggaatgagggagtgggg

SEQ ID NO: 8623 - DNA, 20 bp, Artificial Sequence
  Description of Artificial Sequence: Synthetic oligonucleotide
  Target: SCN10A; (+) strand; PAM type: NNGRRT; PAM sequence: GGGAAT
gggagtggggaagaataagc

SEQ ID NO: 8624 - DNA, 20 bp, Artificial Sequence
  Description of Artificial Sequence: Synthetic oligonucleotide
  Target: SCN10A; (+) strand; PAM type: NNGRRT; PAM sequence: GAGGAT
atgggagaagagcctgtgaa

SEQ ID NO: 8625 - DNA, 20 bp, Artificial Sequence
  Description of Artificial Sequence: Synthetic oligonucleotide
  Target: SCN10A; (+) strand; PAM type: NNGRRT; PAM sequence: TGGGGT
caactgaagcgcaatcctac

SEQ ID NO: 8626 - DNA, 20 bp, Artificial Sequence
  Description of Artificial Sequence: Synthetic oligonucleotide
  Target: SCN10A; (+) strand; PAM type: NNGRRT; PAM sequence: CTGAGT
cgcaatcctactggggtcct

SEQ ID NO: 8627 - DNA, 20 bp, Artificial Sequence
  Description of Artificial Sequence: Synthetic oligonucleotide
  Target: SCN10A; (+) strand; PAM type: NNGRRT; PAM sequence: CAGGAT
gtaactgtgtagagcacatg

SEQ ID NO: 8628 - DNA, 20 bp, Artificial Sequence
  Description of Artificial Sequence: Synthetic oligonucleotide
  Target: SCN10A; (+) strand; PAM type: NNGRRT; PAM sequence: TGGAGT
tcaccaagggacagggaaac

SEQ ID NO: 8629 - DNA, 20 bp, Artificial Sequence
  Description of Artificial Sequence: Synthetic oligonucleotide
  Target: SCN10A; (+) strand; PAM type: NNGRRT; PAM sequence: AAGGGT
gactcccaaaacttattggt

SEQ ID NO: 8630 - DNA, 20 bp, Artificial Sequence
  Description of Artificial Sequence: Synthetic oligonucleotide
  Target: SCN10A; (+) strand; PAM type: NNGRRT; PAM sequence: TGGAGT
ctgcacaagctcctaagccc

SEQ ID NO: 8631 - DNA, 20 bp, Artificial Sequence
  Description of Artificial Sequence: Synthetic oligonucleotide
  Target: SCN10A; (+) strand; PAM type: NNGRRT; PAM sequence: GAGAAT
agccctggagtctttataca

SEQ ID NO: 8632 - DNA, 20 bp, Artificial Sequence
  Description of Artificial Sequence: Synthetic oligonucleotide
  Target: SCN10A; (+) strand; PAM type: NNGRRT; PAM sequence: GGGAAT
ggctaagggaagaggtggca

SEQ ID NO: 8633 - DNA, 20 bp, Artificial Sequence
  Description of Artificial Sequence: Synthetic oligonucleotide
  Target: SCN10A; (+) strand; PAM type: NNGRRT; PAM sequence: TTGAGT
tcttttctttttttttgaga

SEQ ID NO: 8634 - DNA, 20 bp, Artificial Sequence
  Description of Artificial Sequence: Synthetic oligonucleotide
  Target: SCN10A; (+) strand; PAM type: NNGRRT; PAM sequence: TGGAGT
tctcgctgtctcgcccaagc

SEQ ID NO: 8635 - DNA, 20 bp, Artificial Sequence
  Description of Artificial Sequence: Synthetic oligonucleotide
  Target: SCN10A; (+) strand; PAM type: NNGRRT; PAM sequence: CCGGGT
ctcactgcaacttctgcctc

SEQ ID NO: 8636 - DNA, 20 bp, Artificial Sequence
  Description of Artificial Sequence: Synthetic oligonucleotide
  Target: SCN10A; (+) strand; PAM type: NNGRRT; PAM sequence: TGGGGT
ctttcatattttagtagaga

SEQ ID NO: 8637 - DNA, 20 bp, Artificial Sequence
  Description of Artificial Sequence: Synthetic oligonucleotide
  Target: SCN10A; (+) strand; PAM type: NNGRRT; PAM sequence: TAGGAT
acctcggcctcccaaagtgc

SEQ ID NO: 8638 - DNA, 20 bp, Artificial Sequence
  Description of Artificial Sequence: Synthetic oligonucleotide
  Target: SCN10A; (+) strand; PAM type: NNGRRT; PAM sequence: CTGGGT
accactgcgcctggcccatc

SEQ ID NO: 8639 - DNA, 20 bp, Artificial Sequence
  Description of Artificial Sequence: Synthetic oligonucleotide
  Target: SCN10A; (+) strand; PAM type: NNGRRT; PAM sequence: GGGAGT
tttgctcccacccttgtcca

SEQ ID NO: 8640 - DNA, 20 bp, Artificial Sequence
  Description of Artificial Sequence: Synthetic oligonucleotide
  Target: SCN10A; (+) strand; PAM type: NNGRRT; PAM sequence: GGGAGT
ggaaaacctcgagaagcctg

SEQ ID NO: 8641 - DNA, 20 bp, Artificial Sequence
  Description of Artificial Sequence: Synthetic oligonucleotide
  Target: SCN10A; (+) strand; PAM type: NNGRRT; PAM sequence: CTGGGT
ggagggacagtgtgaggttg

SEQ ID NO: 8642 - DNA, 20 bp, Artificial Sequence
  Description of Artificial Sequence: Synthetic oligonucleotide
  Target: SCN10A; (+) strand; PAM type: NNGRRT; PAM sequence: CAGGGT
gtgatcgcctcttccagtac

SEQ ID NO: 8643 - DNA, 20 bp, Artificial Sequence
  Description of Artificial Sequence: Synthetic oligonucleotide
  Target: SCN10A; (+) strand; PAM type: NNGRRT; PAM sequence: ATGGGT
catttcaaatgcagactgat

SEQ ID NO: 8644 - DNA, 20 bp, Artificial Sequence
  Description of Artificial Sequence: Synthetic oligonucleotide
  Target: SCN10A; (+) strand; PAM type: NNGRRT; PAM sequence: TAGAAT
caaatgcagactgatatggg

SEQ ID NO: 8645 - DNA, 20 bp, Artificial Sequence
  Description of Artificial Sequence: Synthetic oligonucleotide
  Target: SCN10A; (+) strand; PAM type: NNGRRT; PAM sequence: GGGAAT
tgggctgagactcacctccc

SEQ ID NO: 8646 - DNA, 20 bp, Artificial Sequence
  Description of Artificial Sequence: Synthetic oligonucleotide
  Target: SCN10A; (+) strand; PAM type: NNGRRT; PAM sequence: GAGAGT
ggtggcccagtgagagagga

SEQ ID NO: 8647 - DNA, 20 bp, Artificial Sequence
  Description of Artificial Sequence: Synthetic oligonucleotide
  Target: SCN10A; (+) strand; PAM type: NNGRRT; PAM sequence: AAGAAT
ttggaaagggcttgtgcaga

SEQ ID NO: 8648 - DNA, 20 bp, Artificial Sequence
  Description of Artificial Sequence: Synthetic oligonucleotide
  Target: SCN10A; (+) strand; PAM type: NNGRRT; PAM sequence: TTGGGT
gaatgaaaggaaaagttccc

SEQ ID NO: 8649 - DNA, 20 bp, Artificial Sequence
  Description of Artificial Sequence: Synthetic oligonucleotide
  Target: SCN10A; (+) strand; PAM type: NNGRRT; PAM sequence: AAGAAT
aatcccacatgtggctgttt

SEQ ID NO: 8650 - DNA, 20 bp, Artificial Sequence
  Description of Artificial Sequence: Synthetic oligonucleotide
  Target: SCN10A; (+) strand; PAM type: NNGRRT; PAM sequence: TAGAGT
cacatgtggctgtttaagaa

SEQ ID NO: 8651 - DNA, 20 bp, Artificial Sequence
  Description of Artificial Sequence: Synthetic oligonucleotide
  Target: SCN10A; (+) strand; PAM type: NNGRRT; PAM sequence: CAGAAT
attaaagacacagagccttt

SEQ ID NO: 8652 - DNA, 20 bp, Artificial Sequence
  Description of Artificial Sequence: Synthetic oligonucleotide
  Target: SCN10A; (+) strand; PAM type: NNGRRT; PAM sequence: CTGAGT
aatgtagtatggactgagga

SEQ ID NO: 8653 - DNA, 20 bp, Artificial Sequence
  Description of Artificial Sequence: Synthetic oligonucleotide
  Target: SCN10A; (+) strand; PAM type: NNGRRT; PAM sequence: AAGAAT
ccaccttatgcacatgatgt

SEQ ID NO: 8654 - DNA, 20 bp, Artificial Sequence
  Description of Artificial Sequence: Synthetic oligonucleotide
  Target: SCN10A; (+) strand; PAM type: NNGRRT; PAM sequence: GAGAAT
atcttccagatggagaagtt

SEQ ID NO: 8655 - DNA, 20 bp, Artificial Sequence
  Description of Artificial Sequence: Synthetic oligonucleotide
  Target: SCN10A; (+) strand; PAM type: NNGRRT; PAM sequence: CTGGGT
gcattcttgaggtctagaaa

SEQ ID NO: 8656 - DNA, 20 bp, Artificial Sequence
  Description of Artificial Sequence: Synthetic oligonucleotide
  Target: SCN10A; (+) strand; PAM type: NNGRRT; PAM sequence: CTGAGT
tctgactgtatctcccaggg

SEQ ID NO: 8657 - DNA, 20 bp, Artificial Sequence
  Description of Artificial Sequence: Synthetic oligonucleotide
  Target: SCN10A; (+) strand; PAM type: NNGRRT; PAM sequence: TTGAAT
agctactcagagattatttg

SEQ ID NO: 8658 - DNA, 20 bp, Artificial Sequence
  Description of Artificial Sequence: Synthetic oligonucleotide
  Target: SCN10A; (+) strand; PAM type: NNGRRT; PAM sequence: TGGAAT
ataaatgcaagaaccaatgg

SEQ ID NO: 8659 - DNA, 20 bp, Artificial Sequence
  Description of Artificial Sequence: Synthetic oligonucleotide
  Target: SCN10A; (+) strand; PAM type: NNGRRT; PAM sequence: AAGAGT
atggtggaatgtagacactc

SEQ ID NO: 8660 - DNA, 20 bp, Artificial Sequence
  Description of Artificial Sequence: Synthetic oligonucleotide
  Target: SCN10A; (+) strand; PAM type: NNGRRT; PAM sequence: TTGAAT
ataagtaattgtattaacac

SEQ ID NO: 8661 - DNA, 20 bp, Artificial Sequence
  Description of Artificial Sequence: Synthetic oligonucleotide
  Target: SCN10A; (+) strand; PAM type: NNGRRT; PAM sequence: CTGAAT
acacttgaatgaacagagga

SEQ ID NO: 8662 - DNA, 20 bp, Artificial Sequence
  Description of Artificial Sequence: Synthetic oligonucleotide
  Target: SCN10A; (+) strand; PAM type: NNGRRT; PAM sequence: ATGAGT
caggtagatgaaggcaagaa

SEQ ID NO: 8663 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ggcaagaaatgagtgattga

SEQ ID NO: 8664 - DNA, 20 bp, Artificial Sequence
  Description of Artificial Sequence: Synthetic oligonucleotide
  Target: SCN10A; (+) strand; PAM type: NNGRRT; PAM sequence: CAGGAT
gatgatgaaagaaagaaaga

SEQ ID NO: 8665 - DNA, 20 bp, Artificial Sequence
  Description of Artificial Sequence: Synthetic oligonucleotide
  Target: SCN10A; (+) strand; PAM type: NNGRRT; PAM sequence: ATGAAT
atgaaagaaagaaagacagg

SEQ ID NO: 8666 - DNA, 20 bp, Artificial Sequence
  Description of Artificial Sequence: Synthetic oligonucleotide
  Target: SCN10A; (+) strand; PAM type: NNGRRT; PAM sequence: AGGAAT
agcctcatggtgtagtctgt

SEQ ID NO: 8667 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tggtgtagtctgtaggaata

SEQ ID NO: 8668 - DNA, 20 bp, Artificial Sequence
  Description of Artificial Sequence: Synthetic oligonucleotide
  Target: SCN10A; (+) strand; PAM type: NNGRRT; PAM sequence: CTGAGT
gagaatgacctcagttcaca

SEQ ID NO: 8669 - DNA, 20 bp, Artificial Sequence
  Description of Artificial Sequence: Synthetic oligonucleotide
  Target: SCN10A; (+) strand; PAM type: NNGRRT; PAM sequence: TGGAGT
gacccagaagaagctgccag

SEQ ID NO: 8670 - DNA, 20 bp, Artificial Sequence
  Description of Artificial Sequence: Synthetic oligonucleotide
  Target: SCN10A; (+) strand; PAM type: NNGRRT; PAM sequence: TTGAAT
aagaagctgccagtggagtt

SEQ ID NO: 8671 - DNA, 20 bp, Artificial Sequence
  Description of Artificial Sequence: Synthetic oligonucleotide
  Target: SCN10A; (+) strand; PAM type: NNGRRT; PAM sequence: ATGGAT
agacgaggaggacattcatg

SEQ ID NO: 8672 - DNA, 20 bp, Artificial Sequence
  Description of Artificial Sequence: Synthetic oligonucleotide
  Target: SCN10A; (+) strand; PAM type: NNGRRT; PAM sequence: TGGGAT
aggaggacattcatgatgga

SEQ ID NO: 8673 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ccaatgccccaccccctctg

SEQ ID NO: 8674 - DNA, 20 bp, Artificial Sequence
  Description of Artificial Sequence: Synthetic oligonucleotide
  Target: SCN10A; (+) strand; PAM type: NNGRRT; PAM sequence: GTGGGT
ctttggaagaagcaagagaa

SEQ ID NO: 8675 - DNA, 20 bp, Artificial Sequence
  Description of Artificial Sequence: Synthetic oligonucleotide
  Target: SCN10A; (+) strand; PAM type: NNGRRT; PAM sequence: ATGGAT
gagacattgggcagctgaag

SEQ ID NO: 8676 - DNA, 20 bp, Artificial Sequence
  Description of Artificial Sequence: Synthetic oligonucleotide
  Target: SCN10A; (+) strand; PAM type: NNGRRT; PAM sequence: CAGGGT
cttcttcccttaacctcatt

SEQ ID NO: 8677 - DNA, 20 bp, Artificial Sequence
  Description of Artificial Sequence: Synthetic oligonucleotide
  Target: SCN10A; (+) strand; PAM type: NNGRRT; PAM sequence: GTGGGT
ttcccttaacctcattcagg

SEQ ID NO: 8678 - DNA, 20 bp, Artificial Sequence
  Description of Artificial Sequence: Synthetic oligonucleotide
  Target: SCN10A; (+) strand; PAM type: NNGRRT; PAM sequence: ATGGAT
gggtgggttgcagtgagaag

SEQ ID NO: 8679 - DNA, 20 bp, Artificial Sequence
  Description of Artificial Sequence: Synthetic oligonucleotide
  Target: SCN10A; (+) strand; PAM type: NNGRRT; PAM sequence: ATGAGT
gggttgcagtgagaagatgg

SEQ ID NO: 8680 - DNA, 20 bp, Artificial Sequence
  Description of Artificial Sequence: Synthetic oligonucleotide
  Target: SCN10A; (+) strand; PAM type: NNGRRT; PAM sequence: GTGAGT
tactgcactcatttagaagt

SEQ ID NO: 8681 - DNA, 20 bp, Artificial Sequence
  Description of Artificial Sequence: Synthetic oligonucleotide
  Target: SCN10A; (+) strand; PAM type: NNGRRT; PAM sequence: GAGAAT
ttatttgtaaataagcaaat

SEQ ID NO: 8682 - DNA, 20 bp, Artificial Sequence
  Description of Artificial Sequence: Synthetic oligonucleotide
  Target: SCN10A; (+) strand; PAM type: NNGRRT; PAM sequence: TAGAAT
agaatctattagatacaaaa

SEQ ID NO: 8683 - DNA, 20 bp, Artificial Sequence
  Description of Artificial Sequence: Synthetic oligonucleotide
  Target: SCN10A; (+) strand; PAM type: NNGRRT; PAM sequence: TCGGGT
atttcaaactatttcaatct

SEQ ID NO: 8684 - DNA, 20 bp, Artificial Sequence
  Description of Artificial Sequence: Synthetic oligonucleotide
  Target: SCN10A; (+) strand; PAM type: NNGRRT; PAM sequence: GTGGGT
tttgtaattatgaggaagag

SEQ ID NO: 8685 - DNA, 20 bp, Artificial Sequence
  Description of Artificial Sequence: Synthetic oligonucleotide
  Target: SCN10A; (+) strand; PAM type: NNGRRT; PAM sequence: GTGGAT
caaggtggaggctgacagtg

SEQ ID NO: 8686 - DNA, 20 bp, Artificial Sequence
  Description of Artificial Sequence: Synthetic oligonucleotide
  Target: SCN10A; (+) strand; PAM type: NNGRRT; PAM sequence: AGGGGT
tgacagtggtggataaggaa

SEQ ID NO: 8687 - DNA, 20 bp, Artificial Sequence
  Description of Artificial Sequence: Synthetic oligonucleotide
  Target: SCN10A; (+) strand; PAM type: NNGRRT; PAM sequence: GTGGAT
agtggtggataaggaaaggg

SEQ ID NO: 8688 - DNA, 20 bp, Artificial Sequence
  Description of Artificial Sequence: Synthetic oligonucleotide
  Target: SCN10A; (+) strand; PAM type: NNGRRT; PAM sequence: GTGGGT
aggagagaagaagcattcca

SEQ ID NO: 8689 - DNA, 20 bp, Artificial Sequence
  Description of Artificial Sequence: Synthetic oligonucleotide
  Target: SCN10A; (+) strand; PAM type: NNGRRT; PAM sequence: TGGAGT
tgagctgatgatgtcactca

SEQ ID NO: 8690 - DNA, 20 bp, Artificial Sequence
  Description of Artificial Sequence: Synthetic oligonucleotide
  Target: SCN10A; (+) strand; PAM type: NNGRRT; PAM sequence: TGGGAT
tcatggaaagacagagaact

SEQ ID NO: 8691 - DNA, 20 bp, Artificial Sequence
  Description of Artificial Sequence: Synthetic oligonucleotide
  Target: SCN10A; (+) strand; PAM type: NNGRRT; PAM sequence: CAGAGT
gagatgttggcaataagagg

SEQ ID NO: 8692 - DNA, 20 bp, Artificial Sequence
  Description of Artificial Sequence: Synthetic oligonucleotide
  Target: SCN10A; (+) strand; PAM type: NNGRRT; PAM sequence: TTGGGT
gttggcaataagaggcagag

SEQ ID NO: 8693 - DNA, 20 bp, Artificial Sequence
  Description of Artificial Sequence: Synthetic oligonucleotide
  Target: SCN10A; (+) strand; PAM type: NNGRRT; PAM sequence: CAGGAT
atgcttgtggagcgatgatt

SEQ ID NO: 8694 - DNA, 20 bp, Artificial Sequence
  Description of Artificial Sequence: Synthetic oligonucleotide
  Target: SCN10A; (+) strand; PAM type: NNGRRT; PAM sequence: GGGGGT
attacttcactaagagcaaa

SEQ ID NO: 8695 - DNA, 20 bp, Artificial Sequence
  Description of Artificial Sequence: Synthetic oligonucleotide
  Target: SCN10A; (+) strand; PAM type: NNGRRT; PAM sequence: CTGGGT
aagagcaaagggggtgaggt

SEQ ID NO: 8696 - DNA, 20 bp, Artificial Sequence
  Description of Artificial Sequence: Synthetic oligonucleotide
  Target: SCN10A; (+) strand; PAM type: NNGRRT; PAM sequence: ATGGGT
tcctggtggctgtaatattt

SEQ ID NO: 8697 - DNA, 20 bp, Artificial Sequence
  Description of Artificial Sequence: Synthetic oligonucleotide
  Target: SCN10A; (+) strand; PAM type: NNGRRT; PAM sequence: GAGAGT
aagacttgaaagagaactaa

SEQ ID NO: 8698 - DNA, 20 bp, Artificial Sequence
  Description of Artificial Sequence: Synthetic oligonucleotide
  Target: SCN10A; (+) strand; PAM type: NNGRRT; PAM sequence: CAGGGT
ggaggtggggccccggagct

SEQ ID NO: 8699 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gccccggagctcagggttgg

SEQ ID NO: 8700 - DNA, 20 bp, Artificial Sequence
  Description of Artificial Sequence: Synthetic oligonucleotide
  Target: SCN10A; (+) strand; PAM type: NNGRRT; PAM sequence: AAGGGT
gatggagggcataaaggggg

SEQ ID NO: 8701 - DNA, 20 bp, Artificial Sequence
  Description of Artificial Sequence: Synthetic oligonucleotide
  Target: SCN10A; (+) strand; PAM type: NNGRRT; PAM sequence: CGGAGT
tttttgtttgttttttgagg

SEQ ID NO: 8702 - DNA, 20 bp, Artificial Sequence
  Description of Artificial Sequence: Synthetic oligonucleotide
  Target: SCN10A; (+) strand; PAM type: NNGRRT; PAM sequence: TGGAGT
tctcgctctgtcacccaggc

SEQ ID NO: 8703 - DNA, 20 bp, Artificial Sequence
  Description of Artificial Sequence: Synthetic oligonucleotide
  Target: SCN10A; (+) strand; PAM type: NNGRRT; PAM sequence: CAGGGT
ttttgtacttttagcagaga

SEQ ID NO: 8704 - DNA, 20 bp, Artificial Sequence
  Description of Artificial Sequence: Synthetic oligonucleotide
  Target: SCN10A; (+) strand; PAM type: NNGRRT; PAM sequence: CAGGGT
cagggtttcggcatgttggc

SEQ ID NO: 8705 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gcctcagcctcccaaagtgc

SEQ ID NO: 8706 - DNA, 20 bp, Artificial Sequence
  Description of Artificial Sequence: Synthetic oligonucleotide
  Target: SCN10A; (+) strand; PAM type: NNGRRT; PAM sequence: AAGGGT
cgcagtggccgcagagcgcg

SEQ ID NO: 8707 - DNA, 20 bp, Artificial Sequence
  Description of Artificial Sequence: Synthetic oligonucleotide
  Target: SCN10A; (+) strand; PAM type: NNGRRT; PAM sequence: CAGAAT
ggctttgatgggagccactt

SEQ ID NO: 8708 - DNA, 20 bp, Artificial Sequence
  Description of Artificial Sequence: Synthetic oligonucleotide
  Target: SCN10A; (+) strand; PAM type: NNGRRT; PAM sequence: CAGAAT
ggagccacttcagaatattc

SEQ ID NO: 8709 - DNA, 20 bp, Artificial Sequence
  Description of Artificial Sequence: Synthetic oligonucleotide
  Target: SCN10A; (+) strand; PAM type: NNGRRT; PAM sequence: CTGAGT
gtgagacttatcagtgagat

SEQ ID NO: 8710 - DNA, 20 bp, Artificial Sequence
  Description of Artificial Sequence: Synthetic oligonucleotide
  Target: SCN10A; (+) strand; PAM type: NNGRRT; PAM sequence: AAGAGT
actccaatgagaggtctaga

SEQ ID NO: 8711 - DNA, 20 bp, Artificial Sequence
  Description of Artificial Sequence: Synthetic oligonucleotide
  Target: SCN10A; (+) strand; PAM type: NNGRRT; PAM sequence: GAGAGT
tccctcctaggggctatgct

SEQ ID NO: 8712 - DNA, 20 bp, Artificial Sequence
  Description of Artificial Sequence: Synthetic oligonucleotide
  Target: SCN10A; (+) strand; PAM type: NNGRRT; PAM sequence: AGGAAT
tatgctgagagtctattctg

SEQ ID NO: 8713 - DNA, 20 bp, Artificial Sequence
  Description of Artificial Sequence: Synthetic oligonucleotide
  Target: SCN10A; (+) strand; PAM type: NNGRRT; PAM sequence: CTGAAT
attctgaggaatatagtaat

SEQ ID NO: 8714 - DNA, 20 bp, Artificial Sequence
  Description of Artificial Sequence: Synthetic oligonucleotide
  Target: SCN10A; (+) strand; PAM type: NNGRRT; PAM sequence: TGGGGT
attatatttgctcagagaag

SEQ ID NO: 8715 - DNA, 20 bp, Artificial Sequence
  Description of Artificial Sequence: Synthetic oligonucleotide
  Target: SCN10A; (+) strand; PAM type: NNGRRT; PAM sequence: AAGAAT
gctcagagaagtggggtgga

SEQ ID NO: 8716 - DNA, 20 bp, Artificial Sequence
  Description of Artificial Sequence: Synthetic oligonucleotide
  Target: SCN10A; (+) strand; PAM type: NNGRRT; PAM sequence: TTGGGT
ggggtggaaagaatagtggt

SEQ ID NO: 8717 - DNA, 20 bp, Artificial Sequence
  Description of Artificial Sequence: Synthetic oligonucleotide
  Target: SCN10A; (+) strand; PAM type: NNGRRT; PAM sequence: TGGGGT
ggaaagaatagtggtttggg

SEQ ID NO: 8718 - DNA, 20 bp, Artificial Sequence
  Description of Artificial Sequence: Synthetic oligonucleotide
  Target: SCN10A; (+) strand; PAM type: NNGRRT; PAM sequence: TTGGGT
aaccctgattttttgtgagc

SEQ ID NO: 8719 - DNA, 20 bp, Artificial Sequence
  Description of Artificial Sequence: Synthetic oligonucleotide
  Target: SCN10A; (+) strand; PAM type: NNGRRT; PAM sequence: CAGGGT
gggttagtgcctggctagtc

SEQ ID NO: 8720 - DNA, 20 bp, Artificial Sequence
  Description of Artificial Sequence: Synthetic oligonucleotide
  Target: SCN10A; (+) strand; PAM type: NNGRRT; PAM sequence: GAGAAT
aaatgaaaaagtcagactaa

SEQ ID NO: 8721 - DNA, 20 bp, Artificial Sequence
  Description of Artificial Sequence: Synthetic oligonucleotide
  Target: SCN10A; (+) strand; PAM type: NNGRRT; PAM sequence: ATGGGT
ttcttcaaaaagtttctggt

SEQ ID NO: 8722 - DNA, 20 bp, Artificial Sequence
  Description of Artificial Sequence: Synthetic oligonucleotide
  Target: SCN10A; (+) strand; PAM type: NNGRRT; PAM sequence: CTGAAT
gccacaccacagatggtggg

SEQ ID NO: 8723 - DNA, 20 bp, Artificial Sequence
  Description of Artificial Sequence: Synthetic oligonucleotide
  Target: SCN10A; (+) strand; PAM type: NNGRRT; PAM sequence: TGGGAT
agcttatcctggcagttagg

SEQ ID NO: 8724 - DNA, 20 bp, Artificial Sequence
  Description of Artificial Sequence: Synthetic oligonucleotide
  Target: SCN10A; (+) strand; PAM type: NNGRRT; PAM sequence: TTGAGT
agaaaagaagggctttatac

SEQ ID NO: 8725 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ccccaagcaatgtccattct

SEQ ID NO: 8726 - DNA, 20 bp, Artificial Sequence
  Description of Artificial Sequence: Synthetic oligonucleotide
  Target: SCN10A; (+) strand; PAM type: NNGRRT; PAM sequence: ATGAGT
aagcaatgtccattctttgg

SEQ ID NO: 8727 - DNA, 20 bp, Artificial Sequence
  Description of Artificial Sequence: Synthetic oligonucleotide
  Target: SCN10A; (+) strand; PAM type: NNGRRT; PAM sequence: CGGAAT
attgcaccaggacaaagaac

SEQ ID NO: 8728 - DNA, 20 bp, Artificial Sequence
  Description of Artificial Sequence: Synthetic oligonucleotide
  Target: SCN10A; (+) strand; PAM type: NNGRRT; PAM sequence: CTGGGT
agcaggtgagacccagctgc

SEQ ID NO: 8729 - DNA, 20 bp, Artificial Sequence
  Description of Artificial Sequence: Synthetic oligonucleotide
  Target: SCN10A; (+) strand; PAM type: NNGRRT; PAM sequence: GAGGGT
acccagctgcctgggtgcat

SEQ ID NO: 8730 - DNA, 20 bp, Artificial Sequence
  Description of Artificial Sequence: Synthetic oligonucleotide
  Target: SCN10A; (+) strand; PAM type: NNGRRT; PAM sequence: ATGGAT
ccctgggaagtctgcctcac

SEQ ID NO: 8731 - DNA, 20 bp, Artificial Sequence
  Description of Artificial Sequence: Synthetic oligonucleotide
  Target: SCN10A; (+) strand; PAM type: NNGRRT; PAM sequence: CAGGAT
cactggtactttatcaccct

SEQ ID NO: 8732 - DNA, 20 bp, Artificial Sequence
  Description of Artificial Sequence: Synthetic oligonucleotide
  Target: SCN10A; (+) strand; PAM type: NNGRRT; PAM sequence: AAGAAT
ctaatgccacctcccatagg

SEQ ID NO: 8733 - DNA, 20 bp, Artificial Sequence
  Description of Artificial Sequence: Synthetic oligonucleotide
  Target: SCN10A; (+) strand; PAM type: NNGRRT; PAM sequence: AAGAGT
attctcaaccaccccacccc

SEQ ID NO: 8734 - DNA, 20 bp, Artificial Sequence
  Description of Artificial Sequence: Synthetic oligonucleotide
  Target: SCN10A; (+) strand; PAM type: NNGRRT; PAM sequence: GTGAGT
agtgtaagatcctggagata

SEQ ID NO: 8735 - DNA, 20 bp, Artificial Sequence
  Description of Artificial Sequence: Synthetic oligonucleotide
  Target: SCN10A; (+) strand; PAM type: NNGRRT; PAM sequence: TAGGAT
tatagcaaatggaagaaaaa

SEQ ID NO: 8736 - DNA, 20 bp, Artificial Sequence
  Description of Artificial Sequence: Synthetic oligonucleotide
  Target: SCN10A; (+) strand; PAM type: NNGRRT; PAM sequence: TGGGAT
tggaagaaaaataggatcat

SEQ ID NO: 8737 - DNA, 20 bp, Artificial Sequence
  Description of Artificial Sequence: Synthetic oligonucleotide
  Target: SCN10A; (+) strand; PAM type: NNGRRT; PAM sequence: CTGGAT
aaagaaagaaagaagtacag

SEQ ID NO: 8738 - DNA, 20 bp, Artificial Sequence
  Description of Artificial Sequence: Synthetic oligonucleotide
  Target: SCN10A; (+) strand; PAM type: NNGRRT; PAM sequence: AAGGGT
tacagctggatgaaaagttg

SEQ ID NO: 8739 - DNA, 20 bp, Artificial Sequence
  Description of Artificial Sequence: Synthetic oligonucleotide
  Target: SCN10A; (+) strand; PAM type: NNGRRT; PAM sequence: AGGGAT
gttgaagggtgattgcatag

SEQ ID NO: 8740 - DNA, 20 bp, Artificial Sequence
  Description of Artificial Sequence: Synthetic oligonucleotide
  Target: SCN10A; (+) strand; PAM type: NNGRRT; PAM sequence: ATGAAT
aagggtgattgcatagaggg

SEQ ID NO: 8741 - DNA, 20 bp, Artificial Sequence
  Description of Artificial Sequence: Synthetic oligonucleotide
  Target: SCN10A; (+) strand; PAM type: NNGRRT; PAM sequence: AAGGAT
ttgcatagagggatgaatta

SEQ ID NO: 8742 - DNA, 20 bp, Artificial Sequence
  Description of Artificial Sequence: Synthetic oligonucleotide
  Target: SCN10A; (+) strand; PAM type: NNGRRT; PAM sequence: TAGGAT
ttaaaggatacaatgataaa

SEQ ID NO: 8743 - DNA, 20 bp, Artificial Sequence
  Description of Artificial Sequence: Synthetic oligonucleotide
  Target: SCN10A; (+) strand; PAM type: NNGRRT; PAM sequence: ATGAAT
ggatagatttaatgtataac

SEQ ID NO: 8744 - DNA, 20 bp, Artificial Sequence
  Description of Artificial Sequence: Synthetic oligonucleotide
  Target: SCN10A; (+) strand; PAM type: NNGRRT; PAM sequence: CTGAGT
gttttcagtatttttgctcg

SEQ ID NO: 8745 - DNA, 20 bp, Artificial Sequence
  Description of Artificial Sequence: Synthetic oligonucleotide
  Target: SCN10A; (+) strand; PAM type: NNGRRT; PAM sequence: ATGGGT
ctcttgccacagggggagaa

SEQ ID NO: 8746 - DNA, 20 bp, Artificial Sequence
  Description of Artificial Sequence: Synthetic oligonucleotide
  Target: SCN10A; (+) strand; PAM type: NNGRRT; PAM sequence: ATGGAT
atgggtaactatgtgagatg

SEQ ID NO: 8747 - DNA, 20 bp, Artificial Sequence
  Description of Artificial Sequence: Synthetic oligonucleotide
  Target: SCN10A; (+) strand; PAM type: NNGRRT; PAM sequence: TTGAAT
gtccccacccaaatcttatc

SEQ ID NO: 8748 - DNA, 20 bp, Artificial Sequence
  Description of Artificial Sequence: Synthetic oligonucleotide
  Target: SCN10A; (+) strand; PAM type: NNGRRT; PAM sequence: GTGAAT
agggaccctgtgggaggtaa

SEQ ID NO: 8749 - DNA, 20 bp, Artificial Sequence
  Description of Artificial Sequence: Synthetic oligonucleotide
  Target: SCN10A; (+) strand; PAM type: NNGRRT; PAM sequence: GTGAAT
cccatgctgttctcatgata

SEQ ID NO: 8750 - DNA, 20 bp, Artificial Sequence
  Description of Artificial Sequence: Synthetic oligonucleotide
  Target: SCN10A; (+) strand; PAM type: NNGRRT; PAM sequence: GGGAGT
gatgtgacggtattataagg

SEQ ID NO: 8751 - DNA, 20 bp, Artificial Sequence
  Description of Artificial Sequence: Synthetic oligonucleotide
  Target: SCN10A; (+) strand; PAM type: NNGRRT; PAM sequence: ATGGAT
aagataacagacacaaaaag

SEQ ID NO: 8752 - DNA, 20 bp, Artificial Sequence
  Description of Artificial Sequence: Synthetic oligonucleotide
  Target: SCN10A; (+) strand; PAM type: NNGRRT; PAM sequence: TAGGAT
aacagacacaaaaagatgga

SEQ ID NO: 8753 - DNA, 20 bp, Artificial Sequence
  Description of Artificial Sequence: Synthetic oligonucleotide
  Target: SCN10A; (+) strand; PAM type: NNGRRT; PAM sequence: TTGAAT
aagatggataggatagatag

SEQ ID NO: 8754 - DNA, 20 bp, Artificial Sequence
  Description of Artificial Sequence: Synthetic oligonucleotide
  Target: SCN10A; (+) strand; PAM type: NNGRRT; PAM sequence: AAGGAT
taggatagatagttgaatgg

SEQ ID NO: 8755 - DNA, 20 bp, Artificial Sequence
  Description of Artificial Sequence: Synthetic oligonucleotide
  Target: SCN10A; (+) strand; PAM type: NNGRRT; PAM sequence: GGGAAT
aaaggaaaagtatgaaagca

SEQ ID NO: 8756 - DNA, 20 bp, Artificial Sequence
  Description of Artificial Sequence: Synthetic oligonucleotide
  Target: SCN10A; (+) strand; PAM type: NNGRRT; PAM sequence: GTGAAT
aagtatgaaagcagggaata

SEQ ID NO: 8757 - DNA, 20 bp, Artificial Sequence
  Description of Artificial Sequence: Synthetic oligonucleotide
  Target: SCN10A; (+) strand; PAM type: NNGRRT; PAM sequence: ATGGAT
atgaaagcagggaatagtga

SEQ ID NO: 8758 - DNA, 20 bp, Artificial Sequence
  Description of Artificial Sequence: Synthetic oligonucleotide
  Target: SCN10A; (+) strand; PAM type: NNGRRT; PAM sequence: GTGGAT
tgaatggatagatgagatag

SEQ ID NO: 8759 - DNA, 20 bp, Artificial Sequence
  Description of Artificial Sequence: Synthetic oligonucleotide
  Target: SCN10A; (+) strand; PAM type: NNGRRT; PAM sequence: AAGGAT
atgagataggtggataagag

SEQ ID NO: 8760 - DNA, 20 bp, Artificial Sequence
  Description of Artificial Sequence: Synthetic oligonucleotide
  Target: SCN10A; (+) strand; PAM type: NNGRRT; PAM sequence: ATGGAT
gataggtggataagagaagg

SEQ ID NO: 8761 - DNA, 20 bp, Artificial Sequence
  Description of Artificial Sequence: Synthetic oligonucleotide
  Target: SCN10A; (+) strand; PAM type: NNGRRT; PAM sequence: CTGGGT
gataagagaaggatggatgg

SEQ ID NO: 8762 - DNA, 20 bp, Artificial Sequence
  Description of Artificial Sequence: Synthetic oligonucleotide
  Target: SCN10A; (+) strand; PAM type: NNGRRT; PAM sequence: ATGAAT
ctgggtaaaatgactaatgc

SEQ ID NO: 8763 - DNA, 20 bp, Artificial Sequence
  Description of Artificial Sequence: Synthetic oligonucleotide
  Target: SCN10A; (+) strand; PAM type: NNGRRT; PAM sequence: CAGAAT
tggaaagatggggagctgga

SEQ ID NO: 8764 - DNA, 20 bp, Artificial Sequence
  Description of Artificial Sequence: Synthetic oligonucleotide
  Target: SCN10A; (+) strand; PAM type: NNGRRT; PAM sequence: ATGAAT
tggggagctggacagaatag

SEQ ID NO: 8765 - DNA, 20 bp, Artificial Sequence
  Description of Artificial Sequence: Synthetic oligonucleotide
  Target: SCN10A; (+) strand; PAM type: NNGRRT; PAM sequence: TGGAAT
agctggacagaatagatgaa

SEQ ID NO: 8766 - DNA, 20 bp, Artificial Sequence
  Description of Artificial Sequence: Synthetic oligonucleotide
  Target: SCN10A; (+) strand; PAM type: NNGRRT; PAM sequence: GTGAAT
tagatgaatggaataaatta

SEQ ID NO: 8767 - DNA, 20 bp, Artificial Sequence
  Description of Artificial Sequence: Synthetic oligonucleotide
  Target: SCN10A; (+) strand; PAM type: NNGRRT; PAM sequence: TAGGAT
gtgaatgactggaaggttga

SEQ ID NO: 8768 - DNA, 20 bp, Artificial Sequence
  Description of Artificial Sequence: Synthetic oligonucleotide
  Target: SCN10A; (+) strand; PAM type: NNGRRT; PAM sequence: ATGGAT
atgactggaaggttgatagg

SEQ ID NO: 8769 - DNA, 20 bp, Artificial Sequence
  Description of Artificial Sequence: Synthetic oligonucleotide
  Target: SCN10A; (+) strand; PAM type: NNGRRT; PAM sequence: ATGAAT
ctggaaggttgataggatgg

SEQ ID NO: 8770 - DNA, 20 bp, Artificial Sequence
  Description of Artificial Sequence: Synthetic oligonucleotide
  Target: SCN10A; (+) strand; PAM type: NNGRRT; PAM sequence: ATGGAT
aaggttgataggatggatga

SEQ ID NO: 8771 - DNA, 20 bp, Artificial Sequence
  Description of Artificial Sequence: Synthetic oligonucleotide
  Target: SCN10A; (+) strand; PAM type: NNGRRT; PAM sequence: ATGAAT
ataggatggatgaatggatg

SEQ ID NO: 8772 - DNA, 20 bp, Artificial Sequence
  Description of Artificial Sequence: Synthetic oligonucleotide
  Target: SCN10A; (+) strand; PAM type: NNGRRT; PAM sequence: AGGGAT
ggatgatgaatggaagggaa

SEQ ID NO: 8773 - DNA, 20 bp, Artificial Sequence
  Description of Artificial Sequence: Synthetic oligonucleotide
  Target: SCN10A; (+) strand; PAM type: NNGRRT; PAM sequence: ATGAAT
gatgaatggaagggaaaggg

SEQ ID NO: 8774 - DNA, 20 bp, Artificial Sequence
  Description of Artificial Sequence: Synthetic oligonucleotide
  Target: SCN10A; (+) strand; PAM type: NNGRRT; PAM sequence: AAGAAT
acagataagtggaagaaagg

SEQ ID NO: 8775 - DNA, 20 bp, Artificial Sequence
  Description of Artificial Sequence: Synthetic oligonucleotide
  Target: SCN10A; (+) strand; PAM type: NNGRRT; PAM sequence: ATGGAT
gtggaagaaaggaagaatag

SEQ ID NO: 8776 - DNA, 20 bp, Artificial Sequence
  Description of Artificial Sequence: Synthetic oligonucleotide
  Target: SCN10A; (+) strand; PAM type: NNGRRT; PAM sequence: AAGAAT
atagatggataggttgaaac

SEQ ID NO: 8777 - DNA, 20 bp, Artificial Sequence
  Description of Artificial Sequence: Synthetic oligonucleotide
  Target: SCN10A; (+) strand; PAM type: NNGRRT; PAM sequence: AAGAAT
aaacaagaatggaaagatag

SEQ ID NO: 8778 - DNA, 20 bp, Artificial Sequence
  Description of Artificial Sequence: Synthetic oligonucleotide
  Target: SCN10A; (+) strand; PAM type: NNGRRT; PAM sequence: ATGAGT
aagaatggaaagatagaaga

SEQ ID NO: 8779 - DNA, 20 bp, Artificial Sequence
  Description of Artificial Sequence: Synthetic oligonucleotide
  Target: SCN10A; (+) strand; PAM type: NNGRRT; PAM sequence: GTGGAT
atggaaagatagaagaatga

SEQ ID NO: 8780 - DNA, 20 bp, Artificial Sequence
  Description of Artificial Sequence: Synthetic oligonucleotide
  Target: SCN10A; (+) strand; PAM type: NNGRRT; PAM sequence: AAGGAT
atagaagaatgagtggatag

SEQ ID NO: 8781 - DNA, 20 bp, Artificial Sequence
  Description of Artificial Sequence: Synthetic oligonucleotide
  Target: SCN10A; (+) strand; PAM type: NNGRRT; PAM sequence: ATGAGT
aagaatgagtggatagaagg

SEQ ID NO: 8782 - DNA, 20 bp, Artificial Sequence
  Description of Artificial Sequence: Synthetic oligonucleotide
  Target: SCN10A; (+) strand; PAM type: NNGRRT; PAM sequence: GTGAGT
atgagtggatagaaggatga

SEQ ID NO: 8783 - DNA, 20 bp, Artificial Sequence
  Description of Artificial Sequence: Synthetic oligonucleotide
  Target: SCN10A; (+) strand; PAM type: NNGRRT; PAM sequence: TTGGAT
atgagtgagtagaagcatgc

SEQ ID NO: 8784 - DNA, 20 bp, Artificial Sequence
  Description of Artificial Sequence: Synthetic oligonucleotide
  Target: SCN10A; (+) strand; PAM type: NNGRRT; PAM sequence: GTGAAT
catgcttggatggaagatgc

SEQ ID NO: 8785 - DNA, 20 bp, Artificial Sequence
  Description of Artificial Sequence: Synthetic oligonucleotide
  Target: SCN10A; (+) strand; PAM type: NNGRRT; PAM sequence: ATGAGT
cttggatggaagatgcgtga

SEQ ID NO: 8786 - DNA, 20 bp, Artificial Sequence
  Description of Artificial Sequence: Synthetic oligonucleotide
  Target: SCN10A; (+) strand; PAM type: NNGRRT; PAM sequence: CAGAAT
aagatgcgtgaatgagtgaa

SEQ ID NO: 8787 - DNA, 20 bp, Artificial Sequence
  Description of Artificial Sequence: Synthetic oligonucleotide
  Target: SCN10A; (+) strand; PAM type: NNGRRT; PAM sequence: TTGGAT
aatgttagatgattggacag

SEQ ID NO: 8788 - DNA, 20 bp, Artificial Sequence
  Description of Artificial Sequence: Synthetic oligonucleotide
  Target: SCN10A; (+) strand; PAM type: NNGRRT; PAM sequence: AAGAAT
atgattggacagttggatag

SEQ ID NO: 8789 - DNA, 20 bp, Artificial Sequence
  Description of Artificial Sequence: Synthetic oligonucleotide
  Target: SCN10A; (+) strand; PAM type: NNGRRT; PAM sequence: ATGAAT
ttggacagttggatagaaga

SEQ ID NO: 8790 - DNA, 20 bp, Artificial Sequence
  Description of Artificial Sequence: Synthetic oligonucleotide
  Target: SCN10A; (+) strand; PAM type: NNGRRT; PAM sequence: AAGGGT
atcaaaagatagaaagatat

SEQ ID NO: 8791 - DNA, 20 bp, Artificial Sequence
  Description of Artificial Sequence: Synthetic oligonucleotide
  Target: SCN10A; (+) strand; PAM type: NNGRRT; PAM sequence: AAGGAT
gatagaaagatataagggtt

SEQ ID NO: 8792 - DNA, 20 bp, Artificial Sequence
  Description of Artificial Sequence: Synthetic oligonucleotide
  Target: SCN10A; (+) strand; PAM type: NNGRRT; PAM sequence: ATGAAT
agatataagggttaaggatg

SEQ ID NO: 8793 - DNA, 20 bp, Artificial Sequence
  Description of Artificial Sequence: Synthetic oligonucleotide
  Target: SCN10A; (+) strand; PAM type: NNGRRT; PAM sequence: TAGAAT
tgaatagatggaaggaagtt

SEQ ID NO: 8794 - DNA, 20 bp, Artificial Sequence
  Description of Artificial Sequence: Synthetic oligonucleotide
  Target: SCN10A; (+) strand; PAM type: NNGRRT; PAM sequence: AAGAAT
gcagaagagaagagggaaag

SEQ ID NO: 8795 - DNA, 20 bp, Artificial Sequence
  Description of Artificial Sequence: Synthetic oligonucleotide
  Target: SCN10A; (+) strand; PAM type: NNGRRT; PAM sequence: GGGAAT
gagaagagggaaagaagaat

SEQ ID NO: 8796 - DNA, 20 bp, Artificial Sequence
  Description of Artificial Sequence: Synthetic oligonucleotide
  Target: SCN10A; (+) strand; PAM type: NNGRRT; PAM sequence: ATGGAT
agagggaaagaagaatggga

SEQ ID NO: 8797 - DNA, 20 bp, Artificial Sequence
  Description of Artificial Sequence: Synthetic oligonucleotide
  Target: SCN10A; (+) strand; PAM type: NNGRRT; PAM sequence: ATGGAT
ggaaagaagaatgggaatgg

SEQ ID NO: 8798 - DNA, 20 bp, Artificial Sequence
  Description of Artificial Sequence: Synthetic oligonucleotide
  Target: SCN10A; (+) strand; PAM type: NNGRRT; PAM sequence: ATGGAT
tacagctggaagaaataaag

SEQ ID NO: 8799 - DNA, 20 bp, Artificial Sequence
  Description of Artificial Sequence: Synthetic oligonucleotide
  Target: SCN10A; (+) strand; PAM type: NNGRRT; PAM sequence: ATGGAT
gctggaagaaataaagatgg

SEQ ID NO: 8800 - DNA, 20 bp, Artificial Sequence
  Description of Artificial Sequence: Synthetic oligonucleotide
  Target: SCN10A; (+) strand; PAM type: NNGRRT; PAM sequence: CTGAAT
ggaggaaggaaaaaggaaga

SEQ ID NO: 8801 - DNA, 20 bp, Artificial Sequence
  Description of Artificial Sequence: Synthetic oligonucleotide
  Target: SCN10A; (+) strand; PAM type: NNGRRT; PAM sequence: TTGGAT
gaaaaaggaagactgaatgg

SEQ ID NO: 8802 - DNA, 20 bp, Artificial Sequence
  Description of Artificial Sequence: Synthetic oligonucleotide
  Target: SCN10A; (+) strand; PAM type: NNGRRT; PAM sequence: AAGGAT
aaggtgaaatgtatggaagg

SEQ ID NO: 8803 - DNA, 20 bp, Artificial Sequence
  Description of Artificial Sequence: Synthetic oligonucleotide
  Target: SCN10A; (+) strand; PAM type: NNGRRT; PAM sequence: ATGGAT
tgaaatgtatggaaggaagg

SEQ ID NO: 8804 - DNA, 20 bp, Artificial Sequence
  Description of Artificial Sequence: Synthetic oligonucleotide
  Target: SCN10A; (+) strand; PAM type: NNGRRT; PAM sequence: AAGAAT
aaggatggatggttggaagg

SEQ ID NO: 8805 - DNA, 20 bp, Artificial Sequence
  Description of Artificial Sequence: Synthetic oligonucleotide
  Target: SCN10A; (+) strand; PAM type: NNGRRT; PAM sequence: ATGGAT
aaggaagaatcagtaggaag

SEQ ID NO: 8806 - DNA, 20 bp, Artificial Sequence
  Description of Artificial Sequence: Synthetic oligonucleotide
  Target: SCN10A; (+) strand; PAM type: NNGRRT; PAM sequence: ATGAGT
tcagtaggaagatggatgaa

SEQ ID NO: 8807 - DNA, 20 bp, Artificial Sequence
  Description of Artificial Sequence: Synthetic oligonucleotide
  Target: SCN10A; (+) strand; PAM type: NNGRRT; PAM sequence: AGGAGT
ctggtgagatcaacataagc

SEQ ID NO: 8808 - DNA, 20 bp, Artificial Sequence
  Description of Artificial Sequence: Synthetic oligonucleotide
  Target: SCN10A; (+) strand; PAM type: NNGRRT; PAM sequence: AGGGGT
aggagtgactgtgcccccaa

SEQ ID NO: 8809 - DNA, 20 bp, Artificial Sequence
  Description of Artificial Sequence: Synthetic oligonucleotide
  Target: SCN10A; (+) strand; PAM type: NNGRRT; PAM sequence: CGGAAT
cccccaaaggggtgggacac

SEQ ID NO: 8810 - DNA, 20 bp, Artificial Sequence
  Description of Artificial Sequence: Synthetic oligonucleotide
  Target: SCN10A; (+) strand; PAM type: NNGRRT; PAM sequence: ATGAAT
aaataattttcctttcattt

SEQ ID NO: 8811 - DNA, 20 bp, Artificial Sequence
  Description of Artificial Sequence: Synthetic oligonucleotide
  Target: SCN10A; (+) strand; PAM type: NNGRRT; PAM sequence: CAGAAT
gaataattatttcatatgca

SEQ ID NO: 8812 - DNA, 20 bp, Artificial Sequence
  Description of Artificial Sequence: Synthetic oligonucleotide
  Target: SCN10A; (+) strand; PAM type: NNGRRT; PAM sequence: GAGAAT
gcattggcatcagggaagaa

SEQ ID NO: 8813 - DNA, 20 bp, Artificial Sequence
  Description of Artificial Sequence: Synthetic oligonucleotide
  Target: SCN10A; (+) strand; PAM type: NNGRRT; PAM sequence: TTGAAT
ggcatcagggaagaagagaa

SEQ ID NO: 8814 - DNA, 20 bp, Artificial Sequence
  Description of Artificial Sequence: Synthetic oligonucleotide
  Target: SCN10A; (+) strand; PAM type: NNGRRT; PAM sequence: CAGAAT
tgccagcacaggaggctgga

SEQ ID NO: 8815 - DNA, 20 bp, Artificial Sequence
  Description of Artificial Sequence: Synthetic oligonucleotide
  Target: SCN10A; (+) strand; PAM type: NNGRRT; PAM sequence: TTGAGT
accttgctgctggcagctgc

SEQ ID NO: 8816 - DNA, 20 bp, Artificial Sequence
  Description of Artificial Sequence: Synthetic oligonucleotide
  Target: SCN10A; (+) strand; PAM type: NNGRRT; PAM sequence: AGGAAT
agatgaggaagagatgactg

SEQ ID NO: 8817 - DNA, 20 bp, Artificial Sequence
  Description of Artificial Sequence: Synthetic oligonucleotide
  Target: SCN10A; (+) strand; PAM type: NNGRRT; PAM sequence: AGGGAT
cacagtcaattctctaatgc

SEQ ID NO: 8818 - DNA, 20 bp, Artificial Sequence
  Description of Artificial Sequence: Synthetic oligonucleotide
  Target: SCN10A; (+) strand; PAM type: NNGRRT; PAM sequence: ATGAGT
attactggccacaggttacc

SEQ ID NO: 8819 - DNA, 20 bp, Artificial Sequence
  Description of Artificial Sequence: Synthetic oligonucleotide
  Target: SCN10A; (+) strand; PAM type: NNGRRT; PAM sequence: CAGAAT
ccacccaagaccaataagat

SEQ ID NO: 8820 - DNA, 20 bp, Artificial Sequence
  Description of Artificial Sequence: Synthetic oligonucleotide
  Target: SCN10A; (+) strand; PAM type: NNGRRT; PAM sequence: TGGGGT
accaataagatcagaatctc

SEQ ID NO: 8821 - DNA, 20 bp, Artificial Sequence
  Description of Artificial Sequence: Synthetic oligonucleotide
  Target: SCN10A; (+) strand; PAM type: NNGRRT; PAM sequence: ATGGAT
aaggtccagaagacccatct

SEQ ID NO: 8822 - DNA, 20 bp, Artificial Sequence
  Description of Artificial Sequence: Synthetic oligonucleotide
  Target: SCN10A; (+) strand; PAM type: NNGRRT; PAM sequence: TTGGAT
gctgcatgtgtcatctcact

SEQ ID NO: 8823 - DNA, 20 bp, Artificial Sequence
  Description of Artificial Sequence: Synthetic oligonucleotide
  Target: SCN10A; (+) strand; PAM type: NNGRRT; PAM sequence: GAGGAT
actttggatgtaaaaatgca

SEQ ID NO: 8824 - DNA, 20 bp, Artificial Sequence
  Description of Artificial Sequence: Synthetic oligonucleotide
  Target: SCN10A; (+) strand; PAM type: NNGRRT; PAM sequence: AGGGAT
gtaaaaatgcagaggattgc

SEQ ID NO: 8825 - DNA, 20 bp, Artificial Sequence
  Description of Artificial Sequence: Synthetic oligonucleotide
  Target: SCN10A; (+) strand; PAM type: NNGRRT; PAM sequence: CTGAAT
agaggattgcagggatcttt

SEQ ID NO: 8826 - DNA, 20 bp, Artificial Sequence
  Description of Artificial Sequence: Synthetic oligonucleotide
  Target: SCN10A; (+) strand; PAM type: NNGRRT; PAM sequence: ATGGGT
ctgcctggactttaccactc

SEQ ID NO: 8827 - DNA, 20 bp, Artificial Sequence
  Description of Artificial Sequence: Synthetic oligonucleotide
  Target: SCN10A; (+) strand; PAM type: NNGRRT; PAM sequence: TGGAGT
aaatgctcaaaacttttctt

SEQ ID NO: 8828 - DNA, 20 bp, Artificial Sequence
  Description of Artificial Sequence: Synthetic oligonucleotide
  Target: SCN10A; (+) strand; PAM type: NNGRRT; PAM sequence: AGGAGT
cctttgccctagctgtagcc

SEQ ID NO: 8829 - DNA, 20 bp, Artificial Sequence
  Description of Artificial Sequence: Synthetic oligonucleotide
  Target: SCN10A; (+) strand; PAM type: NNGRRT; PAM sequence: AAGGAT
tcaaaggcctggaaggaaga

SEQ ID NO: 8830 - DNA, 20 bp, Artificial Sequence
  Description of Artificial Sequence: Synthetic oligonucleotide
  Target: SCN10A; (+) strand; PAM type: NNGRRT; PAM sequence: CAGAAT
cctggaaggaagaaaggatg

SEQ ID NO: 8831 - DNA, 20 bp, Artificial Sequence
  Description of Artificial Sequence: Synthetic oligonucleotide
  Target: SCN10A; (+) strand; PAM type: NNGRRT; PAM sequence: GGGGAT
cctgaccacagtccctggaa

SEQ ID NO: 8832 - DNA, 20 bp, Artificial Sequence
  Description of Artificial Sequence: Synthetic oligonucleotide
  Target: SCN10A; (+) strand; PAM type: NNGRRT; PAM sequence: TGGGAT
tttgctgtggggaggtaaag

SEQ ID NO: 8833 - DNA, 20 bp, Artificial Sequence
  Description of Artificial Sequence: Synthetic oligonucleotide
  Target: SCN10A; (+) strand; PAM type: NNGRRT; PAM sequence: AGGGAT
acagccctgctgatacttgc

SEQ ID NO: 8834 - DNA, 20 bp, Artificial Sequence
  Description of Artificial Sequence: Synthetic oligonucleotide
  Target: SCN10A; (+) strand; PAM type: NNGRRT; PAM sequence: CTGAAT
tgctgatacttgcagggatg

SEQ ID NO: 8835 - DNA, 20 bp, Artificial Sequence
  Description of Artificial Sequence: Synthetic oligonucleotide
  Target: SCN10A; (+) strand; PAM type: NNGRRT; PAM sequence: TTGGAT
agaaagaaaaccttctcaaa

SEQ ID NO: 8836 - DNA, 20 bp, Artificial Sequence
  Description of Artificial Sequence: Synthetic oligonucleotide
  Target: SCN10A; (+) strand; PAM type: NNGRRT; PAM sequence: AGGGAT
ggattttggaagtgaaccaa

SEQ ID NO: 8837 - DNA, 20 bp, Artificial Sequence
  Description of Artificial Sequence: Synthetic oligonucleotide
  Target: SCN10A; (+) strand; PAM type: NNGRRT; PAM sequence: ACGGAT
gtttaaaaataaaagcatca

SEQ ID NO: 8838 - DNA, 20 bp, Artificial Sequence
  Description of Artificial Sequence: Synthetic oligonucleotide
  Target: SCN10A; (+) strand; PAM type: NNGRRT; PAM sequence: AAGAAT
cagtttacaaaaatgaaagt

SEQ ID NO: 8839 - DNA, 20 bp, Artificial Sequence
  Description of Artificial Sequence: Synthetic oligonucleotide
  Target: SCN10A; (+) strand; PAM type: NNGRRT; PAM sequence: AAGAAT
tcgccaacacacctctgaaa

SEQ ID NO: 8840 - DNA, 20 bp, Artificial Sequence
  Description of Artificial Sequence: Synthetic oligonucleotide
  Target: SCN10A; (+) strand; PAM type: NNGRRT; PAM sequence: AAGAAT
tcagactggtggagatggaa

SEQ ID NO: 8841 - DNA, 20 bp, Artificial Sequence
  Description of Artificial Sequence: Synthetic oligonucleotide
  Target: SCN10A; (+) strand; PAM type: NNGRRT; PAM sequence: TAGGAT
gaaaagaataggggaaaccc

SEQ ID NO: 8842 - DNA, 20 bp, Artificial Sequence
  Description of Artificial Sequence: Synthetic oligonucleotide
  Target: SCN10A; (+) strand; PAM type: NNGRRT; PAM sequence: CGGAGT
ttttttttttttttttgaga

SEQ ID NO: 8843 - DNA, 20 bp, Artificial Sequence
  Description of Artificial Sequence: Synthetic oligonucleotide
  Target: SCN10A; (+) strand; PAM type: NNGRRT; PAM sequence: TGGAGT
tctcgctctgtcgcccaggc

SEQ ID NO: 8844 - DNA, 20 bp, Artificial Sequence
  Description of Artificial Sequence: Synthetic oligonucleotide
  Target: SCN10A; (+) strand; PAM type: NNGRRT; PAM sequence: CGGGAT
cccaggctggagtgcagtag

SEQ ID NO: 8845 - DNA, 20 bp, Artificial Sequence
  Description of Artificial Sequence: Synthetic oligonucleotide
  Target: SCN10A; (+) strand; PAM type: NNGRRT; PAM sequence: CGGGGT
ttttgtatttttagtagaga

SEQ ID NO: 8846 - DNA, 20 bp, Artificial Sequence
  Description of Artificial Sequence: Synthetic oligonucleotide
  Target: SCN10A; (+) strand; PAM type: NNGRRT; PAM sequence: CGGGAT
cggggtttcaccgttttagc

SEQ ID NO: 8847 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gcctcagcctcccaaagtgc

SEQ ID NO: 8848 - DNA, 20 bp, Artificial Sequence
  Description of Artificial Sequence: Synthetic oligonucleotide
  Target: SCN10A; (+) strand; PAM type: NNGRRT; PAM sequence: AGGAGT
cactcttacaagtgactggc

SEQ ID NO: 8849 - DNA, 20 bp, Artificial Sequence
  Description of Artificial Sequence: Synthetic oligonucleotide
  Target: SCN10A; (+) strand; PAM type: NNGRRT; PAM sequence: GGGAGT
gcccctatccttcatctgct

SEQ ID NO: 8850 - DNA, 20 bp, Artificial Sequence
  Description of Artificial Sequence: Synthetic oligonucleotide
  Target: SCN10A; (+) strand; PAM type: NNGRRT; PAM sequence: ATGGAT
gtgtcggctgctaatagttc

SEQ ID NO: 8851 - DNA, 20 bp, Artificial Sequence
  Description of Artificial Sequence: Synthetic oligonucleotide
  Target: SCN10A; (+) strand; PAM type: NNGRRT; PAM sequence: GGGGAT
tcagccagggacagtgacag

SEQ ID NO: 8852 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ttgtgcttcagggctttcca

SEQ ID NO: 8853 - DNA, 20 bp, Artificial Sequence
  Description of Artificial Sequence: Synthetic oligonucleotide
  Target: SCN10A; (+) strand; PAM type: NNGRRT; PAM sequence: CCGGAT
ttccatgggatcagctgaag

SEQ ID NO: 8854 - DNA, 20 bp, Artificial Sequence
  Description of Artificial Sequence: Synthetic oligonucleotide
  Target: SCN10A; (+) strand; PAM type: NNGRRT; PAM sequence: GGGAGT
agattatccaacgtctctaa

SEQ ID NO: 8855 - DNA, 20 bp, Artificial Sequence
  Description of Artificial Sequence: Synthetic oligonucleotide
  Target: SCN10A; (+) strand; PAM type: NNGRRT; PAM sequence: GGGAAT
tctctaagggagtacacaca

SEQ ID NO: 8856 - DNA, 20 bp, Artificial Sequence
  Description of Artificial Sequence: Synthetic oligonucleotide
  Target: SCN10A; (+) strand; PAM type: NNGRRT; PAM sequence: TTGAGT
gaagtaaacatagagattgg

SEQ ID NO: 8857 - DNA, 20 bp, Artificial Sequence
  Description of Artificial Sequence: Synthetic oligonucleotide
  Target: SCN10A; (+) strand; PAM type: NNGRRT; PAM sequence: AGGAAT
attggttgagtaaattataa

SEQ ID NO: 8858 - DNA, 20 bp, Artificial Sequence
  Description of Artificial Sequence: Synthetic oligonucleotide
  Target: SCN10A; (+) strand; PAM type: NNGRRT; PAM sequence: TAGAAT
agaaaaatgtactgaggtta

SEQ ID NO: 8859 - DNA, 20 bp, Artificial Sequence
  Description of Artificial Sequence: Synthetic oligonucleotide
  Target: SCN10A; (+) strand; PAM type: NNGRRT; PAM sequence: GTGAGT
gtataccagcatgttttcaa

SEQ ID NO: 8860 - DNA, 20 bp, Artificial Sequence
  Description of Artificial Sequence: Synthetic oligonucleotide
  Target: SCN10A; (+) strand; PAM type: NNGRRT; PAM sequence: TTGAGT
gttttcaagtgagtttctct

SEQ ID NO: 8861 - DNA, 20 bp, Artificial Sequence
  Description of Artificial Sequence: Synthetic oligonucleotide
  Target: SCN10A; (+) strand; PAM type: NNGRRT; PAM sequence: ATGGAT
tctctttgagtgatagggaa

SEQ ID NO: 8862 - DNA, 20 bp, Artificial Sequence
  Description of Artificial Sequence: Synthetic oligonucleotide
  Target: SCN10A; (+) strand; PAM type: NNGRRT; PAM sequence: GGGAAT
gcaggtctgagcttcctcct

SEQ ID NO: 8863 - DNA, 20 bp, Artificial Sequence
  Description of Artificial Sequence: Synthetic oligonucleotide
  Target: SCN10A; (+) strand; PAM type: NNGRRT; PAM sequence: GGGGGT
agcttcctcctgggaatgtg

SEQ ID NO: 8864 - DNA, 20 bp, Artificial Sequence
  Description of Artificial Sequence: Synthetic oligonucleotide
  Target: SCN10A; (+) strand; PAM type: NNGRRT; PAM sequence: CGGGGT
tgggaatgtggggggtggac

SEQ ID NO: 8865 - DNA, 20 bp, Artificial Sequence
  Description of Artificial Sequence: Synthetic oligonucleotide
  Target: SCN10A; (+) strand; PAM type: NNGRRT; PAM sequence: CAGGAT
cacacagttccccctccacc

SEQ ID NO: 8866 - DNA, 20 bp, Artificial Sequence
  Description of Artificial Sequence: Synthetic oligonucleotide
  Target: SCN10A; (+) strand; PAM type: NNGRRT; PAM sequence: GAGAGT
tatttagtaggttgttttta

SEQ ID NO: 8867 - DNA, 20 bp, Artificial Sequence
  Description of Artificial Sequence: Synthetic oligonucleotide
  Target: SCN10A; (+) strand; PAM type: NNGRRT; PAM sequence: ATGAGT
aatgacacatgaggcgcaag

SEQ ID NO: 8868 - DNA, 20 bp, Artificial Sequence
  Description of Artificial Sequence: Synthetic oligonucleotide
  Target: SCN10A; (+) strand; PAM type: NNGRRT; PAM sequence: GTGAAT
tgagtgaaaacactgcagcc

SEQ ID NO: 8869 - DNA, 20 bp, Artificial Sequence
  Description of Artificial Sequence: Synthetic oligonucleotide
  Target: SCN10A; (+) strand; PAM type: NNGRRT; PAM sequence: GAGGAT
tttagaaaatgcaaacaact

SEQ ID NO: 8870 - DNA, 20 bp, Artificial Sequence
  Description of Artificial Sequence: Synthetic oligonucleotide
  Target: SCN10A; (+) strand; PAM type: NNGRRT; PAM sequence: CGGAGT
tgtctaccttggtctattgg

SEQ ID NO: 8871 - DNA, 20 bp, Artificial Sequence
  Description of Artificial Sequence: Synthetic oligonucleotide
  Target: SCN10A; (+) strand; PAM type: NNGRRT; PAM sequence: CTGAAT
cttagagatgtctcccaact

SEQ ID NO: 8872 - DNA, 20 bp, Artificial Sequence
  Description of Artificial Sequence: Synthetic oligonucleotide
  Target: SCN10A; (+) strand; PAM type: NNGRRT; PAM sequence: GTGGGT
aaggccttgttattcaaagt

SEQ ID NO: 8873 - DNA, 20 bp, Artificial Sequence
  Description of Artificial Sequence: Synthetic oligonucleotide
  Target: SCN10A; (+) strand; PAM type: NNGRRT; PAM sequence: TGGAAT
caggccctgccacagattta

SEQ ID NO: 8874 - DNA, 20 bp, Artificial Sequence
  Description of Artificial Sequence: Synthetic oligonucleotide
  Target: SCN10A; (+) strand; PAM type: NNGRRT; PAM sequence: GAGAAT
ctgccacagatttatggaat

SEQ ID NO: 8875 - DNA, 20 bp, Artificial Sequence
  Description of Artificial Sequence: Synthetic oligonucleotide
  Target: SCN10A; (+) strand; PAM type: NNGRRT; PAM sequence: AGGAGT
tgattttctgtgagctttaa

SEQ ID NO: 8876 - DNA, 20 bp, Artificial Sequence
  Description of Artificial Sequence: Synthetic oligonucleotide
  Target: SCN10A; (+) strand; PAM type: NNGRRT; PAM sequence: GAGGGT
gccgtgtgttggggaggtca

SEQ ID NO: 8877 - DNA, 20 bp, Artificial Sequence
  Description of Artificial Sequence: Synthetic oligonucleotide
  Target: SCN10A; (+) strand; PAM type: NNGRRT; PAM sequence: CGGGAT
gggtgggaagccaggggctt

SEQ ID NO: 8878 - DNA, 20 bp, Artificial Sequence
  Description of Artificial Sequence: Synthetic oligonucleotide
  Target: SCN10A; (+) strand; PAM type: NNGRRT; PAM sequence: CTGGGT
gggattaaataagggcaaag

SEQ ID NO: 8879 - DNA, 20 bp, Artificial Sequence
  Description of Artificial Sequence: Synthetic oligonucleotide
  Target: SCN10A; (+) strand; PAM type: NNGRRT; PAM sequence: TTGGGT
tgggttttgctactgacaag

SEQ ID NO: 8880 - DNA, 20 bp, Artificial Sequence
  Description of Artificial Sequence: Synthetic oligonucleotide
  Target: SCN10A; (+) strand; PAM type: NNGRRT; PAM sequence: TTGAGT
ggacaagccttttaaacatt

SEQ ID NO: 8881 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ctgatgcagctccagggcct

SEQ ID NO: 8882 - DNA, 20 bp, Artificial Sequence
  Description of Artificial Sequence: Synthetic oligonucleotide
  Target: SCN10A; (+) strand; PAM type: NNGRRT; PAM sequence: GAGGAT
ttgtaggagattcctatctg

SEQ ID NO: 8883 - DNA, 20 bp, Artificial Sequence
  Description of Artificial Sequence: Synthetic oligonucleotide
  Target: SCN10A; (+) strand; PAM type: NNGRRT; PAM sequence: CAGGAT
accagagatccactgctgag

SEQ ID NO: 8884 - DNA, 20 bp, Artificial Sequence
  Description of Artificial Sequence: Synthetic oligonucleotide
  Target: SCN10A; (+) strand; PAM type: NNGRRT; PAM sequence: GCGAAT
agtttgcagcagggacagtg

SEQ ID NO: 8885 - DNA, 20 bp, Artificial Sequence
  Description of Artificial Sequence: Synthetic oligonucleotide
  Target: SCN10A; (+) strand; PAM type: NNGRRT; PAM sequence: GTGGGT
gtggggagaggtgactgatg

SEQ ID NO: 8886 - DNA, 20 bp, Artificial Sequence
  Description of Artificial Sequence: Synthetic oligonucleotide
  Target: SCN10A; (+) strand; PAM type: NNGRRT; PAM sequence: GGGGAT
ggtgatggccagtgggcaaa

SEQ ID NO: 8887 - DNA, 20 bp, Artificial Sequence
  Description of Artificial Sequence: Synthetic oligonucleotide
  Target: SCN10A; (+) strand; PAM type: NNGRRT; PAM sequence: TGGAAT
cttggaaaaaaattctttcc

SEQ ID NO: 8888 - DNA, 20 bp, Artificial Sequence
  Description of Artificial Sequence: Synthetic oligonucleotide
  Target: SCN10A; (+) strand; PAM type: NNGRRT; PAM sequence: ATGGGT
aaaaaattctttcctggaat

SEQ ID NO: 8889 - DNA, 20 bp, Artificial Sequence
  Description of Artificial Sequence: Synthetic oligonucleotide
  Target: SCN10A; (+) strand; PAM type: NNGRRT; PAM sequence: AGGGGT
ttcctggaatatgggtgaag

SEQ ID NO: 8890 - DNA, 20 bp, Artificial Sequence
  Description of Artificial Sequence: Synthetic oligonucleotide
  Target: SCN10A; (+) strand; PAM type: NNGRRT; PAM sequence: GGGAGT
gtgaagaggggtcccttcca

SEQ ID NO: 8891 - DNA, 20 bp, Artificial Sequence
  Description of Artificial Sequence: Synthetic oligonucleotide
  Target: SCN10A; (+) strand; PAM type: NNGRRT; PAM sequence: GGGGGT
aagctacggcgtatgagcct

SEQ ID NO: 8892 - DNA, 20 bp, Artificial Sequence
  Description of Artificial Sequence: Synthetic oligonucleotide
  Target: SCN10A; (+) strand; PAM type: NNGRRT; PAM sequence: GGGGAT
tgagcctgggggtgcctgag

SEQ ID NO: 8893 - DNA, 20 bp, Artificial Sequence
  Description of Artificial Sequence: Synthetic oligonucleotide
  Target: SCN10A; (+) strand; PAM type: NNGRRT; PAM sequence: TGGGAT
actgagggccacgacgtggc

SEQ ID NO: 8894 - DNA, 20 bp, Artificial Sequence
  Description of Artificial Sequence: Synthetic oligonucleotide
  Target: SCN10A; (+) strand; PAM type: NNGRRT; PAM sequence: GGGGAT
ggccacgacgtggctgggat

SEQ ID NO: 8895 - DNA, 20 bp, Artificial Sequence
  Description of Artificial Sequence: Synthetic oligonucleotide
  Target: SCN10A; (+) strand; PAM type: NNGRRT; PAM sequence: TTGGGT
cgacgtggctgggatgggga

SEQ ID NO: 8896 - DNA, 20 bp, Artificial Sequence
  Description of Artificial Sequence: Synthetic oligonucleotide
  Target: SCN10A; (+) strand; PAM type: NNGRRT; PAM sequence: CAGGGT
cagcccagctcagcccagcc

SEQ ID NO: 8897 - DNA, 20 bp, Artificial Sequence
  Description of Artificial Sequence: Synthetic oligonucleotide
  Target: SCN10A; (+) strand; PAM type: NNGRRT; PAM sequence: TAGAAT
tgaggccacaattcccttta

SEQ ID NO: 8898 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tcattgcacaaatatttatt

SEQ ID NO: 8899 - DNA, 20 bp, Artificial Sequence
  Description of Artificial Sequence: Synthetic oligonucleotide
  Target: SCN10A; (+) strand; PAM type: NNGRRT; PAM sequence: CTGGGT
agatacatcatggccttcct

SEQ ID NO: 8900 - DNA, 20 bp, Artificial Sequence
  Description of Artificial Sequence: Synthetic oligonucleotide
  Target: SCN10A; (+) strand; PAM type: NNGRRT; PAM sequence: AAGAGT
ggtccttcatggtccaaatc

SEQ ID NO: 8901 - DNA, 20 bp, Artificial Sequence
  Description of Artificial Sequence: Synthetic oligonucleotide
  Target: SCN10A; (+) strand; PAM type: NNGRRT; PAM sequence: AGGGGT
ggctggtttagaactcacgg

SEQ ID NO: 8902 - DNA, 20 bp, Artificial Sequence
  Description of Artificial Sequence: Synthetic oligonucleotide
  Target: SCN10A; (+) strand; PAM type: NNGRRT; PAM sequence: GAGGGT
gaactcacggaggggttttt

SEQ ID NO: 8903 - DNA, 20 bp, Artificial Sequence
  Description of Artificial Sequence: Synthetic oligonucleotide
  Target: SCN10A; (+) strand; PAM type: NNGRRT; PAM sequence: GGGAGT
atgcgggcgccctcaagcct

SEQ ID NO: 8904 - DNA, 20 bp, Artificial Sequence
  Description of Artificial Sequence: Synthetic oligonucleotide
  Target: SCN10A; (+) strand; PAM type: NNGRRT; PAM sequence: GTGGAT
gcacagcttgtttgtcttct

SEQ ID NO: 8905 - DNA, 20 bp, Artificial Sequence
  Description of Artificial Sequence: Synthetic oligonucleotide
  Target: SCN10A; (+) strand; PAM type: NNGRRT; PAM sequence: GTGAGT
ttgtcttctgtggatcccag

SEQ ID NO: 8906 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ccaggtgagtgttcgctcaa

SEQ ID NO: 8907 - DNA, 20 bp, Artificial Sequence
  Description of Artificial Sequence: Synthetic oligonucleotide
  Target: SCN10A; (+) strand; PAM type: NNGRRT; PAM sequence: AGGGAT
tccaggtcatctgccagctc

SEQ ID NO: 8908 - DNA, 20 bp, Artificial Sequence
  Description of Artificial Sequence: Synthetic oligonucleotide
  Target: SCN10A; (+) strand; PAM type: NNGRRT; PAM sequence: CAGGAT
gccagctcagggatcttcct

SEQ ID NO: 8909 - DNA, 20 bp, Artificial Sequence
  Description of Artificial Sequence: Synthetic oligonucleotide
  Target: SCN10A; (+) strand; PAM type: NNGRRT; PAM sequence: CAGGAT
gatcttcctcaggatttcct

SEQ ID NO: 8910 - DNA, 20 bp, Artificial Sequence
  Description of Artificial Sequence: Synthetic oligonucleotide
  Target: SCN10A; (+) strand; PAM type: NNGRRT; PAM sequence: GGGAAT
tcgtctctccgcggggcccg

SEQ ID NO: 8911 - DNA, 20 bp, Artificial Sequence
  Description of Artificial Sequence: Synthetic oligonucleotide
  Target: SCN10A; (+) strand; PAM type: NNGRRT; PAM sequence: TGGAGT
taaaccttcggggcccctga

SEQ ID NO: 8912 - DNA, 20 bp, Artificial Sequence
  Description of Artificial Sequence: Synthetic oligonucleotide
  Target: SCN10A; (+) strand; PAM type: NNGRRT; PAM sequence: TTGAAT
actctcagcattcactgggc

SEQ ID NO: 8913 - DNA, 20 bp, Artificial Sequence
  Description of Artificial Sequence: Synthetic oligonucleotide
  Target: SCN10A; (+) strand; PAM type: NNGRRT; PAM sequence: TGGAGT
tgggcttgaatatttaatca

SEQ ID NO: 8914 - DNA, 20 bp, Artificial Sequence
  Description of Artificial Sequence: Synthetic oligonucleotide
  Target: SCN10A; (+) strand; PAM type: NNGRRT; PAM sequence: ATGAAT
cagccctataatgtctccag

SEQ ID NO: 8915 - DNA, 20 bp, Artificial Sequence
  Description of Artificial Sequence: Synthetic oligonucleotide
  Target: SCN10A; (+) strand; PAM type: NNGRRT; PAM sequence: AGGGGT
gtctccagatgaattcaatt

SEQ ID NO: 8916 - DNA, 20 bp, Artificial Sequence
  Description of Artificial Sequence: Synthetic oligonucleotide
  Target: SCN10A; (+) strand; PAM type: NNGRRT; PAM sequence: GCGGGT
taatggacccaaatggtggg

SEQ ID NO: 8917 - DNA, 20 bp, Artificial Sequence
  Description of Artificial Sequence: Synthetic oligonucleotide
  Target: SCN10A; (+) strand; PAM type: NNGRRT; PAM sequence: CGGGGT
tcaggcccctcctgcctagc

SEQ ID NO: 8918 - DNA, 20 bp, Artificial Sequence
  Description of Artificial Sequence: Synthetic oligonucleotide
  Target: SCN10A; (+) strand; PAM type: NNGRRT; PAM sequence: TTGAGT
gaagttgtgtactgaaaaca

SEQ ID NO: 8919 - DNA, 20 bp, Artificial Sequence
  Description of Artificial Sequence: Synthetic oligonucleotide
  Target: SCN10A; (+) strand; PAM type: NNGRRT; PAM sequence: GGGAGT
gagtagggacaactagccag

SEQ ID NO: 8920 - DNA, 20 bp, Artificial Sequence
  Description of Artificial Sequence: Synthetic oligonucleotide
  Target: SCN10A; (+) strand; PAM type: NNGRRT; PAM sequence: CAGAAT
agaagcatgacatccacgtg

SEQ ID NO: 8921 - DNA, 20 bp, Artificial Sequence
  Description of Artificial Sequence: Synthetic oligonucleotide
  Target: SCN10A; (+) strand; PAM type: NNGRRT; PAM sequence: GGGGAT
ctgaagggcttgataacttt

SEQ ID NO: 8922 - DNA, 20 bp, Artificial Sequence
  Description of Artificial Sequence: Synthetic oligonucleotide
  Target: SCN10A; (+) strand; PAM type: NNGRRT; PAM sequence: ATGAAT
agggcttgataactttgggg

SEQ ID NO: 8923 - DNA, 20 bp, Artificial Sequence
  Description of Artificial Sequence: Synthetic oligonucleotide
  Target: SCN10A; (+) strand; PAM type: NNGRRT; PAM sequence: TTGAAT
ctaggtgtcaaattaaattc

SEQ ID NO: 8924 - DNA, 20 bp, Artificial Sequence
  Description of Artificial Sequence: Synthetic oligonucleotide
  Target: SCN10A; (+) strand; PAM type: NNGRRT; PAM sequence: GAGAAT
gtggacaaaagaaagtgggg

SEQ ID NO: 8925 - DNA, 20 bp, Artificial Sequence
  Description of Artificial Sequence: Synthetic oligonucleotide
  Target: SCN10A; (+) strand; PAM type: NNGRRT; PAM sequence: ATGAAT
attaccattcagtttcatag

SEQ ID NO: 8926 - DNA, 20 bp, Artificial Sequence
  Description of Artificial Sequence: Synthetic oligonucleotide
  Target: SCN10A; (+) strand; PAM type: NNGRRT; PAM sequence: TGGAGT
atcttaggtcccacagcttg

SEQ ID NO: 8927 - DNA, 20 bp, Artificial Sequence
  Description of Artificial Sequence: Synthetic oligonucleotide
  Target: SCN10A; (+) strand; PAM type: NNGRRT; PAM sequence: TGGAGT
ttctatacctagaaccaccc

SEQ ID NO: 8928 - DNA, 20 bp, Artificial Sequence
  Description of Artificial Sequence: Synthetic oligonucleotide
  Target: SCN10A; (+) strand; PAM type: NNGRRT; PAM sequence: GCGGAT
atggtgaaagttgaaattgt

SEQ ID NO: 8929 - DNA, 20 bp, Artificial Sequence
  Description of Artificial Sequence: Synthetic oligonucleotide
  Target: SCN10A; (+) strand; PAM type: NNGRRT; PAM sequence: CAGGAT
ggagggactttaaaaattcc

SEQ ID NO: 8930 - DNA, 20 bp, Artificial Sequence
  Description of Artificial Sequence: Synthetic oligonucleotide
  Target: SCN10A; (+) strand; PAM type: NNGRRT; PAM sequence: TTGAGT
taagaaatgaggttatgtga

SEQ ID NO: 8931 - DNA, 20 bp, Artificial Sequence
  Description of Artificial Sequence: Synthetic oligonucleotide
  Target: SCN10A; (+) strand; PAM type: NNGRRT; PAM sequence: TGGAAT
ttatgtgattgagtgcagtc

SEQ ID NO: 8932 - DNA, 20 bp, Artificial Sequence
  Description of Artificial Sequence: Synthetic oligonucleotide
  Target: SCN10A; (+) strand; PAM type: NNGRRT; PAM sequence: AGGGAT
catctttccacgtctcaccc

SEQ ID NO: 8933 - DNA, 20 bp, Artificial Sequence
  Description of Artificial Sequence: Synthetic oligonucleotide
  Target: SCN10A; (+) strand; PAM type: NNGRRT; PAM sequence: CTGGGT
atgttccagtgcctgggctc

SEQ ID NO: 8934 - DNA, 20 bp, Artificial Sequence
  Description of Artificial Sequence: Synthetic oligonucleotide
  Target: SCN10A; (+) strand; PAM type: NNGRRT; PAM sequence: GAGGGT
agctgctcctgctagtgaga

SEQ ID NO: 8935 - DNA, 20 bp, Artificial Sequence
  Description of Artificial Sequence: Synthetic oligonucleotide
  Target: SCN10A; (+) strand; PAM type: NNGRRT; PAM sequence: CTGGGT
ctagtgagagagggtcccaa

SEQ ID NO: 8936 - DNA, 20 bp, Artificial Sequence
  Description of Artificial Sequence: Synthetic oligonucleotide
  Target: SCN10A; (+) strand; PAM type: NNGRRT; PAM sequence: AGGGAT
atgaccagttctaaatttga

SEQ ID NO: 8937 - DNA, 20 bp, Artificial Sequence
  Description of Artificial Sequence: Synthetic oligonucleotide
  Target: SCN10A; (+) strand; PAM type: NNGRRT; PAM sequence: AAGAGT
catcacaggctgccagagcc

SEQ ID NO: 8938 - DNA, 20 bp, Artificial Sequence
  Description of Artificial Sequence: Synthetic oligonucleotide
  Target: SCN10A; (+) strand; PAM type: NNGRRT; PAM sequence: CTGAGT
caaagtaactgaaaatgctt

SEQ ID NO: 8939 - DNA, 20 bp, Artificial Sequence
  Description of Artificial Sequence: Synthetic oligonucleotide
  Target: SCN10A; (+) strand; PAM type: NNGRRT; PAM sequence: CAGAGT
tgagtggcagacagctgtca

SEQ ID NO: 8940 - DNA, 20 bp, Artificial Sequence
  Description of Artificial Sequence: Synthetic oligonucleotide
  Target: SCN10A; (+) strand; PAM type: NNGRRT; PAM sequence: CAGGGT
tgcatgttcctgaggcctca

SEQ ID NO: 8941 - DNA, 20 bp, Artificial Sequence
  Description of Artificial Sequence: Synthetic oligonucleotide
  Target: SCN10A; (+) strand; PAM type: NNGRRT; PAM sequence: GTGAAT
ccttcccacgttgggcagag

SEQ ID NO: 8942 - DNA, 20 bp, Artificial Sequence
  Description of Artificial Sequence: Synthetic oligonucleotide
  Target: SCN10A; (+) strand; PAM type: NNGRRT; PAM sequence: CTGAGT
gttgggcagaggtgaatgcc

SEQ ID NO: 8943 - DNA, 20 bp, Artificial Sequence
  Description of Artificial Sequence: Synthetic oligonucleotide
  Target: SCN10A; (+) strand; PAM type: NNGRRT; PAM sequence: GAGGGT
gttactgagaagaggttagc

SEQ ID NO: 8944 - DNA, 20 bp, Artificial Sequence
  Description of Artificial Sequence: Synthetic oligonucleotide
  Target: SCN10A; (+) strand; PAM type: NNGRRT; PAM sequence: AGGAAT
tataccagcttaaggtagta

SEQ ID NO: 8945 - DNA, 20 bp, Artificial Sequence
  Description of Artificial Sequence: Synthetic oligonucleotide
  Target: SCN10A; (+) strand; PAM type: NNGRRT; PAM sequence: ATGAGT
tgtggggaaaagctggctaa

SEQ ID NO: 8946 - DNA, 20 bp, Artificial Sequence
  Description of Artificial Sequence: Synthetic oligonucleotide
  Target: SCN10A; (+) strand; PAM type: NNGRRT; PAM sequence: AAGAAT
gctggctaaatgagtcacat

SEQ ID NO: 8947 - DNA, 20 bp, Artificial Sequence
  Description of Artificial Sequence: Synthetic oligonucleotide
  Target: SCN10A; (+) strand; PAM type: NNGRRT; PAM sequence: TAGGAT
acataagaatcaggacttct

SEQ ID NO: 8948 - DNA, 20 bp, Artificial Sequence
  Description of Artificial Sequence: Synthetic oligonucleotide
  Target: SCN10A; (+) strand; PAM type: NNGRRT; PAM sequence: CTGGGT
tagcatctcatgcacagagc

SEQ ID NO: 8949 - DNA, 20 bp, Artificial Sequence
  Description of Artificial Sequence: Synthetic oligonucleotide
  Target: SCN10A; (+) strand; PAM type: NNGRRT; PAM sequence: GGGAAT
actccctgtttgtctgcctg

SEQ ID NO: 8950 - DNA, 20 bp, Artificial Sequence
  Description of Artificial Sequence: Synthetic oligonucleotide
  Target: SCN10A; (+) strand; PAM type: NNGRRT; PAM sequence: GGGGAT
actgcctgtggctgtccctt

SEQ ID NO: 8951 - DNA, 20 bp, Artificial Sequence
  Description of Artificial Sequence: Synthetic oligonucleotide
  Target: SCN10A; (+) strand; PAM type: NNGRRT; PAM sequence: GGGGAT
ataactcttacctgtccttt

SEQ ID NO: 8952 - DNA, 20 bp, Artificial Sequence
  Description of Artificial Sequence: Synthetic oligonucleotide
  Target: SCN10A; (+) strand; PAM type: NNGRRT; PAM sequence: TCGGAT
gggcacagagacccacacag

SEQ ID NO: 8953 - DNA, 20 bp, Artificial Sequence
  Description of Artificial Sequence: Synthetic oligonucleotide
  Target: SCN10A; (+) strand; PAM type: NNGRRT; PAM sequence: GAGAGT
ggttctcagccttggagctg

SEQ ID NO: 8954 - DNA, 20 bp, Artificial Sequence
  Description of Artificial Sequence: Synthetic oligonucleotide
  Target: SCN10A; (+) strand; PAM type: NNGRRT; PAM sequence: GGGAGT
cagccttggagctggagagt

SEQ ID NO: 8955 - DNA, 20 bp, Artificial Sequence
  Description of Artificial Sequence: Synthetic oligonucleotide
  Target: SCN10A; (+) strand; PAM type: NNGRRT; PAM sequence: GGGAAT
caggctctgccttgggctgg

SEQ ID NO: 8956 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ttggtacgatggccaaagac

SEQ ID NO: 8957 - DNA, 20 bp, Artificial Sequence
  Description of Artificial Sequence: Synthetic oligonucleotide
  Target: SCN10A; (+) strand; PAM type: NNGRRT; PAM sequence: AAGAGT
tgtgaggttgtcagcactga

SEQ ID NO: 8958 - DNA, 20 bp, Artificial Sequence
  Description of Artificial Sequence: Synthetic oligonucleotide
  Target: SCN10A; (+) strand; PAM type: NNGRRT; PAM sequence: AGGAAT
aggttaagcacctgaagaga

SEQ ID NO: 8959 - DNA, 20 bp, Artificial Sequence
  Description of Artificial Sequence: Synthetic oligonucleotide
  Target: SCN10A; (+) strand; PAM type: NNGRRT; PAM sequence: CCGGGT
ctgagccccacattggccta

SEQ ID NO: 8960 - DNA, 20 bp, Artificial Sequence
  Description of Artificial Sequence: Synthetic oligonucleotide
  Target: SCN10A; (+) strand; PAM type: NNGRRT; PAM sequence: CGGGAT
tgggcctcttcctgcccacc

SEQ ID NO: 8961 - DNA, 20 bp, Artificial Sequence
  Description of Artificial Sequence: Synthetic oligonucleotide
  Target: SCN10A; (+) strand; PAM type: NNGRRT; PAM sequence: GGGAAT
cgggatgctgtcccttttgg

SEQ ID NO: 8962 - DNA, 20 bp, Artificial Sequence
  Description of Artificial Sequence: Synthetic oligonucleotide
  Target: SCN10A; (+) strand; PAM type: NNGRRT; PAM sequence: GGGGAT
gagcagttgagggaaagttt

SEQ ID NO: 8963 - DNA, 20 bp, Artificial Sequence
  Description of Artificial Sequence: Synthetic oligonucleotide
  Target: SCN10A; (+) strand; PAM type: NNGRRT; PAM sequence: TGGAGT
gggaaagtttggggatgtcc

SEQ ID NO: 8964 - DNA, 20 bp, Artificial Sequence
  Description of Artificial Sequence: Synthetic oligonucleotide
  Target: SCN10A; (+) strand; PAM type: NNGRRT; PAM sequence: TGGAAT
ctgggctctgttcctgactc

SEQ ID NO: 8965 - DNA, 20 bp, Artificial Sequence
  Description of Artificial Sequence: Synthetic oligonucleotide
  Target: SCN10A; (+) strand; PAM type: NNGRRT; PAM sequence: AGGGGT
agaaatgtaaaagtgctcag

SEQ ID NO: 8966 - DNA, 20 bp, Artificial Sequence
  Description of Artificial Sequence: Synthetic oligonucleotide
  Target: SCN10A; (+) strand; PAM type: NNGRRT; PAM sequence: GAGGGT
gaggggtaaacttcctgtct

SEQ ID NO: 8967 - DNA, 20 bp, Artificial Sequence
  Description of Artificial Sequence: Synthetic oligonucleotide
  Target: SCN10A; (+) strand; PAM type: NNGRRT; PAM sequence: AGGGAT
aggggcatctgtggctctgc

SEQ ID NO: 8968 - DNA, 20 bp, Artificial Sequence
  Description of Artificial Sequence: Synthetic oligonucleotide
  Target: SCN10A; (+) strand; PAM type: NNGRRT; PAM sequence: CAGAGT
gtgggctcagcctggaagaa

SEQ ID NO: 8969 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gcctggaagaacagagtttc

SEQ ID NO: 8970 - DNA, 20 bp, Artificial Sequence
  Description of Artificial Sequence: Synthetic oligonucleotide
  Target: SCN10A; (+) strand; PAM type: NNGRRT; PAM sequence: CAGGGT
ggcatccctggctcaggcac

SEQ ID NO: 8971 - DNA, 20 bp, Artificial Sequence
  Description of Artificial Sequence: Synthetic oligonucleotide
  Target: SCN10A; (+) strand; PAM type: NNGRRT; PAM sequence: AAGAGT
caccagggtggaaaagacta

SEQ ID NO: 8972 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ggtggaaaagactaaagagt

SEQ ID NO: 8973 - DNA, 20 bp, Artificial Sequence
  Description of Artificial Sequence: Synthetic oligonucleotide
  Target: SCN10A; (+) strand; PAM type: NNGRRT; PAM sequence: CAGAGT
ggcaaggaccccaccatgac

SEQ ID NO: 8974 - DNA, 20 bp, Artificial Sequence
  Description of Artificial Sequence: Synthetic oligonucleotide
  Target: SCN10A; (+) strand; PAM type: NNGRRT; PAM sequence: GTGGGT
aggaccccaccatgaccaga

SEQ ID NO: 8975 - DNA, 20 bp, Artificial Sequence
  Description of Artificial Sequence: Synthetic oligonucleotide
  Target: SCN10A; (+) strand; PAM type: NNGRRT; PAM sequence: AGGGGT
gggccaggctggggcggaga

SEQ ID NO: 8976 - DNA, 20 bp, Artificial Sequence
  Description of Artificial Sequence: Synthetic oligonucleotide
  Target: SCN10A; (+) strand; PAM type: NNGRRT; PAM sequence: GTGAGT
gtattggggcttattggcaa

SEQ ID NO: 8977 - DNA, 20 bp, Artificial Sequence
  Description of Artificial Sequence: Synthetic oligonucleotide
  Target: SCN10A; (+) strand; PAM type: NNGRRT; PAM sequence: TGGAGT
agaggggcttcctccaaaca

SEQ ID NO: 8978 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ttgttattatttctgtggcc

SEQ ID NO: 8979 - DNA, 20 bp, Artificial Sequence
  Description of Artificial Sequence: Synthetic oligonucleotide
  Target: SCN10A; (+) strand; PAM type: NNGRRT; PAM sequence: CTGAAT
atcagtcagctcttacttcc

SEQ ID NO: 8980 - DNA, 20 bp, Artificial Sequence
  Description of Artificial Sequence: Synthetic oligonucleotide
  Target: SCN10A; (+) strand; PAM type: NNGRRT; PAM sequence: TTGAGT
cagctaatagacaccgttta

SEQ ID NO: 8981 - DNA, 20 bp, Artificial Sequence
  Description of Artificial Sequence: Synthetic oligonucleotide
  Target: SCN10A; (+) strand; PAM type: NNGRRT; PAM sequence: ATGAGT
ttaattctcccagtaaaccc

SEQ ID NO: 8982 - DNA, 20 bp, Artificial Sequence
  Description of Artificial Sequence: Synthetic oligonucleotide
  Target: SCN10A; (+) strand; PAM type: NNGRRT; PAM sequence: TGGGGT
aggagattaagtctcttgcc

SEQ ID NO: 8983 - DNA, 20 bp, Artificial Sequence
  Description of Artificial Sequence: Synthetic oligonucleotide
  Target: SCN10A; (+) strand; PAM type: NNGRRT; PAM sequence: ATGAAT
cccaaggcacacttcttgta

SEQ ID NO: 8984 - DNA, 20 bp, Artificial Sequence
  Description of Artificial Sequence: Synthetic oligonucleotide
  Target: SCN10A; (+) strand; PAM type: NNGRRT; PAM sequence: ATGAAT
cttcttgtaatgaatcccac

SEQ ID NO: 8985 - DNA, 20 bp, Artificial Sequence
  Description of Artificial Sequence: Synthetic oligonucleotide
  Target: SCN10A; (+) strand; PAM type: NNGRRT; PAM sequence: CAGGGT
ccaggagacagtgcccccag

SEQ ID NO: 8986 - DNA, 20 bp, Artificial Sequence
  Description of Artificial Sequence: Synthetic oligonucleotide
  Target: SCN10A; (+) strand; PAM type: NNGRRT; PAM sequence: AAGGAT
agcaccatcaccgtcaagaa

SEQ ID NO: 8987 - DNA, 20 bp, Artificial Sequence
  Description of Artificial Sequence: Synthetic oligonucleotide
  Target: SCN10A; (+) strand; PAM type: NNGRRT; PAM sequence: ATGGAT
tcaagaaaaggatgaggcat

SEQ ID NO: 8988 - DNA, 20 bp, Artificial Sequence
  Description of Artificial Sequence: Synthetic oligonucleotide
  Target: SCN10A; (+) strand; PAM type: NNGRRT; PAM sequence: GAGGAT
ttctcaatccactctccaca

SEQ ID NO: 8989 - DNA, 20 bp, Artificial Sequence
  Description of Artificial Sequence: Synthetic oligonucleotide
  Target: SCN10A; (+) strand; PAM type: NNGRRT; PAM sequence: AAGAGT
gatacggaagacaatgagga

SEQ ID NO: 8990 - DNA, 20 bp, Artificial Sequence
  Description of Artificial Sequence: Synthetic oligonucleotide
  Target: SCN10A; (+) strand; PAM type: NNGRRT; PAM sequence: CAGGAT
aagacaaagacaatgatggc

SEQ ID NO: 8991 - DNA, 20 bp, Artificial Sequence
  Description of Artificial Sequence: Synthetic oligonucleotide
  Target: SCN10A; (+) strand; PAM type: NNGRRT; PAM sequence: CTGAGT
gaggttccccagtgccccca

SEQ ID NO: 8992 - DNA, 20 bp, Artificial Sequence
  Description of Artificial Sequence: Synthetic oligonucleotide
  Target: SCN10A; (+) strand; PAM type: NNGRRT; PAM sequence: ATGAGT
ctgagtttccgatgatcttg

SEQ ID NO: 8993 - DNA, 20 bp, Artificial Sequence
  Description of Artificial Sequence: Synthetic oligonucleotide
  Target: SCN10A; (+) strand; PAM type: NNGRRT; PAM sequence: CAGGAT
tgagtgtgtttaaggtgggc

SEQ ID NO: 8994 - DNA, 20 bp, Artificial Sequence
  Description of Artificial Sequence: Synthetic oligonucleotide
  Target: SCN10A; (+) strand; PAM type: NNGRRT; PAM sequence: TTGAAT
tgggccaggatttggccagc

SEQ ID NO: 8995 - DNA, 20 bp, Artificial Sequence
  Description of Artificial Sequence: Synthetic oligonucleotide
  Target: SCN10A; (+) strand; PAM type: NNGRRT; PAM sequence: CTGAGT
atgtgcttcattgactgtgg

SEQ ID NO: 8996 - DNA, 20 bp, Artificial Sequence
  Description of Artificial Sequence: Synthetic oligonucleotide
  Target: SCN10A; (+) strand; PAM type: NNGRRT; PAM sequence: CAGGGT
ttcattgactgtggctgagt

SEQ ID NO: 8997 - DNA, 20 bp, Artificial Sequence
  Description of Artificial Sequence: Synthetic oligonucleotide
  Target: SCN10A; (+) strand; PAM type: NNGRRT; PAM sequence: TGGGGT
gctgagtcagggtcttctac

SEQ ID NO: 8998 - DNA, 20 bp, Artificial Sequence
  Description of Artificial Sequence: Synthetic oligonucleotide
  Target: SCN10A; (+) strand; PAM type: NNGRRT; PAM sequence: CTGAAT
agccacaggcctgatccctc

SEQ ID NO: 8999 - DNA, 20 bp, Artificial Sequence
  Description of Artificial Sequence: Synthetic oligonucleotide
  Target: SCN10A; (+) strand; PAM type: NNGRRT; PAM sequence: TGGGGT
atgggcctcttctgtggagg

SEQ ID NO: 9000 - DNA, 20 bp, Artificial Sequence
  Description of Artificial Sequence: Synthetic oligonucleotide
  Target: SCN10A; (+) strand; PAM type: NNGRRT; PAM sequence: GTGGGT
gcctcttctgtggaggtggg

SEQ ID NO: 9001 - DNA, 20 bp, Artificial Sequence
  Description of Artificial Sequence: Synthetic oligonucleotide
  Target: SCN10A; (+) strand; PAM type: NNGRRT; PAM sequence: TCGGGT
tgaagagagaccagcctcct

SEQ ID NO: 9002 - DNA, 20 bp, Artificial Sequence
  Description of Artificial Sequence: Synthetic oligonucleotide
  Target: SCN10A; (+) strand; PAM type: NNGRRT; PAM sequence: GGGGAT
agaccagcctccttcgggta

SEQ ID NO: 9003 - DNA, 20 bp, Artificial Sequence
  Description of Artificial Sequence: Synthetic oligonucleotide
  Target: SCN10A; (+) strand; PAM type: NNGRRT; PAM sequence: TAGGAT
ccaggctgtggcttaggtgc

SEQ ID NO: 9004 - DNA, 20 bp, Artificial Sequence
  Description of Artificial Sequence: Synthetic oligonucleotide
  Target: SCN10A; (+) strand; PAM type: NNGRRT; PAM sequence: GTGAGT
caattttatcacccatatcc

SEQ ID NO: 9005 - DNA, 20 bp, Artificial Sequence
  Description of Artificial Sequence: Synthetic oligonucleotide
  Target: SCN10A; (+) strand; PAM type: NNGRRT; PAM sequence: GCGGGT
tctttatgtgatgggggaga

SEQ ID NO: 9006 - DNA, 20 bp, Artificial Sequence
  Description of Artificial Sequence: Synthetic oligonucleotide
  Target: SCN10A; (+) strand; PAM type: NNGRRT; PAM sequence: AGGAAT
ccgaaggttgtaagcctagc

SEQ ID NO: 9007 - DNA, 20 bp, Artificial Sequence
  Description of Artificial Sequence: Synthetic oligonucleotide
  Target: SCN10A; (+) strand; PAM type: NNGRRT; PAM sequence: AAGGAT
aagagctatacccttcatgt

SEQ ID NO: 9008 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tgaaccacaaacaatcccag

SEQ ID NO: 9009 - DNA, 20 bp, Artificial Sequence
  Description of Artificial Sequence: Synthetic oligonucleotide
  Target: SCN10A; (+) strand; PAM type: NNGRRT; PAM sequence: TTGAAT
ccaggagaatgcaaggaaaa

SEQ ID NO: 9010 - DNA, 20 bp, Artificial Sequence
  Description of Artificial Sequence: Synthetic oligonucleotide
  Target: SCN10A; (+) strand; PAM type: NNGRRT; PAM sequence: TAGGAT
acaacaaagtggtgctcata

SEQ ID NO: 9011 - DNA, 20 bp, Artificial Sequence
  Description of Artificial Sequence: Synthetic oligonucleotide
  Target: SCN10A; (+) strand; PAM type: NNGRRT; PAM sequence: TGGAAT
tgctcatataggattttatc

SEQ ID NO: 9012 - DNA, 20 bp, Artificial Sequence
  Description of Artificial Sequence: Synthetic oligonucleotide
  Target: SCN10A; (+) strand; PAM type: NNGRRT; PAM sequence: GAGAAT
ctacctaggtattttaagtt

SEQ ID NO: 9013 - DNA, 20 bp, Artificial Sequence
  Description of Artificial Sequence: Synthetic oligonucleotide
  Target: SCN10A; (+) strand; PAM type: NNGRRT; PAM sequence: CAGAAT
caattctacaaagtgctctg

SEQ ID NO: 9014 - DNA, 20 bp, Artificial Sequence
  Description of Artificial Sequence: Synthetic oligonucleotide
  Target: SCN10A; (+) strand; PAM type: NNGRRT; PAM sequence: AAGAGT
tattccctcaaaaattgttt

SEQ ID NO: 9015 - DNA, 20 bp, Artificial Sequence
  Description of Artificial Sequence: Synthetic oligonucleotide
  Target: SCN10A; (+) strand; PAM type: NNGRRT; PAM sequence: AGGAAT
aaaaaacaaacaaaaacaga

SEQ ID NO: 9016 - DNA, 20 bp, Artificial Sequence
  Description of Artificial Sequence: Synthetic oligonucleotide
  Target: SCN10A; (+) strand; PAM type: NNGRRT; PAM sequence: ATGAGT
aacaaacaaaaacagaagga

SEQ ID NO: 9017 - DNA, 20 bp, Artificial Sequence
  Description of Artificial Sequence: Synthetic oligonucleotide
  Target: SCN10A; (+) strand; PAM type: NNGRRT; PAM sequence: AAGAGT
aacagaaggaatgagtcatc

SEQ ID NO: 9018 - DNA, 20 bp, Artificial Sequence
  Description of Artificial Sequence: Synthetic oligonucleotide
  Target: SCN10A; (+) strand; PAM type: NNGRRT; PAM sequence: GTGAAT
gaaggaatgagtcatcaaga

SEQ ID NO: 9019 - DNA, 20 bp, Artificial Sequence
  Description of Artificial Sequence: Synthetic oligonucleotide
  Target: SCN10A; (+) strand; PAM type: NNGRRT; PAM sequence: TAGAAT
cattccatttcttcagatga

SEQ ID NO: 9020 - DNA, 20 bp, Artificial Sequence
  Description of Artificial Sequence: Synthetic oligonucleotide
  Target: SCN10A; (+) strand; PAM type: NNGRRT; PAM sequence: GAGAAT
ataacttgaaactatgtgca

SEQ ID NO: 9021 - DNA, 20 bp, Artificial Sequence
  Description of Artificial Sequence: Synthetic oligonucleotide
  Target: SCN10A; (+) strand; PAM type: NNGRRT; PAM sequence: GAGAAT
agatttgacacagtttggga

SEQ ID NO: 9022 - DNA, 20 bp, Artificial Sequence
  Description of Artificial Sequence: Synthetic oligonucleotide
  Target: SCN10A; (+) strand; PAM type: NNGRRT; PAM sequence: GAGGAT
tgggagagaattagtgaact

SEQ ID NO: 9023 - DNA, 20 bp, Artificial Sequence
  Description of Artificial Sequence: Synthetic oligonucleotide
  Target: SCN10A; (+) strand; PAM type: NNGRRT; PAM sequence: CAGAAT
ttagtgaactgaggatatat

SEQ ID NO: 9024 - DNA, 20 bp, Artificial Sequence
  Description of Artificial Sequence: Synthetic oligonucleotide
  Target: SCN10A; (+) strand; PAM type: NNGRRT; PAM sequence: CAGAAT
atatatcagaataaattatt

SEQ ID NO: 9025 - DNA, 20 bp, Artificial Sequence
  Description of Artificial Sequence: Synthetic oligonucleotide
  Target: SCN10A; (+) strand; PAM type: NNGRRT; PAM sequence: GAGGAT
aaaatagtgtaagagacata

SEQ ID NO: 9026 - DNA, 20 bp, Artificial Sequence
  Description of Artificial Sequence: Synthetic oligonucleotide
  Target: SCN10A; (+) strand; PAM type: NNGRRT; PAM sequence: TAGAAT
agtgtaagagacatagagga

SEQ ID NO: 9027 - DNA, 20 bp, Artificial Sequence
  Description of Artificial Sequence: Synthetic oligonucleotide
  Target: SCN10A; (+) strand; PAM type: NNGRRT; PAM sequence: GAGAGT
agacatagaggatagaatga

SEQ ID NO: 9028 - DNA, 20 bp, Artificial Sequence
  Description of Artificial Sequence: Synthetic oligonucleotide
  Target: SCN10A; (+) strand; PAM type: NNGRRT; PAM sequence: TAGAAT
aagtccagaaggagaaaaaa

SEQ ID NO: 9029 - DNA, 20 bp, Artificial Sequence
  Description of Artificial Sequence: Synthetic oligonucleotide
  Target: SCN10A; (+) strand; PAM type: NNGRRT; PAM sequence: CAGAAT
catcatgtctgggaactttc

SEQ ID NO: 9030 - DNA, 20 bp, Artificial Sequence
  Description of Artificial Sequence: Synthetic oligonucleotide
  Target: SCN10A; (+) strand; PAM type: NNGRRT; PAM sequence: ATGGAT
gaaactgcagaacaccaaag

SEQ ID NO: 9031 - DNA, 20 bp, Artificial Sequence
  Description of Artificial Sequence: Synthetic oligonucleotide
  Target: SCN10A; (+) strand; PAM type: NNGRRT; PAM sequence: AGGAAT
taaaaagcatccagaaagga

SEQ ID NO: 9032 - DNA, 20 bp, Artificial Sequence
  Description of Artificial Sequence: Synthetic oligonucleotide
  Target: SCN10A; (+) strand; PAM type: NNGRRT; PAM sequence: TGGAAT
caacaatggaggctaattgt

SEQ ID NO: 9033 - DNA, 20 bp, Artificial Sequence
  Description of Artificial Sequence: Synthetic oligonucleotide
  Target: SCN10A; (+) strand; PAM type: NNGRRT; PAM sequence: TAGAAT
aaggaagataaagtatcaac

SEQ ID NO: 9034 - DNA, 20 bp, Artificial Sequence
  Description of Artificial Sequence: Synthetic oligonucleotide
  Target: SCN10A; (+) strand; PAM type: NNGRRT; PAM sequence: AAGAAT
atatgtaatgtgtaatatac

SEQ ID NO: 9035 - DNA, 20 bp, Artificial Sequence
  Description of Artificial Sequence: Synthetic oligonucleotide
  Target: SCN10A; (+) strand; PAM type: NNGRRT; PAM sequence: AAGGGT
gaatgtgaaactgtgctcca

SEQ ID NO: 9036 - DNA, 20 bp, Artificial Sequence
  Description of Artificial Sequence: Synthetic oligonucleotide
  Target: SCN10A; (+) strand; PAM type: NNGRRT; PAM sequence: CAGGAT
taactaaatttttaggctta

SEQ ID NO: 9037 - DNA, 20 bp, Artificial Sequence
  Description of Artificial Sequence: Synthetic oligonucleotide
  Target: SCN10A; (+) strand; PAM type: NNGRRT; PAM sequence: AAGAGT
gaaactcaaactgtgttcca

SEQ ID NO: 9038 - DNA, 20 bp, Artificial Sequence
  Description of Artificial Sequence: Synthetic oligonucleotide
  Target: SCN10A; (+) strand; PAM type: NNGRRT; PAM sequence: TTGAGT
tcagtaacttacaaaaattc

SEQ ID NO: 9039 - DNA, 20 bp, Artificial Sequence
  Description of Artificial Sequence: Synthetic oligonucleotide
  Target: SCN10A; (+) strand; PAM type: NNGRRT; PAM sequence: TAGGAT
tacaaaaattcttgagtttt

SEQ ID NO: 9040 - DNA, 20 bp, Artificial Sequence
  Description of Artificial Sequence: Synthetic oligonucleotide
  Target: SCN10A; (+) strand; PAM type: NNGRRT; PAM sequence: CAGGAT
aggctgaaatcaattggaac

SEQ ID NO: 9041 - DNA, 20 bp, Artificial Sequence
  Description of Artificial Sequence: Synthetic oligonucleotide
  Target: SCN10A; (+) strand; PAM type: NNGRRT; PAM sequence: TGGAGT
ttggaaccaggatggccgac

SEQ ID NO: 9042 - DNA, 20 bp, Artificial Sequence
  Description of Artificial Sequence: Synthetic oligonucleotide
  Target: SCN10A; (+) strand; PAM type: NNGRRT; PAM sequence: CAGAAT
atggccgactggagtttgtg

SEQ ID NO: 9043 - DNA, 20 bp, Artificial Sequence
  Description of Artificial Sequence: Synthetic oligonucleotide
  Target: SCN10A; (+) strand; PAM type: NNGRRT; PAM sequence: CTGAAT
gagcttgctgacgtcatgga

SEQ ID NO: 9044 - DNA, 20 bp, Artificial Sequence
  Description of Artificial Sequence: Synthetic oligonucleotide
  Target: SCN10A; (+) strand; PAM type: NNGRRT; PAM sequence: ATGAGT
cagatttgcatatgcaaccc

SEQ ID NO: 9045 - DNA, 20 bp, Artificial Sequence
  Description of Artificial Sequence: Synthetic oligonucleotide
  Target: SCN10A; (+) strand; PAM type: NNGRRT; PAM sequence: GAGAGT
agcaagaaagtgctaagcat

SEQ ID NO: 9046 - DNA, 20 bp, Artificial Sequence
  Description of Artificial Sequence: Synthetic oligonucleotide
  Target: SCN10A; (+) strand; PAM type: NNGRRT; PAM sequence: GTGAAT
agaaagtgctaagcatgaga

SEQ ID NO: 9047 - DNA, 20 bp, Artificial Sequence
  Description of Artificial Sequence: Synthetic oligonucleotide
  Target: SCN10A; (+) strand; PAM type: NNGRRT; PAM sequence: TTGAGT
agagtgaatctaaataaaca

SEQ ID NO: 9048 - DNA, 20 bp, Artificial Sequence
  Description of Artificial Sequence: Synthetic oligonucleotide
  Target: SCN10A; (+) strand; PAM type: NNGRRT; PAM sequence: TGGGGT
cagttttgcttgcaaatagt

SEQ ID NO: 9049 - DNA, 20 bp, Artificial Sequence
  Description of Artificial Sequence: Synthetic oligonucleotide
  Target: SCN10A; (+) strand; PAM type: NNGRRT; PAM sequence: GTGGGT
aaatagttggggtcatgtta

SEQ ID NO: 9050 - DNA, 20 bp, Artificial Sequence
  Description of Artificial Sequence: Synthetic oligonucleotide
  Target: SCN10A; (+) strand; PAM type: NNGRRT; PAM sequence: TGGAAT
tgttagtgggttctgtctgg

SEQ ID NO: 9051 - DNA, 20 bp, Artificial Sequence
  Description of Artificial Sequence: Synthetic oligonucleotide
  Target: SCN10A; (+) strand; PAM type: NNGRRT; PAM sequence: TGGGAT
aagatggtgacatcacgata

SEQ ID NO: 9052 - DNA, 20 bp, Artificial Sequence
  Description of Artificial Sequence: Synthetic oligonucleotide
  Target: SCN10A; (+) strand; PAM type: NNGRRT; PAM sequence: CTGAAT
ggagagcttcccaacaagca

SEQ ID NO: 9053 - DNA, 20 bp, Artificial Sequence
  Description of Artificial Sequence: Synthetic oligonucleotide
  Target: SCN10A; (+) strand; PAM type: NNGRRT; PAM sequence: GAGGGT
tatgttaactcacagattta

SEQ ID NO: 9054 - DNA, 20 bp, Artificial Sequence
  Description of Artificial Sequence: Synthetic oligonucleotide
  Target: SCN10A; (+) strand; PAM type: NNGRRT; PAM sequence: TTGAGT
tgcagctagttgtacttatc

SEQ ID NO: 9055 - DNA, 20 bp, Artificial Sequence
  Description of Artificial Sequence: Synthetic oligonucleotide
  Target: SCN10A; (+) strand; PAM type: NNGRRT; PAM sequence: TGGAAT
gaagctgataggagaaggct

SEQ ID NO: 9056 - DNA, 20 bp, Artificial Sequence
  Description of Artificial Sequence: Synthetic oligonucleotide
  Target: SCN10A; (+) strand; PAM type: NNGRRT; PAM sequence: AAGGGT
tgaaccagcaaccctagggg

SEQ ID NO: 9057 - DNA, 20 bp, Artificial Sequence
  Description of Artificial Sequence: Synthetic oligonucleotide
  Target: SCN10A; (+) strand; PAM type: NNGRRT; PAM sequence: GTGGGT
gtttattaaaccttagtatt

SEQ ID NO: 9058 - DNA, 20 bp, Artificial Sequence
  Description of Artificial Sequence: Synthetic oligonucleotide
  Target: SCN10A; (+) strand; PAM type: NNGRRT; PAM sequence: AAGAAT
gaaagatttagctggtttat

SEQ ID NO: 9059 - DNA, 20 bp, Artificial Sequence
  Description of Artificial Sequence: Synthetic oligonucleotide
  Target: SCN10A; (+) strand; PAM type: NNGRRT; PAM sequence: TGGGAT
agattccaggcagtgagcaa

SEQ ID NO: 9060 - DNA, 20 bp, Artificial Sequence
  Description of Artificial Sequence: Synthetic oligonucleotide
  Target: SCN10A; (+) strand; PAM type: NNGRRT; PAM sequence: TGGAGT
ggcatggcaaagtcacttct

SEQ ID NO: 9061 - DNA, 20 bp, Artificial Sequence
  Description of Artificial Sequence: Synthetic oligonucleotide
  Target: SCN10A; (+) strand; PAM type: NNGRRT; PAM sequence: ACGAGT
ggcttgcattaggctatgat

SEQ ID NO: 9062 - DNA, 20 bp, Artificial Sequence
  Description of Artificial Sequence: Synthetic oligonucleotide
  Target: SCN10A; (+) strand; PAM type: NNGRRT; PAM sequence: TGGGGT
agtgagaaataaacctttat

SEQ ID NO: 9063 - DNA, 20 bp, Artificial Sequence
  Description of Artificial Sequence: Synthetic oligonucleotide
  Target: SCN10A; (+) strand; PAM type: NNGRRT; PAM sequence: AAGGAT
atcattacaataaattggga

SEQ ID NO: 9064 - DNA, 20 bp, Artificial Sequence
  Description of Artificial Sequence: Synthetic oligonucleotide
  Target: SCN10A; (+) strand; PAM type: NNGRRT; PAM sequence: TGGAAT
ataaattgggaaaggatatc

SEQ ID NO: 9065 - DNA, 20 bp, Artificial Sequence
  Description of Artificial Sequence: Synthetic oligonucleotide
  Target: SCN10A; (+) strand; PAM type: NNGRRT; PAM sequence: GAGAGT
tttgattaagttaactaatg

SEQ ID NO: 9066 - DNA, 20 bp, Artificial Sequence
  Description of Artificial Sequence: Synthetic oligonucleotide
  Target: SCN10A; (+) strand; PAM type: NNGRRT; PAM sequence: TGGAGT
ttatttatttatttttgaga

SEQ ID NO: 9067 - DNA, 20 bp, Artificial Sequence
  Description of Artificial Sequence: Synthetic oligonucleotide
  Target: SCN10A; (+) strand; PAM type: NNGRRT; PAM sequence: TGGAGT
tttgcccttgttgcccaggc

SEQ ID NO: 9068 - DNA, 20 bp, Artificial Sequence
  Description of Artificial Sequence: Synthetic oligonucleotide
  Target: SCN10A; (+) strand; PAM type: NNGRRT; PAM sequence: CCGGGT
ctcaccgcaacctccgcctc

SEQ ID NO: 9069 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ccctcagcctcccaagtagc

SEQ ID NO: 9070 - DNA, 20 bp, Artificial Sequence
  Description of Artificial Sequence: Synthetic oligonucleotide
  Target: SCN10A; (+) strand; PAM type: NNGRRT; PAM sequence: ATGGGT
attttgtatttttggtagag

SEQ ID NO: 9071 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gcctgcgcctccaacagtgc

SEQ ID NO: 9072 - DNA, 20 bp, Artificial Sequence
  Description of Artificial Sequence: Synthetic oligonucleotide
  Target: SCN10A; (+) strand; PAM type: NNGRRT; PAM sequence: CGGAGT
ttttattgttttcaatgaga

SEQ ID NO: 9073 - DNA, 20 bp, Artificial Sequence
  Description of Artificial Sequence: Synthetic oligonucleotide
  Target: SCN10A; (+) strand; PAM type: NNGRRT; PAM sequence: TGGAGT
tctcgctctgttgcccaggc

SEQ ID NO: 9074 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ctcactgcaacctctgtctc

SEQ ID NO: 9075 - DNA, 20 bp, Artificial Sequence
  Description of Artificial Sequence: Synthetic oligonucleotide
  Target: SCN10A; (+) strand; PAM type: NNGRRT; PAM sequence: CTGAGT
aattctcatgcctcaccctc

SEQ ID NO: 9076 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gcctcaccctcctgagtagc

SEQ ID NO: 9077 - DNA, 20 bp, Artificial Sequence
  Description of Artificial Sequence: Synthetic oligonucleotide
  Target: SCN10A; (+) strand; PAM type: NNGRRT; PAM sequence: TGGGGT
ttatatatttttagtagaga

SEQ ID NO: 9078 - DNA, 20 bp, Artificial Sequence
  Description of Artificial Sequence: Synthetic oligonucleotide
  Target: SCN10A; (+) strand; PAM type: NNGRRT; PAM sequence: TGGGAT
accttggcctcccaaaattc

SEQ ID NO: 9079 - DNA, 20 bp, Artificial Sequence
  Description of Artificial Sequence: Synthetic oligonucleotide
  Target: SCN10A; (+) strand; PAM type: NNGRRT; PAM sequence: ATGGAT
atcaaatattactcattgat

SEQ ID NO: 9080 - DNA, 20 bp, Artificial Sequence
  Description of Artificial Sequence: Synthetic oligonucleotide
  Target: SCN10A; (+) strand; PAM type: NNGRRT; PAM sequence: GGGAAT
gatcaagctaggtttgagct

SEQ ID NO: 9081 - DNA, 20 bp, Artificial Sequence
  Description of Artificial Sequence: Synthetic oligonucleotide
  Target: SCN10A; (+) strand; PAM type: NNGRRT; PAM sequence: TAGAAT
catgattatctcaatacatg

SEQ ID NO: 9082 - DNA, 20 bp, Artificial Sequence
  Description of Artificial Sequence: Synthetic oligonucleotide
  Target: SCN10A; (+) strand; PAM type: NNGRRT; PAM sequence: AAGGAT
tagaggtggtgaaatattga

SEQ ID NO: 9083 - DNA, 20 bp, Artificial Sequence
  Description of Artificial Sequence: Synthetic oligonucleotide
  Target: SCN10A; (+) strand; PAM type: NNGRRT; PAM sequence: TGGGAT
aatattgaaaggattctttt

SEQ ID NO: 9084 - DNA, 20 bp, Artificial Sequence
  Description of Artificial Sequence: Synthetic oligonucleotide
  Target: SCN10A; (+) strand; PAM type: NNGRRT; PAM sequence: CTGGAT
cacttcttttcaacagtgta

SEQ ID NO: 9085 - DNA, 20 bp, Artificial Sequence
  Description of Artificial Sequence: Synthetic oligonucleotide
  Target: SCN10A; (+) strand; PAM type: NNGRRT; PAM sequence: AAGGAT
taaaaagaacctaatggcat

SEQ ID NO: 9086 - DNA, 20 bp, Artificial Sequence
  Description of Artificial Sequence: Synthetic oligonucleotide
  Target: SCN10A; (+) strand; PAM type: NNGRRT; PAM sequence: GTGGGT
aagaagaaattaggctgggc

SEQ ID NO: 9087 - DNA, 20 bp, Artificial Sequence
  Description of Artificial Sequence: Synthetic oligonucleotide
  Target: SCN10A; (+) strand; PAM type: NNGRRT; PAM sequence: AAGAAT
ccgtctctactaaaaataca

SEQ ID NO: 9088 - DNA, 20 bp, Artificial Sequence
  Description of Artificial Sequence: Synthetic oligonucleotide
  Target: SCN10A; (+) strand; PAM type: NNGRRT; PAM sequence: GTGGGT
agaattagccaggcatggtg

SEQ ID NO: 9089 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tactcaggaggctgaggcag

SEQ ID NO: 9090 - DNA, 20 bp, Artificial Sequence
  Description of Artificial Sequence: Synthetic oligonucleotide
  Target: SCN10A; (+) strand; PAM type: NNGRRT; PAM sequence: CTGGGT
tcacgccactgcactctagc

SEQ ID NO: 9091 - DNA, 20 bp, Artificial Sequence
  Description of Artificial Sequence: Synthetic oligonucleotide
  Target: SCN10A; (+) strand; PAM type: NNGRRT; PAM sequence: TAGAAT
acattgtatagataaattat

SEQ ID NO: 9092 - DNA, 20 bp, Artificial Sequence
  Description of Artificial Sequence: Synthetic oligonucleotide
  Target: SCN10A; (+) strand; PAM type: NNGRRT; PAM sequence: CTGAAT
tatcttcatagatcagaaga

SEQ ID NO: 9093 - DNA, 20 bp, Artificial Sequence
  Description of Artificial Sequence: Synthetic oligonucleotide
  Target: SCN10A; (+) strand; PAM type: NNGRRT; PAM sequence: GTGGGT
aatagcagttttgtgtgtat

SEQ ID NO: 9094 - DNA, 20 bp, Artificial Sequence
  Description of Artificial Sequence: Synthetic oligonucleotide
  Target: SCN10A; (+) strand; PAM type: NNGRRT; PAM sequence: GTGAAT
cttggcaagataattctaaa

SEQ ID NO: 9095 - DNA, 20 bp, Artificial Sequence
  Description of Artificial Sequence: Synthetic oligonucleotide
  Target: SCN10A; (+) strand; PAM type: NNGRRT; PAM sequence: GTGGAT
atattcttgaagtaaattag

SEQ ID NO: 9096 - DNA, 20 bp, Artificial Sequence
  Description of Artificial Sequence: Synthetic oligonucleotide
  Target: SCN10A; (+) strand; PAM type: NNGRRT; PAM sequence: CAGGAT
attaagactgatattggtgc

SEQ ID NO: 9097 - DNA, 20 bp, Artificial Sequence
  Description of Artificial Sequence: Synthetic oligonucleotide
  Target: SCN10A; (+) strand; PAM type: NNGRRT; PAM sequence: TTGAGT
aatcaatcaacaggtgttta

SEQ ID NO: 9098 - DNA, 20 bp, Artificial Sequence
  Description of Artificial Sequence: Synthetic oligonucleotide
  Target: SCN10A; (+) strand; PAM type: NNGRRT; PAM sequence: TGGGAT
tgggccttgtgctaggccct

SEQ ID NO: 9099 - DNA, 20 bp, Artificial Sequence
  Description of Artificial Sequence: Synthetic oligonucleotide
  Target: SCN10A; (+) strand; PAM type: NNGRRT; PAM sequence: TGGGAT
aaactctggtttttgcctca

SEQ ID NO: 9100 - DNA, 20 bp, Artificial Sequence
  Description of Artificial Sequence: Synthetic oligonucleotide
  Target: SCN10A; (+) strand; PAM type: NNGRRT; PAM sequence: AGGAAT
atgccaggttaatttgatga

SEQ ID NO: 9101 - DNA, 20 bp, Artificial Sequence
  Description of Artificial Sequence: Synthetic oligonucleotide
  Target: SCN10A; (+) strand; PAM type: NNGRRT; PAM sequence: CAGAGT
ggtgacaagtgcattgaaca

SEQ ID NO: 9102 - DNA, 20 bp, Artificial Sequence
  Description of Artificial Sequence: Synthetic oligonucleotide
  Target: SCN10A; (+) strand; PAM type: NNGRRT; PAM sequence: GAGAAT
gtgcattgaacacagagttt

SEQ ID NO: 9103 - DNA, 20 bp, Artificial Sequence
  Description of Artificial Sequence: Synthetic oligonucleotide
  Target: SCN10A; (+) strand; PAM type: NNGRRT; PAM sequence: GAGAGT
tctgttatgtgtgaagaaga

SEQ ID NO: 9104 - DNA, 20 bp, Artificial Sequence
  Description of Artificial Sequence: Synthetic oligonucleotide
  Target: SCN10A; (+) strand; PAM type: NNGRRT; PAM sequence: AGGAGT
gaactttgtacaccatcatg

SEQ ID NO: 9105 - DNA, 20 bp, Artificial Sequence
  Description of Artificial Sequence: Synthetic oligonucleotide
  Target: SCN10A; (+) strand; PAM type: NNGRRT; PAM sequence: CTGGAT
tgtacaccatcatgaggagt

SEQ ID NO: 9106 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gtgtgtgtgtgtgtgtgttg

SEQ ID NO: 9107 - DNA, 20 bp, Artificial Sequence
  Description of Artificial Sequence: Synthetic oligonucleotide
  Target: SCN10A; (+) strand; PAM type: NNGRRT; PAM sequence: TTGAGT
gaggcagagggaaaaggtga

SEQ ID NO: 9108 - DNA, 20 bp, Artificial Sequence
  Description of Artificial Sequence: Synthetic oligonucleotide
  Target: SCN10A; (+) strand; PAM type: NNGRRT; PAM sequence: TGGAAT
aagctaggtcatgagggaag

SEQ ID NO: 9109 - DNA, 20 bp, Artificial Sequence
  Description of Artificial Sequence: Synthetic oligonucleotide
  Target: SCN10A; (+) strand; PAM type: NNGRRT; PAM sequence: GTGGGT
cccaagaaagtgtgtagttg

SEQ ID NO: 9110 - DNA, 20 bp, Artificial Sequence
  Description of Artificial Sequence: Synthetic oligonucleotide
  Target: SCN10A; (+) strand; PAM type: NNGRRT; PAM sequence: GGGAAT
gtagttggtgggtgtggtta

SEQ ID NO: 9111 - DNA, 20 bp, Artificial Sequence
  Description of Artificial Sequence: Synthetic oligonucleotide
  Target: SCN10A; (+) strand; PAM type: NNGRRT; PAM sequence: CAGGGT
ttaaatcagcgaggtgggga

SEQ ID NO: 9112 - DNA, 20 bp, Artificial Sequence
  Description of Artificial Sequence: Synthetic oligonucleotide
  Target: SCN10A; (+) strand; PAM type: NNGRRT; PAM sequence: CAGAAT
gacagggtagcattcccctg

SEQ ID NO: 9113 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ttgtttgggactttagactg

SEQ ID NO: 9114 - DNA, 20 bp, Artificial Sequence
  Description of Artificial Sequence: Synthetic oligonucleotide
  Target: SCN10A; (+) strand; PAM type: NNGRRT; PAM sequence: CGGAGT
ttttttttttttttttgaga

SEQ ID NO: 9115 - DNA, 20 bp, Artificial Sequence
  Description of Artificial Sequence: Synthetic oligonucleotide
  Target: SCN10A; (+) strand; PAM type: NNGRRT; PAM sequence: CCGGAT
gtcccgctgtttagcccagg

SEQ ID NO: 9116 - DNA, 20 bp, Artificial Sequence
  Description of Artificial Sequence: Synthetic oligonucleotide
  Target: SCN10A; (+) strand; PAM type: NNGRRT; PAM sequence: CCGAGT
cattctcctgcctcagcctc

SEQ ID NO: 9117 - DNA, 20 bp, Artificial Sequence
  Description of Artificial Sequence: Synthetic oligonucleotide
  Target: SCN10A; (+) strand; PAM type: NNGRRT; PAM sequence: CGGGGT
ttttgtatttttagtagaga

SEQ ID NO: 9118 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gcctcggcctcccaaagtgc

SEQ ID NO: 9119 - DNA, 20 bp, Artificial Sequence
  Description of Artificial Sequence: Synthetic oligonucleotide
  Target: SCN10A; (+) strand; PAM type: NNGRRT; PAM sequence: CAGGGT
aaaactaactgtgggcctgc

SEQ ID NO: 9120 - DNA, 20 bp, Artificial Sequence
  Description of Artificial Sequence: Synthetic oligonucleotide
  Target: SCN10A; (+) strand; PAM type: NNGRRT; PAM sequence: GGGGGT
ctgtgggcctgccagggtat

SEQ ID NO: 9121 - DNA, 20 bp, Artificial Sequence
  Description of Artificial Sequence: Synthetic oligonucleotide
  Target: SCN10A; (+) strand; PAM type: NNGRRT; PAM sequence: ATGGAT
ccttgtaagattttcaagtt

SEQ ID NO: 9122 - DNA, 20 bp, Artificial Sequence
  Description of Artificial Sequence: Synthetic oligonucleotide
  Target: SCN10A; (+) strand; PAM type: NNGRRT; PAM sequence: AAGAGT
agattttcaagttatggata

SEQ ID NO: 9123 - DNA, 20 bp, Artificial Sequence
  Description of Artificial Sequence: Synthetic oligonucleotide
  Target: SCN10A; (+) strand; PAM type: NNGRRT; PAM sequence: TGGGAT
tactctacccttctcctccc

SEQ ID NO: 9124 - DNA, 20 bp, Artificial Sequence
  Description of Artificial Sequence: Synthetic oligonucleotide
  Target: SCN10A; (+) strand; PAM type: NNGRRT; PAM sequence: TAGAGT
gacatgctttatttggtctt

SEQ ID NO: 9125 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ctttagagtgtttttaaaaa

SEQ ID NO: 9126 - DNA, 20 bp, Artificial Sequence
  Description of Artificial Sequence: Synthetic oligonucleotide
  Target: SCN10A; (+) strand; PAM type: NNGRRT; PAM sequence: CTGGAT
aaagacatttgcacaaaaat

SEQ ID NO: 9127 - DNA, 20 bp, Artificial Sequence
  Description of Artificial Sequence: Synthetic oligonucleotide
  Target: SCN10A; (+) strand; PAM type: NNGRRT; PAM sequence: TGGAGT
tcttactctgtctcccaggc

SEQ ID NO: 9128 - DNA, 20 bp, Artificial Sequence
  Description of Artificial Sequence: Synthetic oligonucleotide
  Target: SCN10A; (+) strand; PAM type: NNGRRT; PAM sequence: CTGAGT
gatcctcccacctcagtctt

SEQ ID NO: 9129 - DNA, 20 bp, Artificial Sequence
  Description of Artificial Sequence: Synthetic oligonucleotide
  Target: SCN10A; (+) strand; PAM type: NNGRRT; PAM sequence: TAGGAT
acctcagtcttctgagtagc

SEQ ID NO: 9130 - DNA, 20 bp, Artificial Sequence
  Description of Artificial Sequence: Synthetic oligonucleotide
  Target: SCN10A; (+) strand; PAM type: NNGRRT; PAM sequence: CGGGGT
tttttcattttttgtagaga

SEQ ID NO: 9131 - DNA, 20 bp, Artificial Sequence
  Description of Artificial Sequence: Synthetic oligonucleotide
  Target: SCN10A; (+) strand; PAM type: NNGRRT; PAM sequence: TAGGAT
gcctcggcctcccaaagtac

SEQ ID NO: 9132 - DNA, 20 bp, Artificial Sequence
  Description of Artificial Sequence: Synthetic oligonucleotide
  Target: SCN10A; (+) strand; PAM type: NNGRRT; PAM sequence: AGGAGT
tctatgtaaacatccctccc

SEQ ID NO: 9133 - DNA, 20 bp, Artificial Sequence
  Description of Artificial Sequence: Synthetic oligonucleotide
  Target: SCN10A; (+) strand; PAM type: NNGRRT; PAM sequence: TTGGGT
cccaggagttgtgcactgct

SEQ ID NO: 9134 - DNA, 20 bp, Artificial Sequence
  Description of Artificial Sequence: Synthetic oligonucleotide
  Target: SCN10A; (+) strand; PAM type: NNGRRT; PAM sequence: TGGAGT
ttgggtctgcctaggtgaaa

SEQ ID NO: 9135 - DNA, 20 bp, Artificial Sequence
  Description of Artificial Sequence: Synthetic oligonucleotide
  Target: SCN10A; (+) strand; PAM type: NNGRRT; PAM sequence: TTGAGT
atgtcactgcacatgggcat

SEQ ID NO: 9136 - DNA, 20 bp, Artificial Sequence
  Description of Artificial Sequence: Synthetic oligonucleotide
  Target: SCN10A; (+) strand; PAM type: NNGRRT; PAM sequence: TAGGGT
tgtctcactggcccctgtga

SEQ ID NO: 9137 - DNA, 20 bp, Artificial Sequence
  Description of Artificial Sequence: Synthetic oligonucleotide
  Target: SCN10A; (+) strand; PAM type: NNGRRT; PAM sequence: TAGAGT
ggtcccaagcagatctgtcc

SEQ ID NO: 9138 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ccatgcacccccttcaacct

SEQ ID NO: 9139 - DNA, 20 bp, Artificial Sequence
  Description of Artificial Sequence: Synthetic oligonucleotide
  Target: SCN10A; (+) strand; PAM type: NNGRRT; PAM sequence: TTGGAT
tcaggaccttgggaagattg

SEQ ID NO: 9140 - DNA, 20 bp, Artificial Sequence
  Description of Artificial Sequence: Synthetic oligonucleotide
  Target: SCN10A; (+) strand; PAM type: NNGRRT; PAM sequence: AAGAGT
caggcctctttcctattccc

SEQ ID NO: 9141 - DNA, 20 bp, Artificial Sequence
  Description of Artificial Sequence: Synthetic oligonucleotide
  Target: SCN10A; (+) strand; PAM type: NNGRRT; PAM sequence: GGGAAT
cctagtgacccgacactcct

SEQ ID NO: 9142 - DNA, 20 bp, Artificial Sequence
  Description of Artificial Sequence: Synthetic oligonucleotide
  Target: SCN10A; (+) strand; PAM type: NNGRRT; PAM sequence: GTGGGT
aacctgtggctctgataaaa

SEQ ID NO: 9143 - DNA, 20 bp, Artificial Sequence
  Description of Artificial Sequence: Synthetic oligonucleotide
  Target: SCN10A; (+) strand; PAM type: NNGRRT; PAM sequence: CTGAGT
ctgtagagggcgtcctggag

SEQ ID NO: 9144 - DNA, 20 bp, Artificial Sequence
  Description of Artificial Sequence: Synthetic oligonucleotide
  Target: SCN10A; (+) strand; PAM type: NNGRRT; PAM sequence: GTGAGT
gagaagagccatcattgcat

SEQ ID NO: 9145 - DNA, 20 bp, Artificial Sequence
  Description of Artificial Sequence: Synthetic oligonucleotide
  Target: SCN10A; (+) strand; PAM type: NNGRRT; PAM sequence: GGGAAT
ggctgtgatttcgggcacaa

SEQ ID NO: 9146 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tttcgggcacaagggaatca

SEQ ID NO: 9147 - DNA, 20 bp, Artificial Sequence
  Description of Artificial Sequence: Synthetic oligonucleotide
  Target: SCN10A; (+) strand; PAM type: NNGRRT; PAM sequence: TGGAGT
gctggaaggagctggggctc

SEQ ID NO: 9148 - DNA, 20 bp, Artificial Sequence
  Description of Artificial Sequence: Synthetic oligonucleotide
  Target: SCN10A; (+) strand; PAM type: NNGRRT; PAM sequence: CTGGAT
gggctctggagtcagacaac

SEQ ID NO: 9149 - DNA, 20 bp, Artificial Sequence
  Description of Artificial Sequence: Synthetic oligonucleotide
  Target: SCN10A; (+) strand; PAM type: NNGRRT; PAM sequence: TCGGGT
gcttggcagatgggagactt

SEQ ID NO: 9150 - DNA, 20 bp, Artificial Sequence
  Description of Artificial Sequence: Synthetic oligonucleotide
  Target: SCN10A; (+) strand; PAM type: NNGRRT; PAM sequence: GAGGAT
ctttttcctcacccacccct

SEQ ID NO: 9151 - DNA, 20 bp, Artificial Sequence
  Description of Artificial Sequence: Synthetic oligonucleotide
  Target: SCN10A; (+) strand; PAM type: NNGRRT; PAM sequence: CAGGGT
tcttaaaaacgactatctct

SEQ ID NO: 9152 - DNA, 20 bp, Artificial Sequence
  Description of Artificial Sequence: Synthetic oligonucleotide
  Target: SCN10A; (+) strand; PAM type: NNGRRT; PAM sequence: CTGAGT
ggagaaggcatgtccccact

SEQ ID NO: 9153 - DNA, 20 bp, Artificial Sequence
  Description of Artificial Sequence: Synthetic oligonucleotide
  Target: SCN10A; (+) strand; PAM type: NNGRRT; PAM sequence: AGGAGT
acccaagtctccagtcgccc

SEQ ID NO: 9154 - DNA, 20 bp, Artificial Sequence
  Description of Artificial Sequence: Synthetic oligonucleotide
  Target: SCN10A; (+) strand; PAM type: NNGRRT; PAM sequence: CTGAAT
cccagagcacagtgtcttcc

SEQ ID NO: 9155 - DNA, 20 bp, Artificial Sequence
  Description of Artificial Sequence: Synthetic oligonucleotide
  Target: SCN10A; (+) strand; PAM type: NNGRRT; PAM sequence: CTGGGT
gcacagtgtcttccctgaat

SEQ ID NO: 9156 - DNA, 20 bp, Artificial Sequence
  Description of Artificial Sequence: Synthetic oligonucleotide
  Target: SCN10A; (+) strand; PAM type: NNGRRT; PAM sequence: GGGAGT
tgtcttccctgaatctgggt

SEQ ID NO: 9157 - DNA, 20 bp, Artificial Sequence
  Description of Artificial Sequence: Synthetic oligonucleotide
  Target: SCN10A; (+) strand; PAM type: NNGRRT; PAM sequence: ATGGGT
cttcttctggaaataatagt

SEQ ID NO: 9158 - DNA, 20 bp, Artificial Sequence
  Description of Artificial Sequence: Synthetic oligonucleotide
  Target: SCN10A; (+) strand; PAM type: NNGRRT; PAM sequence: AGGAGT
aaaaaatatggtaaagacct

SEQ ID NO: 9159 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gaaacaagctttcatcacag

SEQ ID NO: 9160 - DNA, 20 bp, Artificial Sequence
  Description of Artificial Sequence: Synthetic oligonucleotide
  Target: SCN10A; (+) strand; PAM type: NNGRRT; PAM sequence: TGGGGT
tttcatcacagtgggatctg

SEQ ID NO: 9161 - DNA, 20 bp, Artificial Sequence
  Description of Artificial Sequence: Synthetic oligonucleotide
  Target: SCN10A; (+) strand; PAM type: NNGRRT; PAM sequence: GAGGAT
tatgttatctgtgggctcct

SEQ ID NO: 9162 - DNA, 20 bp, Artificial Sequence
  Description of Artificial Sequence: Synthetic oligonucleotide
  Target: SCN10A; (+) strand; PAM type: NNGRRT; PAM sequence: CAGGGT
gtgggctcctgaggattggc

SEQ ID NO: 9163 - DNA, 20 bp, Artificial Sequence
  Description of Artificial Sequence: Synthetic oligonucleotide
  Target: SCN10A; (+) strand; PAM type: NNGRRT; PAM sequence: CAGAAT
cagggtaacagtcaacgtga

SEQ ID NO: 9164 - DNA, 20 bp, Artificial Sequence
  Description of Artificial Sequence: Synthetic oligonucleotide
  Target: SCN10A; (+) strand; PAM type: NNGRRT; PAM sequence: GTGAAT
gcatgctgcagtttttccac

SEQ ID NO: 9165 - DNA, 20 bp, Artificial Sequence
  Description of Artificial Sequence: Synthetic oligonucleotide
  Target: SCN10A; (+) strand; PAM type: NNGRRT; PAM sequence: GGGAGT
ttttccacgtgaatggtggt

SEQ ID NO: 9166 - DNA, 20 bp, Artificial Sequence
  Description of Artificial Sequence: Synthetic oligonucleotide
  Target: SCN10A; (+) strand; PAM type: NNGRRT; PAM sequence: TGGAAT
cacgtgaatggtggtgggag

SEQ ID NO: 9167 - DNA, 20 bp, Artificial Sequence
  Description of Artificial Sequence: Synthetic oligonucleotide
  Target: SCN10A; (+) strand; PAM type: NNGRRT; PAM sequence: GCGGAT
tggtggtgggagtggaataa

SEQ ID NO: 9168 - DNA, 20 bp, Artificial Sequence
  Description of Artificial Sequence: Synthetic oligonucleotide
  Target: SCN10A; (+) strand; PAM type: NNGRRT; PAM sequence: AAGAGT
ataatatcattttgtcagtg

SEQ ID NO: 9169 - DNA, 20 bp, Artificial Sequence
  Description of Artificial Sequence: Synthetic oligonucleotide
  Target: SCN10A; (+) strand; PAM type: NNGRRT; PAM sequence: GTGGGT
tggttcagtagttaaaacgt

SEQ ID NO: 9170 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ggttgtgggacatcacagac

SEQ ID NO: 9171 - DNA, 20 bp, Artificial Sequence
  Description of Artificial Sequence: Synthetic oligonucleotide
  Target: SCN10A; (+) strand; PAM type: NNGRRT; PAM sequence: CAGAAT
tctaattgtcttaaatagga

SEQ ID NO: 9172 - DNA, 20 bp, Artificial Sequence
  Description of Artificial Sequence: Synthetic oligonucleotide
  Target: SCN10A; (+) strand; PAM type: NNGRRT; PAM sequence: TCGGGT
gagagaggtcagaaccaggc

SEQ ID NO: 9173 - DNA, 20 bp, Artificial Sequence
  Description of Artificial Sequence: Synthetic oligonucleotide
  Target: SCN10A; (+) strand; PAM type: NNGRRT; PAM sequence: CAGGGT
agaaggaggaaagcaacgac

SEQ ID NO: 9174 - DNA, 20 bp, Artificial Sequence
  Description of Artificial Sequence: Synthetic oligonucleotide
  Target: SCN10A; (+) strand; PAM type: NNGRRT; PAM sequence: GAGAGT
tatggagaagaaaacaggct

SEQ ID NO: 9175 - DNA, 20 bp, Artificial Sequence
  Description of Artificial Sequence: Synthetic oligonucleotide
  Target: SCN10A; (+) strand; PAM type: NNGRRT; PAM sequence: AAGAGT
catgccacaagactgattca

SEQ ID NO: 9176 - DNA, 20 bp, Artificial Sequence
  Description of Artificial Sequence: Synthetic oligonucleotide
  Target: SCN10A; (+) strand; PAM type: NNGRRT; PAM sequence: TGGAGT
actgattcaaagagtatcta

SEQ ID NO: 9177 - DNA, 20 bp, Artificial Sequence
  Description of Artificial Sequence: Synthetic oligonucleotide
  Target: SCN10A; (+) strand; PAM type: NNGRRT; PAM sequence: GGGGGT
caagtcagtgtggtgtggtg

SEQ ID NO: 9178 - DNA, 20 bp, Artificial Sequence
  Description of Artificial Sequence: Synthetic oligonucleotide
  Target: SCN10A; (+) strand; PAM type: NNGRRT; PAM sequence: TAGGGT
cagtgtggtgtggtgggggg

SEQ ID NO: 9179 - DNA, 20 bp, Artificial Sequence
  Description of Artificial Sequence: Synthetic oligonucleotide
  Target: SCN10A; (+) strand; PAM type: NNGRRT; PAM sequence: CTGGGT
gtcttgtgtcttccagagac

SEQ ID NO: 9180 - DNA, 20 bp, Artificial Sequence
  Description of Artificial Sequence: Synthetic oligonucleotide
  Target: SCN10A; (+) strand; PAM type: NNGRRT; PAM sequence: CTGGAT
tccagagacctgggtccacc

SEQ ID NO: 9181 - DNA, 20 bp, Artificial Sequence
  Description of Artificial Sequence: Synthetic oligonucleotide
  Target: SCN10A; (+) strand; PAM type: NNGRRT; PAM sequence: CAGGAT
accagctatacaattttggg

SEQ ID NO: 9182 - DNA, 20 bp, Artificial Sequence
  Description of Artificial Sequence: Synthetic oligonucleotide
  Target: SCN10A; (+) strand; PAM type: NNGRRT; PAM sequence: CTGAGT
gggcaggatatttaacctct

SEQ ID NO: 9183 - DNA, 20 bp, Artificial Sequence
  Description of Artificial Sequence: Synthetic oligonucleotide
  Target: SCN10A; (+) strand; PAM type: NNGRRT; PAM sequence: GAGGGT
agtgctctcttttgtcatgt

SEQ ID NO: 9184 - DNA, 20 bp, Artificial Sequence
  Description of Artificial Sequence: Synthetic oligonucleotide
  Target: SCN10A; (+) strand; PAM type: NNGRRT; PAM sequence: TAGAAT
tgcttccacttttctaactg

SEQ ID NO: 9185 - DNA, 20 bp, Artificial Sequence
  Description of Artificial Sequence: Synthetic oligonucleotide
  Target: SCN10A; (+) strand; PAM type: NNGRRT; PAM sequence: GAGGGT
cacttttctaactgtagaat

SEQ ID NO: 9186 - DNA, 20 bp, Artificial Sequence
  Description of Artificial Sequence: Synthetic oligonucleotide
  Target: SCN10A; (+) strand; PAM type: NNGRRT; PAM sequence: GGGAAT
tggtcttaggctgacttctt

SEQ ID NO: 9187 - DNA, 20 bp, Artificial Sequence
  Description of Artificial Sequence: Synthetic oligonucleotide
  Target: SCN10A; (+) strand; PAM type: NNGRRT; PAM sequence: TAGGAT
tttccttttcatatcaactt

SEQ ID NO: 9188 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ctgctgcccctttcacagcc

SEQ ID NO: 9189 - DNA, 20 bp, Artificial Sequence
  Description of Artificial Sequence: Synthetic oligonucleotide
  Target: SCN10A; (+) strand; PAM type: NNGRRT; PAM sequence: GGGAGT
cagccctggattatggcgga

SEQ ID NO: 9190 - DNA, 20 bp, Artificial Sequence
  Description of Artificial Sequence: Synthetic oligonucleotide
  Target: SCN10A; (+) strand; PAM type: NNGRRT; PAM sequence: GTGAAT
cccaaagccagacagttctg

SEQ ID NO: 9191 - DNA, 20 bp, Artificial Sequence
  Description of Artificial Sequence: Synthetic oligonucleotide
  Target: SCN10A; (+) strand; PAM type: NNGRRT; PAM sequence: CAGGAT
ccctgctgcggacatgaagg

SEQ ID NO: 9192 - DNA, 20 bp, Artificial Sequence
  Description of Artificial Sequence: Synthetic oligonucleotide
  Target: SCN10A; (+) strand; PAM type: NNGRRT; PAM sequence: AGGGGT
cttgtgaggtggcttaattc

SEQ ID NO: 9193 - DNA, 20 bp, Artificial Sequence
  Description of Artificial Sequence: Synthetic oligonucleotide
  Target: SCN10A; (+) strand; PAM type: NNGRRT; PAM sequence: CTGGGT
gggcttggcagccggtctgt

SEQ ID NO: 9194 - DNA, 20 bp, Artificial Sequence
  Description of Artificial Sequence: Synthetic oligonucleotide
  Target: SCN10A; (+) strand; PAM type: NNGRRT; PAM sequence: GGGAAT
ccatttttccatctgggaaa

SEQ ID NO: 9195 - DNA, 20 bp, Artificial Sequence
  Description of Artificial Sequence: Synthetic oligonucleotide
  Target: SCN10A; (+) strand; PAM type: NNGRRT; PAM sequence: AAGAGT
catctgggaaagggaataac

SEQ ID NO: 9196 - DNA, 20 bp, Artificial Sequence
  Description of Artificial Sequence: Synthetic oligonucleotide
  Target: SCN10A; (+) strand; PAM type: NNGRRT; PAM sequence: TAGGGT
taacaagagtgcctaccatg

SEQ ID NO: 9197 - DNA, 20 bp, Artificial Sequence
  Description of Artificial Sequence: Synthetic oligonucleotide
  Target: SCN10A; (+) strand; PAM type: NNGRRT; PAM sequence: CTGAGT
agataatccatgagaagcat

SEQ ID NO: 9198 - DNA, 20 bp, Artificial Sequence
  Description of Artificial Sequence: Synthetic oligonucleotide
  Target: SCN10A; (+) strand; PAM type: NNGRRT; PAM sequence: GTGGGT
tgagtattattactattcct

SEQ ID NO: 9199 - DNA, 20 bp, Artificial Sequence
  Description of Artificial Sequence: Synthetic oligonucleotide
  Target: SCN10A; (+) strand; PAM type: NNGRRT; PAM sequence: CTGAGT
ttggagcagttgttgtccct

SEQ ID NO: 9200 - DNA, 20 bp, Artificial Sequence
  Description of Artificial Sequence: Synthetic oligonucleotide
  Target: SCN10A; (+) strand; PAM type: NNGRRT; PAM sequence: ATGGAT
agtatatagtgaaatccagt

SEQ ID NO: 9201 - DNA, 20 bp, Artificial Sequence
  Description of Artificial Sequence: Synthetic oligonucleotide
  Target: SCN10A; (+) strand; PAM type: NNGRRT; PAM sequence: AAGAGT
agtatggattgtatcttgtt

SEQ ID NO: 9202 - DNA, 20 bp, Artificial Sequence
  Description of Artificial Sequence: Synthetic oligonucleotide
  Target: SCN10A; (+) strand; PAM type: NNGRRT; PAM sequence: CTGGGT
gccattcccaccagctcagc

SEQ ID NO: 9203 - DNA, 20 bp, Artificial Sequence
  Description of Artificial Sequence: Synthetic oligonucleotide
  Target: SCN10A; (+) strand; PAM type: NNGRRT; PAM sequence: AGGGAT
ggtgatggtgagctctgcaa

SEQ ID NO: 9204 - DNA, 20 bp, Artificial Sequence
  Description of Artificial Sequence: Synthetic oligonucleotide
  Target: SCN10A; (+) strand; PAM type: NNGRRT; PAM sequence: GAGAAT
ggatccgtcacaagcccaaa

SEQ ID NO: 9205 - DNA, 20 bp, Artificial Sequence
  Description of Artificial Sequence: Synthetic oligonucleotide
  Target: SCN10A; (+) strand; PAM type: NNGRRT; PAM sequence: CAGGGT
tctgagacaagctggtcaag

SEQ ID NO: 9206 - DNA, 20 bp, Artificial Sequence
  Description of Artificial Sequence: Synthetic oligonucleotide
  Target: SCN10A; (+) strand; PAM type: NNGRRT; PAM sequence: TCGAGT
ggcacttctgttcagactcc

SEQ ID NO: 9207 - DNA, 20 bp, Artificial Sequence
  Description of Artificial Sequence: Synthetic oligonucleotide
  Target: SCN10A; (+) strand; PAM type: NNGRRT; PAM sequence: GTGAAT
tgcctggcaaaacctgaact

SEQ ID NO: 9208 - DNA, 20 bp, Artificial Sequence
  Description of Artificial Sequence: Synthetic oligonucleotide
  Target: SCN10A; (+) strand; PAM type: NNGRRT; PAM sequence: CAGAAT
gagctcccttttatttcact

SEQ ID NO: 9209 - DNA, 20 bp, Artificial Sequence
  Description of Artificial Sequence: Synthetic oligonucleotide
  Target: SCN10A; (+) strand; PAM type: NNGRRT; PAM sequence: GTGGGT
cttcgtgccccacacagtgc

SEQ ID NO: 9210 - DNA, 20 bp, Artificial Sequence
  Description of Artificial Sequence: Synthetic oligonucleotide
  Target: SCN10A; (+) strand; PAM type: NNGRRT; PAM sequence: AAGAGT
ttgacagtaaaattccttgc

SEQ ID NO: 9211 - DNA, 20 bp, Artificial Sequence
  Description of Artificial Sequence: Synthetic oligonucleotide
  Target: SCN10A; (+) strand; PAM type: NNGRRT; PAM sequence: TGGAAT
ctttttttctctgcagcccc

SEQ ID NO: 9212 - DNA, 20 bp, Artificial Sequence
  Description of Artificial Sequence: Synthetic oligonucleotide
  Target: SCN10A; (+) strand; PAM type: NNGRRT; PAM sequence: CAGAAT
cttacccttataacatttga

SEQ ID NO: 9213 - DNA, 20 bp, Artificial Sequence
  Description of Artificial Sequence: Synthetic oligonucleotide
  Target: SCN10A; (+) strand; PAM type: NNGRRT; PAM sequence: TTGAAT
tcctttcctgcttgtaaatg

SEQ ID NO: 9214 - DNA, 20 bp, Artificial Sequence
  Description of Artificial Sequence: Synthetic oligonucleotide
  Target: SCN10A; (+) strand; PAM type: NNGRRT; PAM sequence: TTGAAT
accttagcttctctgtgttt

SEQ ID NO: 9215 - DNA, 20 bp, Artificial Sequence
  Description of Artificial Sequence: Synthetic oligonucleotide
  Target: SCN10A; (+) strand; PAM type: NNGRRT; PAM sequence: GTGGAT
tgcctccgttaaatctccat

SEQ ID NO: 9216 - DNA, 20 bp, Artificial Sequence
  Description of Artificial Sequence: Synthetic oligonucleotide
  Target: SCN10A; (+) strand; PAM type: NNGRRT; PAM sequence: AAGAAT
aagcataatacattgtgaaa

SEQ ID NO: 9217 - DNA, 20 bp, Artificial Sequence
  Description of Artificial Sequence: Synthetic oligonucleotide
  Target: SCN10A; (+) strand; PAM type: NNGRRT; PAM sequence: AAGAAT
tatgcatagaacattgcttg

SEQ ID NO: 9218 - DNA, 20 bp, Artificial Sequence
  Description of Artificial Sequence: Synthetic oligonucleotide
  Target: SCN10A; (+) strand; PAM type: NNGRRT; PAM sequence: TGGAGT
ttgaagaatataagataaac

SEQ ID NO: 9219 - DNA, 20 bp, Artificial Sequence
  Description of Artificial Sequence: Synthetic oligonucleotide
  Target: SCN10A; (+) strand; PAM type: NNGRRT; PAM sequence: GGGGGT
aagataaactggagtgggag

SEQ ID NO: 9220 - DNA, 20 bp, Artificial Sequence
  Description of Artificial Sequence: Synthetic oligonucleotide
  Target: SCN10A; (+) strand; PAM type: NNGRRT; PAM sequence: AGGAGT
gagtgggaggggggtgcacc

SEQ ID NO: 9221 - DNA, 20 bp, Artificial Sequence
  Description of Artificial Sequence: Synthetic oligonucleotide
  Target: SCN10A; (+) strand; PAM type: NNGRRT; PAM sequence: AAGGGT
ccaggagtctggggagcagg

SEQ ID NO: 9222 - DNA, 20 bp, Artificial Sequence
  Description of Artificial Sequence: Synthetic oligonucleotide
  Target: SCN10A; (+) strand; PAM type: NNGRRT; PAM sequence: TAGGGT
gcatacacacttgcagtgtt

SEQ ID NO: 9223 - DNA, 20 bp, Artificial Sequence
  Description of Artificial Sequence: Synthetic oligonucleotide
  Target: SCN10A; (+) strand; PAM type: NNGRRT; PAM sequence: TAGGGT
ttaaattatactttaagttt

SEQ ID NO: 9224 - DNA, 20 bp, Artificial Sequence
  Description of Artificial Sequence: Synthetic oligonucleotide
  Target: SCN10A; (+) strand; PAM type: NNGRRT; PAM sequence: TTGGGT
tggtgcatttgaaatttatt

SEQ ID NO: 9225 - DNA, 20 bp, Artificial Sequence
  Description of Artificial Sequence: Synthetic oligonucleotide
  Target: SCN10A; (+) strand; PAM type: NNGRRT; PAM sequence: AAGAGT
tttgaaatttattttgggta

SEQ ID NO: 9226 - DNA, 20 bp, Artificial Sequence
  Description of Artificial Sequence: Synthetic oligonucleotide
  Target: SCN10A; (+) strand; PAM type: NNGRRT; PAM sequence: TTGAAT
atttatatcaacattactta

SEQ ID NO: 9227 - DNA, 20 bp, Artificial Sequence
  Description of Artificial Sequence: Synthetic oligonucleotide
  Target: SCN10A; (+) strand; PAM type: NNGRRT; PAM sequence: CTGGAT
catgctgttttaatcactga

SEQ ID NO: 9228 - DNA, 20 bp, Artificial Sequence
  Description of Artificial Sequence: Synthetic oligonucleotide
  Target: SCN10A; (+) strand; PAM type: NNGRRT; PAM sequence: ATGAAT
aagaagcacaggaagtagtc

SEQ ID NO: 9229 - DNA, 20 bp, Artificial Sequence
  Description of Artificial Sequence: Synthetic oligonucleotide
  Target: SCN10A; (+) strand; PAM type: NNGRRT; PAM sequence: AAGGAT
tgaccatggccccacctcaa

SEQ ID NO: 9230 - DNA, 20 bp, Artificial Sequence
  Description of Artificial Sequence: Synthetic oligonucleotide
  Target: SCN10A; (+) strand; PAM type: NNGRRT; PAM sequence: AGGAGT
gcattctctcctgccactgc

SEQ ID NO: 9231 - DNA, 20 bp, Artificial Sequence
  Description of Artificial Sequence: Synthetic oligonucleotide
  Target: SCN10A; (+) strand; PAM type: NNGRRT; PAM sequence: TTGAAT
cctgccactgcaggagtctg

SEQ ID NO: 9232 - DNA, 20 bp, Artificial Sequence
  Description of Artificial Sequence: Synthetic oligonucleotide
  Target: SCN10A; (+) strand; PAM type: NNGRRT; PAM sequence: CTGGGT
ttccttttcagtctcctctg

SEQ ID NO: 9233 - DNA, 20 bp, Artificial Sequence
  Description of Artificial Sequence: Synthetic oligonucleotide
  Target: SCN10A; (+) strand; PAM type: NNGRRT; PAM sequence: ATGAGT
tcccctaaaatgctcccttt

SEQ ID NO: 9234 - DNA, 20 bp, Artificial Sequence
  Description of Artificial Sequence: Synthetic oligonucleotide
  Target: SCN10A; (+) strand; PAM type: NNGRRT; PAM sequence: CTGAAT
accatatgcatcatcaagtc

SEQ ID NO: 9235 - DNA, 20 bp, Artificial Sequence
  Description of Artificial Sequence: Synthetic oligonucleotide
  Target: SCN10A; (+) strand; PAM type: NNGRRT; PAM sequence: CAGAGT
cagccccactgtcactaccc

SEQ ID NO: 9236 - DNA, 20 bp, Artificial Sequence
  Description of Artificial Sequence: Synthetic oligonucleotide
  Target: SCN10A; (+) strand; PAM type: NNGRRT; PAM sequence: CAGAGT
ctcttatatctacaagtatc

SEQ ID NO: 9237 - DNA, 20 bp, Artificial Sequence
  Description of Artificial Sequence: Synthetic oligonucleotide
  Target: SCN10A; (+) strand; PAM type: NNGRRT; PAM sequence: AGGAGT
ccatatccttaatgcagtct

SEQ ID NO: 9238 - DNA, 20 bp, Artificial Sequence
  Description of Artificial Sequence: Synthetic oligonucleotide
  Target: SCN10A; (+) strand; PAM type: NNGRRT; PAM sequence: TGGGAT
aatgcagtctaggagtttct

SEQ ID NO: 9239 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gctttgcagtcctttcagcc

SEQ ID NO: 9240 - DNA, 20 bp, Artificial Sequence
  Description of Artificial Sequence: Synthetic oligonucleotide
  Target: SCN10A; (+) strand; PAM type: NNGRRT; PAM sequence: TGGAAT
cactgctgtgacccagcttc

SEQ ID NO: 9241 - DNA, 20 bp, Artificial Sequence
  Description of Artificial Sequence: Synthetic oligonucleotide
  Target: SCN10A; (+) strand; PAM type: NNGRRT; PAM sequence: TTGAGT
gcatagaaggttcacatgct

SEQ ID NO: 9242 - DNA, 20 bp, Artificial Sequence
  Description of Artificial Sequence: Synthetic oligonucleotide
  Target: SCN10A; (+) strand; PAM type: NNGRRT; PAM sequence: GTGAAT
gttcacatgctttgagttca

SEQ ID NO: 9243 - DNA, 20 bp, Artificial Sequence
  Description of Artificial Sequence: Synthetic oligonucleotide
  Target: SCN10A; (+) strand; PAM type: NNGRRT; PAM sequence: ATGAAT
tcaggtgtctcatgtgtgta

SEQ ID NO: 9244 - DNA, 20 bp, Artificial Sequence
  Description of Artificial Sequence: Synthetic oligonucleotide
  Target: SCN10A; (+) strand; PAM type: NNGRRT; PAM sequence: CTGGGT
tttgtgcatgcacttgtctt

SEQ ID NO: 9245 - DNA, 20 bp, Artificial Sequence
  Description of Artificial Sequence: Synthetic oligonucleotide
  Target: SCN10A; (+) strand; PAM type: NNGRRT; PAM sequence: ATGAGT
aatcataatagccaaatgtg

SEQ ID NO: 9246 - DNA, 20 bp, Artificial Sequence
  Description of Artificial Sequence: Synthetic oligonucleotide
  Target: SCN10A; (+) strand; PAM type: NNGRRT; PAM sequence: TAGGAT
tgtaccataagtggaagagc

SEQ ID NO: 9247 - DNA, 20 bp, Artificial Sequence
  Description of Artificial Sequence: Synthetic oligonucleotide
  Target: SCN10A; (+) strand; PAM type: NNGRRT; PAM sequence: CCGGGT
taggatgcaaacccaggcag

SEQ ID NO: 9248 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ttcttttgtcttacctacac

SEQ ID NO: 9249 - DNA, 20 bp, Artificial Sequence
  Description of Artificial Sequence: Synthetic oligonucleotide
  Target: SCN10A; (+) strand; PAM type: NNGRRT; PAM sequence: CAGAAT
ttgttgctatctcattcttg

SEQ ID NO: 9250 - DNA, 20 bp, Artificial Sequence
  Description of Artificial Sequence: Synthetic oligonucleotide
  Target: SCN10A; (+) strand; PAM type: NNGRRT; PAM sequence: GAGAAT
aaatttctgttcttcttgga

SEQ ID NO: 9251 - DNA, 20 bp, Artificial Sequence
  Description of Artificial Sequence: Synthetic oligonucleotide
  Target: SCN10A; (+) strand; PAM type: NNGRRT; PAM sequence: CTGAAT
ttttctcctacttcttatat

SEQ ID NO: 9252 - DNA, 20 bp, Artificial Sequence
  Description of Artificial Sequence: Synthetic oligonucleotide
  Target: SCN10A; (+) strand; PAM type: NNGRRT; PAM sequence: TAGGAT
tttcatgtccccttccctgc

SEQ ID NO: 9253 - DNA, 20 bp, Artificial Sequence
  Description of Artificial Sequence: Synthetic oligonucleotide
  Target: SCN10A; (+) strand; PAM type: NNGRRT; PAM sequence: CTGAAT
aagcttatatcagttcacca

SEQ ID NO: 9254 - DNA, 20 bp, Artificial Sequence
  Description of Artificial Sequence: Synthetic oligonucleotide
  Target: SCN10A; (+) strand; PAM type: NNGRRT; PAM sequence: GAGAAT
caacaaatgcttgttgataa

SEQ ID NO: 9255 - DNA, 20 bp, Artificial Sequence
  Description of Artificial Sequence: Synthetic oligonucleotide
  Target: SCN10A; (+) strand; PAM type: NNGRRT; PAM sequence: GAGAAT
gaggaagcttaacagttttc

SEQ ID NO: 9256 - DNA, 20 bp, Artificial Sequence
  Description of Artificial Sequence: Synthetic oligonucleotide
  Target: SCN10A; (+) strand; PAM type: NNGRRT; PAM sequence: GGGAAT
ctggccaagaaagaaattgt

SEQ ID NO: 9257 - DNA, 20 bp, Artificial Sequence
  Description of Artificial Sequence: Synthetic oligonucleotide
  Target: SCN10A; (+) strand; PAM type: NNGRRT; PAM sequence: GAGAGT
aatgagaaaaaataatagaa

SEQ ID NO: 9258 - DNA, 20 bp, Artificial Sequence
  Description of Artificial Sequence: Synthetic oligonucleotide
  Target: SCN10A; (+) strand; PAM type: NNGRRT; PAM sequence: ATGAGT
gtacacgttgttgttgagaa

SEQ ID NO: 9259 - DNA, 20 bp, Artificial Sequence
  Description of Artificial Sequence: Synthetic oligonucleotide
  Target: SCN10A; (+) strand; PAM type: NNGRRT; PAM sequence: TTGAAT
atgcaagaaatgtaacttag

SEQ ID NO: 9260 - DNA, 20 bp, Artificial Sequence
  Description of Artificial Sequence: Synthetic oligonucleotide
  Target: SCN10A; (+) strand; PAM type: NNGRRT; PAM sequence: TTGGGT
tgtctcttgttaagtcaatg

SEQ ID NO: 9261 - DNA, 20 bp, Artificial Sequence
  Description of Artificial Sequence: Synthetic oligonucleotide
  Target: SCN10A; (+) strand; PAM type: NNGRRT; PAM sequence: CTGAGT
gttgggtactatttcaatat

SEQ ID NO: 9262 - DNA, 20 bp, Artificial Sequence
  Description of Artificial Sequence: Synthetic oligonucleotide
  Target: SCN10A; (+) strand; PAM type: NNGRRT; PAM sequence: CTGAGT
ttcaatatctgagtctgtgt

SEQ ID NO: 9263 - DNA, 20 bp, Artificial Sequence
  Description of Artificial Sequence: Synthetic oligonucleotide
  Target: SCN10A; (+) strand; PAM type: NNGRRT; PAM sequence: GAGAGT
tgtagggctcaaacctggag

SEQ ID NO: 9264 - DNA, 20 bp, Artificial Sequence
  Description of Artificial Sequence: Synthetic oligonucleotide
  Target: SCN10A; (+) strand; PAM type: NNGRRT; PAM sequence: CTGAGT
cattgctaagcgtattttgc

SEQ ID NO: 9265 - DNA, 20 bp, Artificial Sequence
  Description of Artificial Sequence: Synthetic oligonucleotide
  Target: SCN10A; (+) strand; PAM type: NNGRRT; PAM sequence: GAGAGT
tcccatctggtccctggtgg

SEQ ID NO: 9266 - DNA, 20 bp, Artificial Sequence
  Description of Artificial Sequence: Synthetic oligonucleotide
  Target: SCN10A; (+) strand; PAM type: NNGRRT; PAM sequence: ATGGGT
tctctctctagtttccctct

SEQ ID NO: 9267 - DNA, 20 bp, Artificial Sequence
  Description of Artificial Sequence: Synthetic oligonucleotide
  Target: SCN10A; (+) strand; PAM type: NNGRRT; PAM sequence: GTGAAT
actctacagtttctgtgcat

SEQ ID NO: 9268 - DNA, 20 bp, Artificial Sequence
  Description of Artificial Sequence: Synthetic oligonucleotide
  Target: SCN10A; (+) strand; PAM type: NNGRRT; PAM sequence: TAGGAT
accacttcttcccctcaaat

SEQ ID NO: 9269 - DNA, 20 bp, Artificial Sequence
  Description of Artificial Sequence: Synthetic oligonucleotide
  Target: SCN10A; (+) strand; PAM type: NNGRRT; PAM sequence: GGGAGT
ggtcagtttaatttgtctag

SEQ ID NO: 9270 - DNA, 20 bp, Artificial Sequence
  Description of Artificial Sequence: Synthetic oligonucleotide
  Target: SCN10A; (+) strand; PAM type: NNGRRT; PAM sequence: CTGGAT
taccctaaggcaaaaaaagg

SEQ ID NO: 9271 - DNA, 20 bp, Artificial Sequence
  Description of Artificial Sequence: Synthetic oligonucleotide
  Target: SCN10A; (+) strand; PAM type: NNGRRT; PAM sequence: AGGGAT
gacctcctgctcaaggttag

SEQ ID NO: 9272 - DNA, 20 bp, Artificial Sequence
  Description of Artificial Sequence: Synthetic oligonucleotide
  Target: SCN10A; (+) strand; PAM type: NNGRRT; PAM sequence: GTGGAT
cacgctctatggcaaagtgt

SEQ ID NO: 9273 - DNA, 20 bp, Artificial Sequence
  Description of Artificial Sequence: Synthetic oligonucleotide
  Target: SCN10A; (+) strand; PAM type: NNGRRT; PAM sequence: CTGAGT
tagatacattgctggggaga

SEQ ID NO: 9274 - DNA, 20 bp, Artificial Sequence
  Description of Artificial Sequence: Synthetic oligonucleotide
  Target: SCN10A; (+) strand; PAM type: NNGRRT; PAM sequence: GTGGAT
tacattgctggggagactga

SEQ ID NO: 9275 - DNA, 20 bp, Artificial Sequence
  Description of Artificial Sequence: Synthetic oligonucleotide
  Target: SCN10A; (+) strand; PAM type: NNGRRT; PAM sequence: TAGAAT
gtggattcccacttgattgg

SEQ ID NO: 9276 - DNA, 20 bp, Artificial Sequence
  Description of Artificial Sequence: Synthetic oligonucleotide
  Target: SCN10A; (+) strand; PAM type: NNGRRT; PAM sequence: AAGGAT
tataattatgaaaccatgaa

SEQ ID NO: 9277 - DNA, 20 bp, Artificial Sequence
  Description of Artificial Sequence: Synthetic oligonucleotide
  Target: SCN10A; (+) strand; PAM type: NNGRRT; PAM sequence: AAGGAT
ttttgccatgttggaaaatt

SEQ ID NO: 9278 - DNA, 20 bp, Artificial Sequence
  Description of Artificial Sequence: Synthetic oligonucleotide
  Target: SCN10A; (+) strand; PAM type: NNGRRT; PAM sequence: TAGGAT
aatttgaacaagagatgagc

SEQ ID NO: 9279 - DNA, 20 bp, Artificial Sequence
  Description of Artificial Sequence: Synthetic oligonucleotide
  Target: SCN10A; (+) strand; PAM type: NNGRRT; PAM sequence: AAGAAT
gatggtggggcctaagacat

SEQ ID NO: 9280 - DNA, 20 bp, Artificial Sequence
  Description of Artificial Sequence: Synthetic oligonucleotide
  Target: SCN10A; (+) strand; PAM type: NNGRRT; PAM sequence: AGGAGT
gggcctaagacataagaatg

SEQ ID NO: 9281 - DNA, 20 bp, Artificial Sequence
  Description of Artificial Sequence: Synthetic oligonucleotide
  Target: SCN10A; (+) strand; PAM type: NNGRRT; PAM sequence: AGGAAT
acataagaatgaggagtatt

SEQ ID NO: 9282 - DNA, 20 bp, Artificial Sequence
  Description of Artificial Sequence: Synthetic oligonucleotide
  Target: SCN10A; (+) strand; PAM type: NNGRRT; PAM sequence: ACGAGT
acagagatggacgctttgac

SEQ ID NO: 9283 - DNA, 20 bp, Artificial Sequence
  Description of Artificial Sequence: Synthetic oligonucleotide
  Target: SCN10A; (+) strand; PAM type: NNGRRT; PAM sequence: GGGAAT
attgcttctgctgctcacat

SEQ ID NO: 9284 - DNA, 20 bp, Artificial Sequence
  Description of Artificial Sequence: Synthetic oligonucleotide
  Target: SCN10A; (+) strand; PAM type: NNGRRT; PAM sequence: GTGGAT
tgggaattcatcatgacaca

SEQ ID NO: 9285 - DNA, 20 bp, Artificial Sequence
  Description of Artificial Sequence: Synthetic oligonucleotide
  Target: SCN10A; (+) strand; PAM type: NNGRRT; PAM sequence: TCGAAT
aagtcttcttttgtcctgca

SEQ ID NO: 9286 - DNA, 20 bp, Artificial Sequence
  Description of Artificial Sequence: Synthetic oligonucleotide
  Target: SCN10A; (+) strand; PAM type: NNGRRT; PAM sequence: CAGAGT
aatgcctgttgagacacaaa

SEQ ID NO: 9287 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ctgacatcttcatggcaaag

SEQ ID NO: 9288 - DNA, 20 bp, Artificial Sequence
  Description of Artificial Sequence: Synthetic oligonucleotide
  Target: SCN10A; (+) strand; PAM type: NNGRRT; PAM sequence: GTGAAT
ttaggtgatttcatcattct

SEQ ID NO: 9289 - DNA, 20 bp, Artificial Sequence
  Description of Artificial Sequence: Synthetic oligonucleotide
  Target: SCN10A; (+) strand; PAM type: NNGRRT; PAM sequence: CTGAAT
atctgtacagcatgttattg

SEQ ID NO: 9290 - DNA, 20 bp, Artificial Sequence
  Description of Artificial Sequence: Synthetic oligonucleotide
  Target: SCN10A; (+) strand; PAM type: NNGRRT; PAM sequence: TTGGAT
acaaggggagataaggaggc

SEQ ID NO: 9291 - DNA, 20 bp, Artificial Sequence
  Description of Artificial Sequence: Synthetic oligonucleotide
  Target: SCN10A; (+) strand; PAM type: NNGRRT; PAM sequence: AAGAGT
atactaaacagaagggccta

SEQ ID NO: 9292 - DNA, 20 bp, Artificial Sequence
  Description of Artificial Sequence: Synthetic oligonucleotide
  Target: SCN10A; (+) strand; PAM type: NNGRRT; PAM sequence: TAGAAT
cactagcctggtaatttaac

SEQ ID NO: 9293 - DNA, 20 bp, Artificial Sequence
  Description of Artificial Sequence: Synthetic oligonucleotide
  Target: SCN10A; (+) strand; PAM type: NNGRRT; PAM sequence: ATGAAT
agcctggtaatttaactaga

SEQ ID NO: 9294 - DNA, 20 bp, Artificial Sequence
  Description of Artificial Sequence: Synthetic oligonucleotide
  Target: SCN10A; (+) strand; PAM type: NNGRRT; PAM sequence: CAGAAT
taactagaatgaatcaaggt

SEQ ID NO: 9295 - DNA, 20 bp, Artificial Sequence
  Description of Artificial Sequence: Synthetic oligonucleotide
  Target: SCN10A; (+) strand; PAM type: NNGRRT; PAM sequence: GAGGGT
aatctcaggaacagagaaag

SEQ ID NO: 9296 - DNA, 20 bp, Artificial Sequence
  Description of Artificial Sequence: Synthetic oligonucleotide
  Target: SCN10A; (+) strand; PAM type: NNGRRT; PAM sequence: TAGAGT
gccttcagtgaggcattttc

SEQ ID NO: 9297 - DNA, 20 bp, Artificial Sequence
  Description of Artificial Sequence: Synthetic oligonucleotide
  Target: SCN10A; (+) strand; PAM type: NNGRRT; PAM sequence: CAGGAT
tgcactcccagcgagccctg

SEQ ID NO: 9298 - DNA, 20 bp, Artificial Sequence
  Description of Artificial Sequence: Synthetic oligonucleotide
  Target: SCN10A; (+) strand; PAM type: NNGRRT; PAM sequence: AAGGAT
gagacataggcaggacattc

SEQ ID NO: 9299 - DNA, 20 bp, Artificial Sequence
  Description of Artificial Sequence: Synthetic oligonucleotide
  Target: SCN10A; (+) strand; PAM type: NNGRRT; PAM sequence: CTGAGT
tcttctctcctgtgctatgg

SEQ ID NO: 9300 - DNA, 20 bp, Artificial Sequence
  Description of Artificial Sequence: Synthetic oligonucleotide
  Target: SCN10A; (+) strand; PAM type: NNGRRT; PAM sequence: CGGAGT
aactctctctattagcccat

SEQ ID NO: 9301 - DNA, 20 bp, Artificial Sequence
  Description of Artificial Sequence: Synthetic oligonucleotide
  Target: SCN10A; (+) strand; PAM type: NNGRRT; PAM sequence: CTGAAT
atctgtttcttgctgggacc

SEQ ID NO: 9302 - DNA, 20 bp, Artificial Sequence
  Description of Artificial Sequence: Synthetic oligonucleotide
  Target: SCN10A; (+) strand; PAM type: NNGRRT; PAM sequence: TTGAGT
ggaccctgaatcacatgaca

SEQ ID NO: 9303 - DNA, 20 bp, Artificial Sequence
  Description of Artificial Sequence: Synthetic oligonucleotide
  Target: SCN10A; (+) strand; PAM type: NNGRRT; PAM sequence: AGGAAT
tcacagctcccaatccaatg

SEQ ID NO: 9304 - DNA, 20 bp, Artificial Sequence
  Description of Artificial Sequence: Synthetic oligonucleotide
  Target: SCN10A; (+) strand; PAM type: NNGRRT; PAM sequence: AAGAGT
actctgcgattattctatta

SEQ ID NO: 9305 - DNA, 20 bp, Artificial Sequence
  Description of Artificial Sequence: Synthetic oligonucleotide
  Target: SCN10A; (+) strand; PAM type: NNGRRT; PAM sequence: GTGAGT
tttggcaaattatttcttct

SEQ ID NO: 9306 - DNA, 20 bp, Artificial Sequence
  Description of Artificial Sequence: Synthetic oligonucleotide
  Target: SCN10A; (+) strand; PAM type: NNGRRT; PAM sequence: AGGAAT
tttcttctgtgagtaaagca

SEQ ID NO: 9307 - DNA, 20 bp, Artificial Sequence
  Description of Artificial Sequence: Synthetic oligonucleotide
  Target: SCN10A; (+) strand; PAM type: NNGRRT; PAM sequence: CTGAAT
gatctgtcctaagaaacttc

SEQ ID NO: 9308 - DNA, 20 bp, Artificial Sequence
  Description of Artificial Sequence: Synthetic oligonucleotide
  Target: SCN10A; (+) strand; PAM type: NNGRRT; PAM sequence: CTGGGT
aagaaacttcctgaatttct

SEQ ID NO: 9309 - DNA, 20 bp, Artificial Sequence
  Description of Artificial Sequence: Synthetic oligonucleotide
  Target: SCN10A; (+) strand; PAM type: NNGRRT; PAM sequence: AAGAGT
gtgccatttgcccagcctag

SEQ ID NO: 9310 - DNA, 20 bp, Artificial Sequence
  Description of Artificial Sequence: Synthetic oligonucleotide
  Target: SCN10A; (+) strand; PAM type: NNGRRT; PAM sequence: AAGGGT
agagccataagcaggaagag

SEQ ID NO: 9311 - DNA, 20 bp, Artificial Sequence
  Description of Artificial Sequence: Synthetic oligonucleotide
  Target: SCN10A; (+) strand; PAM type: NNGRRT; PAM sequence: TTGAGT
ctatcactgaggcagtgatg

SEQ ID NO: 9312 - DNA, 20 bp, Artificial Sequence
  Description of Artificial Sequence: Synthetic oligonucleotide
  Target: SCN10A; (+) strand; PAM type: NNGRRT; PAM sequence: TGGGGT
agaagcactgataagaaata

SEQ ID NO: 9313 - DNA, 20 bp, Artificial Sequence
  Description of Artificial Sequence: Synthetic oligonucleotide
  Target: SCN10A; (+) strand; PAM type: NNGRRT; PAM sequence: TGGAAT
ataagaaatatggggtcaaa

SEQ ID NO: 9314 - DNA, 20 bp, Artificial Sequence
  Description of Artificial Sequence: Synthetic oligonucleotide
  Target: SCN10A; (+) strand; PAM type: NNGRRT; PAM sequence: CAGAAT
tataatttgcatcactactg

SEQ ID NO: 9315 - DNA, 20 bp, Artificial Sequence
  Description of Artificial Sequence: Synthetic oligonucleotide
  Target: SCN10A; (+) strand; PAM type: NNGRRT; PAM sequence: CTGGGT
aactcaatctctctctctct

SEQ ID NO: 9316 - DNA, 20 bp, Artificial Sequence
  Description of Artificial Sequence: Synthetic oligonucleotide
  Target: SCN10A; (+) strand; PAM type: NNGRRT; PAM sequence: AGGAGT
atcttctatgtctgtaaaaa

SEQ ID NO: 9317 - DNA, 20 bp, Artificial Sequence
  Description of Artificial Sequence: Synthetic oligonucleotide
  Target: SCN10A; (+) strand; PAM type: NNGRRT; PAM sequence: TAGAAT
ctatgtctgtaaaaaaggag

SEQ ID NO: 9318 - DNA, 20 bp, Artificial Sequence
  Description of Artificial Sequence: Synthetic oligonucleotide
  Target: SCN10A; (+) strand; PAM type: NNGRRT; PAM sequence: CAGGAT
tagaatggggaggcattgga

SEQ ID NO: 9319 - DNA, 20 bp, Artificial Sequence
  Description of Artificial Sequence: Synthetic oligonucleotide
  Target: SCN10A; (+) strand; PAM type: NNGRRT; PAM sequence: GGGAGT
ctaggtggaagacagcctga

SEQ ID NO: 9320 - DNA, 20 bp, Artificial Sequence
  Description of Artificial Sequence: Synthetic oligonucleotide
  Target: SCN10A; (+) strand; PAM type: NNGRRT; PAM sequence: TGGAGT
gtgttcatcttctccatgcc

SEQ ID NO: 9321 - DNA, 20 bp, Artificial Sequence
  Description of Artificial Sequence: Synthetic oligonucleotide
  Target: SCN10A; (+) strand; PAM type: NNGRRT; PAM sequence: CAGGGT
atcttctccatgcctggagt

SEQ ID NO: 9322 - DNA, 20 bp, Artificial Sequence
  Description of Artificial Sequence: Synthetic oligonucleotide
  Target: SCN10A; (+) strand; PAM type: NNGRRT; PAM sequence: CTGGGT
catgcctggagtcagggttg

SEQ ID NO: 9323 - DNA, 20 bp, Artificial Sequence
  Description of Artificial Sequence: Synthetic oligonucleotide
  Target: SCN10A; (+) strand; PAM type: NNGRRT; PAM sequence: GGGAGT
catcatctgtgactccctca

SEQ ID NO: 9324 - DNA, 20 bp, Artificial Sequence
  Description of Artificial Sequence: Synthetic oligonucleotide
  Target: SCN10A; (+) strand; PAM type: NNGRRT; PAM sequence: AGGGGT
taagtaaaggcacaaatcta

SEQ ID NO: 9325 - DNA, 20 bp, Artificial Sequence
  Description of Artificial Sequence: Synthetic oligonucleotide
  Target: SCN10A; (+) strand; PAM type: NNGRRT; PAM sequence: CTGGAT
gtcagaggaaaccttgtcac

SEQ ID NO: 9326 - DNA, 20 bp, Artificial Sequence
  Description of Artificial Sequence: Synthetic oligonucleotide
  Target: SCN10A; (+) strand; PAM type: NNGRRT; PAM sequence: TTGAAT
acatacttggtaagtggttg

SEQ ID NO: 9327 - DNA, 20 bp, Artificial Sequence
  Description of Artificial Sequence: Synthetic oligonucleotide
  Target: SCN10A; (+) strand; PAM type: NNGRRT; PAM sequence: ATGAAT
acttggtaagtggttgttga

SEQ ID NO: 9328 - DNA, 20 bp, Artificial Sequence
  Description of Artificial Sequence: Synthetic oligonucleotide
  Target: SCN10A; (+) strand; PAM type: NNGRRT; PAM sequence: ATGAAT
attcattagatcccatctgt

SEQ ID NO: 9329 - DNA, 20 bp, Artificial Sequence
  Description of Artificial Sequence: Synthetic oligonucleotide
  Target: SCN10A; (+) strand; PAM type: NNGRRT; PAM sequence: GAGAGT
gatcccatctgtatgaatgt

SEQ ID NO: 9330 - DNA, 20 bp, Artificial Sequence
  Description of Artificial Sequence: Synthetic oligonucleotide
  Target: SCN10A; (+) strand; PAM type: NNGRRT; PAM sequence: ATGAGT
gacaagagctgtacagtgca

SEQ ID NO: 9331 - DNA, 20 bp, Artificial Sequence
  Description of Artificial Sequence: Synthetic oligonucleotide
  Target: SCN10A; (+) strand; PAM type: NNGRRT; PAM sequence: TAGGAT
tgtacagtgcaatgagtttc

SEQ ID NO: 9332 - DNA, 20 bp, Artificial Sequence
  Description of Artificial Sequence: Synthetic oligonucleotide
  Target: SCN10A; (+) strand; PAM type: NNGRRT; PAM sequence: AAGGGT
aacaatggagagactgaagg

SEQ ID NO: 9333 - DNA, 20 bp, Artificial Sequence
  Description of Artificial Sequence: Synthetic oligonucleotide
  Target: SCN10A; (+) strand; PAM type: NNGRRT; PAM sequence: AAGAAT
gttgcagcctaatttcctgg

SEQ ID NO: 9334 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tcataaacccagagccctca

SEQ ID NO: 9335 - DNA, 20 bp, Artificial Sequence
  Description of Artificial Sequence: Synthetic oligonucleotide
  Target: SCN10A; (+) strand; PAM type: NNGRRT; PAM sequence: CTGGGT
gccctcagagaattagtgtg

SEQ ID NO: 9336 - DNA, 20 bp, Artificial Sequence
  Description of Artificial Sequence: Synthetic oligonucleotide
  Target: SCN10A; (+) strand; PAM type: NNGRRT; PAM sequence: GAGAAT
attactaagctactaaagtg

SEQ ID NO: 9337 - DNA, 20 bp, Artificial Sequence
  Description of Artificial Sequence: Synthetic oligonucleotide
  Target: SCN10A; (+) strand; PAM type: NNGRRT; PAM sequence: TGGGGT
aagtggagaatcttgccaat

SEQ ID NO: 9338 - DNA, 20 bp, Artificial Sequence
  Description of Artificial Sequence: Synthetic oligonucleotide
  Target: SCN10A; (+) strand; PAM type: NNGRRT; PAM sequence: TAGAGT
taaaagctcagtattataaa

SEQ ID NO: 9339 - DNA, 20 bp, Artificial Sequence
  Description of Artificial Sequence: Synthetic oligonucleotide
  Target: SCN10A; (+) strand; PAM type: NNGRRT; PAM sequence: GGGAAT
gacacatccatattaaggaa

SEQ ID NO: 9340 - DNA, 20 bp, Artificial Sequence
  Description of Artificial Sequence: Synthetic oligonucleotide
  Target: SCN10A; (+) strand; PAM type: NNGRRT; PAM sequence: ACGAGT
acagcagtgtctccttggcc

SEQ ID NO: 9341 - DNA, 20 bp, Artificial Sequence
  Description of Artificial Sequence: Synthetic oligonucleotide
  Target: SCN10A; (+) strand; PAM type: NNGRRT; PAM sequence: TAGAAT
tccttggccacgagttattt

SEQ ID NO: 9342 - DNA, 20 bp, Artificial Sequence
  Description of Artificial Sequence: Synthetic oligonucleotide
  Target: SCN10A; (+) strand; PAM type: NNGRRT; PAM sequence: CTGAGT
caaatggtgggcaatgtctt

SEQ ID NO: 9343 - DNA, 20 bp, Artificial Sequence
  Description of Artificial Sequence: Synthetic oligonucleotide
  Target: SCN10A; (+) strand; PAM type: NNGRRT; PAM sequence: TAGAAT
tgtcttctgagtataagcat

SEQ ID NO: 9344 - DNA, 20 bp, Artificial Sequence
  Description of Artificial Sequence: Synthetic oligonucleotide
  Target: SCN10A; (+) strand; PAM type: NNGRRT; PAM sequence: CTGGGT
gattttccacaaaaaccctc

SEQ ID NO: 9345 - DNA, 20 bp, Artificial Sequence
  Description of Artificial Sequence: Synthetic oligonucleotide
  Target: SCN10A; (+) strand; PAM type: NNGRRT; PAM sequence: ATGAAT
gcattaggtctatttaccac

SEQ ID NO: 9346 - DNA, 20 bp, Artificial Sequence
  Description of Artificial Sequence: Synthetic oligonucleotide
  Target: SCN10A; (+) strand; PAM type: NNGRRT; PAM sequence: GAGGAT
tgtacctgggaaaagaggga

SEQ ID NO: 9347 - DNA, 20 bp, Artificial Sequence
  Description of Artificial Sequence: Synthetic oligonucleotide
  Target: SCN10A; (+) strand; PAM type: NNGRRT; PAM sequence: CTGAGT
aagagggagaggatgccttc

SEQ ID NO: 9348 - DNA, 20 bp, Artificial Sequence
  Description of Artificial Sequence: Synthetic oligonucleotide
  Target: SCN10A; (+) strand; PAM type: NNGRRT; PAM sequence: AAGAGT
tgatacctatccagccccat

SEQ ID NO: 9349 - DNA, 20 bp, Artificial Sequence
  Description of Artificial Sequence: Synthetic oligonucleotide
  Target: SCN10A; (+) strand; PAM type: NNGRRT; PAM sequence: GTGGAT
acctatccagccccataaga

SEQ ID NO: 9350 - DNA, 20 bp, Artificial Sequence
  Description of Artificial Sequence: Synthetic oligonucleotide
  Target: SCN10A; (+) strand; PAM type: NNGRRT; PAM sequence: TTGAAT
ataccaagcacctagtattg

SEQ ID NO: 9351 - DNA, 20 bp, Artificial Sequence
  Description of Artificial Sequence: Synthetic oligonucleotide
  Target: SCN10A; (+) strand; PAM type: NNGRRT; PAM sequence: CAGAAT
gctaatctgtgtggggctga

SEQ ID NO: 9352 - DNA, 20 bp, Artificial Sequence
  Description of Artificial Sequence: Synthetic oligonucleotide
  Target: SCN10A; (+) strand; PAM type: NNGRRT; PAM sequence: GTGGAT
atgcagataaatgctgaagt

SEQ ID NO: 9353 - DNA, 20 bp, Artificial Sequence
  Description of Artificial Sequence: Synthetic oligonucleotide
  Target: SCN10A; (+) strand; PAM type: NNGRRT; PAM sequence: GAGGGT
gtatatgcacacataaatct

SEQ ID NO: 9354 - DNA, 20 bp, Artificial Sequence
  Description of Artificial Sequence: Synthetic oligonucleotide
  Target: SCN10A; (+) strand; PAM type: NNGRRT; PAM sequence: TGGGGT
acctatagaaagggcatatt

SEQ ID NO: 9355 - DNA, 20 bp, Artificial Sequence
  Description of Artificial Sequence: Synthetic oligonucleotide
  Target: SCN10A; (+) strand; PAM type: NNGRRT; PAM sequence: TAGAGT
gaaagttgcagtgcaaattt

SEQ ID NO: 9356 - DNA, 20 bp, Artificial Sequence
  Description of Artificial Sequence: Synthetic oligonucleotide
  Target: SCN10A; (+) strand; PAM type: NNGRRT; PAM sequence: AAGAAT
gaaagttattatggggggaa

SEQ ID NO: 9357 - DNA, 20 bp, Artificial Sequence
  Description of Artificial Sequence: Synthetic oligonucleotide
  Target: SCN10A; (+) strand; PAM type: NNGRRT; PAM sequence: CAGGGT
tggggggaaaagaattgcta

SEQ ID NO: 9358 - DNA, 20 bp, Artificial Sequence
  Description of Artificial Sequence: Synthetic oligonucleotide
  Target: SCN10A; (+) strand; PAM type: NNGRRT; PAM sequence: CTGGAT
gtgctgaagccattcccagg

SEQ ID NO: 9359 - DNA, 20 bp, Artificial Sequence
  Description of Artificial Sequence: Synthetic oligonucleotide
  Target: SCN10A; (+) strand; PAM type: NNGRRT; PAM sequence: ATGGGT
ggctggattgtgtcacagag

SEQ ID NO: 9360 - DNA, 20 bp, Artificial Sequence
  Description of Artificial Sequence: Synthetic oligonucleotide
  Target: SCN10A; (+) strand; PAM type: NNGRRT; PAM sequence: TTGAAT
tgataacaacaggtgacagc

SEQ ID NO: 9361 - DNA, 20 bp, Artificial Sequence
  Description of Artificial Sequence: Synthetic oligonucleotide
  Target: SCN10A; (+) strand; PAM type: NNGRRT; PAM sequence: AAGGAT
agaaaaaaaaaaggtgcatg

SEQ ID NO: 9362 - DNA, 20 bp, Artificial Sequence
  Description of Artificial Sequence: Synthetic oligonucleotide
  Target: SCN10A; (+) strand; PAM type: NNGRRT; PAM sequence: CGGGGT
ttcccacctttcctacaaac

SEQ ID NO: 9363 - DNA, 20 bp, Artificial Sequence
  Description of Artificial Sequence: Synthetic oligonucleotide
  Target: SCN10A; (+) strand; PAM type: NNGRRT; PAM sequence: TGGAAT
ttcctccagtgtcctcatct

SEQ ID NO: 9364 - DNA, 20 bp, Artificial Sequence
  Description of Artificial Sequence: Synthetic oligonucleotide
  Target: SCN10A; (+) strand; PAM type: NNGRRT; PAM sequence: GGGAGT
attgcccaatcctgaaacct

SEQ ID NO: 9365 - DNA, 20 bp, Artificial Sequence
  Description of Artificial Sequence: Synthetic oligonucleotide
  Target: SCN10A; (+) strand; PAM type: NNGRRT; PAM sequence: AGGGGT
agtttaagacaccattttgg

SEQ ID NO: 9366 - DNA, 20 bp, Artificial Sequence
  Description of Artificial Sequence: Synthetic oligonucleotide
  Target: SCN10A; (+) strand; PAM type: NNGRRT; PAM sequence: CTGGAT
acaccattttggaggggtgt

SEQ ID NO: 9367 - DNA, 20 bp, Artificial Sequence
  Description of Artificial Sequence: Synthetic oligonucleotide
  Target: SCN10A; (+) strand; PAM type: NNGRRT; PAM sequence: GTGGGT
tgtctacggcagctgcaatg

SEQ ID NO: 9368 - DNA, 20 bp, Artificial Sequence
  Description of Artificial Sequence: Synthetic oligonucleotide
  Target: SCN10A; (+) strand; PAM type: NNGRRT; PAM sequence: AAGGAT
taccatcctgcgctggttgt

SEQ ID NO: 9369 - DNA, 20 bp, Artificial Sequence
  Description of Artificial Sequence: Synthetic oligonucleotide
  Target: SCN10A; (+) strand; PAM type: NNGRRT; PAM sequence: CGGGGT
gctggttgtaaggatcagag

SEQ ID NO: 9370 - DNA, 20 bp, Artificial Sequence
  Description of Artificial Sequence: Synthetic oligonucleotide
  Target: SCN10A; (+) strand; PAM type: NNGRRT; PAM sequence: GGGAGT
ggttaaaggtgatccattgt

SEQ ID NO: 9371 - DNA, 20 bp, Artificial Sequence
  Description of Artificial Sequence: Synthetic oligonucleotide
  Target: SCN10A; (+) strand; PAM type: NNGRRT; PAM sequence: ATGAAT
agtatttgcttggacttagc

SEQ ID NO: 9372 - DNA, 20 bp, Artificial Sequence
  Description of Artificial Sequence: Synthetic oligonucleotide
  Target: SCN10A; (+) strand; PAM type: NNGRRT; PAM sequence: TGGGGT
atgaatgtgtcccccagaca

SEQ ID NO: 9373 - DNA, 20 bp, Artificial Sequence
  Description of Artificial Sequence: Synthetic oligonucleotide
  Target: SCN10A; (+) strand; PAM type: NNGRRT; PAM sequence: AGGGGT
tcccccagacatggggtgcc

SEQ ID NO: 9374 - DNA, 20 bp, Artificial Sequence
  Description of Artificial Sequence: Synthetic oligonucleotide
  Target: SCN10A; (+) strand; PAM type: NNGRRT; PAM sequence: AAGGGT
gatctgaaacagagaagctg

SEQ ID NO: 9375 - DNA, 20 bp, Artificial Sequence
  Description of Artificial Sequence: Synthetic oligonucleotide
  Target: SCN10A; (+) strand; PAM type: NNGRRT; PAM sequence: CAGGGT
agaagctgaagggttaggac

SEQ ID NO: 9376 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ggttaggaccagggtggtgg

SEQ ID NO: 9377 - DNA, 20 bp, Artificial Sequence
  Description of Artificial Sequence: Synthetic oligonucleotide
  Target: SCN10A; (+) strand; PAM type: NNGRRT; PAM sequence: TCGGGT
ccatggcaggaacagacacc

SEQ ID NO: 9378 - DNA, 20 bp, Artificial Sequence
  Description of Artificial Sequence: Synthetic oligonucleotide
  Target: SCN10A; (+) strand; PAM type: NNGRRT; PAM sequence: TGGGGT
gggtcacccccactcattca

SEQ ID NO: 9379 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ctcttttggctgcctgcttc

SEQ ID NO: 9380 - DNA, 20 bp, Artificial Sequence
  Description of Artificial Sequence: Synthetic oligonucleotide
  Target: SCN10A; (+) strand; PAM type: NNGRRT; PAM sequence: GAGGGT
gcttctgggataggtatggg

SEQ ID NO: 9381 - DNA, 20 bp, Artificial Sequence
  Description of Artificial Sequence: Synthetic oligonucleotide
  Target: SCN10A; (+) strand; PAM type: NNGRRT; PAM sequence: CAGAGT
ctgtggtacaggtcatgccc

SEQ ID NO: 9382 - DNA, 20 bp, Artificial Sequence
  Description of Artificial Sequence: Synthetic oligonucleotide
  Target: SCN10A; (+) strand; PAM type: NNGRRT; PAM sequence: TGGGAT
tcatgccccagagttcccca

SEQ ID NO: 9383 - DNA, 20 bp, Artificial Sequence
  Description of Artificial Sequence: Synthetic oligonucleotide
  Target: SCN10A; (+) strand; PAM type: NNGRRT; PAM sequence: AAGAAT
cctcaataggtcacttgcac

SEQ ID NO: 9384 - DNA, 20 bp, Artificial Sequence
  Description of Artificial Sequence: Synthetic oligonucleotide
  Target: SCN10A; (+) strand; PAM type: NNGRRT; PAM sequence: AAGAAT
gctagtccagaacagtatcc

SEQ ID NO: 9385 - DNA, 20 bp, Artificial Sequence
  Description of Artificial Sequence: Synthetic oligonucleotide
  Target: SCN10A; (+) strand; PAM type: NNGRRT; PAM sequence: CAGGGT
tagattttcccagaagtcct

SEQ ID NO: 9386 - DNA, 20 bp, Artificial Sequence
  Description of Artificial Sequence: Synthetic oligonucleotide
  Target: SCN10A; (+) strand; PAM type: NNGRRT; PAM sequence: CTGAAT
tacccatagcacatggaccc

SEQ ID NO: 9387 - DNA, 20 bp, Artificial Sequence
  Description of Artificial Sequence: Synthetic oligonucleotide
  Target: SCN10A; (+) strand; PAM type: NNGRRT; PAM sequence: GGGAAT
ctccaaccaagtctgcgtgg

SEQ ID NO: 9388 - DNA, 20 bp, Artificial Sequence
  Description of Artificial Sequence: Synthetic oligonucleotide
  Target: SCN10A; (+) strand; PAM type: NNGRRT; PAM sequence: AGGAAT
ctgctggtagaggcgttccc

SEQ ID NO: 9389 - DNA, 20 bp, Artificial Sequence
  Description of Artificial Sequence: Synthetic oligonucleotide
  Target: SCN10A; (+) strand; PAM type: NNGRRT; PAM sequence: AGGAAT
tgagaggaaagcccaagcaa

SEQ ID NO: 9390 - DNA, 20 bp, Artificial Sequence
  Description of Artificial Sequence: Synthetic oligonucleotide
  Target: SCN10A; (+) strand; PAM type: NNGRRT; PAM sequence: CCGGGT
aaagctggtgtagttaaaat

SEQ ID NO: 9391 - DNA, 20 bp, Artificial Sequence
  Description of Artificial Sequence: Synthetic oligonucleotide
  Target: SCN10A; (+) strand; PAM type: NNGRRT; PAM sequence: CAGAGT
ccagggctgcgagacaacca

SEQ ID NO: 9392 - DNA, 20 bp, Artificial Sequence
  Description of Artificial Sequence: Synthetic oligonucleotide
  Target: SCN10A; (+) strand; PAM type: NNGRRT; PAM sequence: CAGAGT
cagagttttatgtcagagat

SEQ ID NO: 9393 - DNA, 20 bp, Artificial Sequence
  Description of Artificial Sequence: Synthetic oligonucleotide
  Target: SCN10A; (+) strand; PAM type: NNGRRT; PAM sequence: CAGGAT
cctagtcttcctcttattag

SEQ ID NO: 9394 - DNA, 20 bp, Artificial Sequence
  Description of Artificial Sequence: Synthetic oligonucleotide
  Target: SCN10A; (+) strand; PAM type: NNGRRT; PAM sequence: CAGAAT
ggacgctaatactttcacgt

SEQ ID NO: 9395 - DNA, 20 bp, Artificial Sequence
  Description of Artificial Sequence: Synthetic oligonucleotide
  Target: SCN10A; (+) strand; PAM type: NNGRRT; PAM sequence: GGGAGT
cgtcagaatttcatacacag

SEQ ID NO: 9396 - DNA, 20 bp, Artificial Sequence
  Description of Artificial Sequence: Synthetic oligonucleotide
  Target: SCN10A; (+) strand; PAM type: NNGRRT; PAM sequence: GAGAGT
ccagttcataccagggaaat

SEQ ID NO: 9397 - DNA, 20 bp, Artificial Sequence
  Description of Artificial Sequence: Synthetic oligonucleotide
  Target: SCN10A; (+) strand; PAM type: NNGRRT; PAM sequence: CAGAGT
gagcctgttggcatcatctg

SEQ ID NO: 9398 - DNA, 20 bp, Artificial Sequence
  Description of Artificial Sequence: Synthetic oligonucleotide
  Target: SCN10A; (+) strand; PAM type: NNGRRT; PAM sequence: AGGAAT
atgttctttctttacagata

SEQ ID NO: 9399 - DNA, 20 bp, Artificial Sequence
  Description of Artificial Sequence: Synthetic oligonucleotide
  Target: SCN10A; (+) strand; PAM type: NNGRRT; PAM sequence: GGGGGT
tctttacagataaggaatct

SEQ ID NO: 9400 - DNA, 20 bp, Artificial Sequence
  Description of Artificial Sequence: Synthetic oligonucleotide
  Target: SCN10A; (+) strand; PAM type: NNGRRT; PAM sequence: TTGAGT
actgtcaagtagcccaatac

SEQ ID NO: 9401 - DNA, 20 bp, Artificial Sequence
  Description of Artificial Sequence: Synthetic oligonucleotide
  Target: SCN10A; (+) strand; PAM type: NNGRRT; PAM sequence: GTGAGT
agattaaaaatgactgcctg

SEQ ID NO: 9402 - DNA, 20 bp, Artificial Sequence
  Description of Artificial Sequence: Synthetic oligonucleotide
  Target: SCN10A; (+) strand; PAM type: NNGRRT; PAM sequence: GGGAAT
tgcctggtgagtattgaggt

SEQ ID NO: 9403 - DNA, 20 bp, Artificial Sequence
  Description of Artificial Sequence: Synthetic oligonucleotide
  Target: SCN10A; (+) strand; PAM type: NNGRRT; PAM sequence: GAGGAT
cttcctctctctcataatag

SEQ ID NO: 9404 - DNA, 20 bp, Artificial Sequence
  Description of Artificial Sequence: Synthetic oligonucleotide
  Target: SCN10A; (+) strand; PAM type: NNGRRT; PAM sequence: ATGAGT
ctctctctcataataggagg

SEQ ID NO: 9405 - DNA, 20 bp, Artificial Sequence
  Description of Artificial Sequence: Synthetic oligonucleotide
  Target: SCN10A; (+) strand; PAM type: NNGRRT; PAM sequence: CAGAAT
gcaatgcctcgtttgaagtc

SEQ ID NO: 9406 - DNA, 20 bp, Artificial Sequence
  Description of Artificial Sequence: Synthetic oligonucleotide
  Target: SCN10A; (+) strand; PAM type: NNGRRT; PAM sequence: GTGAAT
tttatttacctgcattcctt

SEQ ID NO: 9407 - DNA, 20 bp, Artificial Sequence
  Description of Artificial Sequence: Synthetic oligonucleotide
  Target: SCN10A; (+) strand; PAM type: NNGRRT; PAM sequence: TGGAAT
ctgcattccttgtgaataca

SEQ ID NO: 9408 - DNA, 20 bp, Artificial Sequence
  Description of Artificial Sequence: Synthetic oligonucleotide
  Target: SCN10A; (+) strand; PAM type: NNGRRT; PAM sequence: CAGGAT
acatggaattcttttactcc

SEQ ID NO: 9409 - DNA, 20 bp, Artificial Sequence
  Description of Artificial Sequence: Synthetic oligonucleotide
  Target: SCN10A; (+) strand; PAM type: NNGRRT; PAM sequence: ATGGAT
ccatgtgaacaacccatacc

SEQ ID NO: 9410 - DNA, 20 bp, Artificial Sequence
  Description of Artificial Sequence: Synthetic oligonucleotide
  Target: SCN10A; (+) strand; PAM type: NNGRRT; PAM sequence: GAGGAT
tataaacagttcactgctct

SEQ ID NO: 9411 - DNA, 20 bp, Artificial Sequence
  Description of Artificial Sequence: Synthetic oligonucleotide
  Target: SCN10A; (+) strand; PAM type: NNGRRT; PAM sequence: AAGGAT
ttaaccttggaagctgctga

SEQ ID NO: 9412 - DNA, 20 bp, Artificial Sequence
  Description of Artificial Sequence: Synthetic oligonucleotide
  Target: SCN10A; (+) strand; PAM type: NNGRRT; PAM sequence: TGGAAT
aagctgctgaaaggataaac

SEQ ID NO: 9413 - DNA, 20 bp, Artificial Sequence
  Description of Artificial Sequence: Synthetic oligonucleotide
  Target: SCN10A; (+) strand; PAM type: NNGRRT; PAM sequence: CAGGGT
gctttcacggcatgccccgg

SEQ ID NO: 9414 - DNA, 20 bp, Artificial Sequence
  Description of Artificial Sequence: Synthetic oligonucleotide
  Target: SCN10A; (+) strand; PAM type: NNGRRT; PAM sequence: AAGGAT
aaatgccattatctagacag

SEQ ID NO: 9415 - DNA, 20 bp, Artificial Sequence
  Description of Artificial Sequence: Synthetic oligonucleotide
  Target: SCN10A; (+) strand; PAM type: NNGRRT; PAM sequence: GGGGGT
ccgtcagcctctcaggcact

SEQ ID NO: 9416 - DNA, 20 bp, Artificial Sequence
  Description of Artificial Sequence: Synthetic oligonucleotide
  Target: SCN10A; (+) strand; PAM type: NNGRRT; PAM sequence: GTGGGT
ccaagctctcagccatggag

SEQ ID NO: 9417 - DNA, 20 bp, Artificial Sequence
  Description of Artificial Sequence: Synthetic oligonucleotide
  Target: SCN10A; (+) strand; PAM type: NNGRRT; PAM sequence: AGGGGT
caaagcagcaggcagagctg

SEQ ID NO: 9418 - DNA, 20 bp, Artificial Sequence
  Description of Artificial Sequence: Synthetic oligonucleotide
  Target: SCN10A; (+) strand; PAM type: NNGRRT; PAM sequence: TGGAAT
tcacattctgttctgccacc

SEQ ID NO: 9419 - DNA, 20 bp, Artificial Sequence
  Description of Artificial Sequence: Synthetic oligonucleotide
  Target: SCN10A; (+) strand; PAM type: NNGRRT; PAM sequence: CAGGGT
agtaaagaacttgttttcca

SEQ ID NO: 9420 - DNA, 20 bp, Artificial Sequence
  Description of Artificial Sequence: Synthetic oligonucleotide
  Target: SCN10A; (+) strand; PAM type: NNGRRT; PAM sequence: ATGAAT
agggtagcatctttatgtct

SEQ ID NO: 9421 - DNA, 20 bp, Artificial Sequence
  Description of Artificial Sequence: Synthetic oligonucleotide
  Target: SCN10A; (+) strand; PAM type: NNGRRT; PAM sequence: CTGGAT
gcaaactagcagcttatagg

SEQ ID NO: 9422 - DNA, 20 bp, Artificial Sequence
  Description of Artificial Sequence: Synthetic oligonucleotide
  Target: SCN10A; (+) strand; PAM type: NNGRRT; PAM sequence: TGGAAT
aacaatatgtagacattttt

SEQ ID NO: 9423 - DNA, 20 bp, Artificial Sequence
  Description of Artificial Sequence: Synthetic oligonucleotide
  Target: SCN10A; (+) strand; PAM type: NNGRRT; PAM sequence: ATGAAT
cactccactcatttgttgtt

SEQ ID NO: 9424 - DNA, 20 bp, Artificial Sequence
  Description of Artificial Sequence: Synthetic oligonucleotide
  Target: SCN10A; (+) strand; PAM type: NNGRRT; PAM sequence: AAGAAT
gttatgaatctggcctctgt

SEQ ID NO: 9425 - DNA, 20 bp, Artificial Sequence
  Description of Artificial Sequence: Synthetic oligonucleotide
  Target: SCN10A; (+) strand; PAM type: NNGRRT; PAM sequence: GAGGGT
gtgttttttcctctacttgt

SEQ ID NO: 9426 - DNA, 20 bp, Artificial Sequence
  Description of Artificial Sequence: Synthetic oligonucleotide
  Target: SCN10A; (+) strand; PAM type: NNGRRT; PAM sequence: TAGAAT
ttgtgagggtaatgtggcta

SEQ ID NO: 9427 - DNA, 20 bp, Artificial Sequence
  Description of Artificial Sequence: Synthetic oligonucleotide
  Target: SCN10A; (+) strand; PAM type: NNGRRT; PAM sequence: TGGAGT
agggtaatgtggctatagaa

SEQ ID NO: 9428 - DNA, 20 bp, Artificial Sequence
  Description of Artificial Sequence: Synthetic oligonucleotide
  Target: SCN10A; (+) strand; PAM type: NNGRRT; PAM sequence: TGGGGT
aataagtattggttccttcc

SEQ ID NO: 9429 - DNA, 20 bp, Artificial Sequence
  Description of Artificial Sequence: Synthetic oligonucleotide
  Target: SCN10A; (+) strand; PAM type: NNGRRT; PAM sequence: TTGAGT
tgacttttcagctctttcca

SEQ ID NO: 9430 - DNA, 20 bp, Artificial Sequence
  Description of Artificial Sequence: Synthetic oligonucleotide
  Target: SCN10A; (+) strand; PAM type: NNGRRT; PAM sequence: TTGGAT
gaagtctatttctctgtctc

SEQ ID NO: 9431 - DNA, 20 bp, Artificial Sequence
  Description of Artificial Sequence: Synthetic oligonucleotide
  Target: SCN10A; (+) strand; PAM type: NNGRRT; PAM sequence: AAGAAT
gactgcaacttgctttagtc

SEQ ID NO: 9432 - DNA, 20 bp, Artificial Sequence
  Description of Artificial Sequence: Synthetic oligonucleotide
  Target: SCN10A; (+) strand; PAM type: NNGRRT; PAM sequence: CAGAAT
tgctttagtcaagaatgtat

SEQ ID NO: 9433 - DNA, 20 bp, Artificial Sequence
  Description of Artificial Sequence: Synthetic oligonucleotide
  Target: SCN10A; (+) strand; PAM type: NNGRRT; PAM sequence: GGGGGT
aggcccaggctaacctgttt

SEQ ID NO: 9434 - DNA, 20 bp, Artificial Sequence
  Description of Artificial Sequence: Synthetic oligonucleotide
  Target: SCN10A; (+) strand; PAM type: NNGRRT; PAM sequence: ATGAAT
aatatgctgtctgcatatgc

SEQ ID NO: 9435 - DNA, 20 bp, Artificial Sequence
  Description of Artificial Sequence: Synthetic oligonucleotide
  Target: SCN10A; (+) strand; PAM type: NNGRRT; PAM sequence: CAGAAT
cagtccaaaatgctgatgca

SEQ ID NO: 9436 - DNA, 20 bp, Artificial Sequence
  Description of Artificial Sequence: Synthetic oligonucleotide
  Target: SCN10A; (+) strand; PAM type: NNGRRT; PAM sequence: ATGAAT
aaatgctgatgcacagaatc

SEQ ID NO: 9437 - DNA, 20 bp, Artificial Sequence
  Description of Artificial Sequence: Synthetic oligonucleotide
  Target: SCN10A; (+) strand; PAM type: NNGRRT; PAM sequence: TGGGGT
tgttttaattcacaaaattt

SEQ ID NO: 9438 - DNA, 20 bp, Artificial Sequence
  Description of Artificial Sequence: Synthetic oligonucleotide
  Target: SCN10A; (+) strand; PAM type: NNGRRT; PAM sequence: CTGGGT
acattccctccccatgagct

SEQ ID NO: 9439 - DNA, 20 bp, Artificial Sequence
  Description of Artificial Sequence: Synthetic oligonucleotide
  Target: SCN10A; (+) strand; PAM type: NNGRRT; PAM sequence: AGGAAT
tgccaaggacaagatggaga

SEQ ID NO: 9440 - DNA, 20 bp, Artificial Sequence
  Description of Artificial Sequence: Synthetic oligonucleotide
  Target: SCN10A; (+) strand; PAM type: NNGRRT; PAM sequence: CTGAGT
tcataagttgggaactcacc

SEQ ID NO: 9441 - DNA, 20 bp, Artificial Sequence
  Description of Artificial Sequence: Synthetic oligonucleotide
  Target: SCN10A; (+) strand; PAM type: NNGRRT; PAM sequence: AGGGGT
agatccattgccacacagta

SEQ ID NO: 9442 - DNA, 20 bp, Artificial Sequence
  Description of Artificial Sequence: Synthetic oligonucleotide
  Target: SCN10A; (+) strand; PAM type: NNGRRT; PAM sequence: GTGAAT
tccaacccaagccttgtgtg

SEQ ID NO: 9443 - DNA, 20 bp, Artificial Sequence
  Description of Artificial Sequence: Synthetic oligonucleotide
  Target: SCN10A; (+) strand; PAM type: NNGRRT; PAM sequence: TAGAAT
tcaatctcccccagcagagg

SEQ ID NO: 9444 - DNA, 20 bp, Artificial Sequence
  Description of Artificial Sequence: Synthetic oligonucleotide
  Target: SCN10A; (+) strand; PAM type: NNGRRT; PAM sequence: AGGGAT
atggctcatttccttgcaag

SEQ ID NO: 9445 - DNA, 20 bp, Artificial Sequence
  Description of Artificial Sequence: Synthetic oligonucleotide
  Target: SCN10A; (+) strand; PAM type: NNGRRT; PAM sequence: TAGAAT
ggatgctgagcaacaggaaa

SEQ ID NO: 9446 - DNA, 20 bp, Artificial Sequence
  Description of Artificial Sequence: Synthetic oligonucleotide
  Target: SCN10A; (+) strand; PAM type: NNGRRT; PAM sequence: GGGAGT
gaaccattttggcaggaaag

SEQ ID NO: 9447 - DNA, 20 bp, Artificial Sequence
  Description of Artificial Sequence: Synthetic oligonucleotide
  Target: SCN10A; (+) strand; PAM type: NNGRRT; PAM sequence: AAGGGT
ccctgtccctatatgatacc

SEQ ID NO: 9448 - DNA, 20 bp, Artificial Sequence
  Description of Artificial Sequence: Synthetic oligonucleotide
  Target: SCN10A; (+) strand; PAM type: NNGRRT; PAM sequence: ATGAGT
ccactcacgttttctgtgag

SEQ ID NO: 9449 - DNA, 20 bp, Artificial Sequence
  Description of Artificial Sequence: Synthetic oligonucleotide
  Target: SCN10A; (+) strand; PAM type: NNGRRT; PAM sequence: AAGAGT
tatttttgaggttgcccttg

SEQ ID NO: 9450 - DNA, 20 bp, Artificial Sequence
  Description of Artificial Sequence: Synthetic oligonucleotide
  Target: SCN10A; (+) strand; PAM type: NNGRRT; PAM sequence: GAGGAT
acacttaggcagaagatggt

SEQ ID NO: 9451 - DNA, 20 bp, Artificial Sequence
  Description of Artificial Sequence: Synthetic oligonucleotide
  Target: SCN10A; (+) strand; PAM type: NNGRRT; PAM sequence: CTGAGT
cacatcagccagtttcttca

SEQ ID NO: 9452 - DNA, 20 bp, Artificial Sequence
  Description of Artificial Sequence: Synthetic oligonucleotide
  Target: SCN10A; (+) strand; PAM type: NNGRRT; PAM sequence: GTGAAT
tcagccagtttcttcactga

SEQ ID NO: 9453 - DNA, 20 bp, Artificial Sequence
  Description of Artificial Sequence: Synthetic oligonucleotide
  Target: SCN10A; (+) strand; PAM type: NNGRRT; PAM sequence: ATGGAT
gatgacagtggtatgaccac

SEQ ID NO: 9454 - DNA, 20 bp, Artificial Sequence
  Description of Artificial Sequence: Synthetic oligonucleotide
  Target: SCN10A; (+) strand; PAM type: NNGRRT; PAM sequence: AGGAGT
cctccttcatctctacatac

SEQ ID NO: 9455 - DNA, 20 bp, Artificial Sequence
  Description of Artificial Sequence: Synthetic oligonucleotide
  Target: SCN10A; (+) strand; PAM type: NNGRRT; PAM sequence: GAGAGT
tttactctgagaggcaggca

SEQ ID NO: 9456 - DNA, 20 bp, Artificial Sequence
  Description of Artificial Sequence: Synthetic oligonucleotide
  Target: SCN10A; (+) strand; PAM type: NNGRRT; PAM sequence: CTGAGT
ttcaatttaaataatttatg

SEQ ID NO: 9457 - DNA, 20 bp, Artificial Sequence
  Description of Artificial Sequence: Synthetic oligonucleotide
  Target: SCN10A; (+) strand; PAM type: NNGRRT; PAM sequence: GTGAGT
acacatgaacctcactgtgt

SEQ ID NO: 9458 - DNA, 20 bp, Artificial Sequence
  Description of Artificial Sequence: Synthetic oligonucleotide
  Target: SCN10A; (+) strand; PAM type: NNGRRT; PAM sequence: TAGAGT
agagagagatgcaagagaga

SEQ ID NO: 9459 - DNA, 20 bp, Artificial Sequence
  Description of Artificial Sequence: Synthetic oligonucleotide
  Target: SCN10A; (+) strand; PAM type: NNGRRT; PAM sequence: GTGAGT
agacacagagaaacagagag

SEQ ID NO: 9460 - DNA, 20 bp, Artificial Sequence
  Description of Artificial Sequence: Synthetic oligonucleotide
  Target: SCN10A; (+) strand; PAM type: NNGRRT; PAM sequence: AAGGAT
aagcacagctggcagcaaag

SEQ ID NO: 9461 - DNA, 20 bp, Artificial Sequence
  Description of Artificial Sequence: Synthetic oligonucleotide
  Target: SCN10A; (+) strand; PAM type: NNGRRT; PAM sequence: AGGGAT
atacacctgcttgtttaagg

SEQ ID NO: 9462 - DNA, 20 bp, Artificial Sequence
  Description of Artificial Sequence: Synthetic oligonucleotide
  Target: SCN10A; (+) strand; PAM type: NNGRRT; PAM sequence: TAGGAT
ctctgaccagggaagcaatc

SEQ ID NO: 9463 - DNA, 20 bp, Artificial Sequence
  Description of Artificial Sequence: Synthetic oligonucleotide
  Target: SCN10A; (+) strand; PAM type: NNGRRT; PAM sequence: CTGAGT
gtcagtccctggactgggag

SEQ ID NO: 9464 - DNA, 20 bp, Artificial Sequence
  Description of Artificial Sequence: Synthetic oligonucleotide
  Target: SCN10A; (+) strand; PAM type: NNGRRT; PAM sequence: TCGAGT
atggctaaggcagcagcatg

SEQ ID NO: 9465 - DNA, 20 bp, Artificial Sequence
  Description of Artificial Sequence: Synthetic oligonucleotide
  Target: SCN10A; (+) strand; PAM type: NNGRRT; PAM sequence: GGGAAT
ttaactgaagttccagaggt

SEQ ID NO: 9466 - DNA, 20 bp, Artificial Sequence
  Description of Artificial Sequence: Synthetic oligonucleotide
  Target: SCN10A; (+) strand; PAM type: NNGRRT; PAM sequence: TGGGGT
tgaagttccagaggtgggaa

SEQ ID NO: 9467 - DNA, 20 bp, Artificial Sequence
  Description of Artificial Sequence: Synthetic oligonucleotide
  Target: SCN10A; (+) strand; PAM type: NNGRRT; PAM sequence: GTGGGT
gttccagaggtgggaatggg

SEQ ID NO: 9468 - DNA, 20 bp, Artificial Sequence
  Description of Artificial Sequence: Synthetic oligonucleotide
  Target: SCN10A; (+) strand; PAM type: NNGRRT; PAM sequence: TGGAGT
agaggtgggaatggggtggg

SEQ ID NO: 9469 - DNA, 20 bp, Artificial Sequence
  Description of Artificial Sequence: Synthetic oligonucleotide
  Target: SCN10A; (+) strand; PAM type: NNGRRT; PAM sequence: AGGAAT
aaaaccttggcagagccctg

SEQ ID NO: 9470 - DNA, 20 bp, Artificial Sequence
  Description of Artificial Sequence: Synthetic oligonucleotide
  Target: SCN10A; (+) strand; PAM type: NNGRRT; PAM sequence: ATGAGT
ccttggcagagccctgagga

SEQ ID NO: 9471 - DNA, 20 bp, Artificial Sequence
  Description of Artificial Sequence: Synthetic oligonucleotide
  Target: SCN10A; (+) strand; PAM type: NNGRRT; PAM sequence: GTGAGT
cagagccctgaggaatgagt

SEQ ID NO: 9472 - DNA, 20 bp, Artificial Sequence
  Description of Artificial Sequence: Synthetic oligonucleotide
  Target: SCN10A; (+) strand; PAM type: NNGRRT; PAM sequence: TTGAGT
ccctgaggaatgagtgtgag

SEQ ID NO: 9473 - DNA, 20 bp, Artificial Sequence
  Description of Artificial Sequence: Synthetic oligonucleotide
  Target: SCN10A; (+) strand; PAM type: NNGRRT; PAM sequence: AAGGAT
agttgagtaaagagaggagg

SEQ ID NO: 9474 - DNA, 20 bp, Artificial Sequence
  Description of Artificial Sequence: Synthetic oligonucleotide
  Target: SCN10A; (+) strand; PAM type: NNGRRT; PAM sequence: TGGAGT
ctgggaggtgagcaatggtg

SEQ ID NO: 9475 - DNA, 20 bp, Artificial Sequence
  Description of Artificial Sequence: Synthetic oligonucleotide
  Target: SCN10A; (+) strand; PAM type: NNGRRT; PAM sequence: GTGGAT
gagtatttgcagaaccgtag

SEQ ID NO: 9476 - DNA, 20 bp, Artificial Sequence
  Description of Artificial Sequence: Synthetic oligonucleotide
  Target: SCN10A; (+) strand; PAM type: NNGRRT; PAM sequence: CAGGGT
caggtcttgcaaataagact

SEQ ID NO: 9477 - DNA, 20 bp, Artificial Sequence
  Description of Artificial Sequence: Synthetic oligonucleotide
  Target: SCN10A; (+) strand; PAM type: NNGRRT; PAM sequence: GAGAGT
gactcagggtcttcccagtt

SEQ ID NO: 9478 - DNA, 20 bp, Artificial Sequence
  Description of Artificial Sequence: Synthetic oligonucleotide
  Target: SCN10A; (+) strand; PAM type: NNGRRT; PAM sequence: GGGAAT
cttcaagaggtgtgtccagt

SEQ ID NO: 9479 - DNA, 20 bp, Artificial Sequence
  Description of Artificial Sequence: Synthetic oligonucleotide
  Target: SCN10A; (+) strand; PAM type: NNGRRT; PAM sequence: GAGAGT
gtgtccagtgggaattggca

SEQ ID NO: 9480 - DNA, 20 bp, Artificial Sequence
  Description of Artificial Sequence: Synthetic oligonucleotide
  Target: SCN10A; (+) strand; PAM type: NNGRRT; PAM sequence: TAGAAT
ggtagaaaagacttccactc

SEQ ID NO: 9481 - DNA, 20 bp, Artificial Sequence
  Description of Artificial Sequence: Synthetic oligonucleotide
  Target: SCN10A; (+) strand; PAM type: NNGRRT; PAM sequence: ATGGGT
gaaaagacttccactctaga

SEQ ID NO: 9482 - DNA, 20 bp, Artificial Sequence
  Description of Artificial Sequence: Synthetic oligonucleotide
  Target: SCN10A; (+) strand; PAM type: NNGRRT; PAM sequence: ACGAAT
ttctgtttacagataagaga

SEQ ID NO: 9483 - DNA, 20 bp, Artificial Sequence
  Description of Artificial Sequence: Synthetic oligonucleotide
  Target: SCN10A; (+) strand; PAM type: NNGRRT; PAM sequence: TGGGGT
cagataagagaacgaattct

SEQ ID NO: 9484 - DNA, 20 bp, Artificial Sequence
  Description of Artificial Sequence: Synthetic oligonucleotide
  Target: SCN10A; (+) strand; PAM type: NNGRRT; PAM sequence: AAGAGT
catcaacctcatgggggctg

SEQ ID NO: 9485 - DNA, 20 bp, Artificial Sequence
  Description of Artificial Sequence: Synthetic oligonucleotide
  Target: SCN10A; (+) strand; PAM type: NNGRRT; PAM sequence: CTGAAT
ttgatggactacttttgttt

SEQ ID NO: 9486 - DNA, 20 bp, Artificial Sequence
  Description of Artificial Sequence: Synthetic oligonucleotide
  Target: SCN10A; (+) strand; PAM type: NNGRRT; PAM sequence: AAGAAT
tttctgaattctcagtaatc

SEQ ID NO: 9487 - DNA, 20 bp, Artificial Sequence
  Description of Artificial Sequence: Synthetic oligonucleotide
  Target: SCN10A; (+) strand; PAM type: NNGRRT; PAM sequence: CTGGGT
ttgcctaattcttttttcct

SEQ ID NO: 9488 - DNA, 20 bp, Artificial Sequence
  Description of Artificial Sequence: Synthetic oligonucleotide
  Target: SCN10A; (+) strand; PAM type: NNGRRT; PAM sequence: CAGGAT
ttcctctgggtgtctaaaga

SEQ ID NO: 9489 - DNA, 20 bp, Artificial Sequence
  Description of Artificial Sequence: Synthetic oligonucleotide
  Target: SCN10A; (+) strand; PAM type: NNGRRT; PAM sequence: AGGGGT
tataaataaaaattcaactg

SEQ ID NO: 9490 - DNA, 20 bp, Artificial Sequence
  Description of Artificial Sequence: Synthetic oligonucleotide
  Target: SCN10A; (+) strand; PAM type: NNGRRT; PAM sequence: CTGAAT
attcaactgaggggtcttgc

SEQ ID NO: 9491 - DNA, 20 bp, Artificial Sequence
  Description of Artificial Sequence: Synthetic oligonucleotide
  Target: SCN10A; (+) strand; PAM type: NNGRRT; PAM sequence: AGGAGT
tgtgggaagagcactggcct

SEQ ID NO: 9492 - DNA, 20 bp, Artificial Sequence
  Description of Artificial Sequence: Synthetic oligonucleotide
  Target: SCN10A; (+) strand; PAM type: NNGRRT; PAM sequence: TTGGGT
ctcttactagtgaagaggcc

SEQ ID NO: 9493 - DNA, 20 bp, Artificial Sequence
  Description of Artificial Sequence: Synthetic oligonucleotide
  Target: SCN10A; (+) strand; PAM type: NNGRRT; PAM sequence: CAGGGT
gtctttgccctggaacctta

SEQ ID NO: 9494 - DNA, 20 bp, Artificial Sequence
  Description of Artificial Sequence: Synthetic oligonucleotide
  Target: SCN10A; (+) strand; PAM type: NNGRRT; PAM sequence: GGGAGT
ttcttgtgaaaattagagaa

SEQ ID NO: 9495 - DNA, 20 bp, Artificial Sequence
  Description of Artificial Sequence: Synthetic oligonucleotide
  Target: SCN10A; (+) strand; PAM type: NNGRRT; PAM sequence: GTGAAT
tgaaaaccaacatatgctct

SEQ ID NO: 9496 - DNA, 20 bp, Artificial Sequence
  Description of Artificial Sequence: Synthetic oligonucleotide
  Target: SCN10A; (+) strand; PAM type: NNGRRT; PAM sequence: TGGGAT
tctgtgaataaatgctcacc

SEQ ID NO: 9497 - DNA, 20 bp, Artificial Sequence
  Description of Artificial Sequence: Synthetic oligonucleotide
  Target: SCN10A; (+) strand; PAM type: NNGRRT; PAM sequence: CTGAAT
tttttaatgctctaagaact

SEQ ID NO: 9498 - DNA, 20 bp, Artificial Sequence
  Description of Artificial Sequence: Synthetic oligonucleotide
  Target: SCN10A; (+) strand; PAM type: NNGRRT; PAM sequence: AAGGGT
tagtcagcatctctgcaagc

SEQ ID NO: 9499 - DNA, 20 bp, Artificial Sequence
  Description of Artificial Sequence: Synthetic oligonucleotide
  Target: SCN10A; (+) strand; PAM type: NNGRRT; PAM sequence: GGGGAT
tctctgcaagcaagggtcct

SEQ ID NO: 9500 - DNA, 20 bp, Artificial Sequence
  Description of Artificial Sequence: Synthetic oligonucleotide
  Target: SCN10A; (+) strand; PAM type: NNGRRT; PAM sequence: AAGGAT
gggatgcatgcagcataaat

SEQ ID NO: 9501 - DNA, 20 bp, Artificial Sequence
  Description of Artificial Sequence: Synthetic oligonucleotide
  Target: SCN10A; (+) strand; PAM type: NNGRRT; PAM sequence: TGGGGT
cagcataaataaggataacc

SEQ ID NO: 9502 - DNA, 20 bp, Artificial Sequence
  Description of Artificial Sequence: Synthetic oligonucleotide
  Target: SCN10A; (+) strand; PAM type: NNGRRT; PAM sequence: AAGGAT
tggggtatcattagcctaga

SEQ ID NO: 9503 - DNA, 20 bp, Artificial Sequence
  Description of Artificial Sequence: Synthetic oligonucleotide
  Target: SCN10A; (+) strand; PAM type: NNGRRT; PAM sequence: CAGAAT
tcattagcctagaaaggatg

SEQ ID NO: 9504 - DNA, 20 bp, Artificial Sequence
  Description of Artificial Sequence: Synthetic oligonucleotide
  Target: SCN10A; (+) strand; PAM type: NNGRRT; PAM sequence: TAGAAT
aaggatgcagaatggacact

SEQ ID NO: 9505 - DNA, 20 bp, Artificial Sequence
  Description of Artificial Sequence: Synthetic oligonucleotide
  Target: SCN10A; (+) strand; PAM type: NNGRRT; PAM sequence: CAGAGT
ttcattattgcaacatcttt

SEQ ID NO: 9506 - DNA, 20 bp, Artificial Sequence
  Description of Artificial Sequence: Synthetic oligonucleotide
  Target: SCN10A; (+) strand; PAM type: NNGRRT; PAM sequence: ACGGAT
ctaggcaacactgcatgtgg

SEQ ID NO: 9507 - DNA, 20 bp, Artificial Sequence
  Description of Artificial Sequence: Synthetic oligonucleotide
  Target: SCN10A; (+) strand; PAM type: NNGRRT; PAM sequence: AGGAGT
gtggacggatcttcaaacac

SEQ ID NO: 9508 - DNA, 20 bp, Artificial Sequence
  Description of Artificial Sequence: Synthetic oligonucleotide
  Target: SCN10A; (+) strand; PAM type: NNGRRT; PAM sequence: GGGGGT
gaaggagaccgccatgtcag

SEQ ID NO: 9509 - DNA, 20 bp, Artificial Sequence
  Description of Artificial Sequence: Synthetic oligonucleotide
  Target: SCN10A; (+) strand; PAM type: NNGRRT; PAM sequence: CAGAGT
ctgagatgaagaaccttctt

SEQ ID NO: 9510 - DNA, 20 bp, Artificial Sequence
  Description of Artificial Sequence: Synthetic oligonucleotide
  Target: SCN10A; (+) strand; PAM type: NNGRRT; PAM sequence: CTGGAT
accttcttcagagtgtgagc

SEQ ID NO: 9511 - DNA, 20 bp, Artificial Sequence
  Description of Artificial Sequence: Synthetic oligonucleotide
  Target: SCN10A; (+) strand; PAM type: NNGRRT; PAM sequence: ATGAAT
aacaggtggtttttggttac

SEQ ID NO: 9512 - DNA, 20 bp, Artificial Sequence
  Description of Artificial Sequence: Synthetic oligonucleotide
  Target: SCN10A; (+) strand; PAM type: NNGRRT; PAM sequence: TTGGGT
gttttgggaaacaggtggtg

SEQ ID NO: 9513 - DNA, 20 bp, Artificial Sequence
  Description of Artificial Sequence: Synthetic oligonucleotide
  Target: SCN10A; (+) strand; PAM type: NNGRRT; PAM sequence: CTGAGT
tgatgcttgactttctattc

SEQ ID NO: 9514 - DNA, 20 bp, Artificial Sequence
  Description of Artificial Sequence: Synthetic oligonucleotide
  Target: SCN10A; (+) strand; PAM type: NNGRRT; PAM sequence: TAGAAT
tattcctgagttacttcatt

SEQ ID NO: 9515 - DNA, 20 bp, Artificial Sequence
  Description of Artificial Sequence: Synthetic oligonucleotide
  Target: SCN10A; (+) strand; PAM type: NNGRRT; PAM sequence: CTGAGT
tatttcattcctttttacaa

SEQ ID NO: 9516 - DNA, 20 bp, Artificial Sequence
  Description of Artificial Sequence: Synthetic oligonucleotide
  Target: SCN10A; (+) strand; PAM type: NNGRRT; PAM sequence: CTGGGT
taataatggcttattttcct

SEQ ID NO: 9517 - DNA, 20 bp, Artificial Sequence
  Description of Artificial Sequence: Synthetic oligonucleotide
  Target: SCN10A; (+) strand; PAM type: NNGRRT; PAM sequence: TGGGAT
tctgggtagatacccagtag

SEQ ID NO: 9518 - DNA, 20 bp, Artificial Sequence
  Description of Artificial Sequence: Synthetic oligonucleotide
  Target: SCN10A; (+) strand; PAM type: NNGRRT; PAM sequence: AGGAAT
gttctacttttagttcttta

SEQ ID NO: 9519 - DNA, 20 bp, Artificial Sequence
  Description of Artificial Sequence: Synthetic oligonucleotide
  Target: SCN10A; (+) strand; PAM type: NNGRRT; PAM sequence: AGGAGT
ttggttatggccattcttgc

SEQ ID NO: 9520 - DNA, 20 bp, Artificial Sequence
  Description of Artificial Sequence: Synthetic oligonucleotide
  Target: SCN10A; (+) strand; PAM type: NNGRRT; PAM sequence: GAGAAT
ccatttatatatcttctttt

SEQ ID NO: 9521 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ttcttgtcctttgcccactt

SEQ ID NO: 9522 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gtcctttgcccacttttgga

SEQ ID NO: 9523 - DNA, 20 bp, Artificial Sequence
  Description of Artificial Sequence: Synthetic oligonucleotide
  Target: SCN10A; (+) strand; PAM type: NNGRRT; PAM sequence: CTGGAT
atttgtgtttcttatagatg

SEQ ID NO: 9524 - DNA, 20 bp, Artificial Sequence
  Description of Artificial Sequence: Synthetic oligonucleotide
  Target: SCN10A; (+) strand; PAM type: NNGRRT; PAM sequence: ATGGGT
aaagatttttctctcatcct

SEQ ID NO: 9525 - DNA, 20 bp, Artificial Sequence
  Description of Artificial Sequence: Synthetic oligonucleotide
  Target: SCN10A; (+) strand; PAM type: NNGRRT; PAM sequence: TTGGAT
cctatgggttgtctgtttac

SEQ ID NO: 9526 - DNA, 20 bp, Artificial Sequence
  Description of Artificial Sequence: Synthetic oligonucleotide
  Target: SCN10A; (+) strand; PAM type: NNGRRT; PAM sequence: TTGGAT
tctatttatttttgtttttg

SEQ ID NO: 9527 - DNA, 20 bp, Artificial Sequence
  Description of Artificial Sequence: Synthetic oligonucleotide
  Target: SCN10A; (+) strand; PAM type: NNGRRT; PAM sequence: TTGGGT
ttgtttttgttggatttgct

SEQ ID NO: 9528 - DNA, 20 bp, Artificial Sequence
  Description of Artificial Sequence: Synthetic oligonucleotide
  Target: SCN10A; (+) strand; PAM type: NNGRRT; PAM sequence: AAGAGT
ttgcctaagccaatgtctag

SEQ ID NO: 9529 - DNA, 20 bp, Artificial Sequence
  Description of Artificial Sequence: Synthetic oligonucleotide
  Target: SCN10A; (+) strand; PAM type: NNGRRT; PAM sequence: TAGAAT
gtttttccaatgttatcttc

SEQ ID NO: 9530 - DNA, 20 bp, Artificial Sequence
  Description of Artificial Sequence: Synthetic oligonucleotide
  Target: SCN10A; (+) strand; PAM type: NNGRRT; PAM sequence: TTGAAT
atttaagccttttatccatc

SEQ ID NO: 9531 - DNA, 20 bp, Artificial Sequence
  Description of Artificial Sequence: Synthetic oligonucleotide
  Target: SCN10A; (+) strand; PAM type: NNGRRT; PAM sequence: TTGAAT
aattatcccagcaccatttg

SEQ ID NO: 9532 - DNA, 20 bp, Artificial Sequence
  Description of Artificial Sequence: Synthetic oligonucleotide
  Target: SCN10A; (+) strand; PAM type: NNGRRT; PAM sequence: TAGGGT
tcccagcaccatttgttgaa

SEQ ID NO: 9533 - DNA, 20 bp, Artificial Sequence
  Description of Artificial Sequence: Synthetic oligonucleotide
  Target: SCN10A; (+) strand; PAM type: NNGRRT; PAM sequence: CTGAGT
gtaagtatttggctttattt

SEQ ID NO: 9534 - DNA, 20 bp, Artificial Sequence
  Description of Artificial Sequence: Synthetic oligonucleotide
  Target: SCN10A; (+) strand; PAM type: NNGRRT; PAM sequence: GTGGAT
cttagtcttgctttggctat

SEQ ID NO: 9535 - DNA, 20 bp, Artificial Sequence
  Description of Artificial Sequence: Synthetic oligonucleotide
  Target: SCN10A; (+) strand; PAM type: NNGRRT; PAM sequence: ATGAAT
ggattcctttttggttccct

SEQ ID NO: 9536 - DNA, 20 bp, Artificial Sequence
  Description of Artificial Sequence: Synthetic oligonucleotide
  Target: SCN10A; (+) strand; PAM type: NNGRRT; PAM sequence: TAGGGT
ttttggttccctatgaattt

SEQ ID NO: 9537 - DNA, 20 bp, Artificial Sequence
  Description of Artificial Sequence: Synthetic oligonucleotide
  Target: SCN10A; (+) strand; PAM type: NNGRRT; PAM sequence: AAGAAT
ttgttatttctatttctgtg

SEQ ID NO: 9538 - DNA, 20 bp, Artificial Sequence
  Description of Artificial Sequence: Synthetic oligonucleotide
  Target: SCN10A; (+) strand; PAM type: NNGRRT; PAM sequence: TTGAAT
gtacttcaatggaaattgta

SEQ ID NO: 9539 - DNA, 20 bp, Artificial Sequence
  Description of Artificial Sequence: Synthetic oligonucleotide
  Target: SCN10A; (+) strand; PAM type: NNGRRT; PAM sequence: TGGGAT
attttatccatccatgagca

SEQ ID NO: 9540 - DNA, 20 bp, Artificial Sequence
  Description of Artificial Sequence: Synthetic oligonucleotide
  Target: SCN10A; (+) strand; PAM type: NNGRRT; PAM sequence: AGGGAT
ttttttgcagctgttgtaaa

SEQ ID NO: 9541 - DNA, 20 bp, Artificial Sequence
  Description of Artificial Sequence: Synthetic oligonucleotide
  Target: SCN10A; (+) strand; PAM type: NNGRRT; PAM sequence: TTGAGT
tgcagctgttgtaaaaggga

SEQ ID NO: 9542 - DNA, 20 bp, Artificial Sequence
  Description of Artificial Sequence: Synthetic oligonucleotide
  Target: SCN10A; (+) strand; PAM type: NNGRRT; PAM sequence: CTGAAT
ttttgtatcctgaaacttta

SEQ ID NO: 9543 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ttattagatctaggagcttt

SEQ ID NO: 9544 - DNA, 20 bp, Artificial Sequence
  Description of Artificial Sequence: Synthetic oligonucleotide
  Target: SCN10A; (+) strand; PAM type: NNGRRT; PAM sequence: ATGAGT
tagatctaggagctttttgg

SEQ ID NO: 9545 - DNA, 20 bp, Artificial Sequence
  Description of Artificial Sequence: Synthetic oligonucleotide
  Target: SCN10A; (+) strand; PAM type: NNGRRT; PAM sequence: TAGGGT
gagctttttggatgagtctt

SEQ ID NO: 9546 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ttgacttcccctttactgat

SEQ ID NO: 9547 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ctaggacttccagtactatg

SEQ ID NO: 9548 - DNA, 20 bp, Artificial Sequence
  Description of Artificial Sequence: Synthetic oligonucleotide
  Target: SCN10A; (+) strand; PAM type: NNGRRT; PAM sequence: GGGAAT
gtcttgtttcagttctcagg

SEQ ID NO: 9549 - DNA, 20 bp, Artificial Sequence
  Description of Artificial Sequence: Synthetic oligonucleotide
  Target: SCN10A; (+) strand; PAM type: NNGRRT; PAM sequence: GTGGAT
tgtttggtataatgttggct

SEQ ID NO: 9550 - DNA, 20 bp, Artificial Sequence
  Description of Artificial Sequence: Synthetic oligonucleotide
  Target: SCN10A; (+) strand; PAM type: NNGRRT; PAM sequence: TGGAGT
atagatggcttttattacct

SEQ ID NO: 9551 - DNA, 20 bp, Artificial Sequence
  Description of Artificial Sequence: Synthetic oligonucleotide
  Target: SCN10A; (+) strand; PAM type: NNGRRT; PAM sequence: GAGGGT
ccttctatgccaatttggtt

SEQ ID NO: 9552 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gttgagggttttaatcataa

SEQ ID NO: 9553 - DNA, 20 bp, Artificial Sequence
  Description of Artificial Sequence: Synthetic oligonucleotide
  Target: SCN10A; (+) strand; PAM type: NNGRRT; PAM sequence: CTGGAT
gttttaatcataatgggatg

SEQ ID NO: 9554 - DNA, 20 bp, Artificial Sequence
  Description of Artificial Sequence: Synthetic oligonucleotide
  Target: SCN10A; (+) strand; PAM type: NNGRRT; PAM sequence: TTGGAT
tgatcatggtgtgttatctt

SEQ ID NO: 9555 - DNA, 20 bp, Artificial Sequence
  Description of Artificial Sequence: Synthetic oligonucleotide
  Target: SCN10A; (+) strand; PAM type: NNGRRT; PAM sequence: TTGGAT
tgttatcttttggatatgtg

SEQ ID NO: 9556 - DNA, 20 bp, Artificial Sequence
  Description of Artificial Sequence: Synthetic oligonucleotide
  Target: SCN10A; (+) strand; PAM type: NNGRRT; PAM sequence: GAGGAT
caattagctagcattttgtt

SEQ ID NO: 9557 - DNA, 20 bp, Artificial Sequence
  Description of Artificial Sequence: Synthetic oligonucleotide
  Target: SCN10A; (+) strand; PAM type: NNGRRT; PAM sequence: AGGGAT
tttttgcatctatgttcatc

SEQ ID NO: 9558 - DNA, 20 bp, Artificial Sequence
  Description of Artificial Sequence: Synthetic oligonucleotide
  Target: SCN10A; (+) strand; PAM type: NNGRRT; PAM sequence: TAGGGT
tccttttctggttttggtat

SEQ ID NO: 9559 - DNA, 20 bp, Artificial Sequence
  Description of Artificial Sequence: Synthetic oligonucleotide
  Target: SCN10A; (+) strand; PAM type: NNGRRT; PAM sequence: GAGGAT
ggcttcataaaatgatttag

SEQ ID NO: 9560 - DNA, 20 bp, Artificial Sequence
  Description of Artificial Sequence: Synthetic oligonucleotide
  Target: SCN10A; (+) strand; PAM type: NNGRRT; PAM sequence: TGGAAT
ttccctctttctgcatcttt

SEQ ID NO: 9561 - DNA, 20 bp, Artificial Sequence
  Description of Artificial Sequence: Synthetic oligonucleotide
  Target: SCN10A; (+) strand; PAM type: NNGRRT; PAM sequence: TTGAAT
aaattggtaccaattcttct

SEQ ID NO: 9562 - DNA, 20 bp, Artificial Sequence
  Description of Artificial Sequence: Synthetic oligonucleotide
  Target: SCN10A; (+) strand; PAM type: NNGRRT; PAM sequence: TAGAAT
attcttctttgaatgtctga

SEQ ID NO: 9563 - DNA, 20 bp, Artificial Sequence
  Description of Artificial Sequence: Synthetic oligonucleotide
  Target: SCN10A; (+) strand; PAM type: NNGRRT; PAM sequence: GTGAAT
atgtctgatagaattcagct

SEQ ID NO: 9564 - DNA, 20 bp, Artificial Sequence
  Description of Artificial Sequence: Synthetic oligonucleotide
  Target: SCN10A; (+) strand; PAM type: NNGRRT; PAM sequence: TTGAAT
ctttttttccttggcaattt

SEQ ID NO: 9565 - DNA, 20 bp, Artificial Sequence
  Description of Artificial Sequence: Synthetic oligonucleotide
  Target: SCN10A; (+) strand; PAM type: NNGRRT; PAM sequence: TAGAGT
ctacttgttattggtctgtt

SEQ ID NO: 9566 - DNA, 20 bp, Artificial Sequence
  Description of Artificial Sequence: Synthetic oligonucleotide
  Target: SCN10A; (+) strand; PAM type: NNGRRT; PAM sequence: AGGAAT
taagacagttgtatatttcc

SEQ ID NO: 9567 - DNA, 20 bp, Artificial Sequence
  Description of Artificial Sequence: Synthetic oligonucleotide
  Target: SCN10A; (+) strand; PAM type: NNGRRT; PAM sequence: TTGAAT
taaaggtgttcatagtagcc

SEQ ID NO: 9568 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ttatttctaattgagcttat

SEQ ID NO: 9569 - DNA, 20 bp, Artificial Sequence
  Description of Artificial Sequence: Synthetic oligonucleotide
  Target: SCN10A; (+) strand; PAM type: NNGRRT; PAM sequence: TTGAAT
tgtattattattatttttat

SEQ ID NO: 9570 - DNA, 20 bp, Artificial Sequence
  Description of Artificial Sequence: Synthetic oligonucleotide
  Target: SCN10A; (+) strand; PAM type: NNGRRT; PAM sequence: TTGGGT
ttccttttcttctgcttggt

SEQ ID NO: 9571 - DNA, 20 bp, Artificial Sequence
  Description of Artificial Sequence: Synthetic oligonucleotide
  Target: SCN10A; (+) strand; PAM type: NNGRRT; PAM sequence: GAGGGT
tcatgtatttgtatagtttt

SEQ ID NO: 9572 - DNA, 20 bp, Artificial Sequence
  Description of Artificial Sequence: Synthetic oligonucleotide
  Target: SCN10A; (+) strand; PAM type: NNGRRT; PAM sequence: TGGAGT
atagttttgagggtttcttt

SEQ ID NO: 9573 - DNA, 20 bp, Artificial Sequence
  Description of Artificial Sequence: Synthetic oligonucleotide
  Target: SCN10A; (+) strand; PAM type: NNGRRT; PAM sequence: GAGGAT
tttattcgactgtgctctga

SEQ ID NO: 9574 - DNA, 20 bp, Artificial Sequence
  Description of Artificial Sequence: Synthetic oligonucleotide
  Target: SCN10A; (+) strand; PAM type: NNGRRT; PAM sequence: GAGAAT
ctatcacgtggtctatctta

SEQ ID NO: 9575 - DNA, 20 bp, Artificial Sequence
  Description of Artificial Sequence: Synthetic oligonucleotide
  Target: SCN10A; (+) strand; PAM type: NNGRRT; PAM sequence: AAGAAT
atattccatgtgctgatgaa

SEQ ID NO: 9576 - DNA, 20 bp, Artificial Sequence
  Description of Artificial Sequence: Synthetic oligonucleotide
  Target: SCN10A; (+) strand; PAM type: NNGRRT; PAM sequence: TAGAAT
tatattctgcagttgtttgg

SEQ ID NO: 9577 - DNA, 20 bp, Artificial Sequence
  Description of Artificial Sequence: Synthetic oligonucleotide
  Target: SCN10A; (+) strand; PAM type: NNGRRT; PAM sequence: TGGAAT
gacctgtctagtgctgtcag

SEQ ID NO: 9578 - DNA, 20 bp, Artificial Sequence
  Description of Artificial Sequence: Synthetic oligonucleotide
  Target: SCN10A; (+) strand; PAM type: NNGRRT; PAM sequence: TAGGAT
gtgttaggtgcatatgtatt

SEQ ID NO: 9579 - DNA, 20 bp, Artificial Sequence
  Description of Artificial Sequence: Synthetic oligonucleotide
  Target: SCN10A; (+) strand; PAM type: NNGRRT; PAM sequence: AAGAAT
aggtctgttttctctgatat

SEQ ID NO: 9580 - DNA, 20 bp, Artificial Sequence
  Description of Artificial Sequence: Synthetic oligonucleotide
  Target: SCN10A; (+) strand; PAM type: NNGRRT; PAM sequence: TGGAAT
gcttttggtttccatttgca

SEQ ID NO: 9581 - DNA, 20 bp, Artificial Sequence
  Description of Artificial Sequence: Synthetic oligonucleotide
  Target: SCN10A; (+) strand; PAM type: NNGRRT; PAM sequence: GTGAGT
tgtggctccttatgtgttag

SEQ ID NO: 9582 - DNA, 20 bp, Artificial Sequence
  Description of Artificial Sequence: Synthetic oligonucleotide
  Target: SCN10A; (+) strand; PAM type: NNGRRT; PAM sequence: GTGGAT
agacagtagatacttggttg

SEQ ID NO: 9583 - DNA, 20 bp, Artificial Sequence
  Description of Artificial Sequence: Synthetic oligonucleotide
  Target: SCN10A; (+) strand; PAM type: NNGRRT; PAM sequence: GTGGAT
tgcccttctgtatattttaa

SEQ ID NO: 9584 - DNA, 20 bp, Artificial Sequence
  Description of Artificial Sequence: Synthetic oligonucleotide
  Target: SCN10A; (+) strand; PAM type: NNGRRT; PAM sequence: TAGAAT
taaggttttatttcaagatt

SEQ ID NO: 9585 - DNA, 20 bp, Artificial Sequence
  Description of Artificial Sequence: Synthetic oligonucleotide
  Target: SCN10A; (+) strand; PAM type: NNGRRT; PAM sequence: TTGGAT
attctttgagcttcttgtat

SEQ ID NO: 9586 - DNA, 20 bp, Artificial Sequence
  Description of Artificial Sequence: Synthetic oligonucleotide
  Target: SCN10A; (+) strand; PAM type: NNGRRT; PAM sequence: TTGGGT
ttctttttgtgtgtcttagt

SEQ ID NO: 9587 - DNA, 20 bp, Artificial Sequence
  Description of Artificial Sequence: Synthetic oligonucleotide
  Target: SCN10A; (+) strand; PAM type: NNGRRT; PAM sequence: GTGAGT
tgcattttgtatttctctaa

SEQ ID NO: 9588 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tctttatatctatttctctg

SEQ ID NO: 9589 - DNA, 20 bp, Artificial Sequence
  Description of Artificial Sequence: Synthetic oligonucleotide
  Target: SCN10A; (+) strand; PAM type: NNGRRT; PAM sequence: TTGAAT
tatctttctctggtgtctcc

SEQ ID NO: 9590 - DNA, 20 bp, Artificial Sequence
  Description of Artificial Sequence: Synthetic oligonucleotide
  Target: SCN10A; (+) strand; PAM type: NNGRRT; PAM sequence: CTGAAT
atcacttaataatcagcctt

SEQ ID NO: 9591 - DNA, 20 bp, Artificial Sequence
  Description of Artificial Sequence: Synthetic oligonucleotide
  Target: SCN10A; (+) strand; PAM type: NNGRRT; PAM sequence: ATGGAT
cttttttttttttttttgag

SEQ ID NO: 9592 - DNA, 20 bp, Artificial Sequence
  Description of Artificial Sequence: Synthetic oligonucleotide
  Target: SCN10A; (+) strand; PAM type: NNGRRT; PAM sequence: TGGAGT
ttcactcttgttgcccaggc

SEQ ID NO: 9593 - DNA, 20 bp, Artificial Sequence
  Description of Artificial Sequence: Synthetic oligonucleotide
  Target: SCN10A; (+) strand; PAM type: NNGRRT; PAM sequence: CTGAGT
aattctcctgcctcagtctc

SEQ ID NO: 9594 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gcctcagtctcctgagtagc

SEQ ID NO: 9595 - DNA, 20 bp, Artificial Sequence
  Description of Artificial Sequence: Synthetic oligonucleotide
  Target: SCN10A; (+) strand; PAM type: NNGRRT; PAM sequence: CGGGGT
tttgtattttttagtagaga

SEQ ID NO: 9596 - DNA, 20 bp, Artificial Sequence
  Description of Artificial Sequence: Synthetic oligonucleotide
  Target: SCN10A; (+) strand; PAM type: NNGRRT; PAM sequence: CTGAAT
gtgagctactgtgcccagcc

SEQ ID NO: 9597 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ttcagagatttcttcttagt

SEQ ID NO: 9598 - DNA, 20 bp, Artificial Sequence
  Description of Artificial Sequence: Synthetic oligonucleotide
  Target: SCN10A; (+) strand; PAM type: NNGRRT; PAM sequence: AGGGGT
ggagctagtttgatcttttg

SEQ ID NO: 9599 - DNA, 20 bp, Artificial Sequence
  Description of Artificial Sequence: Synthetic oligonucleotide
  Target: SCN10A; (+) strand; PAM type: NNGRRT; PAM sequence: CAGAAT
accctcttttgtcatattac

SEQ ID NO: 9600 - DNA, 20 bp, Artificial Sequence
  Description of Artificial Sequence: Synthetic oligonucleotide
  Target: SCN10A; (+) strand; PAM type: NNGRRT; PAM sequence: TTGAGT
cttttctggttccttctcat

SEQ ID NO: 9601 - DNA, 20 bp, Artificial Sequence
  Description of Artificial Sequence: Synthetic oligonucleotide
  Target: SCN10A; (+) strand; PAM type: NNGRRT; PAM sequence: CTGAAT
ttcagagaaaagatctggaa

SEQ ID NO: 9602 - DNA, 20 bp, Artificial Sequence
  Description of Artificial Sequence: Synthetic oligonucleotide
  Target: SCN10A; (+) strand; PAM type: NNGRRT; PAM sequence: ATGGGT
tgtgcagattcttttgtttc

SEQ ID NO: 9603 - DNA, 20 bp, Artificial Sequence
  Description of Artificial Sequence: Synthetic oligonucleotide
  Target: SCN10A; (+) strand; PAM type: NNGRRT; PAM sequence: GGGGAT
ggtgctctccccaatcccct

SEQ ID NO: 9604 - DNA, 20 bp, Artificial Sequence
  Description of Artificial Sequence: Synthetic oligonucleotide
  Target: SCN10A; (+) strand; PAM type: NNGRRT; PAM sequence: TGGGGT
acagaggggctaccaggctc

SEQ ID NO: 9605 - DNA, 20 bp, Artificial Sequence
  Description of Artificial Sequence: Synthetic oligonucleotide
  Target: SCN10A; (+) strand; PAM type: NNGRRT; PAM sequence: AAGAGT
tagtactgggaaatgcctgc

SEQ ID NO: 9606 - DNA, 20 bp, Artificial Sequence
  Description of Artificial Sequence: Synthetic oligonucleotide
  Target: SCN10A; (+) strand; PAM type: NNGRRT; PAM sequence: ATGGAT
gatcttgaagtctcccagcc

SEQ ID NO: 9607 - DNA, 20 bp, Artificial Sequence
  Description of Artificial Sequence: Synthetic oligonucleotide
  Target: SCN10A; (+) strand; PAM type: NNGRRT; PAM sequence: AGGAAT
tgttctggtgaaggtggcag

SEQ ID NO: 9608 - DNA, 20 bp, Artificial Sequence
  Description of Artificial Sequence: Synthetic oligonucleotide
  Target: SCN10A; (+) strand; PAM type: NNGRRT; PAM sequence: TAGAGT
aaggtggcagaggaatgaag

SEQ ID NO: 9609 - DNA, 20 bp, Artificial Sequence
  Description of Artificial Sequence: Synthetic oligonucleotide
  Target: SCN10A; (+) strand; PAM type: NNGRRT; PAM sequence: GAGAGT
aggaatgaagtagagtctgt

SEQ ID NO: 9610 - DNA, 20 bp, Artificial Sequence
  Description of Artificial Sequence: Synthetic oligonucleotide
  Target: SCN10A; (+) strand; PAM type: NNGRRT; PAM sequence: TTGAAT
gatttagtgtgctggctttc

SEQ ID NO: 9611 - DNA, 20 bp, Artificial Sequence
  Description of Artificial Sequence: Synthetic oligonucleotide
  Target: SCN10A; (+) strand; PAM type: NNGRRT; PAM sequence: CAGGAT
actcaggacgtctggttagc

SEQ ID NO: 9612 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ggttgttgttttctttttcc

SEQ ID NO: 9613 - DNA, 20 bp, Artificial Sequence
  Description of Artificial Sequence: Synthetic oligonucleotide
  Target: SCN10A; (+) strand; PAM type: NNGRRT; PAM sequence: ATGAGT
gggatcaaagttattctgtc

SEQ ID NO: 9614 - DNA, 20 bp, Artificial Sequence
  Description of Artificial Sequence: Synthetic oligonucleotide
  Target: SCN10A; (+) strand; PAM type: NNGRRT; PAM sequence: GGGGAT
cactagtgcattagtagaag

SEQ ID NO: 9615 - DNA, 20 bp, Artificial Sequence
  Description of Artificial Sequence: Synthetic oligonucleotide
  Target: SCN10A; (+) strand; PAM type: NNGRRT; PAM sequence: CAGGGT
taagctcaccctaagttggc

SEQ ID NO: 9616 - DNA, 20 bp, Artificial Sequence
  Description of Artificial Sequence: Synthetic oligonucleotide
  Target: SCN10A; (+) strand; PAM type: NNGRRT; PAM sequence: GAGAGT
agcagggccataaagcttcc

SEQ ID NO: 9617 - DNA, 20 bp, Artificial Sequence
  Description of Artificial Sequence: Synthetic oligonucleotide
  Target: SCN10A; (+) strand; PAM type: NNGRRT; PAM sequence: CTGGGT
cataaagcttccgagagttt

SEQ ID NO: 9618 - DNA, 20 bp, Artificial Sequence
  Description of Artificial Sequence: Synthetic oligonucleotide
  Target: SCN10A; (+) strand; PAM type: NNGRRT; PAM sequence: AGGGGT
aaataccatcaggtgggggc

SEQ ID NO: 9619 - DNA, 20 bp, Artificial Sequence
  Description of Artificial Sequence: Synthetic oligonucleotide
  Target: SCN10A; (+) strand; PAM type: NNGRRT; PAM sequence: GTGAGT
tcaggtgggggcaggggtag

SEQ ID NO: 9620 - DNA, 20 bp, Artificial Sequence
  Description of Artificial Sequence: Synthetic oligonucleotide
  Target: SCN10A; (+) strand; PAM type: NNGRRT; PAM sequence: TTGGGT
agtctagactcagacccttc

SEQ ID NO: 9621 - DNA, 20 bp, Artificial Sequence
  Description of Artificial Sequence: Synthetic oligonucleotide
  Target: SCN10A; (+) strand; PAM type: NNGRRT; PAM sequence: AGGGAT
gactcagacccttcttgggt

SEQ ID NO: 9622 - DNA, 20 bp, Artificial Sequence
  Description of Artificial Sequence: Synthetic oligonucleotide
  Target: SCN10A; (+) strand; PAM type: NNGRRT; PAM sequence: GTGGAT
ggattgctgtggccactgtg

SEQ ID NO: 9623 - DNA, 20 bp, Artificial Sequence
  Description of Artificial Sequence: Synthetic oligonucleotide
  Target: SCN10A; (+) strand; PAM type: NNGRRT; PAM sequence: GGGGGT
ctgtggccactgtggtggat

SEQ ID NO: 9624 - DNA, 20 bp, Artificial Sequence
  Description of Artificial Sequence: Synthetic oligonucleotide
  Target: SCN10A; (+) strand; PAM type: NNGRRT; PAM sequence: TGGGGT
ggggttggttctcaggccag

SEQ ID NO: 9625 - DNA, 20 bp, Artificial Sequence
  Description of Artificial Sequence: Synthetic oligonucleotide
  Target: SCN10A; (+) strand; PAM type: NNGRRT; PAM sequence: GGGAAT
cagtggggttgtgttccaga

SEQ ID NO: 9626 - DNA, 20 bp, Artificial Sequence
  Description of Artificial Sequence: Synthetic oligonucleotide
  Target: SCN10A; (+) strand; PAM type: NNGRRT; PAM sequence: TAGAGT
tggctgcctctgctgtgcca

SEQ ID NO: 9627 - DNA, 20 bp, Artificial Sequence
  Description of Artificial Sequence: Synthetic oligonucleotide
  Target: SCN10A; (+) strand; PAM type: NNGRRT; PAM sequence: GGGGAT
tagagttctccagggaagtg

SEQ ID NO: 9628 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ttgcagttcccatttgcccc

SEQ ID NO: 9629 - DNA, 20 bp, Artificial Sequence
  Description of Artificial Sequence: Synthetic oligonucleotide
  Target: SCN10A; (+) strand; PAM type: NNGRRT; PAM sequence: AAGGGT
ttccactggctgccttcccc

SEQ ID NO: 9630 - DNA, 20 bp, Artificial Sequence
  Description of Artificial Sequence: Synthetic oligonucleotide
  Target: SCN10A; (+) strand; PAM type: NNGRRT; PAM sequence: AGGGAT
ggtgcctgtgagacatagtc

SEQ ID NO: 9631 - DNA, 20 bp, Artificial Sequence
  Description of Artificial Sequence: Synthetic oligonucleotide
  Target: SCN10A; (+) strand; PAM type: NNGRRT; PAM sequence: ATGGAT
cctgtgagacatagtcaggg

SEQ ID NO: 9632 - DNA, 20 bp, Artificial Sequence
  Description of Artificial Sequence: Synthetic oligonucleotide
  Target: SCN10A; (+) strand; PAM type: NNGRRT; PAM sequence: GGGAGT
ctggtctcaagctggagact

SEQ ID NO: 9633 - DNA, 20 bp, Artificial Sequence
  Description of Artificial Sequence: Synthetic oligonucleotide
  Target: SCN10A; (+) strand; PAM type: NNGRRT; PAM sequence: AAGGGT
aatttatttacattccaggt

SEQ ID NO: 9634 - DNA, 20 bp, Artificial Sequence
  Description of Artificial Sequence: Synthetic oligonucleotide
  Target: SCN10A; (+) strand; PAM type: NNGRRT; PAM sequence: CTGGAT
gtaaattcttctcctgtgat

SEQ ID NO: 9635 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ggattttcagattacccagt

SEQ ID NO: 9636 - DNA, 20 bp, Artificial Sequence
  Description of Artificial Sequence: Synthetic oligonucleotide
  Target: SCN10A; (+) strand; PAM type: NNGRRT; PAM sequence: CAGAAT
acagtttttcacctgtcttg

SEQ ID NO: 9637 - DNA, 20 bp, Artificial Sequence
  Description of Artificial Sequence: Synthetic oligonucleotide
  Target: SCN10A; (+) strand; PAM type: NNGRRT; PAM sequence: AAGGAT
gcagtgtgccacttatttaa

SEQ ID NO: 9638 - DNA, 20 bp, Artificial Sequence
  Description of Artificial Sequence: Synthetic oligonucleotide
  Target: SCN10A; (+) strand; PAM type: NNGRRT; PAM sequence: ATGAAT
ccacttatttaaaaggatct

SEQ ID NO: 9639 - DNA, 20 bp, Artificial Sequence
  Description of Artificial Sequence: Synthetic oligonucleotide
  Target: SCN10A; (+) strand; PAM type: NNGRRT; PAM sequence: GTGAGT
ttggagcaaacgttcatggt

SEQ ID NO: 9640 - DNA, 20 bp, Artificial Sequence
  Description of Artificial Sequence: Synthetic oligonucleotide
  Target: SCN10A; (+) strand; PAM type: NNGRRT; PAM sequence: CAGGGT
gcatagagatatactcacgc

SEQ ID NO: 9641 - DNA, 20 bp, Artificial Sequence
  Description of Artificial Sequence: Synthetic oligonucleotide
  Target: SCN10A; (+) strand; PAM type: NNGRRT; PAM sequence: AAGGAT
gctaaaatccagccagttcc

SEQ ID NO: 9642 - DNA, 20 bp, Artificial Sequence
  Description of Artificial Sequence: Synthetic oligonucleotide
  Target: SCN10A; (+) strand; PAM type: NNGRRT; PAM sequence: GAGGGT
gtgaagacatatctgggaag

SEQ ID NO: 9643 - DNA, 20 bp, Artificial Sequence
  Description of Artificial Sequence: Synthetic oligonucleotide
  Target: SCN10A; (+) strand; PAM type: NNGRRT; PAM sequence: AGGAGT
tctgggaaggagggtagaaa

SEQ ID NO: 9644 - DNA, 20 bp, Artificial Sequence
  Description of Artificial Sequence: Synthetic oligonucleotide
  Target: SCN10A; (+) strand; PAM type: NNGRRT; PAM sequence: TGGAGT
aaggagtgtcaactgtgcca

SEQ ID NO: 9645 - DNA, 20 bp, Artificial Sequence
  Description of Artificial Sequence: Synthetic oligonucleotide
  Target: SCN10A; (+) strand; PAM type: NNGRRT; PAM sequence: GGGGGT
tgtgccatggagtgtactca

SEQ ID NO: 9646 - DNA, 20 bp, Artificial Sequence
  Description of Artificial Sequence: Synthetic oligonucleotide
  Target: SCN10A; (+) strand; PAM type: NNGRRT; PAM sequence: AGGGAT
ggttccttcttccaggaggg

SEQ ID NO: 9647 - DNA, 20 bp, Artificial Sequence
  Description of Artificial Sequence: Synthetic oligonucleotide
  Target: SCN10A; (+) strand; PAM type: NNGRRT; PAM sequence: AAGAAT
gctccaagaaaaaacatgca

SEQ ID NO: 9648 - DNA, 20 bp, Artificial Sequence
  Description of Artificial Sequence: Synthetic oligonucleotide
  Target: SCN10A; (+) strand; PAM type: NNGRRT; PAM sequence: TGGAGT
agaagggccacacaaataga

SEQ ID NO: 9649 - DNA, 20 bp, Artificial Sequence
  Description of Artificial Sequence: Synthetic oligonucleotide
  Target: SCN10A; (+) strand; PAM type: NNGRRT; PAM sequence: AGGGAT
cacaaatagatggagtgggg

SEQ ID NO: 9650 - DNA, 20 bp, Artificial Sequence
  Description of Artificial Sequence: Synthetic oligonucleotide
  Target: SCN10A; (+) strand; PAM type: NNGRRT; PAM sequence: TGGGGT
gccagcagcttctgctgttc

SEQ ID NO: 9651 - DNA, 20 bp, Artificial Sequence
  Description of Artificial Sequence: Synthetic oligonucleotide
  Target: SCN10A; (+) strand; PAM type: NNGRRT; PAM sequence: GCGGGT
gggttaggcagagggcagta

SEQ ID NO: 9652 - DNA, 20 bp, Artificial Sequence
  Description of Artificial Sequence: Synthetic oligonucleotide
  Target: SCN10A; (+) strand; PAM type: NNGRRT; PAM sequence: AAGGAT
ggcagtagcgggtgaagagc

SEQ ID NO: 9653 - DNA, 20 bp, Artificial Sequence
  Description of Artificial Sequence: Synthetic oligonucleotide
  Target: SCN10A; (+) strand; PAM type: NNGRRT; PAM sequence: TGGAGT
aactcccagtttttagaaac

SEQ ID NO: 9654 - DNA, 20 bp, Artificial Sequence
  Description of Artificial Sequence: Synthetic oligonucleotide
  Target: SCN10A; (+) strand; PAM type: NNGRRT; PAM sequence: ATGAGT
agaaactggagtgcagactg

SEQ ID NO: 9655 - DNA, 20 bp, Artificial Sequence
  Description of Artificial Sequence: Synthetic oligonucleotide
  Target: SCN10A; (+) strand; PAM type: NNGRRT; PAM sequence: GGGAAT
gctgaaaactggctgaagca

SEQ ID NO: 9656 - DNA, 20 bp, Artificial Sequence
  Description of Artificial Sequence: Synthetic oligonucleotide
  Target: SCN10A; (+) strand; PAM type: NNGRRT; PAM sequence: GAGGGT
tctgaaagcaaggtttgggg

SEQ ID NO: 9657 - DNA, 20 bp, Artificial Sequence
  Description of Artificial Sequence: Synthetic oligonucleotide
  Target: SCN10A; (+) strand; PAM type: NNGRRT; PAM sequence: AAGAAT
agggtgataagtagggctga

SEQ ID NO: 9658 - DNA, 20 bp, Artificial Sequence
  Description of Artificial Sequence: Synthetic oligonucleotide
  Target: SCN10A; (+) strand; PAM type: NNGRRT; PAM sequence: ATGGAT
aaactgtttctgctccagaa

SEQ ID NO: 9659 - DNA, 20 bp, Artificial Sequence
  Description of Artificial Sequence: Synthetic oligonucleotide
  Target: SCN10A; (+) strand; PAM type: NNGRRT; PAM sequence: TTGGAT
gtttctgctccagaaatgga

SEQ ID NO: 9660 - DNA, 20 bp, Artificial Sequence
  Description of Artificial Sequence: Synthetic oligonucleotide
  Target: SCN10A; (+) strand; PAM type: NNGRRT; PAM sequence: AAGAGT
gattggatgctcattttctt

SEQ ID NO: 9661 - DNA, 20 bp, Artificial Sequence
  Description of Artificial Sequence: Synthetic oligonucleotide
  Target: SCN10A; (+) strand; PAM type: NNGRRT; PAM sequence: AGGAAT
acagccagccaaggagcatc

SEQ ID NO: 9662 - DNA, 20 bp, Artificial Sequence
  Description of Artificial Sequence: Synthetic oligonucleotide
  Target: SCN10A; (+) strand; PAM type: NNGRRT; PAM sequence: AAGGAT
caaggagcatcaggaatttg

SEQ ID NO: 9663 - DNA, 20 bp, Artificial Sequence
  Description of Artificial Sequence: Synthetic oligonucleotide
  Target: SCN10A; (+) strand; PAM type: NNGRRT; PAM sequence: AAGAGT
gacaataaagagggcagaag

SEQ ID NO: 9664 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tactccggaggctgaggcgg

SEQ ID NO: 9665 - DNA, 20 bp, Artificial Sequence
  Description of Artificial Sequence: Synthetic oligonucleotide
  Target: SCN10A; (+) strand; PAM type: NNGRRT; PAM sequence: CTGGGT
tcgcgtcactgcactccagt

SEQ ID NO: 9666 - DNA, 20 bp, Artificial Sequence
  Description of Artificial Sequence: Synthetic oligonucleotide
  Target: SCN10A; (+) strand; PAM type: NNGRRT; PAM sequence: GAGAGT
aacctgtactaatattttta

SEQ ID NO: 9667 - DNA, 20 bp, Artificial Sequence
  Description of Artificial Sequence: Synthetic oligonucleotide
  Target: SCN10A; (+) strand; PAM type: NNGRRT; PAM sequence: AAGGAT
cacgtatagaacaagagcag

SEQ ID NO: 9668 - DNA, 20 bp, Artificial Sequence
  Description of Artificial Sequence: Synthetic oligonucleotide
  Target: SCN10A; (+) strand; PAM type: NNGRRT; PAM sequence: TGGAAT
aagtaccttcaaagacaaaa

SEQ ID NO: 9669 - DNA, 20 bp, Artificial Sequence
  Description of Artificial Sequence: Synthetic oligonucleotide
  Target: SCN10A; (+) strand; PAM type: NNGRRT; PAM sequence: ATGGAT
agtggaacaaaaaagcagaa

SEQ ID NO: 9670 - DNA, 20 bp, Artificial Sequence
  Description of Artificial Sequence: Synthetic oligonucleotide
  Target: SCN10A; (+) strand; PAM type: NNGRRT; PAM sequence: GAGAAT
gataaaaagtttgaaaatta

SEQ ID NO: 9671 - DNA, 20 bp, Artificial Sequence
  Description of Artificial Sequence: Synthetic oligonucleotide
  Target: SCN10A; (+) strand; PAM type: NNGRRT; PAM sequence: TAGAAT
agccaaactgtcaaagaagg

SEQ ID NO: 9672 - DNA, 20 bp, Artificial Sequence
  Description of Artificial Sequence: Synthetic oligonucleotide
  Target: SCN10A; (+) strand; PAM type: NNGRRT; PAM sequence: GAGGAT
tacttgggaggttgaggcag

SEQ ID NO: 9673 - DNA, 20 bp, Artificial Sequence
  Description of Artificial Sequence: Synthetic oligonucleotide
  Target: SCN10A; (+) strand; PAM type: NNGRRT; PAM sequence: AGGAGT
caggaggatcacttgaaccc

SEQ ID NO: 9674 - DNA, 20 bp, Artificial Sequence
  Description of Artificial Sequence: Synthetic oligonucleotide
  Target: SCN10A; (+) strand; PAM type: NNGRRT; PAM sequence: GAGGAT
cttaaaaaaaaatgttacta

SEQ ID NO: 9675 - DNA, 20 bp, Artificial Sequence
  Description of Artificial Sequence: Synthetic oligonucleotide
  Target: SCN10A; (+) strand; PAM type: NNGRRT; PAM sequence: AGGAAT
cgatccagggaagaggcaaa

SEQ ID NO: 9676 - DNA, 20 bp, Artificial Sequence
  Description of Artificial Sequence: Synthetic oligonucleotide
  Target: SCN10A; (+) strand; PAM type: NNGRRT; PAM sequence: AAGAAT
aggcaaaaggaatccaaaaa

SEQ ID NO: 9677 - DNA, 20 bp, Artificial Sequence
  Description of Artificial Sequence: Synthetic oligonucleotide
  Target: SCN10A; (+) strand; PAM type: NNGRRT; PAM sequence: CAGAAT
ggcctagaaaacatctaggt

SEQ ID NO: 9678 - DNA, 20 bp, Artificial Sequence
  Description of Artificial Sequence: Synthetic oligonucleotide
  Target: SCN10A; (+) strand; PAM type: NNGRRT; PAM sequence: AAGAGT
caacaattaaacatctggag

SEQ ID NO: 9679 - DNA, 20 bp, Artificial Sequence
  Description of Artificial Sequence: Synthetic oligonucleotide
  Target: SCN10A; (+) strand; PAM type: NNGRRT; PAM sequence: AGGGAT
gaagagtttgggaacaaatt

SEQ ID NO: 9680 - DNA, 20 bp, Artificial Sequence
  Description of Artificial Sequence: Synthetic oligonucleotide
  Target: SCN10A; (+) strand; PAM type: NNGRRT; PAM sequence: ATGGAT
attatatatgtagtcataca

SEQ ID NO: 9681 - DNA, 20 bp, Artificial Sequence
  Description of Artificial Sequence: Synthetic oligonucleotide
  Target: SCN10A; (+) strand; PAM type: NNGRRT; PAM sequence: GAGGGT
tataactgtaacaggaagat

SEQ ID NO: 9682 - DNA, 20 bp, Artificial Sequence
  Description of Artificial Sequence: Synthetic oligonucleotide
  Target: SCN10A; (+) strand; PAM type: NNGRRT; PAM sequence: ATGAGT
gaagatgagggtgagaggaa

SEQ ID NO: 9683 - DNA, 20 bp, Artificial Sequence
  Description of Artificial Sequence: Synthetic oligonucleotide
  Target: SCN10A; (+) strand; PAM type: NNGRRT; PAM sequence: GTGGAT
gggtgagaggaaatgagttt

SEQ ID NO: 9684 - DNA, 20 bp, Artificial Sequence
  Description of Artificial Sequence: Synthetic oligonucleotide
  Target: SCN10A; (+) strand; PAM type: NNGRRT; PAM sequence: ATGAGT
aaaaattaaaaattagtatt

SEQ ID NO: 9685 - DNA, 20 bp, Artificial Sequence
  Description of Artificial Sequence: Synthetic oligonucleotide
  Target: SCN10A; (+) strand; PAM type: NNGRRT; PAM sequence: CAGAAT
gaaattgctgttttttttgt

SEQ ID NO: 9686 - DNA, 20 bp, Artificial Sequence
  Description of Artificial Sequence: Synthetic oligonucleotide
  Target: SCN10A; (+) strand; PAM type: NNGRRT; PAM sequence: GTGAAT
agtaaaagtcaagttaaaaa

SEQ ID NO: 9687 - DNA, 20 bp, Artificial Sequence
  Description of Artificial Sequence: Synthetic oligonucleotide
  Target: SCN10A; (+) strand; PAM type: NNGRRT; PAM sequence: AGGAAT
aatcgtgtttgaaatcattt

SEQ ID NO: 9688 - DNA, 20 bp, Artificial Sequence
  Description of Artificial Sequence: Synthetic oligonucleotide
  Target: SCN10A; (+) strand; PAM type: NNGRRT; PAM sequence: CAGAAT
taaattagaaaatcttaact

SEQ ID NO: 9689 - DNA, 20 bp, Artificial Sequence
  Description of Artificial Sequence: Synthetic oligonucleotide
  Target: SCN10A; (+) strand; PAM type: NNGRRT; PAM sequence: ATGGAT
taggttgttgggaagctttg

SEQ ID NO: 9690 - DNA, 20 bp, Artificial Sequence
  Description of Artificial Sequence: Synthetic oligonucleotide
  Target: SCN10A; (+) strand; PAM type: NNGRRT; PAM sequence: GAGAGT
acagacccagaaattatgga

SEQ ID NO: 9691 - DNA, 20 bp, Artificial Sequence
  Description of Artificial Sequence: Synthetic oligonucleotide
  Target: SCN10A; (+) strand; PAM type: NNGRRT; PAM sequence: TGGAGT
cccagctcaacagcagctaa

SEQ ID NO: 9692 - DNA, 20 bp, Artificial Sequence
  Description of Artificial Sequence: Synthetic oligonucleotide
  Target: SCN10A; (+) strand; PAM type: NNGRRT; PAM sequence: TTGGGT
ctgcaaggtatttcttgatg

SEQ ID NO: 9693 - DNA, 20 bp, Artificial Sequence
  Description of Artificial Sequence: Synthetic oligonucleotide
  Target: SCN10A; (+) strand; PAM type: NNGRRT; PAM sequence: GTGAAT
tttcctaagtgctttttctg

SEQ ID NO: 9694 - DNA, 20 bp, Artificial Sequence
  Description of Artificial Sequence: Synthetic oligonucleotide
  Target: SCN10A; (+) strand; PAM type: NNGRRT; PAM sequence: TTGGGT
ctggtgaatgaagaaaatca

SEQ ID NO: 9695 - DNA, 20 bp, Artificial Sequence
  Description of Artificial Sequence: Synthetic oligonucleotide
  Target: SCN10A; (+) strand; PAM type: NNGRRT; PAM sequence: CTGAAT
agattcataatattcaaatt

SEQ ID NO: 9696 - DNA, 20 bp, Artificial Sequence
  Description of Artificial Sequence: Synthetic oligonucleotide
  Target: SCN10A; (+) strand; PAM type: NNGRRT; PAM sequence: ATGGAT
tcataatattcaaattctga

SEQ ID NO: 9697 - DNA, 20 bp, Artificial Sequence
  Description of Artificial Sequence: Synthetic oligonucleotide
  Target: SCN10A; (+) strand; PAM type: NNGRRT; PAM sequence: CAGAAT
tgtgtacctcaacagcaaat

SEQ ID NO: 9698 - DNA, 20 bp, Artificial Sequence
  Description of Artificial Sequence: Synthetic oligonucleotide
  Target: SCN10A; (+) strand; PAM type: NNGRRT; PAM sequence: GTGAAT
cagacccccagctgcgttcc

SEQ ID NO: 9699 - DNA, 20 bp, Artificial Sequence
  Description of Artificial Sequence: Synthetic oligonucleotide
  Target: SCN10A; (+) strand; PAM type: NNGRRT; PAM sequence: TGGGAT
aataaggtatgcactagcat

SEQ ID NO: 9700 - DNA, 20 bp, Artificial Sequence
  Description of Artificial Sequence: Synthetic oligonucleotide
  Target: SCN10A; (+) strand; PAM type: NNGRRT; PAM sequence: CTGGAT
ctgggagcagcatcttctat

SEQ ID NO: 9701 - DNA, 20 bp, Artificial Sequence
  Description of Artificial Sequence: Synthetic oligonucleotide
  Target: SCN10A; (+) strand; PAM type: NNGRRT; PAM sequence: TGGAGT
ttccttgctgaccatgtggc

SEQ ID NO: 9702 - DNA, 20 bp, Artificial Sequence
  Description of Artificial Sequence: Synthetic oligonucleotide
  Target: SCN10A; (+) strand; PAM type: NNGRRT; PAM sequence: ATGAAT
ccattctactttctgtctcc

SEQ ID NO: 9703 - DNA, 20 bp, Artificial Sequence
  Description of Artificial Sequence: Synthetic oligonucleotide
  Target: SCN10A; (+) strand; PAM type: NNGRRT; PAM sequence: TGGAAT
ttctaggtacctactaaagg

SEQ ID NO: 9704 - DNA, 20 bp, Artificial Sequence
  Description of Artificial Sequence: Synthetic oligonucleotide
  Target: SCN10A; (+) strand; PAM type: NNGRRT; PAM sequence: TTGAGT
caacatttgttcttttgcgt

SEQ ID NO: 9705 - DNA, 20 bp, Artificial Sequence
  Description of Artificial Sequence: Synthetic oligonucleotide
  Target: SCN10A; (+) strand; PAM type: NNGRRT; PAM sequence: CAGAAT
gtcaatgttgtggcatgtat

SEQ ID NO: 9706 - DNA, 20 bp, Artificial Sequence
  Description of Artificial Sequence: Synthetic oligonucleotide
  Target: SCN10A; (+) strand; PAM type: NNGRRT; PAM sequence: CTGAAT
aatctcattcatttttaaaa

SEQ ID NO: 9707 - DNA, 20 bp, Artificial Sequence
  Description of Artificial Sequence: Synthetic oligonucleotide
  Target: SCN10A; (+) strand; PAM type: NNGRRT; PAM sequence: GTGAAT
gatggacatatttggctatt

SEQ ID NO: 9708 - DNA, 20 bp, Artificial Sequence
  Description of Artificial Sequence: Synthetic oligonucleotide
  Target: SCN10A; (+) strand; PAM type: NNGRRT; PAM sequence: CTGAGT
ataaatagaacaaaaagtca

SEQ ID NO: 9709 - DNA, 20 bp, Artificial Sequence
  Description of Artificial Sequence: Synthetic oligonucleotide
  Target: SCN10A; (+) strand; PAM type: NNGRRT; PAM sequence: AGGAAT
taaatgccagtcacattata

SEQ ID NO: 9710 - DNA, 20 bp, Artificial Sequence
  Description of Artificial Sequence: Synthetic oligonucleotide
  Target: SCN10A; (+) strand; PAM type: NNGRRT; PAM sequence: AGGAAT
gaatgcaatacttctaatta

SEQ ID NO: 9711 - DNA, 20 bp, Artificial Sequence
  Description of Artificial Sequence: Synthetic oligonucleotide
  Target: SCN10A; (+) strand; PAM type: NNGRRT; PAM sequence: AGGAGT
tggttttgtatcttaccagc

SEQ ID NO: 9712 - DNA, 20 bp, Artificial Sequence
  Description of Artificial Sequence: Synthetic oligonucleotide
  Target: SCN10A; (+) strand; PAM type: NNGRRT; PAM sequence: GAGGAT
attgtgcttatttttgatat

SEQ ID NO: 9713 - DNA, 20 bp, Artificial Sequence
  Description of Artificial Sequence: Synthetic oligonucleotide
  Target: SCN10A; (+) strand; PAM type: NNGRRT; PAM sequence: ATGAAT
tgcttatttttgatatgagg

SEQ ID NO: 9714 - DNA, 20 bp, Artificial Sequence
  Description of Artificial Sequence: Synthetic oligonucleotide
  Target: SCN10A; (+) strand; PAM type: NNGRRT; PAM sequence: TGGGGT
atattcaattggtttaaaag

SEQ ID NO: 9715 - DNA, 20 bp, Artificial Sequence
  Description of Artificial Sequence: Synthetic oligonucleotide
  Target: SCN10A; (+) strand; PAM type: NNGRRT; PAM sequence: TTGGGT
aaacgttagcagataataaa

SEQ ID NO: 9716 - DNA, 20 bp, Artificial Sequence
  Description of Artificial Sequence: Synthetic oligonucleotide
  Target: SCN10A; (+) strand; PAM type: NNGRRT; PAM sequence: AAGGAT
taaattgggtactaggacaa

SEQ ID NO: 9717 - DNA, 20 bp, Artificial Sequence
  Description of Artificial Sequence: Synthetic oligonucleotide
  Target: SCN10A; (+) strand; PAM type: NNGRRT; PAM sequence: TAGGAT
tgtgaccttatttcacattg

SEQ ID NO: 9718 - DNA, 20 bp, Artificial Sequence
  Description of Artificial Sequence: Synthetic oligonucleotide
  Target: SCN10A; (+) strand; PAM type: NNGRRT; PAM sequence: TTGAAT
cgaagtgatgactctttttt

SEQ ID NO: 9719 - DNA, 20 bp, Artificial Sequence
  Description of Artificial Sequence: Synthetic oligonucleotide
  Target: SCN10A; (+) strand; PAM type: NNGRRT; PAM sequence: ATGAAT
ttaactccatgttaaccatt

SEQ ID NO: 9720 - DNA, 20 bp, Artificial Sequence
  Description of Artificial Sequence: Synthetic oligonucleotide
  Target: SCN10A; (+) strand; PAM type: NNGRRT; PAM sequence: ATGAAT
cataaaaagttagaaattct

SEQ ID NO: 9721 - DNA, 20 bp, Artificial Sequence
  Description of Artificial Sequence: Synthetic oligonucleotide
  Target: SCN10A; (+) strand; PAM type: NNGRRT; PAM sequence: ATGAAT
attgtaggagatggagagag

SEQ ID NO: 9722 - DNA, 20 bp, Artificial Sequence
  Description of Artificial Sequence: Synthetic oligonucleotide
  Target: SCN10A; (+) strand; PAM type: NNGRRT; PAM sequence: AAGAAT
attgctctgctaaacaaagt

SEQ ID NO: 9723 - DNA, 20 bp, Artificial Sequence
  Description of Artificial Sequence: Synthetic oligonucleotide
  Target: SCN10A; (+) strand; PAM type: NNGRRT; PAM sequence: TGGAGT
taaacaaagtaagaataagt

SEQ ID NO: 9724 - DNA, 20 bp, Artificial Sequence
  Description of Artificial Sequence: Synthetic oligonucleotide
  Target: SCN10A; (+) strand; PAM type: NNGRRT; PAM sequence: GAGAGT
ttcccagggacaattgagga

SEQ ID NO: 9725 - DNA, 20 bp, Artificial Sequence
  Description of Artificial Sequence: Synthetic oligonucleotide
  Target: SCN10A; (+) strand; PAM type: NNGRRT; PAM sequence: TTGAAT
ataaaatgaaatacacctaa

SEQ ID NO: 9726 - DNA, 20 bp, Artificial Sequence
  Description of Artificial Sequence: Synthetic oligonucleotide
  Target: SCN10A; (+) strand; PAM type: NNGRRT; PAM sequence: TTGAAT
atatgctcactgtcatagct

SEQ ID NO: 9727 - DNA, 20 bp, Artificial Sequence
  Description of Artificial Sequence: Synthetic oligonucleotide
  Target: SCN10A; (+) strand; PAM type: NNGRRT; PAM sequence: AAGAAT
gaaaaataaaaaagtggtat

SEQ ID NO: 9728 - DNA, 20 bp, Artificial Sequence
  Description of Artificial Sequence: Synthetic oligonucleotide
  Target: SCN10A; (+) strand; PAM type: NNGRRT; PAM sequence: GGGAAT
tgtctaaataggaagtccaa

SEQ ID NO: 9729 - DNA, 20 bp, Artificial Sequence
  Description of Artificial Sequence: Synthetic oligonucleotide
  Target: SCN10A; (+) strand; PAM type: NNGRRT; PAM sequence: CAGGGT
tttaactttaaggagctcag

SEQ ID NO: 9730 - DNA, 20 bp, Artificial Sequence
  Description of Artificial Sequence: Synthetic oligonucleotide
  Target: SCN10A; (+) strand; PAM type: NNGRRT; PAM sequence: CTGGAT
taaggagctcagcagggttg

SEQ ID NO: 9731 - DNA, 20 bp, Artificial Sequence
  Description of Artificial Sequence: Synthetic oligonucleotide
  Target: SCN10A; (+) strand; PAM type: NNGRRT; PAM sequence: CAGAGT
attaccaaacaaagtttcca

SEQ ID NO: 9732 - DNA, 20 bp, Artificial Sequence
  Description of Artificial Sequence: Synthetic oligonucleotide
  Target: SCN10A; (+) strand; PAM type: NNGRRT; PAM sequence: GTGAAT
agacaaataaggaggggcat

SEQ ID NO: 9733 - DNA, 20 bp, Artificial Sequence
  Description of Artificial Sequence: Synthetic oligonucleotide
  Target: SCN10A; (+) strand; PAM type: NNGRRT; PAM sequence: CAGGAT
aaatccacgtggtgttgact

SEQ ID NO: 9734 - DNA, 20 bp, Artificial Sequence
  Description of Artificial Sequence: Synthetic oligonucleotide
  Target: SCN10A; (+) strand; PAM type: NNGRRT; PAM sequence: GGGAAT
gaaacagattcagtagacat

SEQ ID NO: 9735 - DNA, 20 bp, Artificial Sequence
  Description of Artificial Sequence: Synthetic oligonucleotide
  Target: SCN10A; (+) strand; PAM type: NNGRRT; PAM sequence: TGGAAT
tgatgtattgaaaaaaatgt

SEQ ID NO: 9736 - DNA, 20 bp, Artificial Sequence
  Description of Artificial Sequence: Synthetic oligonucleotide
  Target: SCN10A; (+) strand; PAM type: NNGRRT; PAM sequence: CAGGAT
gtaactttgaggagaaaaca

SEQ ID NO: 9737 - DNA, 20 bp, Artificial Sequence
  Description of Artificial Sequence: Synthetic oligonucleotide
  Target: SCN10A; (+) strand; PAM type: NNGRRT; PAM sequence: TGGAAT
aacacaggataatatcttta

SEQ ID NO: 9738 - DNA, 20 bp, Artificial Sequence
  Description of Artificial Sequence: Synthetic oligonucleotide
  Target: SCN10A; (+) strand; PAM type: NNGRRT; PAM sequence: ATGAAT
atactatatggcaataaaaa

SEQ ID NO: 9739 - DNA, 20 bp, Artificial Sequence
  Description of Artificial Sequence: Synthetic oligonucleotide
  Target: SCN10A; (+) strand; PAM type: NNGRRT; PAM sequence: ATGAAT
tatatggcaataaaaaatga

SEQ ID NO: 9740 - DNA, 20 bp, Artificial Sequence
  Description of Artificial Sequence: Synthetic oligonucleotide
  Target: SCN10A; (+) strand; PAM type: NNGRRT; PAM sequence: CAGAAT
ataatttgtcaaaggttttc

SEQ ID NO: 9741 - DNA, 20 bp, Artificial Sequence
  Description of Artificial Sequence: Synthetic oligonucleotide
  Target: SCN10A; (+) strand; PAM type: NNGRRT; PAM sequence: GTGAGT
gaatattgttatgcttagag

SEQ ID NO: 9742 - DNA, 20 bp, Artificial Sequence
  Description of Artificial Sequence: Synthetic oligonucleotide
  Target: SCN10A; (+) strand; PAM type: NNGRRT; PAM sequence: TAGGGT
atgcttagaggtgagtgtcc

SEQ ID NO: 9743 - DNA, 20 bp, Artificial Sequence
  Description of Artificial Sequence: Synthetic oligonucleotide
  Target: SCN10A; (+) strand; PAM type: NNGRRT; PAM sequence: GAGAGT
ctctgaaaccagggcatggg

SEQ ID NO: 9744 - DNA, 20 bp, Artificial Sequence
  Description of Artificial Sequence: Synthetic oligonucleotide
  Target: SCN10A; (+) strand; PAM type: NNGRRT; PAM sequence: GGGGAT
gtttcttcccaagcaaaaga

SEQ ID NO: 9745 - DNA, 20 bp, Artificial Sequence
  Description of Artificial Sequence: Synthetic oligonucleotide
  Target: SCN10A; (+) strand; PAM type: NNGRRT; PAM sequence: TGGAAT
caaaagaggggattagaaaa

SEQ ID NO: 9746 - DNA, 20 bp, Artificial Sequence
  Description of Artificial Sequence: Synthetic oligonucleotide
  Target: SCN10A; (+) strand; PAM type: NNGRRT; PAM sequence: AGGAAT
gcaaagctaatgtttcagca

SEQ ID NO: 9747 - DNA, 20 bp, Artificial Sequence
  Description of Artificial Sequence: Synthetic oligonucleotide
  Target: SCN10A; (+) strand; PAM type: NNGRRT; PAM sequence: CTGGGT
aggacatttattatcttcct

SEQ ID NO: 9748 - DNA, 20 bp, Artificial Sequence
  Description of Artificial Sequence: Synthetic oligonucleotide
  Target: SCN10A; (+) strand; PAM type: NNGRRT; PAM sequence: AAGGAT
ctgattatttccacgaggcc

SEQ ID NO: 9749 - DNA, 20 bp, Artificial Sequence
  Description of Artificial Sequence: Synthetic oligonucleotide
  Target: SCN10A; (+) strand; PAM type: NNGRRT; PAM sequence: CAGGAT
atacctgtcacataaattcc

SEQ ID NO: 9750 - DNA, 20 bp, Artificial Sequence
  Description of Artificial Sequence: Synthetic oligonucleotide
  Target: SCN10A; (+) strand; PAM type: NNGRRT; PAM sequence: GGGAAT
tttcatagtgtgcatataaa

SEQ ID NO: 9751 - DNA, 20 bp, Artificial Sequence
  Description of Artificial Sequence: Synthetic oligonucleotide
  Target: SCN10A; (+) strand; PAM type: NNGRRT; PAM sequence: AAGAAT
agttaatacaaaatctccta

SEQ ID NO: 9752 - DNA, 20 bp, Artificial Sequence
  Description of Artificial Sequence: Synthetic oligonucleotide
  Target: SCN10A; (+) strand; PAM type: NNGRRT; PAM sequence: ATGGAT
aatacaaaatctcctaaaga

SEQ ID NO: 9753 - DNA, 20 bp, Artificial Sequence
  Description of Artificial Sequence: Synthetic oligonucleotide
  Target: SCN10A; (+) strand; PAM type: NNGRRT; PAM sequence: GGGAAT
gaatggatttgataattact

SEQ ID NO: 9754 - DNA, 20 bp, Artificial Sequence
  Description of Artificial Sequence: Synthetic oligonucleotide
  Target: SCN10A; (+) strand; PAM type: NNGRRT; PAM sequence: AAGGAT
tgataattactgggaatgga

SEQ ID NO: 9755 - DNA, 20 bp, Artificial Sequence
  Description of Artificial Sequence: Synthetic oligonucleotide
  Target: SCN10A; (+) strand; PAM type: NNGRRT; PAM sequence: AAGGAT
gtgtacaaagatacatgtgt

SEQ ID NO: 9756 - DNA, 20 bp, Artificial Sequence
  Description of Artificial Sequence: Synthetic oligonucleotide
  Target: SCN10A; (+) strand; PAM type: NNGRRT; PAM sequence: GAGGAT
aatatgtggtggcaaaatat

SEQ ID NO: 9757 - DNA, 20 bp, Artificial Sequence
  Description of Artificial Sequence: Synthetic oligonucleotide
  Target: SCN10A; (+) strand; PAM type: NNGRRT; PAM sequence: GTGAAT
ttatgttaattatgataaat

SEQ ID NO: 9758 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ttctataaaacagctgctgc

SEQ ID NO: 9759 - DNA, 20 bp, Artificial Sequence
  Description of Artificial Sequence: Synthetic oligonucleotide
  Target: SCN10A; (+) strand; PAM type: NNGRRT; PAM sequence: GGGGAT
gctgctgctgggattttttt

SEQ ID NO: 9760 - DNA, 20 bp, Artificial Sequence
  Description of Artificial Sequence: Synthetic oligonucleotide
  Target: SCN10A; (+) strand; PAM type: NNGRRT; PAM sequence: TTGAAT
ggatttttttggggatgtca

SEQ ID NO: 9761 - DNA, 20 bp, Artificial Sequence
  Description of Artificial Sequence: Synthetic oligonucleotide
  Target: SCN10A; (+) strand; PAM type: NNGRRT; PAM sequence: ATGAAT
gcactgacattctaacaatt

SEQ ID NO: 9762 - DNA, 20 bp, Artificial Sequence
  Description of Artificial Sequence: Synthetic oligonucleotide
  Target: SCN10A; (+) strand; PAM type: NNGRRT; PAM sequence: TTGGAT
gcatatttttacaacagcat

SEQ ID NO: 9763 - DNA, 20 bp, Artificial Sequence
  Description of Artificial Sequence: Synthetic oligonucleotide
  Target: SCN10A; (+) strand; PAM type: NNGRRT; PAM sequence: CTGAAT
tccatgctgtgacttattcc

SEQ ID NO: 9764 - DNA, 20 bp, Artificial Sequence
  Description of Artificial Sequence: Synthetic oligonucleotide
  Target: SCN10A; (+) strand; PAM type: NNGRRT; PAM sequence: AAGAAT
ttatagtttgtcttttgtcc

SEQ ID NO: 9765 - DNA, 20 bp, Artificial Sequence
  Description of Artificial Sequence: Synthetic oligonucleotide
  Target: SCN10A; (+) strand; PAM type: NNGRRT; PAM sequence: GAGAAT
actctatttcattatgatca

SEQ ID NO: 9766 - DNA, 20 bp, Artificial Sequence
  Description of Artificial Sequence: Synthetic oligonucleotide
  Target: SCN10A; (+) strand; PAM type: NNGRRT; PAM sequence: ATGGAT
ctttctctgatattaaaatc

SEQ ID NO: 9767 - DNA, 20 bp, Artificial Sequence
  Description of Artificial Sequence: Synthetic oligonucleotide
  Target: SCN10A; (+) strand; PAM type: NNGRRT; PAM sequence: TTGAAT
tttgcctttgcttatgtctt

SEQ ID NO: 9768 - DNA, 20 bp, Artificial Sequence
  Description of Artificial Sequence: Synthetic oligonucleotide
  Target: SCN10A; (+) strand; PAM type: NNGRRT; PAM sequence: AGGAGT
agcctttctgtatcaccgtg

SEQ ID NO: 9769 - DNA, 20 bp, Artificial Sequence
  Description of Artificial Sequence: Synthetic oligonucleotide
  Target: SCN10A; (+) strand; PAM type: NNGRRT; PAM sequence: TAGAGT
agtattttttttattcaaca

SEQ ID NO: 9770 - DNA, 20 bp, Artificial Sequence
  Description of Artificial Sequence: Synthetic oligonucleotide
  Target: SCN10A; (+) strand; PAM type: NNGRRT; PAM sequence: TTGGGT
tttttttattcaacatagag

SEQ ID NO: 9771 - DNA, 20 bp, Artificial Sequence
  Description of Artificial Sequence: Synthetic oligonucleotide
  Target: SCN10A; (+) strand; PAM type: NNGRRT; PAM sequence: GTGAGT
ataggcatttttaaaaatag

SEQ ID NO: 9772 - DNA, 20 bp, Artificial Sequence
  Description of Artificial Sequence: Synthetic oligonucleotide
  Target: SCN10A; (+) strand; PAM type: NNGRRT; PAM sequence: TGGAAT
tgaaatttgccgtttgatat

SEQ ID NO: 9773 - DNA, 20 bp, Artificial Sequence
  Description of Artificial Sequence: Synthetic oligonucleotide
  Target: SCN10A; (+) strand; PAM type: NNGRRT; PAM sequence: TTGAGT
aattcgagcgattttcttat

SEQ ID NO: 9774 - DNA, 20 bp, Artificial Sequence
  Description of Artificial Sequence: Synthetic oligonucleotide
  Target: SCN10A; (+) strand; PAM type: NNGRRT; PAM sequence: ATGGGT
ttttcttatttgagttcaaa

SEQ ID NO: 9775 - DNA, 20 bp, Artificial Sequence
  Description of Artificial Sequence: Synthetic oligonucleotide
  Target: SCN10A; (+) strand; PAM type: NNGRRT; PAM sequence: AGGGAT
atcaacaacgcatttggccc

SEQ ID NO: 9776 - DNA, 20 bp, Artificial Sequence
  Description of Artificial Sequence: Synthetic oligonucleotide
  Target: SCN10A; (+) strand; PAM type: NNGRRT; PAM sequence: GAGAGT
atgagaaccttgaagatgag

SEQ ID NO: 9777 - DNA, 20 bp, Artificial Sequence
  Description of Artificial Sequence: Synthetic oligonucleotide
  Target: SCN10A; (+) strand; PAM type: NNGRRT; PAM sequence: ATGGGT
aaggtgaaacagctccataa

SEQ ID NO: 9778 - DNA, 20 bp, Artificial Sequence
  Description of Artificial Sequence: Synthetic oligonucleotide
  Target: SCN10A; (+) strand; PAM type: NNGRRT; PAM sequence: GTGAAT
attgtgatgtgcgataaaaa

SEQ ID NO: 9779 - DNA, 20 bp, Artificial Sequence
  Description of Artificial Sequence: Synthetic oligonucleotide
  Target: SCN10A; (+) strand; PAM type: NNGRRT; PAM sequence: CTGAAT
gtctgatctactacagcttt

SEQ ID NO: 9780 - DNA, 20 bp, Artificial Sequence
  Description of Artificial Sequence: Synthetic oligonucleotide
  Target: SCN10A; (+) strand; PAM type: NNGRRT; PAM sequence: TTGAAT
accaacagttacttcaaaag

SEQ ID NO: 9781 - DNA, 20 bp, Artificial Sequence
  Description of Artificial Sequence: Synthetic oligonucleotide
  Target: SCN10A; (+) strand; PAM type: NNGRRT; PAM sequence: ATGAAT
acagttacttcaaaagttga

SEQ ID NO: 9782 - DNA, 20 bp, Artificial Sequence
  Description of Artificial Sequence: Synthetic oligonucleotide
  Target: SCN10A; (+) strand; PAM type: NNGRRT; PAM sequence: CGGGAT
tgaaacacttccataaccag

SEQ ID NO: 9783 - DNA, 20 bp, Artificial Sequence
  Description of Artificial Sequence: Synthetic oligonucleotide
  Target: SCN10A; (+) strand; PAM type: NNGRRT; PAM sequence: AAGAGT
ggatgcagaaaatgccttcc

SEQ ID NO: 9784 - DNA, 20 bp, Artificial Sequence
  Description of Artificial Sequence: Synthetic oligonucleotide
  Target: SCN10A; (+) strand; PAM type: NNGRRT; PAM sequence: TTGAAT
aaatgccttccaagagttca

SEQ ID NO: 9785 - DNA, 20 bp, Artificial Sequence
  Description of Artificial Sequence: Synthetic oligonucleotide
  Target: SCN10A; (+) strand; PAM type: NNGRRT; PAM sequence: ATGGAT
agttcattgaatcccaaagc

SEQ ID NO: 9786 - DNA, 20 bp, Artificial Sequence
  Description of Artificial Sequence: Synthetic oligonucleotide
  Target: SCN10A; (+) strand; PAM type: NNGRRT; PAM sequence: AGGAAT
agcatggatttttatgctac

SEQ ID NO: 9787 - DNA, 20 bp, Artificial Sequence
  Description of Artificial Sequence: Synthetic oligonucleotide
  Target: SCN10A; (+) strand; PAM type: NNGRRT; PAM sequence: TAGAGT
tgtacaattcttccagtatt

SEQ ID NO: 9788 - DNA, 20 bp, Artificial Sequence
  Description of Artificial Sequence: Synthetic oligonucleotide
  Target: SCN10A; (+) strand; PAM type: NNGRRT; PAM sequence: AAGAGT
tacaaatatatagattacta

SEQ ID NO: 9789 - DNA, 20 bp, Artificial Sequence
  Description of Artificial Sequence: Synthetic oligonucleotide
  Target: SCN10A; (+) strand; PAM type: NNGRRT; PAM sequence: GAGGGT
tcattctattggcattttga

SEQ ID NO: 9790 - DNA, 20 bp, Artificial Sequence
  Description of Artificial Sequence: Synthetic oligonucleotide
  Target: SCN10A; (+) strand; PAM type: NNGRRT; PAM sequence: TGGGGT
ctattggcattttgagaggg

SEQ ID NO: 9791 - DNA, 20 bp, Artificial Sequence
  Description of Artificial Sequence: Synthetic oligonucleotide
  Target: SCN10A; (+) strand; PAM type: NNGRRT; PAM sequence: TTGGGT
tcatttattttaaaaaatta

SEQ ID NO: 9792 - DNA, 20 bp, Artificial Sequence
  Description of Artificial Sequence: Synthetic oligonucleotide
  Target: SCN10A; (+) strand; PAM type: NNGRRT; PAM sequence: CTGGGT
ccttaacaaaataccataga

SEQ ID NO: 9793 - DNA, 20 bp, Artificial Sequence
  Description of Artificial Sequence: Synthetic oligonucleotide
  Target: SCN10A; (+) strand; PAM type: NNGRRT; PAM sequence: TGGGAT
tggaggttgaagcctgagat

SEQ ID NO: 9794 - DNA, 20 bp, Artificial Sequence
  Description of Artificial Sequence: Synthetic oligonucleotide
  Target: SCN10A; (+) strand; PAM type: NNGRRT; PAM sequence: TTGGGT
agattgggatgtcagcatag

SEQ ID NO: 9795 - DNA, 20 bp, Artificial Sequence
  Description of Artificial Sequence: Synthetic oligonucleotide
  Target: SCN10A; (+) strand; PAM type: NNGRRT; PAM sequence: GGGGGT
atctccaacatagcaacatg

SEQ ID NO: 9796 - DNA, 20 bp, Artificial Sequence
  Description of Artificial Sequence: Synthetic oligonucleotide
  Target: SCN10A; (+) strand; PAM type: NNGRRT; PAM sequence: TTGAAT
tggggggtttgtttcaacat

SEQ ID NO: 9797 - DNA, 20 bp, Artificial Sequence
  Description of Artificial Sequence: Synthetic oligonucleotide
  Target: SCN10A; (+) strand; PAM type: NNGRRT; PAM sequence: TAGAAT
tgctgtaagttttctcattt

SEQ ID NO: 9798 - DNA, 20 bp, Artificial Sequence
  Description of Artificial Sequence: Synthetic oligonucleotide
  Target: SCN10A; (+) strand; PAM type: NNGRRT; PAM sequence: TTGAGT
tactcaaagtttatggacat

SEQ ID NO: 9799 - DNA, 20 bp, Artificial Sequence
  Description of Artificial Sequence: Synthetic oligonucleotide
  Target: SCN10A; (+) strand; PAM type: NNGRRT; PAM sequence: TGGGGT
catttgagtggtttccggtt

SEQ ID NO: 9800 - DNA, 20 bp, Artificial Sequence
  Description of Artificial Sequence: Synthetic oligonucleotide
  Target: SCN10A; (+) strand; PAM type: NNGRRT; PAM sequence: AAGGGT
tctgttaaacataggtacct

SEQ ID NO: 9801 - DNA, 20 bp, Artificial Sequence
  Description of Artificial Sequence: Synthetic oligonucleotide
  Target: SCN10A; (+) strand; PAM type: NNGRRT; PAM sequence: AAGAAT
ggtacctaagggtgtaatag

SEQ ID NO: 9802 - DNA, 20 bp, Artificial Sequence
  Description of Artificial Sequence: Synthetic oligonucleotide
  Target: SCN10A; (+) strand; PAM type: NNGRRT; PAM sequence: GTGAGT
tacactcccaccagcagtgt

SEQ ID NO: 9803 - DNA, 20 bp, Artificial Sequence
  Description of Artificial Sequence: Synthetic oligonucleotide
  Target: SCN10A; (+) strand; PAM type: NNGRRT; PAM sequence: AAGAAT
ctttgatttaaaaaaaggtt

SEQ ID NO: 9804 - DNA, 20 bp, Artificial Sequence
  Description of Artificial Sequence: Synthetic oligonucleotide
  Target: SCN10A; (+) strand; PAM type: NNGRRT; PAM sequence: TTGGAT
tttcatatgtttatggccat

SEQ ID NO: 9805 - DNA, 20 bp, Artificial Sequence
  Description of Artificial Sequence: Synthetic oligonucleotide
  Target: SCN10A; (+) strand; PAM type: NNGRRT; PAM sequence: TAGAGT
acatttttctaattgatttg

SEQ ID NO: 9806 - DNA, 20 bp, Artificial Sequence
  Description of Artificial Sequence: Synthetic oligonucleotide
  Target: SCN10A; (+) strand; PAM type: NNGRRT; PAM sequence: CTGAAT
gatttgtagagttcattact

SEQ ID NO: 9807 - DNA, 20 bp, Artificial Sequence
  Description of Artificial Sequence: Synthetic oligonucleotide
  Target: SCN10A; (+) strand; PAM type: NNGRRT; PAM sequence: TGGGAT
gatcaagtcggcttcatacc

SEQ ID NO: 9808 - DNA, 20 bp, Artificial Sequence
  Description of Artificial Sequence: Synthetic oligonucleotide
  Target: SCN10A; (+) strand; PAM type: NNGRRT; PAM sequence: TGGAAT
ctcaataaactaggtattga

SEQ ID NO: 9809 - DNA, 20 bp, Artificial Sequence
  Description of Artificial Sequence: Synthetic oligonucleotide
  Target: SCN10A; (+) strand; PAM type: NNGRRT; PAM sequence: CTGAAT
agcccccagccaatatcata

SEQ ID NO: 9810 - DNA, 20 bp, Artificial Sequence
  Description of Artificial Sequence: Synthetic oligonucleotide
  Target: SCN10A; (+) strand; PAM type: NNGRRT; PAM sequence: AAGAAT
tttgaaaaccagcacaagac

SEQ ID NO: 9811 - DNA, 20 bp, Artificial Sequence
  Description of Artificial Sequence: Synthetic oligonucleotide
  Target: SCN10A; (+) strand; PAM type: NNGRRT; PAM sequence: AGGGGT
tcaggcaagagaaagaaata

SEQ ID NO: 9812 - DNA, 20 bp, Artificial Sequence
  Description of Artificial Sequence: Synthetic oligonucleotide
  Target: SCN10A; (+) strand; PAM type: NNGRRT; PAM sequence: CAGGAT
aagcaacttcagcaaagtct

SEQ ID NO: 9813 - DNA, 20 bp, Artificial Sequence
  Description of Artificial Sequence: Synthetic oligonucleotide
  Target: SCN10A; (+) strand; PAM type: NNGRRT; PAM sequence: ATGAGT
gacaaaccgagagccaaatc

SEQ ID NO: 9814 - DNA, 20 bp, Artificial Sequence
  Description of Artificial Sequence: Synthetic oligonucleotide
  Target: SCN10A; (+) strand; PAM type: NNGRRT; PAM sequence: GAGAAT
ccattcacaattgcaacaaa

SEQ ID NO: 9815 - DNA, 20 bp, Artificial Sequence
  Description of Artificial Sequence: Synthetic oligonucleotide
  Target: SCN10A; (+) strand; PAM type: NNGRRT; PAM sequence: AGGGAT
atctagaaatacaacttaca

SEQ ID NO: 9816 - DNA, 20 bp, Artificial Sequence
  Description of Artificial Sequence: Synthetic oligonucleotide
  Target: SCN10A; (+) strand; PAM type: NNGRRT; PAM sequence: ATGGAT
tggaaaaacattccatgctc

SEQ ID NO: 9817 - DNA, 20 bp, Artificial Sequence
  Description of Artificial Sequence: Synthetic oligonucleotide
  Target: SCN10A; (+) strand; PAM type: NNGRRT; PAM sequence: CAGAAT
gctaccactgactttcttca

SEQ ID NO: 9818 - DNA, 20 bp, Artificial Sequence
  Description of Artificial Sequence: Synthetic oligonucleotide
  Target: SCN10A; (+) strand; PAM type: NNGRRT; PAM sequence: AAGGAT
acaaaagcaagcaatgggga

SEQ ID NO: 9819 - DNA, 20 bp, Artificial Sequence
  Description of Artificial Sequence: Synthetic oligonucleotide
  Target: SCN10A; (+) strand; PAM type: NNGRRT; PAM sequence: TGGAAT
caaaagccaaaattgacaaa

SEQ ID NO: 9820 - DNA, 20 bp, Artificial Sequence
  Description of Artificial Sequence: Synthetic oligonucleotide
  Target: SCN10A; (+) strand; PAM type: NNGRRT; PAM sequence: CAGAGT
acagcaaaagaaactatcat

SEQ ID NO: 9821 - DNA, 20 bp, Artificial Sequence
  Description of Artificial Sequence: Synthetic oligonucleotide
  Target: SCN10A; (+) strand; PAM type: NNGRRT; PAM sequence: GTGAAT
caaaagaaactatcatcaga

SEQ ID NO: 9822 - DNA, 20 bp, Artificial Sequence
  Description of Artificial Sequence: Synthetic oligonucleotide
  Target: SCN10A; (+) strand; PAM type: NNGRRT; PAM sequence: CAGAAT
cagagtgaataggtaaccta

SEQ ID NO: 9823 - DNA, 20 bp, Artificial Sequence
  Description of Artificial Sequence: Synthetic oligonucleotide
  Target: SCN10A; (+) strand; PAM type: NNGRRT; PAM sequence: CAGAAT
tctgacaaagggctaatatc

SEQ ID NO: 9824 - DNA, 20 bp, Artificial Sequence
  Description of Artificial Sequence: Synthetic oligonucleotide
  Target: SCN10A; (+) strand; PAM type: NNGRRT; PAM sequence: AAGGAT
actccatcaaaaagtgggca

SEQ ID NO: 9825 - DNA, 20 bp, Artificial Sequence
  Description of Artificial Sequence: Synthetic oligonucleotide
  Target: SCN10A; (+) strand; PAM type: NNGRRT; PAM sequence: TGGAGT
cagtcaaaaccacaatgaga

SEQ ID NO: 9826 - DNA, 20 bp, Artificial Sequence
  Description of Artificial Sequence: Synthetic oligonucleotide
  Target: SCN10A; (+) strand; PAM type: NNGRRT; PAM sequence: TAGAAT
agatggagtctcataccagt

SEQ ID NO: 9827 - DNA, 20 bp, Artificial Sequence
  Description of Artificial Sequence: Synthetic oligonucleotide
  Target: SCN10A; (+) strand; PAM type: NNGRRT; PAM sequence: GAGGAT
aggaaacaacagatgctgga

SEQ ID NO: 9828 - DNA, 20 bp, Artificial Sequence
  Description of Artificial Sequence: Synthetic oligonucleotide
  Target: SCN10A; (+) strand; PAM type: NNGRRT; PAM sequence: AGGAAT
tggagaggatgtggagagat

SEQ ID NO: 9829 - DNA, 20 bp, Artificial Sequence
  Description of Artificial Sequence: Synthetic oligonucleotide
  Target: SCN10A; (+) strand; PAM type: NNGRRT; PAM sequence: GGGAGT
aatgcttttacactgttggt

SEQ ID NO: 9830 - DNA, 20 bp, Artificial Sequence
  Description of Artificial Sequence: Synthetic oligonucleotide
  Target: SCN10A; (+) strand; PAM type: NNGRRT; PAM sequence: AAGGAT
agacagtgtggtgattcctc

SEQ ID NO: 9831 - DNA, 20 bp, Artificial Sequence
  Description of Artificial Sequence: Synthetic oligonucleotide
  Target: SCN10A; (+) strand; PAM type: NNGRRT; PAM sequence: CTGGGT
ttgacccagcaattccatta

SEQ ID NO: 9832 - DNA, 20 bp, Artificial Sequence
  Description of Artificial Sequence: Synthetic oligonucleotide
  Target: SCN10A; (+) strand; PAM type: NNGRRT; PAM sequence: AAGGAT
cattactgggtatataccca

SEQ ID NO: 9833 - DNA, 20 bp, Artificial Sequence
  Description of Artificial Sequence: Synthetic oligonucleotide
  Target: SCN10A; (+) strand; PAM type: NNGRRT; PAM sequence: CTGGAT
aaacgcccatcagtgataga

SEQ ID NO: 9834 - DNA, 20 bp, Artificial Sequence
  Description of Artificial Sequence: Synthetic oligonucleotide
  Target: SCN10A; (+) strand; PAM type: NNGRRT; PAM sequence: TGGAAT
aatatggcacatatacacca

SEQ ID NO: 9835 - DNA, 20 bp, Artificial Sequence
  Description of Artificial Sequence: Synthetic oligonucleotide
  Target: SCN10A; (+) strand; PAM type: NNGRRT; PAM sequence: AAGGGT
aatactatgcagccataaaa

SEQ ID NO: 9836 - DNA, 20 bp, Artificial Sequence
  Description of Artificial Sequence: Synthetic oligonucleotide
  Target: SCN10A; (+) strand; PAM type: NNGRRT; PAM sequence: GTGAGT
ctatgcagccataaaaaagg

SEQ ID NO: 9837 - DNA, 20 bp, Artificial Sequence
  Description of Artificial Sequence: Synthetic oligonucleotide
  Target: SCN10A; (+) strand; PAM type: NNGRRT; PAM sequence: ATGGAT
ttcatgttctttgcagggac

SEQ ID NO: 9838 - DNA, 20 bp, Artificial Sequence
  Description of Artificial Sequence: Synthetic oligonucleotide
  Target: SCN10A; (+) strand; PAM type: NNGRRT; PAM sequence: GTGGAT
gagatgaacaatgagagcac

SEQ ID NO: 9839 - DNA, 20 bp, Artificial Sequence
  Description of Artificial Sequence: Synthetic oligonucleotide
  Target: SCN10A; (+) strand; PAM type: NNGRRT; PAM sequence: AGGGGT
tcacacaccagggcctgttg

SEQ ID NO: 9840 - DNA, 20 bp, Artificial Sequence
  Description of Artificial Sequence: Synthetic oligonucleotide
  Target: SCN10A; (+) strand; PAM type: NNGRRT; PAM sequence: AGGGAT
gaggggttgggggctagggg

SEQ ID NO: 9841 - DNA, 20 bp, Artificial Sequence
  Description of Artificial Sequence: Synthetic oligonucleotide
  Target: SCN10A; (+) strand; PAM type: NNGRRT; PAM sequence: ATGGGT
agaaatacctaatgtagatg

SEQ ID NO: 9842 - DNA, 20 bp, Artificial Sequence
  Description of Artificial Sequence: Synthetic oligonucleotide
  Target: SCN10A; (+) strand; PAM type: NNGRRT; PAM sequence: ATGGGT
ctaatgtagatgatgggttg

SEQ ID NO: 9843 - DNA, 20 bp, Artificial Sequence
  Description of Artificial Sequence: Synthetic oligonucleotide
  Target: SCN10A; (+) strand; PAM type: NNGRRT; PAM sequence: TAGAAT
aagtgaggtgttgatccacc

SEQ ID NO: 9844 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ttcttgtgtgtggtgcaaag

SEQ ID NO: 9845 - DNA, 20 bp, Artificial Sequence
  Description of Artificial Sequence: Synthetic oligonucleotide
  Target: SCN10A; (+) strand; PAM type: NNGRRT; PAM sequence: TGGGGT
ccgccttttccctgctgttc

SEQ ID NO: 9846 - DNA, 20 bp, Artificial Sequence
  Description of Artificial Sequence: Synthetic oligonucleotide
  Target: SCN10A; (+) strand; PAM type: NNGRRT; PAM sequence: TAGAAT
tagtaaatctcgacatccag

SEQ ID NO: 9847 - DNA, 20 bp, Artificial Sequence
  Description of Artificial Sequence: Synthetic oligonucleotide
  Target: SCN10A; (+) strand; PAM type: NNGRRT; PAM sequence: ATGAGT
aaatctcgacatccagtaga

SEQ ID NO: 9848 - DNA, 20 bp, Artificial Sequence
  Description of Artificial Sequence: Synthetic oligonucleotide
  Target: SCN10A; (+) strand; PAM type: NNGRRT; PAM sequence: GAGGAT
gcctgttgaaatattgattt

SEQ ID NO: 9849 - DNA, 20 bp, Artificial Sequence
  Description of Artificial Sequence: Synthetic oligonucleotide
  Target: SCN10A; (+) strand; PAM type: NNGRRT; PAM sequence: GGGAGT
taaatttattaatcattttt

SEQ ID NO: 9850 - DNA, 20 bp, Artificial Sequence
  Description of Artificial Sequence: Synthetic oligonucleotide
  Target: SCN10A; (+) strand; PAM type: NNGRRT; PAM sequence: TTGAAT
gtctttacaatattgagact

SEQ ID NO: 9851 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ctgtttatctctaggttatg

SEQ ID NO: 9852 - DNA, 20 bp, Artificial Sequence
  Description of Artificial Sequence: Synthetic oligonucleotide
  Target: SCN10A; (+) strand; PAM type: NNGRRT; PAM sequence: ATGAAT
acgcttgatactttaaaaca

SEQ ID NO: 9853 - DNA, 20 bp, Artificial Sequence
  Description of Artificial Sequence: Synthetic oligonucleotide
  Target: SCN10A; (+) strand; PAM type: NNGRRT; PAM sequence: CAGAGT
aaacaatgaataccctttat

SEQ ID NO: 9854 - DNA, 20 bp, Artificial Sequence
  Description of Artificial Sequence: Synthetic oligonucleotide
  Target: SCN10A; (+) strand; PAM type: NNGRRT; PAM sequence: TGGGGT
aattattatactttaagttc

SEQ ID NO: 9855 - DNA, 20 bp, Artificial Sequence
  Description of Artificial Sequence: Synthetic oligonucleotide
  Target: SCN10A; (+) strand; PAM type: NNGRRT; PAM sequence: ATGAGT
tcattgttcaactcccactt

SEQ ID NO: 9856 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tgttcttgtgttagtttgct

SEQ ID NO: 9857 - DNA, 20 bp, Artificial Sequence
  Description of Artificial Sequence: Synthetic oligonucleotide
  Target: SCN10A; (+) strand; PAM type: NNGRRT; PAM sequence: AAGAAT
ccttctatttcaacttttct

SEQ ID NO: 9858 - DNA, 20 bp, Artificial Sequence
  Description of Artificial Sequence: Synthetic oligonucleotide
  Target: SCN10A; (+) strand; PAM type: NNGRRT; PAM sequence: TGGAGT
aaggtatgttaggttcaagc

SEQ ID NO: 9859 - DNA, 20 bp, Artificial Sequence
  Description of Artificial Sequence: Synthetic oligonucleotide
  Target: SCN10A; (+) strand; PAM type: NNGRRT; PAM sequence: GTGGAT
gaagcatccctcccagatgt

SEQ ID NO: 9860 - DNA, 20 bp, Artificial Sequence
  Description of Artificial Sequence: Synthetic oligonucleotide
  Target: SCN10A; (+) strand; PAM type: NNGRRT; PAM sequence: TGGAAT
ccctcccagatgtgtggata

SEQ ID NO: 9861 - DNA, 20 bp, Artificial Sequence
  Description of Artificial Sequence: Synthetic oligonucleotide
  Target: SCN10A; (+) strand; PAM type: NNGRRT; PAM sequence: AGGGGT
ctcccagattctgaaactat

SEQ ID NO: 9862 - DNA, 20 bp, Artificial Sequence
  Description of Artificial Sequence: Synthetic oligonucleotide
  Target: SCN10A; (+) strand; PAM type: NNGRRT; PAM sequence: TAGAAT
cacccactaacctagggaaa

SEQ ID NO: 9863 - DNA, 20 bp, Artificial Sequence
  Description of Artificial Sequence: Synthetic oligonucleotide
  Target: SCN10A; (+) strand; PAM type: NNGRRT; PAM sequence: AGGAAT
tagggaaatagaataacttc

SEQ ID NO: 9864 - DNA, 20 bp, Artificial Sequence
  Description of Artificial Sequence: Synthetic oligonucleotide
  Target: SCN10A; (+) strand; PAM type: NNGRRT; PAM sequence: ATGAGT
taacttaaacagcttcattt

SEQ ID NO: 9865 - DNA, 20 bp, Artificial Sequence
  Description of Artificial Sequence: Synthetic oligonucleotide
  Target: SCN10A; (+) strand; PAM type: NNGRRT; PAM sequence: GTGAGT
tttgtgtgtgcatctagcag

SEQ ID NO: 9866 - DNA, 20 bp, Artificial Sequence
  Description of Artificial Sequence: Synthetic oligonucleotide
  Target: SCN10A; (+) strand; PAM type: NNGRRT; PAM sequence: GTGAGT
tgtgtgcatctagcaggtga

SEQ ID NO: 9867 - DNA, 20 bp, Artificial Sequence
  Description of Artificial Sequence: Synthetic oligonucleotide
  Target: SCN10A; (+) strand; PAM type: NNGRRT; PAM sequence: GGGGGT
tgagtgtgtgtgtgttgggg

SEQ ID NO: 9868 - DNA, 20 bp, Artificial Sequence
  Description of Artificial Sequence: Synthetic oligonucleotide
  Target: SCN10A; (+) strand; PAM type: NNGRRT; PAM sequence: CAGGAT
attacccacatgaggcatgg

SEQ ID NO: 9869 - DNA, 20 bp, Artificial Sequence
  Description of Artificial Sequence: Synthetic oligonucleotide
  Target: SCN10A; (+) strand; PAM type: NNGRRT; PAM sequence: TCGGGT
attttctctggaaggtcagt

SEQ ID NO: 9870 - DNA, 20 bp, Artificial Sequence
  Description of Artificial Sequence: Synthetic oligonucleotide
  Target: SCN10A; (+) strand; PAM type: NNGRRT; PAM sequence: TAGGAT
caagtctctgtgatgtcatc

SEQ ID NO: 9871 - DNA, 20 bp, Artificial Sequence
  Description of Artificial Sequence: Synthetic oligonucleotide
  Target: SCN10A; (+) strand; PAM type: NNGRRT; PAM sequence: CTGAAT
catctaggatcaccttgatg

SEQ ID NO: 9872 - DNA, 20 bp, Artificial Sequence
  Description of Artificial Sequence: Synthetic oligonucleotide
  Target: SCN10A; (+) strand; PAM type: NNGRRT; PAM sequence: CTGAGT
ataataaccactaacattta

SEQ ID NO: 9873 - DNA, 20 bp, Artificial Sequence
  Description of Artificial Sequence: Synthetic oligonucleotide
  Target: SCN10A; (+) strand; PAM type: NNGRRT; PAM sequence: CTGAGT
tactgagtgcctaagctagg

SEQ ID NO: 9874 - DNA, 20 bp, Artificial Sequence
  Description of Artificial Sequence: Synthetic oligonucleotide
  Target: SCN10A; (+) strand; PAM type: NNGRRT; PAM sequence: GTGGGT
ctaatacaactgatctacag

SEQ ID NO: 9875 - DNA, 20 bp, Artificial Sequence
  Description of Artificial Sequence: Synthetic oligonucleotide
  Target: SCN10A; (+) strand; PAM type: NNGRRT; PAM sequence: GGGAAT
gaagaggtacaaactttcat

SEQ ID NO: 9876 - DNA, 20 bp, Artificial Sequence
  Description of Artificial Sequence: Synthetic oligonucleotide
  Target: SCN10A; (+) strand; PAM type: NNGRRT; PAM sequence: TTGGGT
aattagtttcatcagattgt

SEQ ID NO: 9877 - DNA, 20 bp, Artificial Sequence
  Description of Artificial Sequence: Synthetic oligonucleotide
  Target: SCN10A; (+) strand; PAM type: NNGRRT; PAM sequence: CTGGGT
tccaccgaggaaatggtctt

SEQ ID NO: 9878 - DNA, 20 bp, Artificial Sequence
  Description of Artificial Sequence: Synthetic oligonucleotide
  Target: SCN10A; (+) strand; PAM type: NNGRRT; PAM sequence: TAGGAT
ctcaggaagaaaaccccaag

SEQ ID NO: 9879 - DNA, 20 bp, Artificial Sequence
  Description of Artificial Sequence: Synthetic oligonucleotide
  Target: SCN10A; (+) strand; PAM type: NNGRRT; PAM sequence: TGGAGT
aaccccaagtaggattaggc

SEQ ID NO: 9880 - DNA, 20 bp, Artificial Sequence
  Description of Artificial Sequence: Synthetic oligonucleotide
  Target: SCN10A; (+) strand; PAM type: NNGRRT; PAM sequence: CTGAAT
ttaggctggagtggagaact

SEQ ID NO: 9881 - DNA, 20 bp, Artificial Sequence
  Description of Artificial Sequence: Synthetic oligonucleotide
  Target: SCN10A; (+) strand; PAM type: NNGRRT; PAM sequence: TAGAGT
agtggagaactctgaatagc

SEQ ID NO: 9882 - DNA, 20 bp, Artificial Sequence
  Description of Artificial Sequence: Synthetic oligonucleotide
  Target: SCN10A; (+) strand; PAM type: NNGRRT; PAM sequence: GAGAAT
aactctgaatagctagagtg

SEQ ID NO: 9883 - DNA, 20 bp, Artificial Sequence
  Description of Artificial Sequence: Synthetic oligonucleotide
  Target: SCN10A; (+) strand; PAM type: NNGRRT; PAM sequence: AGGGAT
tgacagcagactatgggcaa

SEQ ID NO: 9884 - DNA, 20 bp, Artificial Sequence
  Description of Artificial Sequence: Synthetic oligonucleotide
  Target: SCN10A; (+) strand; PAM type: NNGRRT; PAM sequence: GTGGGT
agggagacattgaaaggaag

SEQ ID NO: 9885 - DNA, 20 bp, Artificial Sequence
  Description of Artificial Sequence: Synthetic oligonucleotide
  Target: SCN10A; (+) strand; PAM type: NNGRRT; PAM sequence: GAGAAT
agggaagaaatgttggtggg

SEQ ID NO: 9886 - DNA, 20 bp, Artificial Sequence
  Description of Artificial Sequence: Synthetic oligonucleotide
  Target: SCN10A; (+) strand; PAM type: NNGRRT; PAM sequence: AGGAAT
cccacttggacatttttctt

SEQ ID NO: 9887 - DNA, 20 bp, Artificial Sequence
  Description of Artificial Sequence: Synthetic oligonucleotide
  Target: SCN10A; (+) strand; PAM type: NNGRRT; PAM sequence: GAGAGT
agataaacttgacctacaga

SEQ ID NO: 9888 - DNA, 20 bp, Artificial Sequence
  Description of Artificial Sequence: Synthetic oligonucleotide
  Target: SCN10A; (+) strand; PAM type: NNGRRT; PAM sequence: AAGGAT
atggggggaaatgttaatcc

SEQ ID NO: 9889 - DNA, 20 bp, Artificial Sequence
  Description of Artificial Sequence: Synthetic oligonucleotide
  Target: SCN10A; (+) strand; PAM type: NNGRRT; PAM sequence: TAGAAT
acattcatagcaaatgtgat

SEQ ID NO: 9890 - DNA, 20 bp, Artificial Sequence
  Description of Artificial Sequence: Synthetic oligonucleotide
  Target: SCN10A; (+) strand; PAM type: NNGRRT; PAM sequence: GAGAAT
aatattaataatagggccct

SEQ ID NO: 9891 - DNA, 20 bp, Artificial Sequence
  Description of Artificial Sequence: Synthetic oligonucleotide
  Target: SCN10A; (+) strand; PAM type: NNGRRT; PAM sequence: TGGAGT
attctagtatcttttggggc

SEQ ID NO: 9892 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tcatcaaatctcaagatgaa

SEQ ID NO: 9893 - DNA, 20 bp, Artificial Sequence
  Description of Artificial Sequence: Synthetic oligonucleotide
  Target: SCN10A; (+) strand; PAM type: NNGRRT; PAM sequence: GGGGAT
tggtcacttggttcttttta

SEQ ID NO: 9894 - DNA, 20 bp, Artificial Sequence
  Description of Artificial Sequence: Synthetic oligonucleotide
  Target: SCN10A; (+) strand; PAM type: NNGRRT; PAM sequence: CAGAAT
ttatccagatgtaattcaac

SEQ ID NO: 9895 - DNA, 20 bp, Artificial Sequence
  Description of Artificial Sequence: Synthetic oligonucleotide
  Target: SCN10A; (+) strand; PAM type: NNGRRT; PAM sequence: AGGAGT
ttcaaccagaatccataaag

SEQ ID NO: 9896 - DNA, 20 bp, Artificial Sequence
  Description of Artificial Sequence: Synthetic oligonucleotide
  Target: SCN10A; (+) strand; PAM type: NNGRRT; PAM sequence: GAGAAT
aagcagagacgacacattga

SEQ ID NO: 9897 - DNA, 20 bp, Artificial Sequence
  Description of Artificial Sequence: Synthetic oligonucleotide
  Target: SCN10A; (+) strand; PAM type: NNGRRT; PAM sequence: CAGGAT
actgtagatactgctctacg

SEQ ID NO: 9898 - DNA, 20 bp, Artificial Sequence
  Description of Artificial Sequence: Synthetic oligonucleotide
  Target: SCN10A; (+) strand; PAM type: NNGRRT; PAM sequence: TTGGAT
tcttaactagctacatggtc

SEQ ID NO: 9899 - DNA, 20 bp, Artificial Sequence
  Description of Artificial Sequence: Synthetic oligonucleotide
  Target: SCN10A; (+) strand; PAM type: NNGRRT; PAM sequence: GGGGAT
agtttcattatctgtaaaat

SEQ ID NO: 9900 - DNA, 20 bp, Artificial Sequence
  Description of Artificial Sequence: Synthetic oligonucleotide
  Target: SCN10A; (+) strand; PAM type: NNGRRT; PAM sequence: TAGAAT
tgtcattaaatatccttctg

SEQ ID NO: 9901 - DNA, 20 bp, Artificial Sequence
  Description of Artificial Sequence: Synthetic oligonucleotide
  Target: SCN10A; (+) strand; PAM type: NNGRRT; PAM sequence: TTGAGT
tcaagctgtgcagcttcatg

SEQ ID NO: 9902 - DNA, 20 bp, Artificial Sequence
  Description of Artificial Sequence: Synthetic oligonucleotide
  Target: SCN10A; (+) strand; PAM type: NNGRRT; PAM sequence: CAGAGT
agaaatccaacaatctgcct

SEQ ID NO: 9903 - DNA, 20 bp, Artificial Sequence
  Description of Artificial Sequence: Synthetic oligonucleotide
  Target: SCN10A; (+) strand; PAM type: NNGRRT; PAM sequence: CAGGGT
tctgcctcagagttagggag

SEQ ID NO: 9904 - DNA, 20 bp, Artificial Sequence
  Description of Artificial Sequence: Synthetic oligonucleotide
  Target: SCN10A; (+) strand; PAM type: NNGRRT; PAM sequence: AAGGAT
ttccaatccttccgatgacc

SEQ ID NO: 9905 - DNA, 20 bp, Artificial Sequence
  Description of Artificial Sequence: Synthetic oligonucleotide
  Target: SCN10A; (+) strand; PAM type: NNGRRT; PAM sequence: TAGGAT
gaccaaggatcttaggtcat

SEQ ID NO: 9906 - DNA, 20 bp, Artificial Sequence
  Description of Artificial Sequence: Synthetic oligonucleotide
  Target: SCN10A; (+) strand; PAM type: NNGRRT; PAM sequence: TAGGAT
ggtcattaggatctttccat

SEQ ID NO: 9907 - DNA, 20 bp, Artificial Sequence
  Description of Artificial Sequence: Synthetic oligonucleotide
  Target: SCN10A; (+) strand; PAM type: NNGRRT; PAM sequence: TTGAGT
tttaaacctgctagtagttt

SEQ ID NO: 9908 - DNA, 20 bp, Artificial Sequence
  Description of Artificial Sequence: Synthetic oligonucleotide
  Target: SCN10A; (+) strand; PAM type: NNGRRT; PAM sequence: GAGAAT
agcggaccacacaccgtggt

SEQ ID NO: 9909 - DNA, 20 bp, Artificial Sequence
  Description of Artificial Sequence: Synthetic oligonucleotide
  Target: SCN10A; (+) strand; PAM type: NNGRRT; PAM sequence: GAGGAT
agcaaacctcccctcataaa

SEQ ID NO: 9910 - DNA, 20 bp, Artificial Sequence
  Description of Artificial Sequence: Synthetic oligonucleotide
  Target: SCN10A; (+) strand; PAM type: NNGRRT; PAM sequence: GTGAAT
tgtgtctagattagtctgag

SEQ ID NO: 9911 - DNA, 20 bp, Artificial Sequence
  Description of Artificial Sequence: Synthetic oligonucleotide
  Target: SCN10A; (+) strand; PAM type: NNGRRT; PAM sequence: TGGGGT
tctgtgtcttgggactgctt

SEQ ID NO: 9912 - DNA, 20 bp, Artificial Sequence
  Description of Artificial Sequence: Synthetic oligonucleotide
  Target: SCN10A; (+) strand; PAM type: NNGRRT; PAM sequence: TGGGAT
taatgacctcattgtacttt

SEQ ID NO: 9913 - DNA, 20 bp, Artificial Sequence
  Description of Artificial Sequence: Synthetic oligonucleotide
  Target: SCN10A; (+) strand; PAM type: NNGRRT; PAM sequence: TTGGAT
attgtacttttgggattcaa

SEQ ID NO: 9914 - DNA, 20 bp, Artificial Sequence
  Description of Artificial Sequence: Synthetic oligonucleotide
  Target: SCN10A; (+) strand; PAM type: NNGRRT; PAM sequence: AAGGAT
gtggaagaggcaatcgtgca

SEQ ID NO: 9915 - DNA, 20 bp, Artificial Sequence
  Description of Artificial Sequence: Synthetic oligonucleotide
  Target: SCN10A; (+) strand; PAM type: NNGRRT; PAM sequence: ATGAGT
gaggcaatcgtgcaaaggat

SEQ ID NO: 9916 - DNA, 20 bp, Artificial Sequence
  Description of Artificial Sequence: Synthetic oligonucleotide
  Target: SCN10A; (+) strand; PAM type: NNGRRT; PAM sequence: CTGAAT
ttctgatcaggttgaaagga

SEQ ID NO: 9917 - DNA, 20 bp, Artificial Sequence
  Description of Artificial Sequence: Synthetic oligonucleotide
  Target: SCN10A; (+) strand; PAM type: NNGRRT; PAM sequence: CCGAGT
ggactgaatagccacagggc

SEQ ID NO: 9918 - DNA, 20 bp, Artificial Sequence
  Description of Artificial Sequence: Synthetic oligonucleotide
  Target: SCN10A; (+) strand; PAM type: NNGRRT; PAM sequence: GAGAGT
tctgggaactacaggtcaat

SEQ ID NO: 9919 - DNA, 20 bp, Artificial Sequence
  Description of Artificial Sequence: Synthetic oligonucleotide
  Target: SCN10A; (+) strand; PAM type: NNGRRT; PAM sequence: GAGGAT
tgcaggtacagagaggcaga

SEQ ID NO: 9920 - DNA, 20 bp, Artificial Sequence
  Description of Artificial Sequence: Synthetic oligonucleotide
  Target: SCN10A; (+) strand; PAM type: NNGRRT; PAM sequence: GAGGGT
tgcaccaagatgagcccact

SEQ ID NO: 9921 - DNA, 20 bp, Artificial Sequence
  Description of Artificial Sequence: Synthetic oligonucleotide
  Target: SCN10A; (+) strand; PAM type: NNGRRT; PAM sequence: CAGGAT
ccaggggaggactctggcaa

SEQ ID NO: 9922 - DNA, 20 bp, Artificial Sequence
  Description of Artificial Sequence: Synthetic oligonucleotide
  Target: SCN10A; (+) strand; PAM type: NNGRRT; PAM sequence: GAGGAT
ctctcctggtttctccctct

SEQ ID NO: 9923 - DNA, 20 bp, Artificial Sequence
  Description of Artificial Sequence: Synthetic oligonucleotide
  Target: SCN10A; (+) strand; PAM type: NNGRRT; PAM sequence: GAGGAT
ttctccctctgaggatttag

SEQ ID NO: 9924 - DNA, 20 bp, Artificial Sequence
  Description of Artificial Sequence: Synthetic oligonucleotide
  Target: SCN10A; (+) strand; PAM type: NNGRRT; PAM sequence: AGGGAT
ttctcaaactttttgatttc

SEQ ID NO: 9925 - DNA, 20 bp, Artificial Sequence
  Description of Artificial Sequence: Synthetic oligonucleotide
  Target: SCN10A; (+) strand; PAM type: NNGRRT; PAM sequence: GGGAAT
ctcaggaaattttaaaacac

SEQ ID NO: 9926 - DNA, 20 bp, Artificial Sequence
  Description of Artificial Sequence: Synthetic oligonucleotide
  Target: SCN10A; (+) strand; PAM type: NNGRRT; PAM sequence: TAGAGT
gcacacattccagtagcttt

SEQ ID NO: 9927 - DNA, 20 bp, Artificial Sequence
  Description of Artificial Sequence: Synthetic oligonucleotide
  Target: SCN10A; (+) strand; PAM type: NNGRRT; PAM sequence: AGGGGT
aaaacagttttggggacacc

SEQ ID NO: 9928 - DNA, 20 bp, Artificial Sequence
  Description of Artificial Sequence: Synthetic oligonucleotide
  Target: SCN10A; (+) strand; PAM type: NNGRRT; PAM sequence: GTGGGT
agttatctgcttttgaagat

SEQ ID NO: 9929 - DNA, 20 bp, Artificial Sequence
  Description of Artificial Sequence: Synthetic oligonucleotide
  Target: SCN10A; (+) strand; PAM type: NNGRRT; PAM sequence: CGGAAT
atattttttttggttgttaa

SEQ ID NO: 9930 - DNA, 20 bp, Artificial Sequence
  Description of Artificial Sequence: Synthetic oligonucleotide
  Target: SCN10A; (+) strand; PAM type: NNGRRT; PAM sequence: CTGGGT
gccaaggaggactttctggg

SEQ ID NO: 9931 - DNA, 20 bp, Artificial Sequence
  Description of Artificial Sequence: Synthetic oligonucleotide
  Target: SCN10A; (+) strand; PAM type: NNGRRT; PAM sequence: ACGGAT
tacccggtgtgtgctgtaga

SEQ ID NO: 9932 - DNA, 20 bp, Artificial Sequence
  Description of Artificial Sequence: Synthetic oligonucleotide
  Target: SCN10A; (+) strand; PAM type: NNGRRT; PAM sequence: CGGAGT
tctatctccaccagtgactc

SEQ ID NO: 9933 - DNA, 20 bp, Artificial Sequence
  Description of Artificial Sequence: Synthetic oligonucleotide
  Target: SCN10A; (+) strand; PAM type: NNGRRT; PAM sequence: AGGGAT
gacggaagttgttagtttcg

SEQ ID NO: 9934 - DNA, 20 bp, Artificial Sequence
  Description of Artificial Sequence: Synthetic oligonucleotide
  Target: SCN10A; (+) strand; PAM type: NNGRRT; PAM sequence: GGGAAT
tagtttcgagggatccaatg

SEQ ID NO: 9935 - DNA, 20 bp, Artificial Sequence
  Description of Artificial Sequence: Synthetic oligonucleotide
  Target: SCN10A; (+) strand; PAM type: NNGRRT; PAM sequence: AAGAGT
ggaagtatttatactcttat

SEQ ID NO: 9936 - DNA, 20 bp, Artificial Sequence
  Description of Artificial Sequence: Synthetic oligonucleotide
  Target: SCN10A; (+) strand; PAM type: NNGRRT; PAM sequence: CAGGGT
caaccctcctccaggtgcct

SEQ ID NO: 9937 - DNA, 20 bp, Artificial Sequence
  Description of Artificial Sequence: Synthetic oligonucleotide
  Target: SCN10A; (+) strand; PAM type: NNGRRT; PAM sequence: CTGAGT
tctcctcatttccaggacca

SEQ ID NO: 9938 - DNA, 20 bp, Artificial Sequence
  Description of Artificial Sequence: Synthetic oligonucleotide
  Target: SCN10A; (+) strand; PAM type: NNGRRT; PAM sequence: TTGAAT
gtcaacatttctccacctgt

SEQ ID NO: 9939 - DNA, 20 bp, Artificial Sequence
  Description of Artificial Sequence: Synthetic oligonucleotide
  Target: SCN10A; (+) strand; PAM type: NNGRRT; PAM sequence: GAGAAT
tggagaactccagattattg

SEQ ID NO: 9940 - DNA, 20 bp, Artificial Sequence
  Description of Artificial Sequence: Synthetic oligonucleotide
  Target: SCN10A; (+) strand; PAM type: NNGRRT; PAM sequence: AGGGGT
acagttcccctgaactgctg

SEQ ID NO: 9941 - DNA, 20 bp, Artificial Sequence
  Description of Artificial Sequence: Synthetic oligonucleotide
  Target: SCN10A; (+) strand; PAM type: NNGRRT; PAM sequence: GGGAAT
ggggaacctcagtattgcct

SEQ ID NO: 9942 - DNA, 20 bp, Artificial Sequence
  Description of Artificial Sequence: Synthetic oligonucleotide
  Target: SCN10A; (+) strand; PAM type: NNGRRT; PAM sequence: TAGGAT
accattcctttccctctgct

SEQ ID NO: 9943 - DNA, 20 bp, Artificial Sequence
  Description of Artificial Sequence: Synthetic oligonucleotide
  Target: SCN10A; (+) strand; PAM type: NNGRRT; PAM sequence: TTGGAT
cacttttcagtctttgaagc

SEQ ID NO: 9944 - DNA, 20 bp, Artificial Sequence
  Description of Artificial Sequence: Synthetic oligonucleotide
  Target: SCN10A; (+) strand; PAM type: NNGRRT; PAM sequence: AGGGAT
tcactaaaatgcttccttgc

SEQ ID NO: 9945 - DNA, 20 bp, Artificial Sequence
  Description of Artificial Sequence: Synthetic oligonucleotide
  Target: SCN10A; (+) strand; PAM type: NNGRRT; PAM sequence: CAGGGT
ttctttttttttttttgaga

SEQ ID NO: 9946 - DNA, 20 bp, Artificial Sequence
  Description of Artificial Sequence: Synthetic oligonucleotide
  Target: SCN10A; (+) strand; PAM type: NNGRRT; PAM sequence: TAGAGT
ggtatcactgtcacccggac

SEQ ID NO: 9947 - DNA, 20 bp, Artificial Sequence
  Description of Artificial Sequence: Synthetic oligonucleotide
  Target: SCN10A; (+) strand; PAM type: NNGRRT; PAM sequence: CCGAAT
aattctcccacctcagcctc

SEQ ID NO: 9948 - DNA, 20 bp, Artificial Sequence
  Description of Artificial Sequence: Synthetic oligonucleotide
  Target: SCN10A; (+) strand; PAM type: NNGRRT; PAM sequence: GTGAAT
agcttttcccatacatgatt

SEQ ID NO: 9949 - DNA, 20 bp, Artificial Sequence
  Description of Artificial Sequence: Synthetic oligonucleotide
  Target: SCN10A; (+) strand; PAM type: NNGRRT; PAM sequence: CAGAAT
ggcactctatcttttgtttt

SEQ ID NO: 9950 - DNA, 20 bp, Artificial Sequence
  Description of Artificial Sequence: Synthetic oligonucleotide
  Target: SCN10A; (+) strand; PAM type: NNGRRT; PAM sequence: CTGGAT
attccactgtatttcagact

SEQ ID NO: 9951 - DNA, 20 bp, Artificial Sequence
  Description of Artificial Sequence: Synthetic oligonucleotide
  Target: SCN10A; (+) strand; PAM type: NNGRRT; PAM sequence: ATGAGT
tttccaagatcacattacta

SEQ ID NO: 9952 - DNA, 20 bp, Artificial Sequence
  Description of Artificial Sequence: Synthetic oligonucleotide
  Target: SCN10A; (+) strand; PAM type: NNGRRT; PAM sequence: CTGAGT
tctcatttatatgcagatga

SEQ ID NO: 9953 - DNA, 20 bp, Artificial Sequence
  Description of Artificial Sequence: Synthetic oligonucleotide
  Target: SCN10A; (+) strand; PAM type: NNGRRT; PAM sequence: CTGGGT
tttctgtgtctgtccacaac

SEQ ID NO: 9954 - DNA, 20 bp, Artificial Sequence
  Description of Artificial Sequence: Synthetic oligonucleotide
  Target: SCN10A; (+) strand; PAM type: NNGRRT; PAM sequence: TTGAAT
ctacttttataagtttatcc

SEQ ID NO: 9955 - DNA, 20 bp, Artificial Sequence
  Description of Artificial Sequence: Synthetic oligonucleotide
  Target: SCN10A; (+) strand; PAM type: NNGRRT; PAM sequence: TAGGAT
gacctatatgaagtctatgt

SEQ ID NO: 9956 - DNA, 20 bp, Artificial Sequence
  Description of Artificial Sequence: Synthetic oligonucleotide
  Target: SCN10A; (+) strand; PAM type: NNGRRT; PAM sequence: CAGAAT
tgcctggaactaactagata

SEQ ID NO: 9957 - DNA, 20 bp, Artificial Sequence
  Description of Artificial Sequence: Synthetic oligonucleotide
  Target: SCN10A; (+) strand; PAM type: NNGRRT; PAM sequence: ATGAAT
acagaatagatagttgttgc

SEQ ID NO: 9958 - DNA, 20 bp, Artificial Sequence
  Description of Artificial Sequence: Synthetic oligonucleotide
  Target: SCN10A; (+) strand; PAM type: NNGRRT; PAM sequence: AGGAAT
aaaatcacagatccaataat

SEQ ID NO: 9959 - DNA, 20 bp, Artificial Sequence
  Description of Artificial Sequence: Synthetic oligonucleotide
  Target: SCN10A; (+) strand; PAM type: NNGRRT; PAM sequence: TTGAGT
ataaggaaccaaagagatta

SEQ ID NO: 9960 - DNA, 20 bp, Artificial Sequence
  Description of Artificial Sequence: Synthetic oligonucleotide
  Target: SCN10A; (+) strand; PAM type: NNGRRT; PAM sequence: TTGAAT
accatacctagaggtatttc

SEQ ID NO: 9961 - DNA, 20 bp, Artificial Sequence
  Description of Artificial Sequence: Synthetic oligonucleotide
  Target: SCN10A; (+) strand; PAM type: NNGRRT; PAM sequence: TTGAAT
cttatagtttggaaccaaat

SEQ ID NO: 9962 - DNA, 20 bp, Artificial Sequence
  Description of Artificial Sequence: Synthetic oligonucleotide
  Target: SCN10A; (+) strand; PAM type: NNGRRT; PAM sequence: AAGAAT
cagttgtttagtaacaatgc

SEQ ID NO: 9963 - DNA, 20 bp, Artificial Sequence
  Description of Artificial Sequence: Synthetic oligonucleotide
  Target: SCN10A; (+) strand; PAM type: NNGRRT; PAM sequence: TGGAAT
aagaattctctcagtgacac

SEQ ID NO: 9964 - DNA, 20 bp, Artificial Sequence
  Description of Artificial Sequence: Synthetic oligonucleotide
  Target: SCN10A; (+) strand; PAM type: NNGRRT; PAM sequence: GAGGAT
tgacactggaatgcaatgtt

SEQ ID NO: 9965 - DNA, 20 bp, Artificial Sequence
  Description of Artificial Sequence: Synthetic oligonucleotide
  Target: SCN10A; (+) strand; PAM type: NNGRRT; PAM sequence: CAGAAT
gattgagaacaggactaagc

SEQ ID NO: 9966 - DNA, 20 bp, Artificial Sequence
  Description of Artificial Sequence: Synthetic oligonucleotide
  Target: SCN10A; (+) strand; PAM type: NNGRRT; PAM sequence: TGGGGT
gacaaaattgttttcaacat

SEQ ID NO: 9967 - DNA, 20 bp, Artificial Sequence
  Description of Artificial Sequence: Synthetic oligonucleotide
  Target: SCN10A; (+) strand; PAM type: NNGRRT; PAM sequence: GGGAAT
attgttttcaacattggggt

SEQ ID NO: 9968 - DNA, 20 bp, Artificial Sequence
  Description of Artificial Sequence: Synthetic oligonucleotide
  Target: SCN10A; (+) strand; PAM type: NNGRRT; PAM sequence: TGGGAT
agaagtgatagctctggact

SEQ ID NO: 9969 - DNA, 20 bp, Artificial Sequence
  Description of Artificial Sequence: Synthetic oligonucleotide
  Target: SCN10A; (+) strand; PAM type: NNGRRT; PAM sequence: TGGGGT
tgacattctgagaaaactat

SEQ ID NO: 9970 - DNA, 20 bp, Artificial Sequence
  Description of Artificial Sequence: Synthetic oligonucleotide
  Target: SCN10A; (+) strand; PAM type: NNGRRT; PAM sequence: AGGAAT
tttatctgagagctatttct

SEQ ID NO: 9971 - DNA, 20 bp, Artificial Sequence
  Description of Artificial Sequence: Synthetic oligonucleotide
  Target: SCN10A; (+) strand; PAM type: NNGRRT; PAM sequence: CAGAAT
tcttatgggcaaactgggct

SEQ ID NO: 9972 - DNA, 20 bp, Artificial Sequence
  Description of Artificial Sequence: Synthetic oligonucleotide
  Target: SCN10A; (+) strand; PAM type: NNGRRT; PAM sequence: AGGGGT
ggctcagaattgtttcactg

SEQ ID NO: 9973 - DNA, 20 bp, Artificial Sequence
  Description of Artificial Sequence: Synthetic oligonucleotide
  Target: SCN10A; (+) strand; PAM type: NNGRRT; PAM sequence: AAGGAT
gaattgtttcactgaggggt

SEQ ID NO: 9974 - DNA, 20 bp, Artificial Sequence
  Description of Artificial Sequence: Synthetic oligonucleotide
  Target: SCN10A; (+) strand; PAM type: NNGRRT; PAM sequence: TAGGGT
tcactgaggggtaaggatac

SEQ ID NO: 9975 - DNA, 20 bp, Artificial Sequence
  Description of Artificial Sequence: Synthetic oligonucleotide
  Target: SCN10A; (+) strand; PAM type: NNGRRT; PAM sequence: TGGGAT
ttattggttgacggttgtcc

SEQ ID NO: 9976 - DNA, 20 bp, Artificial Sequence
  Description of Artificial Sequence: Synthetic oligonucleotide
  Target: SCN10A; (+) strand; PAM type: NNGRRT; PAM sequence: GGGAAT
tagtccttgcaaccttaatt

SEQ ID NO: 9977 - DNA, 20 bp, Artificial Sequence
  Description of Artificial Sequence: Synthetic oligonucleotide
  Target: SCN10A; (+) strand; PAM type: NNGRRT; PAM sequence: TAGAGT
ttaattgggaatccctattt

SEQ ID NO: 9978 - DNA, 20 bp, Artificial Sequence
  Description of Artificial Sequence: Synthetic oligonucleotide
  Target: SCN10A; (+) strand; PAM type: NNGRRT; PAM sequence: TTGAAT
atccctattttagagtctag

SEQ ID NO: 9979 - DNA, 20 bp, Artificial Sequence
  Description of Artificial Sequence: Synthetic oligonucleotide
  Target: SCN10A; (+) strand; PAM type: NNGRRT; PAM sequence: TAGGAT
catatcaaatgtatgtgtta

SEQ ID NO: 9980 - DNA, 20 bp, Artificial Sequence
  Description of Artificial Sequence: Synthetic oligonucleotide
  Target: SCN10A; (+) strand; PAM type: NNGRRT; PAM sequence: TTGGAT
ctgggcctgatactcacttc

SEQ ID NO: 9981 - DNA, 20 bp, Artificial Sequence
  Description of Artificial Sequence: Synthetic oligonucleotide
  Target: SCN10A; (+) strand; PAM type: NNGRRT; PAM sequence: ATGAGT
ctggctttcaaacagtctgc

SEQ ID NO: 9982 - DNA, 20 bp, Artificial Sequence
  Description of Artificial Sequence: Synthetic oligonucleotide
  Target: SCN10A; (+) strand; PAM type: NNGRRT; PAM sequence: TGGAGT
tctcactctgttgtccaggc

SEQ ID NO: 9983 - DNA, 20 bp, Artificial Sequence
  Description of Artificial Sequence: Synthetic oligonucleotide
  Target: SCN10A; (+) strand; PAM type: NNGRRT; PAM sequence: TGGGGT
gctaatcttcatatttttga

SEQ ID NO: 9984 - DNA, 20 bp, Artificial Sequence
  Description of Artificial Sequence: Synthetic oligonucleotide
  Target: SCN10A; (-) strand; PAM type: NNNNGHTT; PAM sequence: TTCTGTTT
tttttaaaaattcaaataaa

SEQ ID NO: 9985 - DNA, 20 bp, Artificial Sequence
  Description of Artificial Sequence: Synthetic oligonucleotide
  Target: SCN10A; (-) strand; PAM type: NNNNGHTT; PAM sequence: TCAAGATT
tctgggaaaaagagtgtcag

SEQ ID NO: 9986 - DNA, 20 bp, Artificial Sequence
  Description of Artificial Sequence: Synthetic oligonucleotide
  Target: SCN10A; (-) strand; PAM type: NNNNGHTT; PAM sequence: ACTGGATT
caaatgtccaacagtgatag

SEQ ID NO: 9987 - DNA, 20 bp, Artificial Sequence
  Description of Artificial Sequence: Synthetic oligonucleotide
  Target: SCN10A; (-) strand; PAM type: NNNNGHTT; PAM sequence: GTATGTTT
ctataaagacacatgcacac

SEQ ID NO: 9988 - DNA, 20 bp, Artificial Sequence
  Description of Artificial Sequence: Synthetic oligonucleotide
  Target: SCN10A; (-) strand; PAM type: NNNNGHTT; PAM sequence: AAAGGATT
ccattactgggtatataccc

SEQ ID NO: 9989 - DNA, 20 bp, Artificial Sequence
  Description of Artificial Sequence: Synthetic oligonucleotide
  Target: SCN10A; (-) strand; PAM type: NNNNGHTT; PAM sequence: AAGAGCTT
aatgggatctcattaaacta

SEQ ID NO: 9990 - DNA, 20 bp, Artificial Sequence
  Description of Artificial Sequence: Synthetic oligonucleotide
  Target: SCN10A; (-) strand; PAM type: NNNNGHTT; PAM sequence: GATGGATT
ttatacaaaaattaattcaa

SEQ ID NO: 9991 - DNA, 20 bp, Artificial Sequence
  Description of Artificial Sequence: Synthetic oligonucleotide
  Target: SCN10A; (-) strand; PAM type: NNNNGHTT; PAM sequence: AAAGGATT
gacaaaaacaagaaatgggg

SEQ ID NO: 9992 - DNA, 20 bp, Artificial Sequence
  Description of Artificial Sequence: Synthetic oligonucleotide
  Target: SCN10A; (-) strand; PAM type: NNNNGHTT; PAM sequence: CTCTGTTT
agttcactcatgatttggct

SEQ ID NO: 9993 - DNA, 20 bp, Artificial Sequence
  Description of Artificial Sequence: Synthetic oligonucleotide
  Target: SCN10A; (-) strand; PAM type: NNNNGHTT; PAM sequence: TCATGATT
aattgtgaatgggagttcac

SEQ ID NO: 9994 - DNA, 20 bp, Artificial Sequence
  Description of Artificial Sequence: Synthetic oligonucleotide
  Target: SCN10A; (-) strand; PAM type: NNNNGHTT; PAM sequence: AGTGGTTT
cctcttttatttcactgagc

SEQ ID NO: 9995 - DNA, 20 bp, Artificial Sequence
  Description of Artificial Sequence: Synthetic oligonucleotide
  Target: SCN10A; (-) strand; PAM type: NNNNGHTT; PAM sequence: ATTTGTTT
tgagcatggagtattcttcc

SEQ ID NO: 9996 - DNA, 20 bp, Artificial Sequence
  Description of Artificial Sequence: Synthetic oligonucleotide
  Target: SCN10A; (-) strand; PAM type: NNNNGHTT; PAM sequence: TATTGATT
cagtatggccattttcaaga

SEQ ID NO: 9997 - DNA, 20 bp, Artificial Sequence
  Description of Artificial Sequence: Synthetic oligonucleotide
  Target: SCN10A; (-) strand; PAM type: NNNNGHTT; PAM sequence: GGTAGCTT
attctgagaagaaagtcatt

SEQ ID NO: 9998 - DNA, 20 bp, Artificial Sequence
  Description of Artificial Sequence: Synthetic oligonucleotide
  Target: SCN10A; (-) strand; PAM type: NNNNGHTT; PAM sequence: AGTAGTTT
tggttccgtatgaactttaa

SEQ ID NO: 9999 - DNA, 20 bp, Artificial Sequence
  Description of Artificial Sequence: Synthetic oligonucleotide
  Target: SCN10A; (-) strand; PAM type: NNNNGHTT; PAM sequence: TTAGGATT
aggttaaaaaaaaaacagga

SEQ ID NO: 10000 - DNA, 20 bp, Artificial Sequence
  Description of Artificial Sequence: Synthetic oligonucleotide
  Target: SCN10A; (-) strand; PAM type: NNNNGHTT; PAM sequence: ACAGGATT
aaagtaaggttaaaaaaaaa

SEQ ID NO: 10001 - DNA, 20 bp, Artificial Sequence
  Description of Artificial Sequence: Synthetic oligonucleotide
  Target: SCN10A; (-) strand; PAM type: NNNNGHTT; PAM sequence: AAAGGTTT
gctaaaaagtaaaaaaaagt

SEQ ID NO: 10002 - DNA, 20 bp, Artificial Sequence
  Description of Artificial Sequence: Synthetic oligonucleotide
  Target: SCN10A; (-) strand; PAM type: NNNNGHTT; PAM sequence: GTTGGTTT
tataggtatacatgtgccat

SEQ ID NO: 10003 - DNA, 20 bp, Artificial Sequence
  Description of Artificial Sequence: Synthetic oligonucleotide
  Target: SCN10A; (-) strand; PAM type: NNNNGHTT; PAM sequence: ACATGTTT
agggtacatgtgcacaatgt

SEQ ID NO: 10004 - DNA, 20 bp, Artificial Sequence
  Description of Artificial Sequence: Synthetic oligonucleotide
  Target: SCN10A; (-) strand; PAM type: NNNNGHTT; PAM sequence: GAAGGTTT
tctggagctgaacacaggct

SEQ ID NO: 10005 - DNA, 20 bp, Artificial Sequence
  Description of Artificial Sequence: Synthetic oligonucleotide
  Target: SCN10A; (-) strand; PAM type: NNNNGHTT; PAM sequence: ATTTGCTT
gagccctggtgtgctggagc

SEQ ID NO: 10006 - DNA, 20 bp, Artificial Sequence
  Description of Artificial Sequence: Synthetic oligonucleotide
  Target: SCN10A; (-) strand; PAM type: NNNNGHTT; PAM sequence: ACTAGATT
ggtacaattacaaggtagaa

SEQ ID NO: 10007 - DNA, 20 bp, Artificial Sequence
  Description of Artificial Sequence: Synthetic oligonucleotide
  Target: SCN10A; (-) strand; PAM type: NNNNGHTT; PAM sequence: GCCAGTTT
cttttgaaaatttcactaga

SEQ ID NO: 10008 - DNA, 20 bp, Artificial Sequence
  Description of Artificial Sequence: Synthetic oligonucleotide
  Target: SCN10A; (-) strand; PAM type: NNNNGHTT; PAM sequence: GCAAGATT
ttttggaaatgtatccaaat

SEQ ID NO: 10009 - DNA, 20 bp, Artificial Sequence
  Description of Artificial Sequence: Synthetic oligonucleotide
  Target: SCN10A; (-) strand; PAM type: NNNNGHTT; PAM sequence: CGGAGTTT
tatacacatcttgcatgaca

SEQ ID NO: 10010 - DNA, 20 bp, Artificial Sequence
  Description of Artificial Sequence: Synthetic oligonucleotide
  Target: SCN10A; (-) strand; PAM type: NNNNGHTT; PAM sequence: CCTAGTTT
atttctattattgtcatcta

SEQ ID NO: 10011 - DNA, 20 bp, Artificial Sequence
  Description of Artificial Sequence: Synthetic oligonucleotide
  Target: SCN10A; (-) strand; PAM type: NNNNGHTT; PAM sequence: CCTTGATT
ggaacatggctctgccaata

SEQ ID NO: 10012 - DNA, 20 bp, Artificial Sequence
  Description of Artificial Sequence: Synthetic oligonucleotide
  Target: SCN10A; (-) strand; PAM type: NNNNGHTT; PAM sequence: GCGGGCTT
gaaggcaacggttctcacct

SEQ ID NO: 10013 - DNA, 20 bp, Artificial Sequence
  Description of Artificial Sequence: Synthetic oligonucleotide
  Target: SCN10A; (-) strand; PAM type: NNNNGHTT; PAM sequence: CAAAGATT
atgtgcaggccaaggaatgg

SEQ ID NO: 10014 - DNA, 20 bp, Artificial Sequence
  Description of Artificial Sequence: Synthetic oligonucleotide
  Target: SCN10A; (-) strand; PAM type: NNNNGHTT; PAM sequence: TAAGGTTT
attgtgaccttatttgacat

SEQ ID NO: 10015 - DNA, 20 bp, Artificial Sequence
  Description of Artificial Sequence: Synthetic oligonucleotide
  Target: SCN10A; (-) strand; PAM type: NNNNGHTT; PAM sequence: CTGTGATT
gaagttctaaccaatagtac

SEQ ID NO: 10016 - DNA, 20 bp, Artificial Sequence
  Description of Artificial Sequence: Synthetic oligonucleotide
  Target: SCN10A; (-) strand; PAM type: NNNNGHTT; PAM sequence: TTATGCTT
taattcaactttatgttgaa

SEQ ID NO: 10017 - DNA, 20 bp, Artificial Sequence
  Description of Artificial Sequence: Synthetic oligonucleotide
  Target: SCN10A; (-) strand; PAM type: NNNNGHTT; PAM sequence: ACAGGTTT
agtggacagagagtttgggc

SEQ ID NO: 10018 - DNA, 20 bp, Artificial Sequence
  Description of Artificial Sequence: Synthetic oligonucleotide
  Target: SCN10A; (-) strand; PAM type: NNNNGHTT; PAM sequence: GAGAGTTT
ataagacagctaagtggaca

SEQ ID NO: 10019 - DNA, 20 bp, Artificial Sequence
  Description of Artificial Sequence: Synthetic oligonucleotide
  Target: SCN10A; (-) strand; PAM type: NNNNGHTT; PAM sequence: AAGTGTTT
gccatctgagatactagccc

SEQ ID NO: 10020 - DNA, 20 bp, Artificial Sequence
  Description of Artificial Sequence: Synthetic oligonucleotide
  Target: SCN10A; (-) strand; PAM type: NNNNGHTT; PAM sequence: TGCAGCTT
gggagcacagatactgactg

SEQ ID NO: 10021 - DNA, 20 bp, Artificial Sequence
  Description of Artificial Sequence: Synthetic oligonucleotide
  Target: SCN10A; (-) strand; PAM type: NNNNGHTT; PAM sequence: GCCTGATT
aaatcagctattctctgaat

SEQ ID NO: 10022 - DNA, 20 bp, Artificial Sequence
  Description of Artificial Sequence: Synthetic oligonucleotide
  Target: SCN10A; (-) strand; PAM type: NNNNGHTT; PAM sequence: AGATGCTT
agaagtcaaagaggctctca

SEQ ID NO: 10023 - DNA, 20 bp, Artificial Sequence
  Description of Artificial Sequence: Synthetic oligonucleotide
  Target: SCN10A; (-) strand; PAM type: NNNNGHTT; PAM sequence: TACAGATT
catctcacatgcctcaagaa

SEQ ID NO: 10024 - DNA, 20 bp, Artificial Sequence
  Description of Artificial Sequence: Synthetic oligonucleotide
  Target: SCN10A; (-) strand; PAM type: NNNNGHTT; PAM sequence: ATAAGATT
tctatatatttgatcatttc

SEQ ID NO: 10025 - DNA, 20 bp, Artificial Sequence
  Description of Artificial Sequence: Synthetic oligonucleotide
  Target: SCN10A; (-) strand; PAM type: NNNNGHTT; PAM sequence: CAAAGATT
cccattcccagccacaatca

SEQ ID NO: 10026 - DNA, 20 bp, Artificial Sequence
  Description of Artificial Sequence: Synthetic oligonucleotide
  Target: SCN10A; (-) strand; PAM type: NNNNGHTT; PAM sequence: TAGGGATT
ccctataacaacataggaca

SEQ ID NO: 10027 - DNA, 20 bp, Artificial Sequence
  Description of Artificial Sequence: Synthetic oligonucleotide
  Target: SCN10A; (-) strand; PAM type: NNNNGHTT; PAM sequence: TGCAGATT
tatttaggccaaaggcatgt

SEQ ID NO: 10028 - DNA, 20 bp, Artificial Sequence
  Description of Artificial Sequence: Synthetic oligonucleotide
  Target: SCN10A; (-) strand; PAM type: NNNNGHTT; PAM sequence: AGGAGTTT
aatggagtaagaattgtcag

SEQ ID NO: 10029 - DNA, 20 bp, Artificial Sequence
  Description of Artificial Sequence: Synthetic oligonucleotide
  Target: SCN10A; (-) strand; PAM type: NNNNGHTT; PAM sequence: AAAAGATT
aaaataggaattaagccccc

SEQ ID NO: 10030 - DNA, 20 bp, Artificial Sequence
  Description of Artificial Sequence: Synthetic oligonucleotide
  Target: SCN10A; (-) strand; PAM type: NNNNGHTT; PAM sequence: AGTAGTTT
agtagataaaaggtatggcc

SEQ ID NO: 10031 - DNA, 20 bp, Artificial Sequence
  Description of Artificial Sequence: Synthetic oligonucleotide
  Target: SCN10A; (-) strand; PAM type: NNNNGHTT; PAM sequence: GAGAGTTT
cataatcagacattaaggag

SEQ ID NO: 10032 - DNA, 20 bp, Artificial Sequence
  Description of Artificial Sequence: Synthetic oligonucleotide
  Target: SCN10A; (-) strand; PAM type: NNNNGHTT; PAM sequence: GGCAGCTT
ttctgttgtgtagctaaaga

SEQ ID NO: 10033 - DNA, 20 bp, Artificial Sequence
  Description of Artificial Sequence: Synthetic oligonucleotide
  Target: SCN10A; (-) strand; PAM type: NNNNGHTT; PAM sequence: GAATGCTT
tggtgggaagggaagaaaat

SEQ ID NO: 10034 - DNA, 20 bp, Artificial Sequence
  Description of Artificial Sequence: Synthetic oligonucleotide
  Target: SCN10A; (-) strand; PAM type: NNNNGHTT; PAM sequence: TTGAGATT
ggatcctgatatttttcagt

SEQ ID NO: 10035 - DNA, 20 bp, Artificial Sequence
  Description of Artificial Sequence: Synthetic oligonucleotide
  Target: SCN10A; (-) strand; PAM type: NNNNGHTT; PAM sequence: TTCAGTTT
tttctgggatcctgatattt

SEQ ID NO: 10036 - DNA, 20 bp, Artificial Sequence
  Description of Artificial Sequence: Synthetic oligonucleotide
  Target: SCN10A; (-) strand; PAM type: NNNNGHTT; PAM sequence: TTAGGATT
acagagattggcaatattat

SEQ ID NO: 10037 - DNA, 20 bp, Artificial Sequence
  Description of Artificial Sequence: Synthetic oligonucleotide
  Target: SCN10A; (-) strand; PAM type: NNNNGHTT; PAM sequence: CAGAGATT
gtcctctgtggagcaccata

SEQ ID NO: 10038 - DNA, 20 bp, Artificial Sequence
  Description of Artificial Sequence: Synthetic oligonucleotide
  Target: SCN10A; (-) strand; PAM type: NNNNGHTT; PAM sequence: ATCAGATT
gtccttttatttttgttgta

SEQ ID NO: 10039 - DNA, 20 bp, Artificial Sequence
  Description of Artificial Sequence: Synthetic oligonucleotide
  Target: SCN10A; (-) strand; PAM type: NNNNGHTT; PAM sequence: CTGTGATT
agaagctaagagcacttcca

SEQ ID NO: 10040 - DNA, 20 bp, Artificial Sequence
  Description of Artificial Sequence: Synthetic oligonucleotide
  Target: SCN10A; (-) strand; PAM type: NNNNGHTT; PAM sequence: AGCTGATT
agatgaagccaccagtatgg

SEQ ID NO: 10041 - DNA, 20 bp, Artificial Sequence
  Description of Artificial Sequence: Synthetic oligonucleotide
  Target: SCN10A; (-) strand; PAM type: NNNNGHTT; PAM sequence: AACTGCTT
gtactcccagacaaatctga

SEQ ID NO: 10042 - DNA, 20 bp, Artificial Sequence
  Description of Artificial Sequence: Synthetic oligonucleotide
  Target: SCN10A; (-) strand; PAM type: NNNNGHTT; PAM sequence: GAAGGTTT
aggctgcatcactcccagat

SEQ ID NO: 10043 - DNA, 20 bp, Artificial Sequence
  Description of Artificial Sequence: Synthetic oligonucleotide
  Target: SCN10A; (-) strand; PAM type: NNNNGHTT; PAM sequence: AGAAGTTT
tctgaaggcaaatatggagg

SEQ ID NO: 10044 - DNA, 20 bp, Artificial Sequence
  Description of Artificial Sequence: Synthetic oligonucleotide
  Target: SCN10A; (-) strand; PAM type: NNNNGHTT; PAM sequence: GTTGGATT
gtcctaggagaatccgggga

SEQ ID NO: 10045 - DNA, 20 bp, Artificial Sequence
  Description of Artificial Sequence: Synthetic oligonucleotide
  Target: SCN10A; (-) strand; PAM type: NNNNGHTT; PAM sequence: TTTTGCTT
atccactgcttggacatcct

SEQ ID NO: 10046 - DNA, 20 bp, Artificial Sequence
  Description of Artificial Sequence: Synthetic oligonucleotide
  Target: SCN10A; (-) strand; PAM type: NNNNGHTT; PAM sequence: CACTGCTT
tggtccctggagataagatc

SEQ ID NO: 10047 - DNA, 20 bp, Artificial Sequence
  Description of Artificial Sequence: Synthetic oligonucleotide
  Target: SCN10A; (-) strand; PAM type: NNNNGHTT; PAM sequence: CTCAGTTT
gaagtttgacccagaggcca

SEQ ID NO: 10048 - DNA, 20 bp, Artificial Sequence
  Description of Artificial Sequence: Synthetic oligonucleotide
  Target: SCN10A; (-) strand; PAM type: NNNNGHTT; PAM sequence: AGAAGTTT
catgttctatgagacctggg

SEQ ID NO: 10049 - DNA, 20 bp, Artificial Sequence
  Description of Artificial Sequence: Synthetic oligonucleotide
  Target: SCN10A; (-) strand; PAM type: NNNNGHTT; PAM sequence: CAGTGATT
catggtcaacatgtacattg

SEQ ID NO: 10050 - DNA, 20 bp, Artificial Sequence
  Description of Artificial Sequence: Synthetic oligonucleotide
  Target: SCN10A; (-) strand; PAM type: NNNNGHTT; PAM sequence: TCCAGATT
caacagcatgctgtgcctct

SEQ ID NO: 10051 - DNA, 20 bp, Artificial Sequence
  Description of Artificial Sequence: Synthetic oligonucleotide
  Target: SCN10A; (-) strand; PAM type: NNNNGHTT; PAM sequence: TCCAGCTT
tctactctatcttcggtatg

SEQ ID NO: 10052 - DNA, 20 bp, Artificial Sequence
  Description of Artificial Sequence: Synthetic oligonucleotide
  Target: SCN10A; (-) strand; PAM type: NNNNGHTT; PAM sequence: GCCTGATT
atttcttccttcttttaaag

SEQ ID NO: 10053 - DNA, 20 bp, Artificial Sequence
  Description of Artificial Sequence: Synthetic oligonucleotide
  Target: SCN10A; (-) strand; PAM type: NNNNGHTT; PAM sequence: ATAAGTTT
gctgaacttggctgcagaag

SEQ ID NO: 10054 - DNA, 20 bp, Artificial Sequence
  Description of Artificial Sequence: Synthetic oligonucleotide
  Target: SCN10A; (-) strand; PAM type: NNNNGHTT; PAM sequence: TTATGCTT
cagctggtcattcaaatccc

SEQ ID NO: 10055 - DNA, 20 bp, Artificial Sequence
  Description of Artificial Sequence: Synthetic oligonucleotide
  Target: SCN10A; (-) strand; PAM type: NNNNGHTT; PAM sequence: GAGAGCTT
cagggaacctggcaaggagc

SEQ ID NO: 10056 - DNA, 20 bp, Artificial Sequence
  Description of Artificial Sequence: Synthetic oligonucleotide
  Target: SCN10A; (-) strand; PAM type: NNNNGHTT; PAM sequence: CAAAGATT
aattcacagaaggtcttcca

SEQ ID NO: 10057 - DNA, 20 bp, Artificial Sequence
  Description of Artificial Sequence: Synthetic oligonucleotide
  Target: SCN10A; (-) strand; PAM type: NNNNGHTT; PAM sequence: AGGTGATT
tcttctttcccaccaacaag

SEQ ID NO: 10058 - DNA, 20 bp, Artificial Sequence
  Description of Artificial Sequence: Synthetic oligonucleotide
  Target: SCN10A; (-) strand; PAM type: NNNNGHTT; PAM sequence: TGTGGCTT
atatcttaactaccagttcc

SEQ ID NO: 10059 - DNA, 20 bp, Artificial Sequence
  Description of Artificial Sequence: Synthetic oligonucleotide
  Target: SCN10A; (-) strand; PAM type: NNNNGHTT; PAM sequence: GCTTGTTT
attttatattaaagaaggga

SEQ ID NO: 10060 - DNA, 20 bp, Artificial Sequence
  Description of Artificial Sequence: Synthetic oligonucleotide
  Target: SCN10A; (-) strand; PAM type: NNNNGHTT; PAM sequence: GGGAGCTT
tttgattttatattaaagaa

SEQ ID NO: 10061 - DNA, 20 bp, Artificial Sequence
  Description of Artificial Sequence: Synthetic oligonucleotide
  Target: SCN10A; (-) strand; PAM type: NNNNGHTT; PAM sequence: TTTTGATT
atgaaagattccaaaggcta

SEQ ID NO: 10062 - DNA, 20 bp, Artificial Sequence
  Description of Artificial Sequence: Synthetic oligonucleotide
  Target: SCN10A; (-) strand; PAM type: NNNNGHTT; PAM sequence: GAAAGATT
ttttgtttgtcttccaaaat

SEQ ID NO: 10063 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
ttgttttcatttttgttttg

SEQ ID NO: 10064 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
gttagttgttttcatttttg

SEQ ID NO: 10065 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
ggttggttagttgttttcat

SEQ ID NO: 10066 - DNA, 20 bp, Artificial Sequence
  Description of Artificial Sequence: Synthetic oligonucleotide
  Target: SCN10A; (-) strand; PAM type: NNNNGHTT; PAM sequence: AGTTGTTT
tttttgttggttggttggtt

SEQ ID NO: 10067 - DNA, 20 bp, Artificial Sequence
  Description of Artificial Sequence: Synthetic oligonucleotide
  Target: SCN10A; (-) strand; PAM type: NNNNGHTT; PAM sequence: AGGAGTTT
cttatctcacttagcataat

SEQ ID NO: 10068 - DNA, 20 bp, Artificial Sequence
  Description of Artificial Sequence: Synthetic oligonucleotide
  Target: SCN10A; (-) strand; PAM type: NNNNGHTT; PAM sequence: TCTGGCTT
gtcgtttttgtccttctgtg

SEQ ID NO: 10069 - DNA, 20 bp, Artificial Sequence
  Description of Artificial Sequence: Synthetic oligonucleotide
  Target: SCN10A; (-) strand; PAM type: NNNNGHTT; PAM sequence: TGTCGTTT
tccttatataaatgcaatca

SEQ ID NO: 10070 - DNA, 20 bp, Artificial Sequence
  Description of Artificial Sequence: Synthetic oligonucleotide
  Target: SCN10A; (-) strand; PAM type: NNNNGHTT; PAM sequence: TTTAGATT
gctcccatgagtttgactat

SEQ ID NO: 10071 - DNA, 20 bp, Artificial Sequence
  Description of Artificial Sequence: Synthetic oligonucleotide
  Target: SCN10A; (-) strand; PAM type: NNNNGHTT; PAM sequence: ATGAGTTT
ccattctattctctgctccc

SEQ ID NO: 10072 - DNA, 20 bp, Artificial Sequence
  Description of Artificial Sequence: Synthetic oligonucleotide
  Target: SCN10A; (-) strand; PAM type: NNNNGHTT; PAM sequence: GGAAGTTT
tttattcatgtcacataact

SEQ ID NO: 10073 - DNA, 20 bp, Artificial Sequence
  Description of Artificial Sequence: Synthetic oligonucleotide
  Target: SCN10A; (-) strand; PAM type: NNNNGHTT; PAM sequence: CTAGGATT
actatgctataagtagagct

SEQ ID NO: 10074 - DNA, 20 bp, Artificial Sequence
  Description of Artificial Sequence: Synthetic oligonucleotide
  Target: SCN10A; (-) strand; PAM type: NNNNGHTT; PAM sequence: TTAAGATT
ttattgggtgctaggaacac

SEQ ID NO: 10075 - DNA, 20 bp, Artificial Sequence
  Description of Artificial Sequence: Synthetic oligonucleotide
  Target: SCN10A; (-) strand; PAM type: NNNNGHTT; PAM sequence: ATGAGTTT
tgtttaatgtacacaacttt

SEQ ID NO: 10076 - DNA, 20 bp, Artificial Sequence
  Description of Artificial Sequence: Synthetic oligonucleotide
  Target: SCN10A; (-) strand; PAM type: NNNNGHTT; PAM sequence: ACATGTTT
atccacatgtaaaaagctat

SEQ ID NO: 10077 - DNA, 20 bp, Artificial Sequence
  Description of Artificial Sequence: Synthetic oligonucleotide
  Target: SCN10A; (-) strand; PAM type: NNNNGHTT; PAM sequence: CTCTGTTT
gttttattttgatattgctg

SEQ ID NO: 10078 - DNA, 20 bp, Artificial Sequence
  Description of Artificial Sequence: Synthetic oligonucleotide
  Target: SCN10A; (-) strand; PAM type: NNNNGHTT; PAM sequence: TCTTGTTT
ggatttcagtttgtttttgt

SEQ ID NO: 10079 - DNA, 20 bp, Artificial Sequence
  Description of Artificial Sequence: Synthetic oligonucleotide
  Target: SCN10A; (-) strand; PAM type: NNNNGHTT; PAM sequence: GTTTGTTT
gtgtatttccggggatttca

SEQ ID NO: 10080 - DNA, 20 bp, Artificial Sequence
  Description of Artificial Sequence: Synthetic oligonucleotide
  Target: SCN10A; (-) strand; PAM type: NNNNGHTT; PAM sequence: TTCAGTTT
ttgcgtgtatttccggggat

SEQ ID NO: 10081 - DNA, 20 bp, Artificial Sequence
  Description of Artificial Sequence: Synthetic oligonucleotide
  Target: SCN10A; (-) strand; PAM type: NNNNGHTT; PAM sequence: CGGGGATT
ccttgggttgcgtgtatttc

SEQ ID NO: 10082 - DNA, 20 bp, Artificial Sequence
  Description of Artificial Sequence: Synthetic oligonucleotide
  Target: SCN10A; (-) strand; PAM type: NNNNGHTT; PAM sequence: CACTGATT
tagctgtagatttaatttgc

SEQ ID NO: 10083 - DNA, 20 bp, Artificial Sequence
  Description of Artificial Sequence: Synthetic oligonucleotide
  Target: SCN10A; (-) strand; PAM type: NNNNGHTT; PAM sequence: TGTAGATT
ttttcatgtcggggtgtagc

SEQ ID NO: 10084 - DNA, 20 bp, Artificial Sequence
  Description of Artificial Sequence: Synthetic oligonucleotide
  Target: SCN10A; (-) strand; PAM type: NNNNGHTT; PAM sequence: ACCTGCTT
tcttgattggttatatcctg

SEQ ID NO: 10085 - DNA, 20 bp, Artificial Sequence
  Description of Artificial Sequence: Synthetic oligonucleotide
  Target: SCN10A; (-) strand; PAM type: NNNNGHTT; PAM sequence: TCTTGATT
cacctggcattataaatgta

SEQ ID NO: 10086 - DNA, 20 bp, Artificial Sequence
  Description of Artificial Sequence: Synthetic oligonucleotide
  Target: SCN10A; (-) strand; PAM type: NNNNGHTT; PAM sequence: ACCAGCTT
ataaaggccaaatcatgctc

SEQ ID NO: 10087 - DNA, 20 bp, Artificial Sequence
  Description of Artificial Sequence: Synthetic oligonucleotide
  Target: SCN10A; (-) strand; PAM type: NNNNGHTT; PAM sequence: TGAAGTTT
ccctgggcttatgggttagc

SEQ ID NO: 10088 - DNA, 20 bp, Artificial Sequence
  Description of Artificial Sequence: Synthetic oligonucleotide
  Target: SCN10A; (-) strand; PAM type: NNNNGHTT; PAM sequence: CTGGGCTT
caacagccaagagactgtcc

SEQ ID NO: 10089 - DNA, 20 bp, Artificial Sequence
  Description of Artificial Sequence: Synthetic oligonucleotide
  Target: SCN10A; (-) strand; PAM type: NNNNGHTT; PAM sequence: CTGAGTTT
agagtttccaagggttgaag

SEQ ID NO: 10090 - DNA, 20 bp, Artificial Sequence
  Description of Artificial Sequence: Synthetic oligonucleotide
  Target: SCN10A; (-) strand; PAM type: NNNNGHTT; PAM sequence: CAGAGTTT
aagaatattatgcagggtca

SEQ ID NO: 10091 - DNA, 20 bp, Artificial Sequence
  Description of Artificial Sequence: Synthetic oligonucleotide
  Target: SCN10A; (-) strand; PAM type: NNNNGHTT; PAM sequence: AGGAGATT
actgggaggagattgttcaa

SEQ ID NO: 10092 - DNA, 20 bp, Artificial Sequence
  Description of Artificial Sequence: Synthetic oligonucleotide
  Target: SCN10A; (-) strand; PAM type: NNNNGHTT; PAM sequence: AGGAGATT
caaagtgaggaaagactggg

SEQ ID NO: 10093 - DNA, 20 bp, Artificial Sequence
  Description of Artificial Sequence: Synthetic oligonucleotide
  Target: SCN10A; (-) strand; PAM type: NNNNGHTT; PAM sequence: GATGGATT
aaatctgttctggaaaagga

SEQ ID NO: 10094 - DNA, 20 bp, Artificial Sequence
  Description of Artificial Sequence: Synthetic oligonucleotide
  Target: SCN10A; (-) strand; PAM type: NNNNGHTT; PAM sequence: AAGTGTTT
gccttctccatgctcacacg

SEQ ID NO: 10095 - DNA, 20 bp, Artificial Sequence
  Description of Artificial Sequence: Synthetic oligonucleotide
  Target: SCN10A; (-) strand; PAM type: NNNNGHTT; PAM sequence: GCAAGTTT
tttgcagctttccaagagta

SEQ ID NO: 10096 - DNA, 20 bp, Artificial Sequence
  Description of Artificial Sequence: Synthetic oligonucleotide
  Target: SCN10A; (-) strand; PAM type: NNNNGHTT; PAM sequence: TGCAGCTT
tgttagaagaaccctgtatt

SEQ ID NO: 10097 - DNA, 20 bp, Artificial Sequence
  Description of Artificial Sequence: Synthetic oligonucleotide
  Target: SCN10A; (-) strand; PAM type: NNNNGHTT; PAM sequence: ACGTGTTT
accaaccaactttttgaaat

SEQ ID NO: 10098 - DNA, 20 bp, Artificial Sequence
  Description of Artificial Sequence: Synthetic oligonucleotide
  Target: SCN10A; (-) strand; PAM type: NNNNGHTT; PAM sequence: CTCTGTTT
acgtggtggggaagccccac

SEQ ID NO: 10099 - DNA, 20 bp, Artificial Sequence
  Description of Artificial Sequence: Synthetic oligonucleotide
  Target: SCN10A; (-) strand; PAM type: NNNNGHTT; PAM sequence: ATGTGTTT
ctacttcacaaatggctgga

SEQ ID NO: 10100 - DNA, 20 bp, Artificial Sequence
  Description of Artificial Sequence: Synthetic oligonucleotide
  Target: SCN10A; (-) strand; PAM type: NNNNGHTT; PAM sequence: GTTCGCTT
ggcgaatgtgtcatgaagat

SEQ ID NO: 10101 - DNA, 20 bp, Artificial Sequence
  Description of Artificial Sequence: Synthetic oligonucleotide
  Target: SCN10A; (-) strand; PAM type: NNNNGHTT; PAM sequence: ACAAGCTT
gtctttgacatcgtgaccag

SEQ ID NO: 10102 - DNA, 20 bp, Artificial Sequence
  Description of Artificial Sequence: Synthetic oligonucleotide
  Target: SCN10A; (-) strand; PAM type: NNNNGHTT; PAM sequence: CAGGGTTT
tgttttctcagaacaagttc

SEQ ID NO: 10103 - DNA, 20 bp, Artificial Sequence
  Description of Artificial Sequence: Synthetic oligonucleotide
  Target: SCN10A; (-) strand; PAM type: NNNNGHTT; PAM sequence: TCTTGTTT
aaggccctgatgccactatc

SEQ ID NO: 10104 - DNA, 20 bp, Artificial Sequence
  Description of Artificial Sequence: Synthetic oligonucleotide
  Target: SCN10A; (-) strand; PAM type: NNNNGHTT; PAM sequence: CCTGGTTT
atctacagataacacagatg

SEQ ID NO: 10105 - DNA, 20 bp, Artificial Sequence
  Description of Artificial Sequence: Synthetic oligonucleotide
  Target: SCN10A; (-) strand; PAM type: NNNNGHTT; PAM sequence: TTTCGCTT
tggaagaggtaaggatagta

SEQ ID NO: 10106 - DNA, 20 bp, Artificial Sequence
  Description of Artificial Sequence: Synthetic oligonucleotide
  Target: SCN10A; (-) strand; PAM type: NNNNGHTT; PAM sequence: GATGGATT
agtaagtggagcttaaaaga

SEQ ID NO: 10107 - DNA, 20 bp, Artificial Sequence
  Description of Artificial Sequence: Synthetic oligonucleotide
  Target: SCN10A; (-) strand; PAM type: NNNNGHTT; PAM sequence: TGGAGCTT
gggacactccatgcagtaag

SEQ ID NO: 10108 - DNA, 20 bp, Artificial Sequence
  Description of Artificial Sequence: Synthetic oligonucleotide
  Target: SCN10A; (-) strand; PAM type: NNNNGHTT; PAM sequence: ATAAGTTT
cagagggaacatttccaaga

SEQ ID NO: 10109 - DNA, 20 bp, Artificial Sequence
  Description of Artificial Sequence: Synthetic oligonucleotide
  Target: SCN10A; (-) strand; PAM type: NNNNGHTT; PAM sequence: ATTTGCTT
accctacgccctatacctgc

SEQ ID NO: 10110 - DNA, 20 bp, Artificial Sequence
  Description of Artificial Sequence: Synthetic oligonucleotide
  Target: SCN10A; (-) strand; PAM type: NNNNGHTT; PAM sequence: AGGAGCTT
aaagaagagaagatcacagt

SEQ ID NO: 10111 - DNA, 20 bp, Artificial Sequence
  Description of Artificial Sequence: Synthetic oligonucleotide
  Target: SCN10A; (-) strand; PAM type: NNNNGHTT; PAM sequence: AGAAGTTT
tgagctccatagaggtcagg

SEQ ID NO: 10112 - DNA, 20 bp, Artificial Sequence
  Description of Artificial Sequence: Synthetic oligonucleotide
  Target: SCN10A; (-) strand; PAM type: NNNNGHTT; PAM sequence: AGGGGTTT
ggcaaagcttcaaagcaaga

SEQ ID NO: 10113 - DNA, 20 bp, Artificial Sequence
  Description of Artificial Sequence: Synthetic oligonucleotide
  Target: SCN10A; (-) strand; PAM type: NNNNGHTT; PAM sequence: CAAAGCTT
gaagtgacaaaactaggtgg

SEQ ID NO: 10114 - DNA, 20 bp, Artificial Sequence
  Description of Artificial Sequence: Synthetic oligonucleotide
  Target: SCN10A; (-) strand; PAM type: NNNNGHTT; PAM sequence: AAGAGTTT
attactgaggcagagggacc

SEQ ID NO: 10115 - DNA, 20 bp, Artificial Sequence
  Description of Artificial Sequence: Synthetic oligonucleotide
  Target: SCN10A; (-) strand; PAM type: NNNNGHTT; PAM sequence: TAGAGATT
gttaggagaaactaggtcat

SEQ ID NO: 10116 - DNA, 20 bp, Artificial Sequence
  Description of Artificial Sequence: Synthetic oligonucleotide
  Target: SCN10A; (-) strand; PAM type: NNNNGHTT; PAM sequence: TTCTGCTT
agatgtaagtttctgaaata

SEQ ID NO: 10117 - DNA, 20 bp, Artificial Sequence
  Description of Artificial Sequence: Synthetic oligonucleotide
  Target: SCN10A; (-) strand; PAM type: NNNNGHTT; PAM sequence: GTAAGTTT
gatggtagctggagggagat

SEQ ID NO: 10118 - DNA, 20 bp, Artificial Sequence
  Description of Artificial Sequence: Synthetic oligonucleotide
  Target: SCN10A; (-) strand; PAM type: NNNNGHTT; PAM sequence: TTTTGCTT
tacacaactctttcaagaaa

SEQ ID NO: 10119 - DNA, 20 bp, Artificial Sequence
  Description of Artificial Sequence: Synthetic oligonucleotide
  Target: SCN10A; (-) strand; PAM type: NNNNGHTT; PAM sequence: CACTGATT
gctgaggagtgaatgaggga

SEQ ID NO: 10120 - DNA, 20 bp, Artificial Sequence
  Description of Artificial Sequence: Synthetic oligonucleotide
  Target: SCN10A; (-) strand; PAM type: NNNNGHTT; PAM sequence: TACAGTTT
acagacaaagttcctactct

SEQ ID NO: 10121 - DNA, 20 bp, Artificial Sequence
  Description of Artificial Sequence: Synthetic oligonucleotide
  Target: SCN10A; (-) strand; PAM type: NNNNGHTT; PAM sequence: AGAGGCTT
tccctcatagccactcatgc

SEQ ID NO: 10122 - DNA, 20 bp, Artificial Sequence
  Description of Artificial Sequence: Synthetic oligonucleotide
  Target: SCN10A; (-) strand; PAM type: NNNNGHTT; PAM sequence: CTCTGCTT
cctcatcacagcacttcccc

SEQ ID NO: 10123 - DNA, 20 bp, Artificial Sequence
  Description of Artificial Sequence: Synthetic oligonucleotide
  Target: SCN10A; (-) strand; PAM type: NNNNGHTT; PAM sequence: GTCTGATT
catgagcaaaggccactttg

SEQ ID NO: 10124 - DNA, 20 bp, Artificial Sequence
  Description of Artificial Sequence: Synthetic oligonucleotide
  Target: SCN10A; (-) strand; PAM type: NNNNGHTT; PAM sequence: AAGGGATT
cattttcagtgatgaaatgg

SEQ ID NO: 10125 - DNA, 20 bp, Artificial Sequence
  Description of Artificial Sequence: Synthetic oligonucleotide
  Target: SCN10A; (-) strand; PAM type: NNNNGHTT; PAM sequence: CTCTGTTT
cttaacgatgccgttgcctg

SEQ ID NO: 10126 - DNA, 20 bp, Artificial Sequence
  Description of Artificial Sequence: Synthetic oligonucleotide
  Target: SCN10A; (-) strand; PAM type: NNNNGHTT; PAM sequence: TAAGGATT
gtttcttccataggaaaagt

SEQ ID NO: 10127 - DNA, 20 bp, Artificial Sequence
  Description of Artificial Sequence: Synthetic oligonucleotide
  Target: SCN10A; (-) strand; PAM type: NNNNGHTT; PAM sequence: TCTTGTTT
gatgatgctcaggctctaaa

SEQ ID NO: 10128 - DNA, 20 bp, Artificial Sequence
  Description of Artificial Sequence: Synthetic oligonucleotide
  Target: SCN10A; (-) strand; PAM type: NNNNGHTT; PAM sequence: CAGAGCTT
gcatgggtgccatttcatga

SEQ ID NO: 10129 - DNA, 20 bp, Artificial Sequence
  Description of Artificial Sequence: Synthetic oligonucleotide
  Target: SCN10A; (-) strand; PAM type: NNNNGHTT; PAM sequence: ACAGGATT
cataccagcaaagcactgac

SEQ ID NO: 10130 - DNA, 20 bp, Artificial Sequence
  Description of Artificial Sequence: Synthetic oligonucleotide
  Target: SCN10A; (-) strand; PAM type: NNNNGHTT; PAM sequence: GCCAGATT
ccaggcccagcttgcttttg

SEQ ID NO: 10131 - DNA, 20 bp, Artificial Sequence
  Description of Artificial Sequence: Synthetic oligonucleotide
  Target: SCN10A; (-) strand; PAM type: NNNNGHTT; PAM sequence: GCTTGCTT
gacccttcttcccaggccca

SEQ ID NO: 10132 - DNA, 20 bp, Artificial Sequence
  Description of Artificial Sequence: Synthetic oligonucleotide
  Target: SCN10A; (-) strand; PAM type: NNNNGHTT; PAM sequence: CCCAGCTT
ctaagacccttcttcccagg

SEQ ID NO: 10133 - DNA, 20 bp, Artificial Sequence
  Description of Artificial Sequence: Synthetic oligonucleotide
  Target: SCN10A; (-) strand; PAM type: NNNNGHTT; PAM sequence: AGTGGATT
catcctttgaatggaagaag

SEQ ID NO: 10134 - DNA, 20 bp, Artificial Sequence
  Description of Artificial Sequence: Synthetic oligonucleotide
  Target: SCN10A; (-) strand; PAM type: NNNNGHTT; PAM sequence: CTGAGATT
cctcataaccaattctgttc

SEQ ID NO: 10135 - DNA, 20 bp, Artificial Sequence
  Description of Artificial Sequence: Synthetic oligonucleotide
  Target: SCN10A; (-) strand; PAM type: NNNNGHTT; PAM sequence: GAAAGCTT
caaccccataggctgccaaa

SEQ ID NO: 10136 - DNA, 20 bp, Artificial Sequence
  Description of Artificial Sequence: Synthetic oligonucleotide
  Target: SCN10A; (-) strand; PAM type: NNNNGHTT; PAM sequence: CCCAGCTT
actcaatctctctttgacat

SEQ ID NO: 10137 - DNA, 20 bp, Artificial Sequence
  Description of Artificial Sequence: Synthetic oligonucleotide
  Target: SCN10A; (-) strand; PAM type: NNNNGHTT; PAM sequence: GAAAGTTT
acaacccttggcaaaaacat

SEQ ID NO: 10138 - DNA, 20 bp, Artificial Sequence
  Description of Artificial Sequence: Synthetic oligonucleotide
  Target: SCN10A; (-) strand; PAM type: NNNNGHTT; PAM sequence: GTAAGATT
ggcctttacttgtggctgga

SEQ ID NO: 10139 - DNA, 20 bp, Artificial Sequence
  Description of Artificial Sequence: Synthetic oligonucleotide
  Target: SCN10A; (-) strand; PAM type: NNNNGHTT; PAM sequence: ACTGGATT
tcacccatacaatcaagata

SEQ ID NO: 10140 - DNA, 20 bp, Artificial Sequence
  Description of Artificial Sequence: Synthetic oligonucleotide
  Target: SCN10A; (-) strand; PAM type: NNNNGHTT; PAM sequence: CACAGCTT
ggttcagacctctgtagggg

SEQ ID NO: 10141 - DNA, 20 bp, Artificial Sequence
  Description of Artificial Sequence: Synthetic oligonucleotide
  Target: SCN10A; (-) strand; PAM type: NNNNGHTT; PAM sequence: TCTAGATT
ggtcatgaatttattactag

SEQ ID NO: 10142 - DNA, 20 bp, Artificial Sequence
  Description of Artificial Sequence: Synthetic oligonucleotide
  Target: SCN10A; (-) strand; PAM type: NNNNGHTT; PAM sequence: ATAGGATT
agatttttttaaatcaaggt

SEQ ID NO: 10143 - DNA, 20 bp, Artificial Sequence
  Description of Artificial Sequence: Synthetic oligonucleotide
  Target: SCN10A; (-) strand; PAM type: NNNNGHTT; PAM sequence: ATTAGATT
tgcattctgttagccaagct

SEQ ID NO: 10144 - DNA, 20 bp, Artificial Sequence
  Description of Artificial Sequence: Synthetic oligonucleotide
  Target: SCN10A; (-) strand; PAM type: NNNNGHTT; PAM sequence: ACAGGTTT
acttttttgggaatggatga

SEQ ID NO: 10145 - DNA, 20 bp, Artificial Sequence
  Description of Artificial Sequence: Synthetic oligonucleotide
  Target: SCN10A; (-) strand; PAM type: NNNNGHTT; PAM sequence: CATGGCTT
ttcataaagatctcaagaga

SEQ ID NO: 10146 - DNA, 20 bp, Artificial Sequence
  Description of Artificial Sequence: Synthetic oligonucleotide
  Target: SCN10A; (-) strand; PAM type: NNNNGHTT; PAM sequence: TCTAGTTT
ggcaaaaattagggccagac

SEQ ID NO: 10147 - DNA, 20 bp, Artificial Sequence
  Description of Artificial Sequence: Synthetic oligonucleotide
  Target: SCN10A; (-) strand; PAM type: NNNNGHTT; PAM sequence: TAAAGATT
aaagttatcccactcgagtt

SEQ ID NO: 10148 - DNA, 20 bp, Artificial Sequence
  Description of Artificial Sequence: Synthetic oligonucleotide
  Target: SCN10A; (-) strand; PAM type: NNNNGHTT; PAM sequence: TCGAGTTT
ggaaccaaaagttatcccac

SEQ ID NO: 10149 - DNA, 20 bp, Artificial Sequence
  Description of Artificial Sequence: Synthetic oligonucleotide
  Target: SCN10A; (-) strand; PAM type: NNNNGHTT; PAM sequence: CAGGGATT
cagtaagggtagttagaacc

SEQ ID NO: 10150 - DNA, 20 bp, Artificial Sequence
  Description of Artificial Sequence: Synthetic oligonucleotide
  Target: SCN10A; (-) strand; PAM type: NNNNGHTT; PAM sequence: ACAGGATT
aacagttttagagttcaagt

SEQ ID NO: 10151 - DNA, 20 bp, Artificial Sequence
  Description of Artificial Sequence: Synthetic oligonucleotide
  Target: SCN10A; (-) strand; PAM type: NNNNGHTT; PAM sequence: AACAGTTT
gggaagcactgagtttctcc

SEQ ID NO: 10152 - DNA, 20 bp, Artificial Sequence
  Description of Artificial Sequence: Synthetic oligonucleotide
  Target: SCN10A; (-) strand; PAM type: NNNNGHTT; PAM sequence: CTGAGTTT
tgaatctgttgggggaagca

SEQ ID NO: 10153 - DNA, 20 bp, Artificial Sequence
  Description of Artificial Sequence: Synthetic oligonucleotide
  Target: SCN10A; (-) strand; PAM type: NNNNGHTT; PAM sequence: TGCTGTTT
caggcaggggcctgagggag

SEQ ID NO: 10154 - DNA, 20 bp, Artificial Sequence
  Description of Artificial Sequence: Synthetic oligonucleotide
  Target: SCN10A; (-) strand; PAM type: NNNNGHTT; PAM sequence: AGAGGTTT
cacggcccctggtgagcccc

SEQ ID NO: 10155 - DNA, 20 bp, Artificial Sequence
  Description of Artificial Sequence: Synthetic oligonucleotide
  Target: SCN10A; (-) strand; PAM type: NNNNGHTT; PAM sequence: TCTTGCTT
tggtatccgtagggggttcc

SEQ ID NO: 10156 - DNA, 20 bp, Artificial Sequence
  Description of Artificial Sequence: Synthetic oligonucleotide
  Target: SCN10A; (-) strand; PAM type: NNNNGHTT; PAM sequence: TTCTGATT
gatcctttctctcctgcctg

SEQ ID NO: 10157 - DNA, 20 bp, Artificial Sequence
  Description of Artificial Sequence: Synthetic oligonucleotide
  Target: SCN10A; (-) strand; PAM type: NNNNGHTT; PAM sequence: CTTGGTTT
agacactccttgatgctggg

SEQ ID NO: 10158 - DNA, 20 bp, Artificial Sequence
  Description of Artificial Sequence: Synthetic oligonucleotide
  Target: SCN10A; (-) strand; PAM type: NNNNGHTT; PAM sequence: CTGGGCTT
tggcaagacactccttgatg

SEQ ID NO: 10159 - DNA, 20 bp, Artificial Sequence
  Description of Artificial Sequence: Synthetic oligonucleotide
  Target: SCN10A; (-) strand; PAM type: NNNNGHTT; PAM sequence: CTTTGCTT
ccctggagaacagaaactgg

SEQ ID NO: 10160 - DNA, 20 bp, Artificial Sequence
  Description of Artificial Sequence: Synthetic oligonucleotide
  Target: SCN10A; (-) strand; PAM type: NNNNGHTT; PAM sequence: ACTGGCTT
tggatccctggagaacagaa

SEQ ID NO: 10161 - DNA, 20 bp, Artificial Sequence
  Description of Artificial Sequence: Synthetic oligonucleotide
  Target: SCN10A; (-) strand; PAM type: NNNNGHTT; PAM sequence: TCCTGTTT
acatgtaccttctccttgag

SEQ ID NO: 10162 - DNA, 20 bp, Artificial Sequence
  Description of Artificial Sequence: Synthetic oligonucleotide
  Target: SCN10A; (-) strand; PAM type: NNNNGHTT; PAM sequence: CTCAGATT
tgaacaggctagatccaagg

SEQ ID NO: 10163 - DNA, 20 bp, Artificial Sequence
  Description of Artificial Sequence: Synthetic oligonucleotide
  Target: SCN10A; (-) strand; PAM type: NNNNGHTT; PAM sequence: CTTTGCTT
gcttctgtccctcccagagt

SEQ ID NO: 10164 - DNA, 20 bp, Artificial Sequence
  Description of Artificial Sequence: Synthetic oligonucleotide
  Target: SCN10A; (-) strand; PAM type: NNNNGHTT; PAM sequence: GAGGGCTT
ctcctctccagaaaagattt

SEQ ID NO: 10165 - DNA, 20 bp, Artificial Sequence
  Description of Artificial Sequence: Synthetic oligonucleotide
  Target: SCN10A; (-) strand; PAM type: NNNNGHTT; PAM sequence: AAAAGATT
cctcatctcctcctctccag

SEQ ID NO: 10166 - DNA, 20 bp, Artificial Sequence
  Description of Artificial Sequence: Synthetic oligonucleotide
  Target: SCN10A; (-) strand; PAM type: NNNNGHTT; PAM sequence: TGCAGTTT
gaggaaaacatcttcgttgg

SEQ ID NO: 10167 - DNA, 20 bp, Artificial Sequence
  Description of Artificial Sequence: Synthetic oligonucleotide
  Target: SCN10A; (-) strand; PAM type: NNNNGHTT; PAM sequence: GAGAGTTT
tatgtcaggaagctaaaggt

SEQ ID NO: 10168 - DNA, 20 bp, Artificial Sequence
  Description of Artificial Sequence: Synthetic oligonucleotide
  Target: SCN10A; (-) strand; PAM type: NNNNGHTT; PAM sequence: GGTGGCTT
ataaacatgttattaaaata

SEQ ID NO: 10169 - DNA, 20 bp, Artificial Sequence
  Description of Artificial Sequence: Synthetic oligonucleotide
  Target: SCN10A; (-) strand; PAM type: NNNNGHTT; PAM sequence: CCCAGTTT
tcaaattccacagatctcag

SEQ ID NO: 10170 - DNA, 20 bp, Artificial Sequence
  Description of Artificial Sequence: Synthetic oligonucleotide
  Target: SCN10A; (-) strand; PAM type: NNNNGHTT; PAM sequence: AACAGATT
tgagaaaactgaggtcaaga

SEQ ID NO: 10171 - DNA, 20 bp, Artificial Sequence
  Description of Artificial Sequence: Synthetic oligonucleotide
  Target: SCN10A; (-) strand; PAM type: NNNNGHTT; PAM sequence: TTGAGATT
atttagtaccctggggaggt

SEQ ID NO: 10172 - DNA, 20 bp, Artificial Sequence
  Description of Artificial Sequence: Synthetic oligonucleotide
  Target: SCN10A; (-) strand; PAM type: NNNNGHTT; PAM sequence: GGAGGTTT
agtgctatttagtaccctgg

SEQ ID NO: 10173 - DNA, 20 bp, Artificial Sequence
  Description of Artificial Sequence: Synthetic oligonucleotide
  Target: SCN10A; (-) strand; PAM type: NNNNGHTT; PAM sequence: TGCAGTTT
gcataagacaactttggtgg

SEQ ID NO: 10174 - DNA, 20 bp, Artificial Sequence
  Description of Artificial Sequence: Synthetic oligonucleotide
  Target: SCN10A; (-) strand; PAM type: NNNNGHTT; PAM sequence: TCTGGATT
ggggctaataatacctactc

SEQ ID NO: 10175 - DNA, 20 bp, Artificial Sequence
  Description of Artificial Sequence: Synthetic oligonucleotide
  Target: SCN10A; (-) strand; PAM type: NNNNGHTT; PAM sequence: CTCAGTTT
tattttaaacccctctgagt

SEQ ID NO: 10176 - DNA, 20 bp, Artificial Sequence
  Description of Artificial Sequence: Synthetic oligonucleotide
  Target: SCN10A; (-) strand; PAM type: NNNNGHTT; PAM sequence: CTGGGTTT
gtcacagagtacatgcaaac

SEQ ID NO: 10177 - DNA, 20 bp, Artificial Sequence
  Description of Artificial Sequence: Synthetic oligonucleotide
  Target: SCN10A; (-) strand; PAM type: NNNNGHTT; PAM sequence: TCTAGATT
ctgaggtagataggcgctgt

SEQ ID NO: 10178 - DNA, 20 bp, Artificial Sequence
  Description of Artificial Sequence: Synthetic oligonucleotide
  Target: SCN10A; (-) strand; PAM type: NNNNGHTT; PAM sequence: TCATGTTT
atcgaatcccagataacctc

SEQ ID NO: 10179 - DNA, 20 bp, Artificial Sequence
  Description of Artificial Sequence: Synthetic oligonucleotide
  Target: SCN10A; (-) strand; PAM type: NNNNGHTT; PAM sequence: CTCTGATT
tgtgcctccaagggtgccga

SEQ ID NO: 10180 - DNA, 20 bp, Artificial Sequence
  Description of Artificial Sequence: Synthetic oligonucleotide
  Target: SCN10A; (-) strand; PAM type: NNNNGHTT; PAM sequence: GAAGGCTT
accctccttgggatggggag

SEQ ID NO: 10181 - DNA, 20 bp, Artificial Sequence
  Description of Artificial Sequence: Synthetic oligonucleotide
  Target: SCN10A; (-) strand; PAM type: NNNNGHTT; PAM sequence: TCAGGATT
tgccccactaacatcctcac

SEQ ID NO: 10182 - DNA, 20 bp, Artificial Sequence
  Description of Artificial Sequence: Synthetic oligonucleotide
  Target: SCN10A; (-) strand; PAM type: NNNNGHTT; PAM sequence: CTGTGATT
tatcagtgctaacccttgcc

SEQ ID NO: 10183 - DNA, 20 bp, Artificial Sequence
  Description of Artificial Sequence: Synthetic oligonucleotide
  Target: SCN10A; (-) strand; PAM type: NNNNGHTT; PAM sequence: TCTGGTTT
ataagtggtgctcaggagtt

SEQ ID NO: 10184 - DNA, 20 bp, Artificial Sequence
  Description of Artificial Sequence: Synthetic oligonucleotide
  Target: SCN10A; (-) strand; PAM type: NNNNGHTT; PAM sequence: AGGAGTTT
aaaaaagataagtggtgctc

SEQ ID NO: 10185 - DNA, 20 bp, Artificial Sequence
  Description of Artificial Sequence: Synthetic oligonucleotide
  Target: SCN10A; (-) strand; PAM type: NNNNGHTT; PAM sequence: GGAGGCTT
ttgtcatcttcatcattttt

SEQ ID NO: 10186 - DNA, 20 bp, Artificial Sequence
  Description of Artificial Sequence: Synthetic oligonucleotide
  Target: SCN10A; (-) strand; PAM type: NNNNGHTT; PAM sequence: CTTGGCTT
acccaggtccatgtcttagg

SEQ ID NO: 10187 - DNA, 20 bp, Artificial Sequence
  Description of Artificial Sequence: Synthetic oligonucleotide
  Target: SCN10A; (-) strand; PAM type: NNNNGHTT; PAM sequence: TTAGGCTT
cctgcacccaggtccatgtc

SEQ ID NO: 10188 - DNA, 20 bp, Artificial Sequence
  Description of Artificial Sequence: Synthetic oligonucleotide
  Target: SCN10A; (-) strand; PAM type: NNNNGHTT; PAM sequence: TCCTGCTT
attcttccccactccctcat

SEQ ID NO: 10189 - DNA, 20 bp, Artificial Sequence
  Description of Artificial Sequence: Synthetic oligonucleotide
  Target: SCN10A; (-) strand; PAM type: NNNNGHTT; PAM sequence: TCCCGCTT
ttcacaggctcttctcccat

SEQ ID NO: 10190 - DNA, 20 bp, Artificial Sequence
  Description of Artificial Sequence: Synthetic oligonucleotide
  Target: SCN10A; (-) strand; PAM type: NNNNGHTT; PAM sequence: CCCTGCTT
ttcagttgcccacaatgatg

SEQ ID NO: 10191 - DNA, 20 bp, Artificial Sequence
  Description of Artificial Sequence: Synthetic oligonucleotide
  Target: SCN10A; (-) strand; PAM type: NNNNGHTT; PAM sequence: TTGCGCTT
ctcagaggaccccagtagga

SEQ ID NO: 10192 - DNA, 20 bp, Artificial Sequence
  Description of Artificial Sequence: Synthetic oligonucleotide
  Target: SCN10A; (-) strand; PAM type: NNNNGHTT; PAM sequence: GTAGGATT
cagttactcagaggacccca

SEQ ID NO: 10193 - DNA, 20 bp, Artificial Sequence
  Description of Artificial Sequence: Synthetic oligonucleotide
  Target: SCN10A; (-) strand; PAM type: NNNNGHTT; PAM sequence: TCCAGTTT
gggagtctgaggataaatac

SEQ ID NO: 10194 - DNA, 20 bp, Artificial Sequence
  Description of Artificial Sequence: Synthetic oligonucleotide
  Target: SCN10A; (-) strand; PAM type: NNNNGHTT; PAM sequence: ATAAGTTT
cctaggggcaacccttacca

SEQ ID NO: 10195 - DNA, 20 bp, Artificial Sequence
  Description of Artificial Sequence: Synthetic oligonucleotide
  Target: SCN10A; (-) strand; PAM type: NNNNGHTT; PAM sequence: CAGGGATT
gcaacttctcccccaagtac

SEQ ID NO: 10196 - DNA, 20 bp, Artificial Sequence
  Description of Artificial Sequence: Synthetic oligonucleotide
  Target: SCN10A; (-) strand; PAM type: NNNNGHTT; PAM sequence: AGGAGCTT
gtataaagactccagggctt

SEQ ID NO: 10197 - DNA, 20 bp, Artificial Sequence
  Description of Artificial Sequence: Synthetic oligonucleotide
  Target: SCN10A; (-) strand; PAM type: NNNNGHTT; PAM sequence: CAGGGCTT
gattctctgtataaagactc

SEQ ID NO: 10198 - DNA, 20 bp, Artificial Sequence
  Description of Artificial Sequence: Synthetic oligonucleotide
  Target: SCN10A; (-) strand; PAM type: NNNNGHTT; PAM sequence: TTCTGATT
atttcacctgcaggctgcac

SEQ ID NO: 10199 - DNA, 20 bp, Artificial Sequence
  Description of Artificial Sequence: Synthetic oligonucleotide
  Target: SCN10A; (-) strand; PAM type: NNNNGHTT; PAM sequence: TTCTGATT
cacctcttcccttagcccac

SEQ ID NO: 10200 - DNA, 20 bp, Artificial Sequence
  Description of Artificial Sequence: Synthetic oligonucleotide
  Target: SCN10A; (-) strand; PAM type: NNNNGHTT; PAM sequence: TCCAGCTT
ctgagattgcgtcactgcac

SEQ ID NO: 10201 - DNA, 20 bp, Artificial Sequence
  Description of Artificial Sequence: Synthetic oligonucleotide
  Target: SCN10A; (-) strand; PAM type: NNNNGHTT; PAM sequence: CTGAGATT
gaggcagaagttgcagtgag

SEQ ID NO: 10202 - DNA, 20 bp, Artificial Sequence
  Description of Artificial Sequence: Synthetic oligonucleotide
  Target: SCN10A; (-) strand; PAM type: NNNNGHTT; PAM sequence: GGCGGCTT
gaaagaaattagcagggcat

SEQ ID NO: 10203 - DNA, 20 bp, Artificial Sequence
  Description of Artificial Sequence: Synthetic oligonucleotide
  Target: SCN10A; (-) strand; PAM type: NNNNGHTT; PAM sequence: GGCAGATT
cactttgggaggccgaggtg

SEQ ID NO: 10204 - DNA, 20 bp, Artificial Sequence
  Description of Artificial Sequence: Synthetic oligonucleotide
  Target: SCN10A; (-) strand; PAM type: NNNNGHTT; PAM sequence: CGAGGTTT
tctacactccccaggcttct

SEQ ID NO: 10205 - DNA, 20 bp, Artificial Sequence
  Description of Artificial Sequence: Synthetic oligonucleotide
  Target: SCN10A; (-) strand; PAM type: NNNNGHTT; PAM sequence: CCAGGCTT
ccccctttcatctacactcc

SEQ ID NO: 10206 - DNA, 20 bp, Artificial Sequence
  Description of Artificial Sequence: Synthetic oligonucleotide
  Target: SCN10A; (-) strand; PAM type: NNNNGHTT; PAM sequence: CGAGGCTT
ctgttgagtgtttcagccac

SEQ ID NO: 10207 - DNA, 20 bp, Artificial Sequence
  Description of Artificial Sequence: Synthetic oligonucleotide
  Target: SCN10A; (-) strand; PAM type: NNNNGHTT; PAM sequence: GAGTGTTT
tgtccagctggctctctgtt

SEQ ID NO: 10208 - DNA, 20 bp, Artificial Sequence
  Description of Artificial Sequence: Synthetic oligonucleotide
  Target: SCN10A; (-) strand; PAM type: NNNNGHTT; PAM sequence: TGTTGATT
atggacattatgtatgcagc

SEQ ID NO: 10209 - DNA, 20 bp, Artificial Sequence
  Description of Artificial Sequence: Synthetic oligonucleotide
  Target: SCN10A; (-) strand; PAM type: NNNNGHTT; PAM sequence: CATGGCTT
ctcctctctcactgggccac

SEQ ID NO: 10210 - DNA, 20 bp, Artificial Sequence
  Description of Artificial Sequence: Synthetic oligonucleotide
  Target: SCN10A; (-) strand; PAM type: NNNNGHTT; PAM sequence: ATGAGATT
ggattactttaaatcatcat

SEQ ID NO: 10211 - DNA, 20 bp, Artificial Sequence
  Description of Artificial Sequence: Synthetic oligonucleotide
  Target: SCN10A; (-) strand; PAM type: NNNNGHTT; PAM sequence: GTGGGATT
ctattcttaaacagccacat

SEQ ID NO: 10212 - DNA, 20 bp, Artificial Sequence
  Description of Artificial Sequence: Synthetic oligonucleotide
  Target: SCN10A; (-) strand; PAM type: NNNNGHTT; PAM sequence: CCCAGTTT
tgaacatgctggaaggcaca

SEQ ID NO: 10213 - DNA, 20 bp, Artificial Sequence
  Description of Artificial Sequence: Synthetic oligonucleotide
  Target: SCN10A; (-) strand; PAM type: NNNNGHTT; PAM sequence: CTGGGCTT
cctgggagatacagtcagaa

SEQ ID NO: 10214 - DNA, 20 bp, Artificial Sequence
  Description of Artificial Sequence: Synthetic oligonucleotide
  Target: SCN10A; (-) strand; PAM type: NNNNGHTT; PAM sequence: ATGGGATT
cataaagggatgggcctgcc

SEQ ID NO: 10215 - DNA, 20 bp, Artificial Sequence
  Description of Artificial Sequence: Synthetic oligonucleotide
  Target: SCN10A; (-) strand; PAM type: NNNNGHTT; PAM sequence: TCTTGCTT
accatgagatcaaccatatc

SEQ ID NO: 10216 - DNA, 20 bp, Artificial Sequence
  Description of Artificial Sequence: Synthetic oligonucleotide
  Target: SCN10A; (-) strand; PAM type: NNNNGHTT; PAM sequence: GGCAGCTT
gcaagattcaaaactccact

SEQ ID NO: 10217 - DNA, 20 bp, Artificial Sequence
  Description of Artificial Sequence: Synthetic oligonucleotide
  Target: SCN10A; (-) strand; PAM type: NNNNGHTT; PAM sequence: GCAAGATT
tgtgaataacaagtctgact

SEQ ID NO: 10218 - DNA, 20 bp, Artificial Sequence
  Description of Artificial Sequence: Synthetic oligonucleotide
  Target: SCN10A; (-) strand; PAM type: NNNNGHTT; PAM sequence: TGTCGATT
agagttttcccttgtacctt

SEQ ID NO: 10219 - DNA, 20 bp, Artificial Sequence
  Description of Artificial Sequence: Synthetic oligonucleotide
  Target: SCN10A; (-) strand; PAM type: NNNNGHTT; PAM sequence: GAGAGTTT
gtgcatcaactataccgatg

SEQ ID NO: 10220 - DNA, 20 bp, Artificial Sequence
  Description of Artificial Sequence: Synthetic oligonucleotide
  Target: SCN10A; (-) strand; PAM type: NNNNGHTT; PAM sequence: GGAAGTTT
gggtgtgaacctcttcgcag

SEQ ID NO: 10221 - DNA, 20 bp, Artificial Sequence
  Description of Artificial Sequence: Synthetic oligonucleotide
  Target: SCN10A; (-) strand; PAM type: NNNNGHTT; PAM sequence: TCTTGCTT
tgcactaattaacccacttc

SEQ ID NO: 10222 - DNA, 20 bp, Artificial Sequence
  Description of Artificial Sequence: Synthetic oligonucleotide
  Target: SCN10A; (-) strand; PAM type: NNNNGHTT; PAM sequence: GTATGCTT
cacacttctaaatgagtgca

SEQ ID NO: 10223 - DNA, 20 bp, Artificial Sequence
  Description of Artificial Sequence: Synthetic oligonucleotide
  Target: SCN10A; (-) strand; PAM type: NNNNGHTT; PAM sequence: TTGTGTTT
aaattgtatttaaattgtgt

SEQ ID NO: 10224 - DNA, 20 bp, Artificial Sequence
  Description of Artificial Sequence: Synthetic oligonucleotide
  Target: SCN10A; (-) strand; PAM type: NNNNGHTT; PAM sequence: TTGTGTTT
tactttaaattgtatttaaa

SEQ ID NO: 10225 - DNA, 20 bp, Artificial Sequence
  Description of Artificial Sequence: Synthetic oligonucleotide
  Target: SCN10A; (-) strand; PAM type: NNNNGHTT; PAM sequence: TTAGGTTT
gctattttgtgaatatggat

SEQ ID NO: 10226 - DNA, 20 bp, Artificial Sequence
  Description of Artificial Sequence: Synthetic oligonucleotide
  Target: SCN10A; (-) strand; PAM type: NNNNGHTT; PAM sequence: TATGGATT
caaataagctattttgtgaa

SEQ ID NO: 10227 - DNA, 20 bp, Artificial Sequence
  Description of Artificial Sequence: Synthetic oligonucleotide
  Target: SCN10A; (-) strand; PAM type: NNNNGHTT; PAM sequence: ATTTGCTT
tttgtatctaatagattctc

SEQ ID NO: 10228 - DNA, 20 bp, Artificial Sequence
  Description of Artificial Sequence: Synthetic oligonucleotide
  Target: SCN10A; (-) strand; PAM type: NNNNGHTT; PAM sequence: AATAGATT
atttattctattttgtatct

SEQ ID NO: 10229 - DNA, 20 bp, Artificial Sequence
  Description of Artificial Sequence: Synthetic oligonucleotide
  Target: SCN10A; (-) strand; PAM type: NNNNGHTT; PAM sequence: AATAGTTT
cactaggacccgaagattga

SEQ ID NO: 10230 - DNA, 20 bp, Artificial Sequence
  Description of Artificial Sequence: Synthetic oligonucleotide
  Target: SCN10A; (-) strand; PAM type: NNNNGHTT; PAM sequence: CGAAGATT
cctttacaaacactaggacc

SEQ ID NO: 10231 - DNA, 20 bp, Artificial Sequence
  Description of Artificial Sequence: Synthetic oligonucleotide
  Target: SCN10A; (-) strand; PAM type: NNNNGHTT; PAM sequence: GTGGGCTT
tcatagcttcaaaaacaaaa

SEQ ID NO: 10232 - DNA, 20 bp, Artificial Sequence
  Description of Artificial Sequence: Synthetic oligonucleotide
  Target: SCN10A; (-) strand; PAM type: NNNNGHTT; PAM sequence: CATAGCTT
cattggctggaagtagtcat

SEQ ID NO: 10233 - DNA, 20 bp, Artificial Sequence
  Description of Artificial Sequence: Synthetic oligonucleotide
  Target: SCN10A; (-) strand; PAM type: NNNNGHTT; PAM sequence: TTTTGCTT
ctccccagcagaaagtaagg

SEQ ID NO: 10234 - DNA, 20 bp, Artificial Sequence
  Description of Artificial Sequence: Synthetic oligonucleotide
  Target: SCN10A; (-) strand; PAM type: NNNNGHTT; PAM sequence: TAAGGTTT
aatggctccccagcagaaag

SEQ ID NO: 10235 - DNA, 20 bp, Artificial Sequence
  Description of Artificial Sequence: Synthetic oligonucleotide
  Target: SCN10A; (-) strand; PAM type: NNNNGHTT; PAM sequence: TGCTGATT
cagagccttgtcttagagat

SEQ ID NO: 10236 - DNA, 20 bp, Artificial Sequence
  Description of Artificial Sequence: Synthetic oligonucleotide
  Target: SCN10A; (-) strand; PAM type: NNNNGHTT; PAM sequence: TAGAGATT
tcacagccagagccttgtct

SEQ ID NO: 10237 - DNA, 20 bp, Artificial Sequence
  Description of Artificial Sequence: Synthetic oligonucleotide
  Target: SCN10A; (-) strand; PAM type: NNNNGHTT; PAM sequence: GAATGCTT
acctcagctgccacccactg

SEQ ID NO: 10238 - DNA, 20 bp, Artificial Sequence
  Description of Artificial Sequence: Synthetic oligonucleotide
  Target: SCN10A; (-) strand; PAM type: NNNNGHTT; PAM sequence: GCAGGTTT
acaaaaaacttctctggtct

SEQ ID NO: 10239 - DNA, 20 bp, Artificial Sequence
  Description of Artificial Sequence: Synthetic oligonucleotide
  Target: SCN10A; (-) strand; PAM type: NNNNGHTT; PAM sequence: CCGAGATT
cgaggtgtggtggtagtgag

SEQ ID NO: 10240 - DNA, 20 bp, Artificial Sequence
  Description of Artificial Sequence: Synthetic oligonucleotide
  Target: SCN10A; (-) strand; PAM type: NNNNGHTT; PAM sequence: TCTCGATT
tgcggccactgcgggctctt

SEQ ID NO: 10241 - DNA, 20 bp, Artificial Sequence
  Description of Artificial Sequence: Synthetic oligonucleotide
  Target: SCN10A; (-) strand; PAM type: NNNNGHTT; PAM sequence: CGAAGATT
ctcactgataagtctcacag

SEQ ID NO: 10242 - DNA, 20 bp, Artificial Sequence
  Description of Artificial Sequence: Synthetic oligonucleotide
  Target: SCN10A; (-) strand; PAM type: NNNNGHTT; PAM sequence: TGATGTTT
gcctttctggaaacctagag

SEQ ID NO: 10243 - DNA, 20 bp, Artificial Sequence
  Description of Artificial Sequence: Synthetic oligonucleotide
  Target: SCN10A; (-) strand; PAM type: NNNNGHTT; PAM sequence: GATGGCTT
aataaggtgggagctaggat

SEQ ID NO: 10244 - DNA, 20 bp, Artificial Sequence
  Description of Artificial Sequence: Synthetic oligonucleotide
  Target: SCN10A; (-) strand; PAM type: NNNNGHTT; PAM sequence: GATTGTTT
gactgagtttttcttgccca

SEQ ID NO: 10245 - DNA, 20 bp, Artificial Sequence
  Description of Artificial Sequence: Synthetic oligonucleotide
  Target: SCN10A; (-) strand; PAM type: NNNNGHTT; PAM sequence: CCCAGATT
tagagactgagtttttcttg

SEQ ID NO: 10246 - DNA, 20 bp, Artificial Sequence
  Description of Artificial Sequence: Synthetic oligonucleotide
  Target: SCN10A; (-) strand; PAM type: NNNNGHTT; PAM sequence: CTGAGTTT
gaggttggtgatgttagaga

SEQ ID NO: 10247 - DNA, 20 bp, Artificial Sequence
  Description of Artificial Sequence: Synthetic oligonucleotide
  Target: SCN10A; (-) strand; PAM type: NNNNGHTT; PAM sequence: GGAAGCTT
aagagttgatttaatacact

SEQ ID NO: 10248 - DNA, 20 bp, Artificial Sequence
  Description of Artificial Sequence: Synthetic oligonucleotide
  Target: SCN10A; (-) strand; PAM type: NNNNGHTT; PAM sequence: AGTTGATT
cccctagaaggaaaaggaag

SEQ ID NO: 10249 - DNA, 20 bp, Artificial Sequence
  Description of Artificial Sequence: Synthetic oligonucleotide
  Target: SCN10A; (-) strand; PAM type: NNNNGHTT; PAM sequence: ATCAGTTT
atgtctccaagtctctgaaa

SEQ ID NO: 10250 - DNA, 20 bp, Artificial Sequence
  Description of Artificial Sequence: Synthetic oligonucleotide
  Target: SCN10A; (-) strand; PAM type: NNNNGHTT; PAM sequence: TTCAGATT
acttctctgagcaaatataa

SEQ ID NO: 10251 - DNA, 20 bp, Artificial Sequence
  Description of Artificial Sequence: Synthetic oligonucleotide
  Target: SCN10A; (-) strand; PAM type: NNNNGHTT; PAM sequence: GTAAGTTT
agcaggggaacttttttcat

SEQ ID NO: 10252 - DNA, 20 bp, Artificial Sequence
  Description of Artificial Sequence: Synthetic oligonucleotide
  Target: SCN10A; (-) strand; PAM type: NNNNGHTT; PAM sequence: CATTGCTT
ccactcatccaaagaatgga

SEQ ID NO: 10253 - DNA, 20 bp, Artificial Sequence
  Description of Artificial Sequence: Synthetic oligonucleotide
  Target: SCN10A; (-) strand; PAM type: NNNNGHTT; PAM sequence: TGCAGATT
cagcacctgtctgccccagc

SEQ ID NO: 10254 - DNA, 20 bp, Artificial Sequence
  Description of Artificial Sequence: Synthetic oligonucleotide
  Target: SCN10A; (-) strand; PAM type: NNNNGHTT; PAM sequence: GTGGGCTT
gctgagcagtgggaatggag

SEQ ID NO: 10255 - DNA, 20 bp, Artificial Sequence
  Description of Artificial Sequence: Synthetic oligonucleotide
  Target: SCN10A; (-) strand; PAM type: NNNNGHTT; PAM sequence: ATCAGATT
aagagaaagacatgatcata

SEQ ID NO: 10256 - DNA, 20 bp, Artificial Sequence
  Description of Artificial Sequence: Synthetic oligonucleotide
  Target: SCN10A; (-) strand; PAM type: NNNNGHTT; PAM sequence: TGATGTTT
tgagggtgataaagtaccag

SEQ ID NO: 10257 - DNA, 20 bp, Artificial Sequence
  Description of Artificial Sequence: Synthetic oligonucleotide
  Target: SCN10A; (-) strand; PAM type: NNNNGHTT; PAM sequence: TGGAGTTT
atgacacaggctacagagta

SEQ ID NO: 10258 - DNA, 20 bp, Artificial Sequence
  Description of Artificial Sequence: Synthetic oligonucleotide
  Target: SCN10A; (-) strand; PAM type: NNNNGHTT; PAM sequence: ATTTGATT
acaagtatgctcagggaaca

SEQ ID NO: 10259 - DNA, 20 bp, Artificial Sequence
  Description of Artificial Sequence: Synthetic oligonucleotide
  Target: SCN10A; (-) strand; PAM type: NNNNGHTT; PAM sequence: AAGTGCTT
gaatacaggattgtcttatg

SEQ ID NO: 10260 - DNA, 20 bp, Artificial Sequence
  Description of Artificial Sequence: Synthetic oligonucleotide
  Target: SCN10A; (-) strand; PAM type: NNNNGHTT; PAM sequence: ACAGGATT
tatacatctaactattgaat

SEQ ID NO: 10261 - DNA, 20 bp, Artificial Sequence
  Description of Artificial Sequence: Synthetic oligonucleotide
  Target: SCN10A; (-) strand; PAM type: NNNNGHTT; PAM sequence: AAATGATT
tataagatatatatatatat

SEQ ID NO: 10262 - DNA, 20 bp, Artificial Sequence
  Description of Artificial Sequence: Synthetic oligonucleotide
  Target: SCN10A; (-) strand; PAM type: NNNNGHTT; PAM sequence: ATAAGATT
acaacacatgggaattcaag

SEQ ID NO: 10263 - DNA, 20 bp, Artificial Sequence
  Description of Artificial Sequence: Synthetic oligonucleotide
  Target: SCN10A; (-) strand; PAM type: NNNNGHTT; PAM sequence: CCATGATT
agcatgggaaagacctgctc

SEQ ID NO: 10264 - DNA, 20 bp, Artificial Sequence
  Description of Artificial Sequence: Synthetic oligonucleotide
  Target: SCN10A; (-) strand; PAM type: NNNNGHTT; PAM sequence: TACAGCTT
gaaagaggtttaattggact

SEQ ID NO: 10265 - DNA, 20 bp, Artificial Sequence
  Description of Artificial Sequence: Synthetic oligonucleotide
  Target: SCN10A; (-) strand; PAM type: NNNNGHTT; PAM sequence: AGAGGTTT
ctgggcaatttataaaagaa

SEQ ID NO: 10266 - DNA, 20 bp, Artificial Sequence
  Description of Artificial Sequence: Synthetic oligonucleotide
  Target: SCN10A; (-) strand; PAM type: NNNNGHTT; PAM sequence: GTTTGTTT
tttcatacttttcctttctt

SEQ ID NO: 10267 - DNA, 20 bp, Artificial Sequence
  Description of Artificial Sequence: Synthetic oligonucleotide
  Target: SCN10A; (-) strand; PAM type: NNNNGHTT; PAM sequence: TCTTGTTT
ctgctttcatacttttcctt

SEQ ID NO: 10268 - DNA, 20 bp, Artificial Sequence
  Description of Artificial Sequence: Synthetic oligonucleotide
  Target: SCN10A; (-) strand; PAM type: NNNNGHTT; PAM sequence: CCCTGCTT
tcatctatccattcactatt

SEQ ID NO: 10269 - DNA, 20 bp, Artificial Sequence
  Description of Artificial Sequence: Synthetic oligonucleotide
  Target: SCN10A; (-) strand; PAM type: NNNNGHTT; PAM sequence: TCTTGTTT
tcattcttctatctttccat

SEQ ID NO: 10270 - DNA, 20 bp, Artificial Sequence
  Description of Artificial Sequence: Synthetic oligonucleotide
  Target: SCN10A; (-) strand; PAM type: NNNNGHTT; PAM sequence: GCATGCTT
ttcacgcatcttccatccaa

SEQ ID NO: 10271 - DNA, 20 bp, Artificial Sequence
  Description of Artificial Sequence: Synthetic oligonucleotide
  Target: SCN10A; (-) strand; PAM type: NNNNGHTT; PAM sequence: TTTTGATT
aacccttatatctttctatc

SEQ ID NO: 10272 - DNA, 20 bp, Artificial Sequence
  Description of Artificial Sequence: Synthetic oligonucleotide
  Target: SCN10A; (-) strand; PAM type: NNNNGHTT; PAM sequence: TACTGATT
actcatttcatccatcttcc

SEQ ID NO: 10273 - DNA, 20 bp, Artificial Sequence
  Description of Artificial Sequence: Synthetic oligonucleotide
  Target: SCN10A; (-) strand; PAM type: NNNNGHTT; PAM sequence: TCCTGCTT
ccctttgggggcacagtcac

SEQ ID NO: 10274 - DNA, 20 bp, Artificial Sequence
  Description of Artificial Sequence: Synthetic oligonucleotide
  Target: SCN10A; (-) strand; PAM type: NNNNGHTT; PAM sequence: CAAGGATT
agcttcaggccactgtacca

SEQ ID NO: 10275 - DNA, 20 bp, Artificial Sequence
  Description of Artificial Sequence: Synthetic oligonucleotide
  Target: SCN10A; (-) strand; PAM type: NNNNGHTT; PAM sequence: AGCAGCTT
ttccctgatgccaatgcact

SEQ ID NO: 10276 - DNA, 20 bp, Artificial Sequence
  Description of Artificial Sequence: Synthetic oligonucleotide
  Target: SCN10A; (-) strand; PAM type: NNNNGHTT; PAM sequence: TGGTGCTT
tcaggaaatgtgtctgtatt

SEQ ID NO: 10277 - DNA, 20 bp, Artificial Sequence
  Description of Artificial Sequence: Synthetic oligonucleotide
  Target: SCN10A; (-) strand; PAM type: NNNNGHTT; PAM sequence: GAGGGTTT
ctgttcactgccgcatagct

SEQ ID NO: 10278 - DNA, 20 bp, Artificial Sequence
  Description of Artificial Sequence: Synthetic oligonucleotide
  Target: SCN10A; (-) strand; PAM type: NNNNGHTT; PAM sequence: CTTTGCTT
actgtctaggccactacctt

SEQ ID NO: 10279 - DNA, 20 bp, Artificial Sequence
  Description of Artificial Sequence: Synthetic oligonucleotide
  Target: SCN10A; (-) strand; PAM type: NNNNGHTT; PAM sequence: ATGTGATT
gtgcttctcacacatcagac

SEQ ID NO: 10280 - DNA, 20 bp, Artificial Sequence
  Description of Artificial Sequence: Synthetic oligonucleotide
  Target: SCN10A; (-) strand; PAM type: NNNNGHTT; PAM sequence: GTGTGCTT
cctgcattagagaattgact

SEQ ID NO: 10281 - DNA, 20 bp, Artificial Sequence
  Description of Artificial Sequence: Synthetic oligonucleotide
  Target: SCN10A; (-) strand; PAM type: NNNNGHTT; PAM sequence: CTGAGCTT
gcagccatggcttagaacca

SEQ ID NO: 10282 - DNA, 20 bp, Artificial Sequence
  Description of Artificial Sequence: Synthetic oligonucleotide
  Target: SCN10A; (-) strand; PAM type: NNNNGHTT; PAM sequence: CATGGCTT
aggcatttccaaggtgcagc

SEQ ID NO: 10283 - DNA, 20 bp, Artificial Sequence
  Description of Artificial Sequence: Synthetic oligonucleotide
  Target: SCN10A; (-) strand; PAM type: NNNNGHTT; PAM sequence: CAGAGATT
gtgaccgaccaccactaccc

SEQ ID NO: 10284 - DNA, 20 bp, Artificial Sequence
  Description of Artificial Sequence: Synthetic oligonucleotide
  Target: SCN10A; (-) strand; PAM type: NNNNGHTT; PAM sequence: AAAAGTTT
cctcaagggctactccaaag

SEQ ID NO: 10285 - DNA, 20 bp, Artificial Sequence
  Description of Artificial Sequence: Synthetic oligonucleotide
  Target: SCN10A; (-) strand; PAM type: NNNNGHTT; PAM sequence: TGGGGTTT
agtggctcagtgggaacacg

SEQ ID NO: 10286 - DNA, 20 bp, Artificial Sequence
  Description of Artificial Sequence: Synthetic oligonucleotide
  Target: SCN10A; (-) strand; PAM type: NNNNGHTT; PAM sequence: TATGGCTT
tgctgcttaagtgggtggcc

SEQ ID NO: 10287 - DNA, 20 bp, Artificial Sequence
  Description of Artificial Sequence: Synthetic oligonucleotide
  Target: SCN10A; (-) strand; PAM type: NNNNGHTT; PAM sequence: TGCTGCTT
ctttatctttgtgttcgaga

SEQ ID NO: 10288 - DNA, 20 bp, Artificial Sequence
  Description of Artificial Sequence: Synthetic oligonucleotide
  Target: SCN10A; (-) strand; PAM type: NNNNGHTT; PAM sequence: GAAAGCTT
ctggaccagaagcccacggt

SEQ ID NO: 10289 - DNA, 20 bp, Artificial Sequence
  Description of Artificial Sequence: Synthetic oligonucleotide
  Target: SCN10A; (-) strand; PAM type: NNNNGHTT; PAM sequence: TCATGCTT
ccccattggccctgaagaag

SEQ ID NO: 10290 - DNA, 20 bp, Artificial Sequence
  Description of Artificial Sequence: Synthetic oligonucleotide
  Target: SCN10A; (-) strand; PAM type: NNNNGHTT; PAM sequence: GGCTGTTT
atccctgcaagtatcagcag

SEQ ID NO: 10291 - DNA, 20 bp, Artificial Sequence
  Description of Artificial Sequence: Synthetic oligonucleotide
  Target: SCN10A; (-) strand; PAM type: NNNNGHTT; PAM sequence: GAAGGTTT
acttccaaaatccaatttga

SEQ ID NO: 10292 - DNA, 20 bp, Artificial Sequence
  Description of Artificial Sequence: Synthetic oligonucleotide
  Target: SCN10A; (-) strand; PAM type: NNNNGHTT; PAM sequence: TGATGCTT
aactgcctgtgaacatccgt

SEQ ID NO: 10293 - DNA, 20 bp, Artificial Sequence
  Description of Artificial Sequence: Synthetic oligonucleotide
  Target: SCN10A; (-) strand; PAM type: NNNNGHTT; PAM sequence: TGGCGATT
attctttttcagaggtgtgt

SEQ ID NO: 10294 - DNA, 20 bp, Artificial Sequence
  Description of Artificial Sequence: Synthetic oligonucleotide
  Target: SCN10A; (-) strand; PAM type: NNNNGHTT; PAM sequence: CCTTGATT
tcttcttttaatttgaattt

SEQ ID NO: 10295 - DNA, 20 bp, Artificial Sequence
  Description of Artificial Sequence: Synthetic oligonucleotide
  Target: SCN10A; (-) strand; PAM type: NNNNGHTT; PAM sequence: TAGGGTTT
cccccacagccacagcatcc

SEQ ID NO: 10296 - DNA, 20 bp, Artificial Sequence
  Description of Artificial Sequence: Synthetic oligonucleotide
  Target: SCN10A; (-) strand; PAM type: NNNNGHTT; PAM sequence: CAGAGCTT
aatggcgtgaacctgggagg

SEQ ID NO: 10297 - DNA, 20 bp, Artificial Sequence
  Description of Artificial Sequence: Synthetic oligonucleotide
  Target: SCN10A; (-) strand; PAM type: NNNNGHTT; PAM sequence: CCAGGTTT
ttggcttcacacaggactgg

SEQ ID NO: 10298 - DNA, 20 bp, Artificial Sequence
  Description of Artificial Sequence: Synthetic oligonucleotide
  Target: SCN10A; (-) strand; PAM type: NNNNGHTT; PAM sequence: TTTGGCTT
cctctgagtcacattgccaa

SEQ ID NO: 10299 - DNA, 20 bp, Artificial Sequence
  Description of Artificial Sequence: Synthetic oligonucleotide
  Target: SCN10A; (-) strand; PAM type: NNNNGHTT; PAM sequence: TAGTGCTT
gcctccagtgtccttaggat

SEQ ID NO: 10300 - DNA, 20 bp, Artificial Sequence
  Description of Artificial Sequence: Synthetic oligonucleotide
  Target: SCN10A; (-) strand; PAM type: NNNNGHTT; PAM sequence: TTAGGATT
accaacagcctccagtgtcc

SEQ ID NO: 10301 - DNA, 20 bp, Artificial Sequence
  Description of Artificial Sequence: Synthetic oligonucleotide
  Target: SCN10A; (-) strand; PAM type: NNNNGHTT; PAM sequence: CACAGTTT
taagcatttcccaaggtgga

SEQ ID NO: 10302 - DNA, 20 bp, Artificial Sequence
  Description of Artificial Sequence: Synthetic oligonucleotide
  Target: SCN10A; (-) strand; PAM type: NNNNGHTT; PAM sequence: TCCGGCTT
agatgtgggttcagttgaaa

SEQ ID NO: 10303 - DNA, 20 bp, Artificial Sequence
  Description of Artificial Sequence: Synthetic oligonucleotide
  Target: SCN10A; (-) strand; PAM type: NNNNGHTT; PAM sequence: CTATGTTT
ataatttactcaaccaatct

SEQ ID NO: 10304 - DNA, 20 bp, Artificial Sequence
  Description of Artificial Sequence: Synthetic oligonucleotide
  Target: SCN10A; (-) strand; PAM type: NNNNGHTT; PAM sequence: TCTTGCTT
gctggtatacctctttctca

SEQ ID NO: 10305 - DNA, 20 bp, Artificial Sequence
  Description of Artificial Sequence: Synthetic oligonucleotide
  Target: SCN10A; (-) strand; PAM type: NNNNGHTT; PAM sequence: TTAGGCTT
ggcaccaaatttagccttct

SEQ ID NO: 10306 - DNA, 20 bp, Artificial Sequence
  Description of Artificial Sequence: Synthetic oligonucleotide
  Target: SCN10A; (-) strand; PAM type: NNNNGHTT; PAM sequence: TTTTGCTT
ttgtgggccttctctcctca

SEQ ID NO: 10307 - DNA, 20 bp, Artificial Sequence
  Description of Artificial Sequence: Synthetic oligonucleotide
  Target: SCN10A; (-) strand; PAM type: NNNNGHTT; PAM sequence: ATTGGCTT
ggtgctctcctcactacgtc

SEQ ID NO: 10308 - DNA, 20 bp, Artificial Sequence
  Description of Artificial Sequence: Synthetic oligonucleotide
  Target: SCN10A; (-) strand; PAM type: NNNNGHTT; PAM sequence: GCTGGATT
gctcttctccttccagtcct

SEQ ID NO: 10309 - DNA, 20 bp, Artificial Sequence
  Description of Artificial Sequence: Synthetic oligonucleotide
  Target: SCN10A; (-) strand; PAM type: NNNNGHTT; PAM sequence: CAGTGCTT
aggggcaagagagggctggg

SEQ ID NO: 10310 - DNA, 20 bp, Artificial Sequence
  Description of Artificial Sequence: Synthetic oligonucleotide
  Target: SCN10A; (-) strand; PAM type: NNNNGHTT; PAM sequence: CAGTGATT
cccagtgccctggcacaggg

SEQ ID NO: 10311 - DNA, 20 bp, Artificial Sequence
  Description of Artificial Sequence: Synthetic oligonucleotide
  Target: SCN10A; (-) strand; PAM type: NNNNGHTT; PAM sequence: GAGAGTTT
gacgcaaagccaagggagaa

SEQ ID NO: 10312 - DNA, 20 bp, Artificial Sequence
  Description of Artificial Sequence: Synthetic oligonucleotide
  Target: SCN10A; (-) strand; PAM type: NNNNGHTT; PAM sequence: CTCAGCTT
aaaactgctcggtgcatggc

SEQ ID NO: 10313 - DNA, 20 bp, Artificial Sequence
  Description of Artificial Sequence: Synthetic oligonucleotide
  Target: SCN10A; (-) strand; PAM type: NNNNGHTT; PAM sequence: GCCAGATT
atctaggcctccatctaaat

SEQ ID NO: 10314 - DNA, 20 bp, Artificial Sequence
  Description of Artificial Sequence: Synthetic oligonucleotide
  Target: SCN10A; (-) strand; PAM type: NNNNGHTT; PAM sequence: CAGTGTTT
gctcttccgattcacggctg

SEQ ID NO: 10315 - DNA, 20 bp, Artificial Sequence
  Description of Artificial Sequence: Synthetic oligonucleotide
  Target: SCN10A; (-) strand; PAM type: NNNNGHTT; PAM sequence: TTCCGATT
ctaggactacagtcccgctc

SEQ ID NO: 10316 - DNA, 20 bp, Artificial Sequence
  Description of Artificial Sequence: Synthetic oligonucleotide
  Target: SCN10A; (-) strand; PAM type: NNNNGHTT; PAM sequence: AGGGGCTT
agtcaaagcccaaaggcatg

SEQ ID NO: 10317 - DNA, 20 bp, Artificial Sequence
  Description of Artificial Sequence: Synthetic oligonucleotide
  Target: SCN10A; (-) strand; PAM type: NNNNGHTT; PAM sequence: AGTTGTTT
ggaaggaacttaacatcctc

SEQ ID NO: 10318 - DNA, 20 bp, Artificial Sequence
  Description of Artificial Sequence: Synthetic oligonucleotide
  Target: SCN10A; (-) strand; PAM type: NNNNGHTT; PAM sequence: TGTGGCTT
aaggaaggttctctctgtac

SEQ ID NO: 10319 - DNA, 20 bp, Artificial Sequence
  Description of Artificial Sequence: Synthetic oligonucleotide
  Target: SCN10A; (-) strand; PAM type: NNNNGHTT; PAM sequence: CTGGGCTT
tctaaggccctggctgaata

SEQ ID NO: 10320 - DNA, 20 bp, Artificial Sequence
  Description of Artificial Sequence: Synthetic oligonucleotide
  Target: SCN10A; (-) strand; PAM type: NNNNGHTT; PAM sequence: TAGAGATT
ataacaaggccttatgggaa

SEQ ID NO: 10321 - DNA, 20 bp, Artificial Sequence
  Description of Artificial Sequence: Synthetic oligonucleotide
  Target: SCN10A; (-) strand; PAM type: NNNNGHTT; PAM sequence: TGATGCTT
atttctaacaagctcccagg

SEQ ID NO: 10322 - DNA, 20 bp, Artificial Sequence
  Description of Artificial Sequence: Synthetic oligonucleotide
  Target: SCN10A; (-) strand; PAM type: NNNNGHTT; PAM sequence: TGCAGATT
ctcccaggagcttgttcaaa

SEQ ID NO: 10323 - DNA, 20 bp, Artificial Sequence
  Description of Artificial Sequence: Synthetic oligonucleotide
  Target: SCN10A; (-) strand; PAM type: NNNNGHTT; PAM sequence: AGGAGCTT
ttctcaaaatttaatctccc

SEQ ID NO: 10324 - DNA, 20 bp, Artificial Sequence
  Description of Artificial Sequence: Synthetic oligonucleotide
  Target: SCN10A; (-) strand; PAM type: NNNNGHTT; PAM sequence: CCTGGCTT
ccttatttaatcccgaagcc

SEQ ID NO: 10325 - DNA, 20 bp, Artificial Sequence
  Description of Artificial Sequence: Synthetic oligonucleotide
  Target: SCN10A; (-) strand; PAM type: NNNNGHTT; PAM sequence: CCCAGCTT
ccaacttgtcagtagcaaaa

SEQ ID NO: 10326 - DNA, 20 bp, Artificial Sequence
  Description of Artificial Sequence: Synthetic oligonucleotide
  Target: SCN10A; (-) strand; PAM type: NNNNGHTT; PAM sequence: AAAGGCTT
actgacactcaaaatgttta

SEQ ID NO: 10327 - DNA, 20 bp, Artificial Sequence
  Description of Artificial Sequence: Synthetic oligonucleotide
  Target: SCN10A; (-) strand; PAM type: NNNNGHTT; PAM sequence: AAATGTTT
gatggggaaactgacactca

SEQ ID NO: 10328 - DNA, 20 bp, Artificial Sequence
  Description of Artificial Sequence: Synthetic oligonucleotide
  Target: SCN10A; (-) strand; PAM type: NNNNGHTT; PAM sequence: GAGAGCTT
tcgtggagcacagctggttt

SEQ ID NO: 10329 - DNA, 20 bp, Artificial Sequence
  Description of Artificial Sequence: Synthetic oligonucleotide
  Target: SCN10A; (-) strand; PAM type: NNNNGHTT; PAM sequence: GCTGGTTT
ctaccgtatcgtggagcaca

SEQ ID NO: 10330 - DNA, 20 bp, Artificial Sequence
  Description of Artificial Sequence: Synthetic oligonucleotide
  Target: SCN10A; (-) strand; PAM type: NNNNGHTT; PAM sequence: AATGGTTT
acaagtgggtttcctagcag

SEQ ID NO: 10331 - DNA, 20 bp, Artificial Sequence
  Description of Artificial Sequence: Synthetic oligonucleotide
  Target: SCN10A; (-) strand; PAM type: NNNNGHTT; PAM sequence: GTGGGTTT
tttttccaagggcatgacaa

SEQ ID NO: 10332 - DNA, 20 bp, Artificial Sequence
  Description of Artificial Sequence: Synthetic oligonucleotide
  Target: SCN10A; (-) strand; PAM type: NNNNGHTT; PAM sequence: TCTGGATT
tggagaggaacacctgttgg

SEQ ID NO: 10333 - DNA, 20 bp, Artificial Sequence
  Description of Artificial Sequence: Synthetic oligonucleotide
  Target: SCN10A; (-) strand; PAM type: NNNNGHTT; PAM sequence: GTCTGTTT
aggctcatacgccgtagctt

SEQ ID NO: 10334 - DNA, 20 bp, Artificial Sequence
  Description of Artificial Sequence: Synthetic oligonucleotide
  Target: SCN10A; (-) strand; PAM type: NNNNGHTT; PAM sequence: CGTAGCTT
gcacccccaggctcatacgc

SEQ ID NO: 10335 - DNA, 20 bp, Artificial Sequence
  Description of Artificial Sequence: Synthetic oligonucleotide
  Target: SCN10A; (-) strand; PAM type: NNNNGHTT; PAM sequence: TTGGGCTT
gtcgtggccctcagttcagc

SEQ ID NO: 10336 - DNA, 20 bp, Artificial Sequence
  Description of Artificial Sequence: Synthetic oligonucleotide
  Target: SCN10A; (-) strand; PAM type: NNNNGHTT; PAM sequence: TTCAGCTT
agccacgtcgtggccctcag

SEQ ID NO: 10337 - DNA, 20 bp, Artificial Sequence
  Description of Artificial Sequence: Synthetic oligonucleotide
  Target: SCN10A; (-) strand; PAM type: NNNNGHTT; PAM sequence: AATAGTTT
taaatacttgagtttttatt

SEQ ID NO: 10338 - DNA, 20 bp, Artificial Sequence
  Description of Artificial Sequence: Synthetic oligonucleotide
  Target: SCN10A; (-) strand; PAM type: NNNNGHTT; PAM sequence: TTGAGTTT
aagaaaaattttttaaatac

SEQ ID NO: 10339 - DNA, 20 bp, Artificial Sequence
  Description of Artificial Sequence: Synthetic oligonucleotide
  Target: SCN10A; (-) strand; PAM type: NNNNGHTT; PAM sequence: CAATGCTT
tataaagggaattgtggcct

SEQ ID NO: 10340 - DNA, 20 bp, Artificial Sequence
  Description of Artificial Sequence: Synthetic oligonucleotide
  Target: SCN10A; (-) strand; PAM type: NNNNGHTT; PAM sequence: CAGTGTTT
gtcttagtcatctttcctct

SEQ ID NO: 10341 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
tgtatctgcttccctcaatc

SEQ ID NO: 10342 - DNA, 20 bp, Artificial Sequence
  Description of Artificial Sequence: Synthetic oligonucleotide
  Target: SCN10A; (-) strand; PAM type: NNNNGHTT; PAM sequence: ATCTGCTT
ccagaggaaggccatgatgt

SEQ ID NO: 10343 - DNA, 20 bp, Artificial Sequence
  Description of Artificial Sequence: Synthetic oligonucleotide
  Target: SCN10A; (-) strand; PAM type: NNNNGHTT; PAM sequence: TCTTGATT
ccataaacaccactgaaaac

SEQ ID NO: 10344 - DNA, 20 bp, Artificial Sequence
  Description of Artificial Sequence: Synthetic oligonucleotide
  Target: SCN10A; (-) strand; PAM type: NNNNGHTT; PAM sequence: CCAGGCTT
gcccacttgctgcctcactc

SEQ ID NO: 10345 - DNA, 20 bp, Artificial Sequence
  Description of Artificial Sequence: Synthetic oligonucleotide
  Target: SCN10A; (-) strand; PAM type: NNNNGHTT; PAM sequence: GACTGCTT
atgacctggaagaaccagat

SEQ ID NO: 10346 - DNA, 20 bp, Artificial Sequence
  Description of Artificial Sequence: Synthetic oligonucleotide
  Target: SCN10A; (-) strand; PAM type: NNNNGHTT; PAM sequence: CTGGGCTT
ggagagacgagttcactgcc

SEQ ID NO: 10347 - DNA, 20 bp, Artificial Sequence
  Description of Artificial Sequence: Synthetic oligonucleotide
  Target: SCN10A; (-) strand; PAM type: NNNNGHTT; PAM sequence: GAAGGTTT
agcactccatcaggggcccc

SEQ ID NO: 10348 - DNA, 20 bp, Artificial Sequence
  Description of Artificial Sequence: Synthetic oligonucleotide
  Target: SCN10A; (-) strand; PAM type: NNNNGHTT; PAM sequence: CCATGATT
caggcccctgcagcattact

SEQ ID NO: 10349 - DNA, 20 bp, Artificial Sequence
  Description of Artificial Sequence: Synthetic oligonucleotide
  Target: SCN10A; (-) strand; PAM type: NNNNGHTT; PAM sequence: TCAGGTTT
tgggtccattagcaaagcta

SEQ ID NO: 10350 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
tctgggtgttggttttttgt

SEQ ID NO: 10351 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
acaacttctgggtgttggtt

SEQ ID NO: 10352 - DNA, 20 bp, Artificial Sequence
  Description of Artificial Sequence: Synthetic oligonucleotide
  Target: SCN10A; (-) strand; PAM type: NNNNGHTT; PAM sequence: GTTGGTTT
tcagtacacaacttctgggt

SEQ ID NO: 10353 - DNA, 20 bp, Artificial Sequence
  Description of Artificial Sequence: Synthetic oligonucleotide
  Target: SCN10A; (-) strand; PAM type: NNNNGHTT; PAM sequence: CAATGTTT
cctggctagttgtccctact

SEQ ID NO: 10354 - DNA, 20 bp, Artificial Sequence
  Description of Artificial Sequence: Synthetic oligonucleotide
  Target: SCN10A; (-) strand; PAM type: NNNNGHTT; PAM sequence: TCATGCTT
tcacattctgcacgtggatg

SEQ ID NO: 10355 - DNA, 20 bp, Artificial Sequence
  Description of Artificial Sequence: Synthetic oligonucleotide
  Target: SCN10A; (-) strand; PAM type: NNNNGHTT; PAM sequence: AGCCGCTT
gggggctgtgggtgaacaga

SEQ ID NO: 10356 - DNA, 20 bp, Artificial Sequence
  Description of Artificial Sequence: Synthetic oligonucleotide
  Target: SCN10A; (-) strand; PAM type: NNNNGHTT; PAM sequence: ACGGGATT
agataagagggagggctggg

SEQ ID NO: 10357 - DNA, 20 bp, Artificial Sequence
  Description of Artificial Sequence: Synthetic oligonucleotide
  Target: SCN10A; (-) strand; PAM type: NNNNGHTT; PAM sequence: TTCAGCTT
tccccaaagttatcaagccc

SEQ ID NO: 10358 - DNA, 20 bp, Artificial Sequence
  Description of Artificial Sequence: Synthetic oligonucleotide
  Target: SCN10A; (-) strand; PAM type: NNNNGHTT; PAM sequence: AAAAGTTT
atagggaaagaggcatctat

SEQ ID NO: 10359 - DNA, 20 bp, Artificial Sequence
  Description of Artificial Sequence: Synthetic oligonucleotide
  Target: SCN10A; (-) strand; PAM type: NNNNGHTT; PAM sequence: TGTGGTTT
ttatacaaggtaaaaataaa

SEQ ID NO: 10360 - DNA, 20 bp, Artificial Sequence
  Description of Artificial Sequence: Synthetic oligonucleotide
  Target: SCN10A; (-) strand; PAM type: NNNNGHTT; PAM sequence: TTAGGATT
tgagctggaagattagaggt

SEQ ID NO: 10361 - DNA, 20 bp, Artificial Sequence
  Description of Artificial Sequence: Synthetic oligonucleotide
  Target: SCN10A; (-) strand; PAM type: NNNNGHTT; PAM sequence: AGAGGTTT
agagactgagctggaagatt

SEQ ID NO: 10362 - DNA, 20 bp, Artificial Sequence
  Description of Artificial Sequence: Synthetic oligonucleotide
  Target: SCN10A; (-) strand; PAM type: NNNNGHTT; PAM sequence: GGAAGATT
agcctcacagagactgagct

SEQ ID NO: 10363 - DNA, 20 bp, Artificial Sequence
  Description of Artificial Sequence: Synthetic oligonucleotide
  Target: SCN10A; (-) strand; PAM type: NNNNGHTT; PAM sequence: TTGTGATT
acagatgaagaagttttccc

SEQ ID NO: 10364 - DNA, 20 bp, Artificial Sequence
  Description of Artificial Sequence: Synthetic oligonucleotide
  Target: SCN10A; (-) strand; PAM type: NNNNGHTT; PAM sequence: AGAAGTTT
ttggaggtgctcacagatga

SEQ ID NO: 10365 - DNA, 20 bp, Artificial Sequence
  Description of Artificial Sequence: Synthetic oligonucleotide
  Target: SCN10A; (-) strand; PAM type: NNNNGHTT; PAM sequence: AAATGTTT
taaatgagatgctgcttgtc

SEQ ID NO: 10366 - DNA, 20 bp, Artificial Sequence
  Description of Artificial Sequence: Synthetic oligonucleotide
  Target: SCN10A; (-) strand; PAM type: NNNNGHTT; PAM sequence: TGCTGCTT
attttgaagcttaaatgaga

SEQ ID NO: 10367 - DNA, 20 bp, Artificial Sequence
  Description of Artificial Sequence: Synthetic oligonucleotide
  Target: SCN10A; (-) strand; PAM type: NNNNGHTT; PAM sequence: TGAAGCTT
cctacttggtaggattattt

SEQ ID NO: 10368 - DNA, 20 bp, Artificial Sequence
  Description of Artificial Sequence: Synthetic oligonucleotide
  Target: SCN10A; (-) strand; PAM type: NNNNGHTT; PAM sequence: GTAGGATT
tgaatggtaatgcctacttg

SEQ ID NO: 10369 - DNA, 20 bp, Artificial Sequence
  Description of Artificial Sequence: Synthetic oligonucleotide
  Target: SCN10A; (-) strand; PAM type: NNNNGHTT; PAM sequence: GTCAGCTT
gtccctgctgaggtaggtat

SEQ ID NO: 10370 - DNA, 20 bp, Artificial Sequence
  Description of Artificial Sequence: Synthetic oligonucleotide
  Target: SCN10A; (-) strand; PAM type: NNNNGHTT; PAM sequence: TGAAGATT
aattttgaagctgggaaaaa

SEQ ID NO: 10371 - DNA, 20 bp, Artificial Sequence
  Description of Artificial Sequence: Synthetic oligonucleotide
  Target: SCN10A; (-) strand; PAM type: NNNNGHTT; PAM sequence: AAGTGTTT
tgagccaagcacttcgtgca

SEQ ID NO: 10372 - DNA, 20 bp, Artificial Sequence
  Description of Artificial Sequence: Synthetic oligonucleotide
  Target: SCN10A; (-) strand; PAM type: NNNNGHTT; PAM sequence: CTGTGCTT
tactaagtggtccagaaaag

SEQ ID NO: 10373 - DNA, 20 bp, Artificial Sequence
  Description of Artificial Sequence: Synthetic oligonucleotide
  Target: SCN10A; (-) strand; PAM type: NNNNGHTT; PAM sequence: GCCAGCTT
attcttatgtgactcattta

SEQ ID NO: 10374 - DNA, 20 bp, Artificial Sequence
  Description of Artificial Sequence: Synthetic oligonucleotide
  Target: SCN10A; (-) strand; PAM type: NNNNGHTT; PAM sequence: TCCTGATT
tttaccagcatcctaagaag

SEQ ID NO: 10375 - DNA, 20 bp, Artificial Sequence
  Description of Artificial Sequence: Synthetic oligonucleotide
  Target: SCN10A; (-) strand; PAM type: NNNNGHTT; PAM sequence: ATGAGATT
gctctgtgcatgagatgcta

SEQ ID NO: 10376 - DNA, 20 bp, Artificial Sequence
  Description of Artificial Sequence: Synthetic oligonucleotide
  Target: SCN10A; (-) strand; PAM type: NNNNGHTT; PAM sequence: TGGGGATT
aaaggccaccttgaggtgct

SEQ ID NO: 10377 - DNA, 20 bp, Artificial Sequence
  Description of Artificial Sequence: Synthetic oligonucleotide
  Target: SCN10A; (-) strand; PAM type: NNNNGHTT; PAM sequence: AGGTGCTT
gtgagcaaaaggccaccttg

SEQ ID NO: 10378 - DNA, 20 bp, Artificial Sequence
  Description of Artificial Sequence: Synthetic oligonucleotide
  Target: SCN10A; (-) strand; PAM type: NNNNGHTT; PAM sequence: TGGCGTTT
gccaagctttccagaggagt

SEQ ID NO: 10379 - DNA, 20 bp, Artificial Sequence
  Description of Artificial Sequence: Synthetic oligonucleotide
  Target: SCN10A; (-) strand; PAM type: NNNNGHTT; PAM sequence: CCAAGCTT
ataaagaagtttaaaccatg

SEQ ID NO: 10380 - DNA, 20 bp, Artificial Sequence
  Description of Artificial Sequence: Synthetic oligonucleotide
  Target: SCN10A; (-) strand; PAM type: NNNNGHTT; PAM sequence: AGAAGTTT
cagaggagaccttgacataa

SEQ ID NO: 10381 - DNA, 20 bp, Artificial Sequence
  Description of Artificial Sequence: Synthetic oligonucleotide
  Target: SCN10A; (-) strand; PAM type: NNNNGHTT; PAM sequence: CAGGGCTT
caggcagtggggaggggctt

SEQ ID NO: 10382 - DNA, 20 bp, Artificial Sequence
  Description of Artificial Sequence: Synthetic oligonucleotide
  Target: SCN10A; (-) strand; PAM type: NNNNGHTT; PAM sequence: AGGGGCTT
gacagccacaggcagtgggg

SEQ ID NO: 10383 - DNA, 20 bp, Artificial Sequence
  Description of Artificial Sequence: Synthetic oligonucleotide
  Target: SCN10A; (-) strand; PAM type: NNNNGHTT; PAM sequence: CAGAGCTT
atgatggtggggaagatgct

SEQ ID NO: 10384 - DNA, 20 bp, Artificial Sequence
  Description of Artificial Sequence: Synthetic oligonucleotide
  Target: SCN10A; (-) strand; PAM type: NNNNGHTT; PAM sequence: TGCAGCTT
atcgtaccaaacaggctctt

SEQ ID NO: 10385 - DNA, 20 bp, Artificial Sequence
  Description of Artificial Sequence: Synthetic oligonucleotide
  Target: SCN10A; (-) strand; PAM type: NNNNGHTT; PAM sequence: AGGTGCTT
cccttccattccttctcttc

SEQ ID NO: 10386 - DNA, 20 bp, Artificial Sequence
  Description of Artificial Sequence: Synthetic oligonucleotide
  Target: SCN10A; (-) strand; PAM type: NNNNGHTT; PAM sequence: TAGAGATT
ggccaatgtggggctcagct

SEQ ID NO: 10387 - DNA, 20 bp, Artificial Sequence
  Description of Artificial Sequence: Synthetic oligonucleotide
  Target: SCN10A; (-) strand; PAM type: NNNNGHTT; PAM sequence: CTCAGCTT
cccggtaggccaatgtgggg

SEQ ID NO: 10388 - DNA, 20 bp, Artificial Sequence
  Description of Artificial Sequence: Synthetic oligonucleotide
  Target: SCN10A; (-) strand; PAM type: NNNNGHTT; PAM sequence: ATATGCTT
ctcctcctttatggtggaaa

SEQ ID NO: 10389 - DNA, 20 bp, Artificial Sequence
  Description of Artificial Sequence: Synthetic oligonucleotide
  Target: SCN10A; (-) strand; PAM type: NNNNGHTT; PAM sequence: CAGGGCTT
ccagagtcaggaacagagcc

SEQ ID NO: 10390 - DNA, 20 bp, Artificial Sequence
  Description of Artificial Sequence: Synthetic oligonucleotide
  Target: SCN10A; (-) strand; PAM type: NNNNGHTT; PAM sequence: CCAGGATT
ctggaagcagcaagatgtgc

SEQ ID NO: 10391 - DNA, 20 bp, Artificial Sequence
  Description of Artificial Sequence: Synthetic oligonucleotide
  Target: SCN10A; (-) strand; PAM type: NNNNGHTT; PAM sequence: GGAAGTTT
atgcccctcaccctcagaca

SEQ ID NO: 10392 - DNA, 20 bp, Artificial Sequence
  Description of Artificial Sequence: Synthetic oligonucleotide
  Target: SCN10A; (-) strand; PAM type: NNNNGHTT; PAM sequence: ATGAGTTT
ccaacttgggttctttcctc

SEQ ID NO: 10393 - DNA, 20 bp, Artificial Sequence
  Description of Artificial Sequence: Synthetic oligonucleotide
  Target: SCN10A; (-) strand; PAM type: NNNNGHTT; PAM sequence: CTCAGCTT
ccccagcctggccccctgcc

SEQ ID NO: 10394 - DNA, 20 bp, Artificial Sequence
  Description of Artificial Sequence: Synthetic oligonucleotide
  Target: SCN10A; (-) strand; PAM type: NNNNGHTT; PAM sequence: CCATGTTT
aaataataacaaaatctact

SEQ ID NO: 10395 - DNA, 20 bp, Artificial Sequence
  Description of Artificial Sequence: Synthetic oligonucleotide
  Target: SCN10A; (-) strand; PAM type: NNNNGHTT; PAM sequence: GACTGATT
tattcagggaagtaagagct

SEQ ID NO: 10396 - DNA, 20 bp, Artificial Sequence
  Description of Artificial Sequence: Synthetic oligonucleotide
  Target: SCN10A; (-) strand; PAM type: NNNNGHTT; PAM sequence: ATGGGTTT
caagaaaataatgcttactc

SEQ ID NO: 10397 - DNA, 20 bp, Artificial Sequence
  Description of Artificial Sequence: Synthetic oligonucleotide
  Target: SCN10A; (-) strand; PAM type: NNNNGHTT; PAM sequence: TAATGCTT
tttccttaaaatcaagaaaa

SEQ ID NO: 10398 - DNA, 20 bp, Artificial Sequence
  Description of Artificial Sequence: Synthetic oligonucleotide
  Target: SCN10A; (-) strand; PAM type: NNNNGHTT; PAM sequence: ATATGATT
tgacttgcaggaatgagaac

SEQ ID NO: 10399 - DNA, 20 bp, Artificial Sequence
  Description of Artificial Sequence: Synthetic oligonucleotide
  Target: SCN10A; (-) strand; PAM type: NNNNGHTT; PAM sequence: GTGGGATT
ttcaaacttttcaaattcat

SEQ ID NO: 10400 - DNA, 20 bp, Artificial Sequence
  Description of Artificial Sequence: Synthetic oligonucleotide
  Target: SCN10A; (-) strand; PAM type: NNNNGHTT; PAM sequence: CCCAGATT
ctttgatctgcatttttatg

SEQ ID NO: 10401 - DNA, 20 bp, Artificial Sequence
  Description of Artificial Sequence: Synthetic oligonucleotide
  Target: SCN10A; (-) strand; PAM type: NNNNGHTT; PAM sequence: AAAAGCTT
aaggcttctgggttatctga

SEQ ID NO: 10402 - DNA, 20 bp, Artificial Sequence
  Description of Artificial Sequence: Synthetic oligonucleotide
  Target: SCN10A; (-) strand; PAM type: NNNNGHTT; PAM sequence: GAAGGCTT
actgtctcctggggaaagga

SEQ ID NO: 10403 - DNA, 20 bp, Artificial Sequence
  Description of Artificial Sequence: Synthetic oligonucleotide
  Target: SCN10A; (-) strand; PAM type: NNNNGHTT; PAM sequence: AGTGGATT
cttccgtatcctctgtggag

SEQ ID NO: 10404 - DNA, 20 bp, Artificial Sequence
  Description of Artificial Sequence: Synthetic oligonucleotide
  Target: SCN10A; (-) strand; PAM type: NNNNGHTT; PAM sequence: CTCTGTTT
agctaccaaaacctgacggt

SEQ ID NO: 10405 - DNA, 20 bp, Artificial Sequence
  Description of Artificial Sequence: Synthetic oligonucleotide
  Target: SCN10A; (-) strand; PAM type: NNNNGHTT; PAM sequence: TTTGGTTT
ccttgtgtttttcccagatc

SEQ ID NO: 10406 - DNA, 20 bp, Artificial Sequence
  Description of Artificial Sequence: Synthetic oligonucleotide
  Target: SCN10A; (-) strand; PAM type: NNNNGHTT; PAM sequence: TTGTGTTT
gtttaatgggatgagaggcc

SEQ ID NO: 10407 - DNA, 20 bp, Artificial Sequence
  Description of Artificial Sequence: Synthetic oligonucleotide
  Target: SCN10A; (-) strand; PAM type: NNNNGHTT; PAM sequence: CCTGGTTT
aagcagtgtccagaaaacgc

SEQ ID NO: 10408 - DNA, 20 bp, Artificial Sequence
  Description of Artificial Sequence: Synthetic oligonucleotide
  Target: SCN10A; (-) strand; PAM type: NNNNGHTT; PAM sequence: ATAAGCTT
tggtctctcttcagtcataa

SEQ ID NO: 10409 - DNA, 20 bp, Artificial Sequence
  Description of Artificial Sequence: Synthetic oligonucleotide
  Target: SCN10A; (-) strand; PAM type: NNNNGHTT; PAM sequence: AGATGTTT
aagatgagaaatgccctaag

SEQ ID NO: 10410 - DNA, 20 bp, Artificial Sequence
  Description of Artificial Sequence: Synthetic oligonucleotide
  Target: SCN10A; (-) strand; PAM type: NNNNGHTT; PAM sequence: TGCAGTTT
tccatgaaatcatggacatt

SEQ ID NO: 10411 - DNA, 20 bp, Artificial Sequence
  Description of Artificial Sequence: Synthetic oligonucleotide
  Target: SCN10A; (-) strand; PAM type: NNNNGHTT; PAM sequence: TTGAGTTT
tcttgtgggacttagcatat

SEQ ID NO: 10412 - DNA, 20 bp, Artificial Sequence
  Description of Artificial Sequence: Synthetic oligonucleotide
  Target: SCN10A; (-) strand; PAM type: NNNNGHTT; PAM sequence: TGATGATT
aacacatacatttttatgct

SEQ ID NO: 10413 - DNA, 20 bp, Artificial Sequence
  Description of Artificial Sequence: Synthetic oligonucleotide
  Target: SCN10A; (-) strand; PAM type: NNNNGHTT; PAM sequence: TTATGCTT
attttaaaacacatacattt

SEQ ID NO: 10414 - DNA, 20 bp, Artificial Sequence
  Description of Artificial Sequence: Synthetic oligonucleotide
  Target: SCN10A; (-) strand; PAM type: NNNNGHTT; PAM sequence: CTCAGATT
ctgacagactgacagttgag

SEQ ID NO: 10415 - DNA, 20 bp, Artificial Sequence
  Description of Artificial Sequence: Synthetic oligonucleotide
  Target: SCN10A; (-) strand; PAM type: NNNNGHTT; PAM sequence: GTGGGATT
acaggattaaacctcctccc

SEQ ID NO: 10416 - DNA, 20 bp, Artificial Sequence
  Description of Artificial Sequence: Synthetic oligonucleotide
  Target: SCN10A; (-) strand; PAM type: NNNNGHTT; PAM sequence: ACAGGATT
catacagcacttactgtata

SEQ ID NO: 10417 - DNA, 20 bp, Artificial Sequence
  Description of Artificial Sequence: Synthetic oligonucleotide
  Target: SCN10A; (-) strand; PAM type: NNNNGHTT; PAM sequence: TCCAGATT
cccatatgaggagagtaact

SEQ ID NO: 10418 - DNA, 20 bp, Artificial Sequence
  Description of Artificial Sequence: Synthetic oligonucleotide
  Target: SCN10A; (-) strand; PAM type: NNNNGHTT; PAM sequence: CTCTGCTT
cacagagttgttgttttaag

SEQ ID NO: 10419 - DNA, 20 bp, Artificial Sequence
  Description of Artificial Sequence: Synthetic oligonucleotide
  Target: SCN10A; (-) strand; PAM type: NNNNGHTT; PAM sequence: TGTTGTTT
ctgtgaccagtccacagagt

SEQ ID NO: 10420 - DNA, 20 bp, Artificial Sequence
  Description of Artificial Sequence: Synthetic oligonucleotide
  Target: SCN10A; (-) strand; PAM type: NNNNGHTT; PAM sequence: TTGTGTTT
tactaatgctcagtttttat

SEQ ID NO: 10421 - DNA, 20 bp, Artificial Sequence
  Description of Artificial Sequence: Synthetic oligonucleotide
  Target: SCN10A; (-) strand; PAM type: NNNNGHTT; PAM sequence: CTCAGTTT
ccccatactagttactaatg

SEQ ID NO: 10422 - DNA, 20 bp, Artificial Sequence
  Description of Artificial Sequence: Synthetic oligonucleotide
  Target: SCN10A; (-) strand; PAM type: NNNNGHTT; PAM sequence: CTACGTTT
aaccttcggcaggccatgga

SEQ ID NO: 10423 - DNA, 20 bp, Artificial Sequence
  Description of Artificial Sequence: Synthetic oligonucleotide
  Target: SCN10A; (-) strand; PAM type: NNNNGHTT; PAM sequence: CTAGGCTT
aaagcagggagaaattcctg

SEQ ID NO: 10424 - DNA, 20 bp, Artificial Sequence
  Description of Artificial Sequence: Synthetic oligonucleotide
  Target: SCN10A; (-) strand; PAM type: NNNNGHTT; PAM sequence: GATTGTTT
ttttccttgcattctcctgg

SEQ ID NO: 10425 - DNA, 20 bp, Artificial Sequence
  Description of Artificial Sequence: Synthetic oligonucleotide
  Target: SCN10A; (-) strand; PAM type: NNNNGHTT; PAM sequence: CTGGGATT
tcaattttccttgcattctc

SEQ ID NO: 10426 - DNA, 20 bp, Artificial Sequence
  Description of Artificial Sequence: Synthetic oligonucleotide
  Target: SCN10A; (-) strand; PAM type: NNNNGHTT; PAM sequence: TGTTGTTT
atcctatatgagcaccactt

SEQ ID NO: 10427 - DNA, 20 bp, Artificial Sequence
  Description of Artificial Sequence: Synthetic oligonucleotide
  Target: SCN10A; (-) strand; PAM type: NNNNGHTT; PAM sequence: AATAGTTT
tcttaaacaatttttgaggg

SEQ ID NO: 10428 - DNA, 20 bp, Artificial Sequence
  Description of Artificial Sequence: Synthetic oligonucleotide
  Target: SCN10A; (-) strand; PAM type: NNNNGHTT; PAM sequence: GTTTGTTT
gactcattccttctgttttt

SEQ ID NO: 10429 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
tgatgactcattccttctgt

SEQ ID NO: 10430 - DNA, 20 bp, Artificial Sequence
  Description of Artificial Sequence: Synthetic oligonucleotide
  Target: SCN10A; (-) strand; PAM type: NNNNGHTT; PAM sequence: TTCTGTTT
cactcttgatgactcattcc

SEQ ID NO: 10431 - DNA, 20 bp, Artificial Sequence
  Description of Artificial Sequence: Synthetic oligonucleotide
  Target: SCN10A; (-) strand; PAM type: NNNNGHTT; PAM sequence: TGTGGTTT
ggaatgactatttccacatc

SEQ ID NO: 10432 - DNA, 20 bp, Artificial Sequence
  Description of Artificial Sequence: Synthetic oligonucleotide
  Target: SCN10A; (-) strand; PAM type: NNNNGHTT; PAM sequence: CATAGTTT
tagtttttttattctctgca

SEQ ID NO: 10433 - DNA, 20 bp, Artificial Sequence
  Description of Artificial Sequence: Synthetic oligonucleotide
  Target: SCN10A; (-) strand; PAM type: NNNNGHTT; PAM sequence: TATAGTTT
cacaacttgttattgttatc

SEQ ID NO: 10434 - DNA, 20 bp, Artificial Sequence
  Description of Artificial Sequence: Synthetic oligonucleotide
  Target: SCN10A; (-) strand; PAM type: NNNNGHTT; PAM sequence: TTTAGTTT
atatactgacttcttgaatc

SEQ ID NO: 10435 - DNA, 20 bp, Artificial Sequence
  Description of Artificial Sequence: Synthetic oligonucleotide
  Target: SCN10A; (-) strand; PAM type: NNNNGHTT; PAM sequence: TAATGCTT
tgtggacttctttccattta

SEQ ID NO: 10436 - DNA, 20 bp, Artificial Sequence
  Description of Artificial Sequence: Synthetic oligonucleotide
  Target: SCN10A; (-) strand; PAM type: NNNNGHTT; PAM sequence: TGCAGTTT
tctatccatctttggtgttc

SEQ ID NO: 10437 - DNA, 20 bp, Artificial Sequence
  Description of Artificial Sequence: Synthetic oligonucleotide
  Target: SCN10A; (-) strand; PAM type: NNNNGHTT; PAM sequence: GGATGCTT
actgttattccttcctttct

SEQ ID NO: 10438 - DNA, 20 bp, Artificial Sequence
  Description of Artificial Sequence: Synthetic oligonucleotide
  Target: SCN10A; (-) strand; PAM type: NNNNGHTT; PAM sequence: GTCAGCTT
tccattgttgctaatgagca

SEQ ID NO: 10439 - DNA, 20 bp, Artificial Sequence
  Description of Artificial Sequence: Synthetic oligonucleotide
  Target: SCN10A; (-) strand; PAM type: NNNNGHTT; PAM sequence: TTCAGTTT
tgtttatctgaaatttgctc

SEQ ID NO: 10440 - DNA, 20 bp, Artificial Sequence
  Description of Artificial Sequence: Synthetic oligonucleotide
  Target: SCN10A; (-) strand; PAM type: NNNNGHTT; PAM sequence: CTTTGTTT
gtgccttctggccataacct

SEQ ID NO: 10441 - DNA, 20 bp, Artificial Sequence
  Description of Artificial Sequence: Synthetic oligonucleotide
  Target: SCN10A; (-) strand; PAM type: NNNNGHTT; PAM sequence: CACAGTTT
atttcttcaaccctttggag

SEQ ID NO: 10442 - DNA, 20 bp, Artificial Sequence
  Description of Artificial Sequence: Synthetic oligonucleotide
  Target: SCN10A; (-) strand; PAM type: NNNNGHTT; PAM sequence: TATTGATT
tgtaagcctaaaaatttagt

SEQ ID NO: 10443 - DNA, 20 bp, Artificial Sequence
  Description of Artificial Sequence: Synthetic oligonucleotide
  Target: SCN10A; (-) strand; PAM type: NNNNGHTT; PAM sequence: TTCAGATT
ctttggaacacagtttgagt

SEQ ID NO: 10444 - DNA, 20 bp, Artificial Sequence
  Description of Artificial Sequence: Synthetic oligonucleotide
  Target: SCN10A; (-) strand; PAM type: NNNNGHTT; PAM sequence: TTGAGTTT
cttactctttggaacacagt

SEQ ID NO: 10445 - DNA, 20 bp, Artificial Sequence
  Description of Artificial Sequence: Synthetic oligonucleotide
  Target: SCN10A; (-) strand; PAM type: NNNNGHTT; PAM sequence: CACAGTTT
tgatttcttactctttggaa

SEQ ID NO: 10446 - DNA, 20 bp, Artificial Sequence
  Description of Artificial Sequence: Synthetic oligonucleotide
  Target: SCN10A; (-) strand; PAM type: NNNNGHTT; PAM sequence: TACTGATT
actcaagaatttttgtaagt

SEQ ID NO: 10447 - DNA, 20 bp, Artificial Sequence
  Description of Artificial Sequence: Synthetic oligonucleotide
  Target: SCN10A; (-) strand; PAM type: NNNNGHTT; PAM sequence: AGTTGTTT
ggagtttcagtgtctcagca

SEQ ID NO: 10448 - DNA, 20 bp, Artificial Sequence
  Description of Artificial Sequence: Synthetic oligonucleotide
  Target: SCN10A; (-) strand; PAM type: NNNNGHTT; PAM sequence: GGGAGTTT
ttcatcatcacacaagggga

SEQ ID NO: 10449 - DNA, 20 bp, Artificial Sequence
  Description of Artificial Sequence: Synthetic oligonucleotide
  Target: SCN10A; (-) strand; PAM type: NNNNGHTT; PAM sequence: GCCTGTTT
cctggttccaattgatttca

SEQ ID NO: 10450 - DNA, 20 bp, Artificial Sequence
  Description of Artificial Sequence: Synthetic oligonucleotide
  Target: SCN10A; (-) strand; PAM type: NNNNGHTT; PAM sequence: AATTGATT
cagtcggccatcctggttcc

SEQ ID NO: 10451 - DNA, 20 bp, Artificial Sequence
  Description of Artificial Sequence: Synthetic oligonucleotide
  Target: SCN10A; (-) strand; PAM type: NNNNGHTT; PAM sequence: TCATGCTT
gggcctgcacagttatctct

SEQ ID NO: 10452 - DNA, 20 bp, Artificial Sequence
  Description of Artificial Sequence: Synthetic oligonucleotide
  Target: SCN10A; (-) strand; PAM type: NNNNGHTT; PAM sequence: GGAGGTTT
gtgattggtggaaggaaagg

SEQ ID NO: 10453 - DNA, 20 bp, Artificial Sequence
  Description of Artificial Sequence: Synthetic oligonucleotide
  Target: SCN10A; (-) strand; PAM type: NNNNGHTT; PAM sequence: AGGTGATT
gggtggataccgggatttgc

SEQ ID NO: 10454 - DNA, 20 bp, Artificial Sequence
  Description of Artificial Sequence: Synthetic oligonucleotide
  Target: SCN10A; (-) strand; PAM type: NNNNGHTT; PAM sequence: CCGGGATT
aaatgtttagtgggtggata

SEQ ID NO: 10455 - DNA, 20 bp, Artificial Sequence
  Description of Artificial Sequence: Synthetic oligonucleotide
  Target: SCN10A; (-) strand; PAM type: NNNNGHTT; PAM sequence: AAATGTTT
aaggcagtatttttattaga

SEQ ID NO: 10456 - DNA, 20 bp, Artificial Sequence
  Description of Artificial Sequence: Synthetic oligonucleotide
  Target: SCN10A; (-) strand; PAM type: NNNNGHTT; PAM sequence: AAAAGCTT
caccaggcttttgagaaaag

SEQ ID NO: 10457 - DNA, 20 bp, Artificial Sequence
  Description of Artificial Sequence: Synthetic oligonucleotide
  Target: SCN10A; (-) strand; PAM type: NNNNGHTT; PAM sequence: CCAGGCTT
tggaagccaagacgaggaca

SEQ ID NO: 10458 - DNA, 20 bp, Artificial Sequence
  Description of Artificial Sequence: Synthetic oligonucleotide
  Target: SCN10A; (-) strand; PAM type: NNNNGHTT; PAM sequence: TCATGCTT
atgtttatttagattcactc

SEQ ID NO: 10459 - DNA, 20 bp, Artificial Sequence
  Description of Artificial Sequence: Synthetic oligonucleotide
  Target: SCN10A; (-) strand; PAM type: NNNNGHTT; PAM sequence: TTTAGATT
ttgtgtccactcaatgttta

SEQ ID NO: 10460 - DNA, 20 bp, Artificial Sequence
  Description of Artificial Sequence: Synthetic oligonucleotide
  Target: SCN10A; (-) strand; PAM type: NNNNGHTT; PAM sequence: CAATGTTT
acattgttgttgtgtccact

SEQ ID NO: 10461 - DNA, 20 bp, Artificial Sequence
  Description of Artificial Sequence: Synthetic oligonucleotide
  Target: SCN10A; (-) strand; PAM type: NNNNGHTT; PAM sequence: GGGGGTTT
aaagggaaagaaaaagttca

SEQ ID NO: 10462 - DNA, 20 bp, Artificial Sequence
  Description of Artificial Sequence: Synthetic oligonucleotide
  Target: SCN10A; (-) strand; PAM type: NNNNGHTT; PAM sequence: CTAGGATT
tcaagtagcgcctcaaggat

SEQ ID NO: 10463 - DNA, 20 bp, Artificial Sequence
  Description of Artificial Sequence: Synthetic oligonucleotide
  Target: SCN10A; (-) strand; PAM type: NNNNGHTT; PAM sequence: CAGTGCTT
tgtatgtctcacagcacatt

SEQ ID NO: 10464 - DNA, 20 bp, Artificial Sequence
  Description of Artificial Sequence: Synthetic oligonucleotide
  Target: SCN10A; (-) strand; PAM type: NNNNGHTT; PAM sequence: TGATGCTT
ttaagccagtgccacatagt

SEQ ID NO: 10465 - DNA, 20 bp, Artificial Sequence
  Description of Artificial Sequence: Synthetic oligonucleotide
  Target: SCN10A; (-) strand; PAM type: NNNNGHTT; PAM sequence: ATCAGCTT
gacattccaagccttctcct

SEQ ID NO: 10466 - DNA, 20 bp, Artificial Sequence
  Description of Artificial Sequence: Synthetic oligonucleotide
  Target: SCN10A; (-) strand; PAM type: NNNNGHTT; PAM sequence: CATAGATT
atatttttgtcactgaataa

SEQ ID NO: 10467 - DNA, 20 bp, Artificial Sequence
  Description of Artificial Sequence: Synthetic oligonucleotide
  Target: SCN10A; (-) strand; PAM type: NNNNGHTT; PAM sequence: TAAGGTTT
ttacaactgacccacaatac

SEQ ID NO: 10468 - DNA, 20 bp, Artificial Sequence
  Description of Artificial Sequence: Synthetic oligonucleotide
  Target: SCN10A; (-) strand; PAM type: NNNNGHTT; PAM sequence: TCTGGATT
aatcgtcaaggctctaaact

SEQ ID NO: 10469 - DNA, 20 bp, Artificial Sequence
  Description of Artificial Sequence: Synthetic oligonucleotide
  Target: SCN10A; (-) strand; PAM type: NNNNGHTT; PAM sequence: AGTTGTTT
ttactacaagctttgctaag

SEQ ID NO: 10470 - DNA, 20 bp, Artificial Sequence
  Description of Artificial Sequence: Synthetic oligonucleotide
  Target: SCN10A; (-) strand; PAM type: NNNNGHTT; PAM sequence: ACAAGCTT
acagtggctacaccattact

SEQ ID NO: 10471 - DNA, 20 bp, Artificial Sequence
  Description of Artificial Sequence: Synthetic oligonucleotide
  Target: SCN10A; (-) strand; PAM type: NNNNGHTT; PAM sequence: CTTTGCTT
ttctcaattgttctttattt

SEQ ID NO: 10472 - DNA, 20 bp, Artificial Sequence
  Description of Artificial Sequence: Synthetic oligonucleotide
  Target: SCN10A; (-) strand; PAM type: NNNNGHTT; PAM sequence: AAGTGCTT
agacctctcattgccacaca

SEQ ID NO: 10473 - DNA, 20 bp, Artificial Sequence
  Description of Artificial Sequence: Synthetic oligonucleotide
  Target: SCN10A; (-) strand; PAM type: NNNNGHTT; PAM sequence: GATGGCTT
acaattacttcaaaaactta

SEQ ID NO: 10474 - DNA, 20 bp, Artificial Sequence
  Description of Artificial Sequence: Synthetic oligonucleotide
  Target: SCN10A; (-) strand; PAM type: NNNNGHTT; PAM sequence: TTTTGATT
aaggctttttcagtcaggga

SEQ ID NO: 10475 - DNA, 20 bp, Artificial Sequence
  Description of Artificial Sequence: Synthetic oligonucleotide
  Target: SCN10A; (-) strand; PAM type: NNNNGHTT; PAM sequence: CAGGGATT
cagtgaaaggctttttcagt

SEQ ID NO: 10476 - DNA, 20 bp, Artificial Sequence
  Description of Artificial Sequence: Synthetic oligonucleotide
  Target: SCN10A; (-) strand; PAM type: NNNNGHTT; PAM sequence: AAAGGCTT
gttttaaggtttaaacagtg

SEQ ID NO: 10477 - DNA, 20 bp, Artificial Sequence
  Description of Artificial Sequence: Synthetic oligonucleotide
  Target: SCN10A; (-) strand; PAM type: NNNNGHTT; PAM sequence: TAAGGTTT
tggaaagccaaggtttgttt

SEQ ID NO: 10478 - DNA, 20 bp, Artificial Sequence
  Description of Artificial Sequence: Synthetic oligonucleotide
  Target: SCN10A; (-) strand; PAM type: NNNNGHTT; PAM sequence: GTTTGTTT
tgggaaaatggaaagccaag

SEQ ID NO: 10479 - DNA, 20 bp, Artificial Sequence
  Description of Artificial Sequence: Synthetic oligonucleotide
  Target: SCN10A; (-) strand; PAM type: NNNNGHTT; PAM sequence: CAAGGTTT
cttgtgggaaaatggaaagc

SEQ ID NO: 10480 - DNA, 20 bp, Artificial Sequence
  Description of Artificial Sequence: Synthetic oligonucleotide
  Target: SCN10A; (-) strand; PAM type: NNNNGHTT; PAM sequence: TCCTGCTT
atataacttcaaagtttgcc

SEQ ID NO: 10481 - DNA, 20 bp, Artificial Sequence
  Description of Artificial Sequence: Synthetic oligonucleotide
  Target: SCN10A; (-) strand; PAM type: NNNNGHTT; PAM sequence: CAAAGTTT
gaaggaggccaatataactt

SEQ ID NO: 10482 - DNA, 20 bp, Artificial Sequence
  Description of Artificial Sequence: Synthetic oligonucleotide
  Target: SCN10A; (-) strand; PAM type: NNNNGHTT; PAM sequence: AAAGGTTT
actgagtaactgaccccaat

SEQ ID NO: 10483 - DNA, 20 bp, Artificial Sequence
  Description of Artificial Sequence: Synthetic oligonucleotide
  Target: SCN10A; (-) strand; PAM type: NNNNGHTT; PAM sequence: TCTTGTTT
tgataagtattttaatttta

SEQ ID NO: 10484 - DNA, 20 bp, Artificial Sequence
  Description of Artificial Sequence: Synthetic oligonucleotide
  Target: SCN10A; (-) strand; PAM type: NNNNGHTT; PAM sequence: CTGAGATT
gaggcggaggttgcggtgag

SEQ ID NO: 10485 - DNA, 20 bp, Artificial Sequence
  Description of Artificial Sequence: Synthetic oligonucleotide
  Target: SCN10A; (-) strand; PAM type: NNNNGHTT; PAM sequence: AATTGCTT
ttgggaggctgagggaggag

SEQ ID NO: 10486 - DNA, 20 bp, Artificial Sequence
  Description of Artificial Sequence: Synthetic oligonucleotide
  Target: SCN10A; (-) strand; PAM type: NNNNGHTT; PAM sequence: AATTGCTT
tcaggagggtgaggcatgag

SEQ ID NO: 10487 - DNA, 20 bp, Artificial Sequence
  Description of Artificial Sequence: Synthetic oligonucleotide
  Target: SCN10A; (-) strand; PAM type: NNNNGHTT; PAM sequence: GATTGCTT
ttgggaggccaaggtgggag

SEQ ID NO: 10488 - DNA, 20 bp, Artificial Sequence
  Description of Artificial Sequence: Synthetic oligonucleotide
  Target: SCN10A; (-) strand; PAM type: NNNNGHTT; PAM sequence: GGAGGATT
aattttgggaggccaaggtg

SEQ ID NO: 10489 - DNA, 20 bp, Artificial Sequence
  Description of Artificial Sequence: Synthetic oligonucleotide
  Target: SCN10A; (-) strand; PAM type: NNNNGHTT; PAM sequence: CCAAGATT
caggttttggtatcaaggtt

SEQ ID NO: 10490 - DNA, 20 bp, Artificial Sequence
  Description of Artificial Sequence: Synthetic oligonucleotide
  Target: SCN10A; (-) strand; PAM type: NNNNGHTT; PAM sequence: CCAGGTTT
cctgactttcattgtccttg

SEQ ID NO: 10491 - DNA, 20 bp, Artificial Sequence
  Description of Artificial Sequence: Synthetic oligonucleotide
  Target: SCN10A; (-) strand; PAM type: NNNNGHTT; PAM sequence: TTAAGATT
ttagtttgctaaaaatttgc

SEQ ID NO: 10492 - DNA, 20 bp, Artificial Sequence
  Description of Artificial Sequence: Synthetic oligonucleotide
  Target: SCN10A; (-) strand; PAM type: NNNNGHTT; PAM sequence: ATTTGCTT
gaagatttagtttgctaaaa

SEQ ID NO: 10493 - DNA, 20 bp, Artificial Sequence
  Description of Artificial Sequence: Synthetic oligonucleotide
  Target: SCN10A; (-) strand; PAM type: NNNNGHTT; PAM sequence: TTTAGTTT
ttttttaatacattggaaga

SEQ ID NO: 10494 - DNA, 20 bp, Artificial Sequence
  Description of Artificial Sequence: Synthetic oligonucleotide
  Target: SCN10A; (-) strand; PAM type: NNNNGHTT; PAM sequence: GGAAGATT
gatgcattttttaatacatt

SEQ ID NO: 10495 - DNA, 20 bp, Artificial Sequence
  Description of Artificial Sequence: Synthetic oligonucleotide
  Target: SCN10A; (-) strand; PAM type: NNNNGHTT; PAM sequence: CCTAGCTT
ctttacattcccagctcaaa

SEQ ID NO: 10496 - DNA, 20 bp, Artificial Sequence
  Description of Artificial Sequence: Synthetic oligonucleotide
  Target: SCN10A; (-) strand; PAM type: NNNNGHTT; PAM sequence: AATTGATT
ttaaagtggtgaattatatt

SEQ ID NO: 10497 - DNA, 20 bp, Artificial Sequence
  Description of Artificial Sequence: Synthetic oligonucleotide
  Target: SCN10A; (-) strand; PAM type: NNNNGHTT; PAM sequence: GGATGTTT
caagaatatttatcatgaat

SEQ ID NO: 10498 - DNA, 20 bp, Artificial Sequence
  Description of Artificial Sequence: Synthetic oligonucleotide
  Target: SCN10A; (-) strand; PAM type: NNNNGHTT; PAM sequence: GCAGGCTT
caccacctctaacaattgtg

SEQ ID NO: 10499 - DNA, 20 bp, Artificial Sequence
  Description of Artificial Sequence: Synthetic oligonucleotide
  Target: SCN10A; (-) strand; PAM type: NNNNGHTT; PAM sequence: CTGGGATT
tgccttggcctcctaaagtg

SEQ ID NO: 10500 - DNA, 20 bp, Artificial Sequence
  Description of Artificial Sequence: Synthetic oligonucleotide
  Target: SCN10A; (-) strand; PAM type: NNNNGHTT; PAM sequence: CGGGGTTT
ctttgtatttttagtagaga

SEQ ID NO: 10501 - DNA, 20 bp, Artificial Sequence
  Description of Artificial Sequence: Synthetic oligonucleotide
  Target: SCN10A; (-) strand; PAM type: NNNNGHTT; PAM sequence: ATGAGTTT
cacatcatgtgaaaataaca

SEQ ID NO: 10502 - DNA, 20 bp, Artificial Sequence
  Description of Artificial Sequence: Synthetic oligonucleotide
  Target: SCN10A; (-) strand; PAM type: NNNNGHTT; PAM sequence: CAATGTTT
attctaataatttatctata

SEQ ID NO: 10503 - DNA, 20 bp, Artificial Sequence
  Description of Artificial Sequence: Synthetic oligonucleotide
  Target: SCN10A; (-) strand; PAM type: NNNNGHTT; PAM sequence: TGAGGTTT
aaagtttaaaaatgtttcca

SEQ ID NO: 10504 - DNA, 20 bp, Artificial Sequence
  Description of Artificial Sequence: Synthetic oligonucleotide
  Target: SCN10A; (-) strand; PAM type: NNNNGHTT; PAM sequence: AAATGTTT
agtctttcaataaagtttaa

SEQ ID NO: 10505 - DNA, 20 bp, Artificial Sequence
  Description of Artificial Sequence: Synthetic oligonucleotide
  Target: SCN10A; (-) strand; PAM type: NNNNGHTT; PAM sequence: TAAAGTTT
gctgtataccagtctttcaa

SEQ ID NO: 10506 - DNA, 20 bp, Artificial Sequence
  Description of Artificial Sequence: Synthetic oligonucleotide
  Target: SCN10A; (-) strand; PAM type: NNNNGHTT; PAM sequence: TATTGTTT
ccacatacacacaaaactgc

SEQ ID NO: 10507 - DNA, 20 bp, Artificial Sequence
  Description of Artificial Sequence: Synthetic oligonucleotide
  Target: SCN10A; (-) strand; PAM type: NNNNGHTT; PAM sequence: GGCAGCTT
ccaatatcagtcttaattat

SEQ ID NO: 10508 - DNA, 20 bp, Artificial Sequence
  Description of Artificial Sequence: Synthetic oligonucleotide
  Target: SCN10A; (-) strand; PAM type: NNNNGHTT; PAM sequence: CATTGCTT
ttccttctctcccaaaatag

SEQ ID NO: 10509 - DNA, 20 bp, Artificial Sequence
  Description of Artificial Sequence: Synthetic oligonucleotide
  Target: SCN10A; (-) strand; PAM type: NNNNGHTT; PAM sequence: GATTGATT
gaactcaataaacacctgtt

SEQ ID NO: 10510 - DNA, 20 bp, Artificial Sequence
  Description of Artificial Sequence: Synthetic oligonucleotide
  Target: SCN10A; (-) strand; PAM type: NNNNGHTT; PAM sequence: TGTTGATT
ataggaactcaataaacacc

SEQ ID NO: 10511 - DNA, 20 bp, Artificial Sequence
  Description of Artificial Sequence: Synthetic oligonucleotide
  Target: SCN10A; (-) strand; PAM type: NNNNGHTT; PAM sequence: TACCGTTT
aaaaaccagagtttcttgtc

SEQ ID NO: 10512 - DNA, 20 bp, Artificial Sequence
  Description of Artificial Sequence: Synthetic oligonucleotide
  Target: SCN10A; (-) strand; PAM type: NNNNGHTT; PAM sequence: CAGAGTTT
ctatcccatgaggcaaaaac

SEQ ID NO: 10513 - DNA, 20 bp, Artificial Sequence
  Description of Artificial Sequence: Synthetic oligonucleotide
  Target: SCN10A; (-) strand; PAM type: NNNNGHTT; PAM sequence: GTTGGATT
ccccaaccacactatctaaa

SEQ ID NO: 10514 - DNA, 20 bp, Artificial Sequence
  Description of Artificial Sequence: Synthetic oligonucleotide
  Target: SCN10A; (-) strand; PAM type: NNNNGHTT; PAM sequence: TGAAGTTT
acttcttggctttgggcctt

SEQ ID NO: 10515 - DNA, 20 bp, Artificial Sequence
  Description of Artificial Sequence: Synthetic oligonucleotide
  Target: SCN10A; (-) strand; PAM type: NNNNGHTT; PAM sequence: CTTGGCTT
tcacacataacagagaactt

SEQ ID NO: 10516 - DNA, 20 bp, Artificial Sequence
  Description of Artificial Sequence: Synthetic oligonucleotide
  Target: SCN10A; (-) strand; PAM type: NNNNGHTT; PAM sequence: ACTGGTTT
catttgttacaaataacttc

SEQ ID NO: 10517 - DNA, 20 bp, Artificial Sequence
  Description of Artificial Sequence: Synthetic oligonucleotide
  Target: SCN10A; (-) strand; PAM type: NNNNGHTT; PAM sequence: CAGAGTTT
cacacacacacacacacaca

SEQ ID NO: 10518 - DNA, 20 bp, Artificial Sequence
  Description of Artificial Sequence: Synthetic oligonucleotide
  Target: SCN10A; (-) strand; PAM type: NNNNGHTT; PAM sequence: GAAAGCTT
aaactggagcagattgaaca

SEQ ID NO: 10519 - DNA, 20 bp, Artificial Sequence
  Description of Artificial Sequence: Synthetic oligonucleotide
  Target: SCN10A; (-) strand; PAM type: NNNNGHTT; PAM sequence: AGCAGATT
ttcagttttcagaaaactgg

SEQ ID NO: 10520 - DNA, 20 bp, Artificial Sequence
  Description of Artificial Sequence: Synthetic oligonucleotide
  Target: SCN10A; (-) strand; PAM type: NNNNGHTT; PAM sequence: TTCAGTTT
actttattttcaggacagtt

SEQ ID NO: 10521 - DNA, 20 bp, Artificial Sequence
  Description of Artificial Sequence: Synthetic oligonucleotide
  Target: SCN10A; (-) strand; PAM type: NNNNGHTT; PAM sequence: GACAGTTT
ttaatagactttattttcag

SEQ ID NO: 10522 - DNA, 20 bp, Artificial Sequence
  Description of Artificial Sequence: Synthetic oligonucleotide
  Target: SCN10A; (-) strand; PAM type: NNNNGHTT; PAM sequence: CCTGGTTT
caccgccagctggtcagttt

SEQ ID NO: 10523 - DNA, 20 bp, Artificial Sequence
  Description of Artificial Sequence: Synthetic oligonucleotide
  Target: SCN10A; (-) strand; PAM type: NNNNGHTT; PAM sequence: GTCAGTTT
agaaaaatcaccgccagctg

SEQ ID NO: 10524 - DNA, 20 bp, Artificial Sequence
  Description of Artificial Sequence: Synthetic oligonucleotide
  Target: SCN10A; (-) strand; PAM type: NNNNGHTT; PAM sequence: TTGTGTTT
ccctctgcctctttgcgttt

SEQ ID NO: 10525 - DNA, 20 bp, Artificial Sequence
  Description of Artificial Sequence: Synthetic oligonucleotide
  Target: SCN10A; (-) strand; PAM type: NNNNGHTT; PAM sequence: TTGCGTTT
caccttttccctctgcctct

SEQ ID NO: 10526 - DNA, 20 bp, Artificial Sequence
  Description of Artificial Sequence: Synthetic oligonucleotide
  Target: SCN10A; (-) strand; PAM type: NNNNGHTT; PAM sequence: CTTAGATT
ccacttccctcatgacctag

SEQ ID NO: 10527 - DNA, 20 bp, Artificial Sequence
  Description of Artificial Sequence: Synthetic oligonucleotide
  Target: SCN10A; (-) strand; PAM type: NNNNGHTT; PAM sequence: CCTAGCTT
ctattccacttccctcatga

SEQ ID NO: 10528 - DNA, 20 bp, Artificial Sequence
  Description of Artificial Sequence: Synthetic oligonucleotide
  Target: SCN10A; (-) strand; PAM type: NNNNGHTT; PAM sequence: CGCTGATT
atgctaccctgtccccacct

SEQ ID NO: 10529 - DNA, 20 bp, Artificial Sequence
  Description of Artificial Sequence: Synthetic oligonucleotide
  Target: SCN10A; (-) strand; PAM type: NNNNGHTT; PAM sequence: ACAGGATT
ttacttcacagtctgcccct

SEQ ID NO: 10530 - DNA, 20 bp, Artificial Sequence
  Description of Artificial Sequence: Synthetic oligonucleotide
  Target: SCN10A; (-) strand; PAM type: NNNNGHTT; PAM sequence: GCAAGTTT
tcccaaacaaccaaaaatag

SEQ ID NO: 10531 - DNA, 20 bp, Artificial Sequence
  Description of Artificial Sequence: Synthetic oligonucleotide
  Target: SCN10A; (-) strand; PAM type: NNNNGHTT; PAM sequence: TAGTGTTT
cacttggggaagcagaagct

SEQ ID NO: 10532 - DNA, 20 bp, Artificial Sequence
  Description of Artificial Sequence: Synthetic oligonucleotide
  Target: SCN10A; (-) strand; PAM type: NNNNGHTT; PAM sequence: AGAAGCTT
tctgctacacttggggaagc

SEQ ID NO: 10533 - DNA, 20 bp, Artificial Sequence
  Description of Artificial Sequence: Synthetic oligonucleotide
  Target: SCN10A; (-) strand; PAM type: NNNNGHTT; PAM sequence: CCGAGATT
gaggcggagcttacagtgag

SEQ ID NO: 10534 - DNA, 20 bp, Artificial Sequence
  Description of Artificial Sequence: Synthetic oligonucleotide
  Target: SCN10A; (-) strand; PAM type: NNNNGHTT; PAM sequence: CGGAGCTT
aatggcgtgaacctgggagg

SEQ ID NO: 10535 - DNA, 20 bp, Artificial Sequence
  Description of Artificial Sequence: Synthetic oligonucleotide
  Target: SCN10A; (-) strand; PAM type: NNNNGHTT; PAM sequence: GTTAGTTT
cataccctggcaggcccaca

SEQ ID NO: 10536 - DNA, 20 bp, Artificial Sequence
  Description of Artificial Sequence: Synthetic oligonucleotide
  Target: SCN10A; (-) strand; PAM type: NNNNGHTT; PAM sequence: GACAGATT
ttaaatcacatttttagaag

SEQ ID NO: 10537 - DNA, 20 bp, Artificial Sequence
  Description of Artificial Sequence: Synthetic oligonucleotide
  Target: SCN10A; (-) strand; PAM type: NNNNGHTT; PAM sequence: TCCAGTTT
tctttaatattggctactaa

SEQ ID NO: 10538 - DNA, 20 bp, Artificial Sequence
  Description of Artificial Sequence: Synthetic oligonucleotide
  Target: SCN10A; (-) strand; PAM type: NNNNGHTT; PAM sequence: TCCAGATT
ttttccaaaaaagtcagaaa

SEQ ID NO: 10539 - DNA, 20 bp, Artificial Sequence
  Description of Artificial Sequence: Synthetic oligonucleotide
  Target: SCN10A; (-) strand; PAM type: NNNNGHTT; PAM sequence: GATCGCTT
ttgggaggccgaggcaggca

SEQ ID NO: 10540 - DNA, 20 bp, Artificial Sequence
  Description of Artificial Sequence: Synthetic oligonucleotide
  Target: SCN10A; (-) strand; PAM type: NNNNGHTT; PAM sequence: GGATGTTT
cagtgcacaactcctgggag

SEQ ID NO: 10541 - DNA, 20 bp, Artificial Sequence
  Description of Artificial Sequence: Synthetic oligonucleotide
  Target: SCN10A; (-) strand; PAM type: NNNNGHTT; PAM sequence: CCTGGATT
gagcccctgaacttggcgta

SEQ ID NO: 10542 - DNA, 20 bp, Artificial Sequence
  Description of Artificial Sequence: Synthetic oligonucleotide
  Target: SCN10A; (-) strand; PAM type: NNNNGHTT; PAM sequence: ATCTGCTT
gcaacgagactctaggacag

SEQ ID NO: 10543 - DNA, 20 bp, Artificial Sequence
  Description of Artificial Sequence: Synthetic oligonucleotide
  Target: SCN10A; (-) strand; PAM type: NNNNGHTT; PAM sequence: CACGGCTT
aaagaggcctgaagaaatgt

SEQ ID NO: 10544 - DNA, 20 bp, Artificial Sequence
  Description of Artificial Sequence: Synthetic oligonucleotide
  Target: SCN10A; (-) strand; PAM type: NNNNGHTT; PAM sequence: GGAAGCTT
aggtctccaggccatctgga

SEQ ID NO: 10545 - DNA, 20 bp, Artificial Sequence
  Description of Artificial Sequence: Synthetic oligonucleotide
  Target: SCN10A; (-) strand; PAM type: NNNNGHTT; PAM sequence: GTCAGATT
caggtttgtcagccaaacct

SEQ ID NO: 10546 - DNA, 20 bp, Artificial Sequence
  Description of Artificial Sequence: Synthetic oligonucleotide
  Target: SCN10A; (-) strand; PAM type: NNNNGHTT; PAM sequence: ACAGGTTT
cacccacttttatcagagcc

SEQ ID NO: 10547 - DNA, 20 bp, Artificial Sequence
  Description of Artificial Sequence: Synthetic oligonucleotide
  Target: SCN10A; (-) strand; PAM type: NNNNGHTT; PAM sequence: CTCTGATT
ccagcctcaaggaagtcatt

SEQ ID NO: 10548 - DNA, 20 bp, Artificial Sequence
  Description of Artificial Sequence: Synthetic oligonucleotide
  Target: SCN10A; (-) strand; PAM type: NNNNGHTT; PAM sequence: AGTCGTTT
tcacaacaaccctgagagat

SEQ ID NO: 10549 - DNA, 20 bp, Artificial Sequence
  Description of Artificial Sequence: Synthetic oligonucleotide
  Target: SCN10A; (-) strand; PAM type: NNNNGHTT; PAM sequence: CCCAGCTT
tggagacttgggtctgtggc

SEQ ID NO: 10550 - DNA, 20 bp, Artificial Sequence
  Description of Artificial Sequence: Synthetic oligonucleotide
  Target: SCN10A; (-) strand; PAM type: NNNNGHTT; PAM sequence: CCCAGATT
atggcttggggaaactccca

SEQ ID NO: 10551 - DNA, 20 bp, Artificial Sequence
  Description of Artificial Sequence: Synthetic oligonucleotide
  Target: SCN10A; (-) strand; PAM type: NNNNGHTT; PAM sequence: GATGGCTT
cttggtaatgtttttctctt

SEQ ID NO: 10552 - DNA, 20 bp, Artificial Sequence
  Description of Artificial Sequence: Synthetic oligonucleotide
  Target: SCN10A; (-) strand; PAM type: NNNNGHTT; PAM sequence: TAATGTTT
gctgcggagcttccgcttgg

SEQ ID NO: 10553 - DNA, 20 bp, Artificial Sequence
  Description of Artificial Sequence: Synthetic oligonucleotide
  Target: SCN10A; (-) strand; PAM type: NNNNGHTT; PAM sequence: TTCCGCTT
gcctgtctgtgctgcggagc

SEQ ID NO: 10554 - DNA, 20 bp, Artificial Sequence
  Description of Artificial Sequence: Synthetic oligonucleotide
  Target: SCN10A; (-) strand; PAM type: NNNNGHTT; PAM sequence: CGGAGCTT
agggaagcctgtctgtgctg

SEQ ID NO: 10555 - DNA, 20 bp, Artificial Sequence
  Description of Artificial Sequence: Synthetic oligonucleotide
  Target: SCN10A; (-) strand; PAM type: NNNNGHTT; PAM sequence: GCTTGTTT
cagatcccactgtgatgaaa

SEQ ID NO: 10556 - DNA, 20 bp, Artificial Sequence
  Description of Artificial Sequence: Synthetic oligonucleotide
  Target: SCN10A; (-) strand; PAM type: NNNNGHTT; PAM sequence: GAAAGCTT
cccacagatcccactgtgat

SEQ ID NO: 10557 - DNA, 20 bp, Artificial Sequence
  Description of Artificial Sequence: Synthetic oligonucleotide
  Target: SCN10A; (-) strand; PAM type: NNNNGHTT; PAM sequence: AAAGGATT
catagcaactgaacaaaaca

SEQ ID NO: 10558 - DNA, 20 bp, Artificial Sequence
  Description of Artificial Sequence: Synthetic oligonucleotide
  Target: SCN10A; (-) strand; PAM type: NNNNGHTT; PAM sequence: ATCCGCTT
taataatgatcttaaagact

SEQ ID NO: 10559 - DNA, 20 bp, Artificial Sequence
  Description of Artificial Sequence: Synthetic oligonucleotide
  Target: SCN10A; (-) strand; PAM type: NNNNGHTT; PAM sequence: ACACGTTT
tctgtgatgtcccacaaccc

SEQ ID NO: 10560 - DNA, 20 bp, Artificial Sequence
  Description of Artificial Sequence: Synthetic oligonucleotide
  Target: SCN10A; (-) strand; PAM type: NNNNGHTT; PAM sequence: CTGGGATT
taagctaggaaatgtctggg

SEQ ID NO: 10561 - DNA, 20 bp, Artificial Sequence
  Description of Artificial Sequence: Synthetic oligonucleotide
  Target: SCN10A; (-) strand; PAM type: NNNNGHTT; PAM sequence: CCAAGCTT
aggaaggatgcattatttgt

SEQ ID NO: 10562 - DNA, 20 bp, Artificial Sequence
  Description of Artificial Sequence: Synthetic oligonucleotide
  Target: SCN10A; (-) strand; PAM type: NNNNGHTT; PAM sequence: CGTTGCTT
gaaaagcacctgaccctggt

SEQ ID NO: 10563 - DNA, 20 bp, Artificial Sequence
  Description of Artificial Sequence: Synthetic oligonucleotide
  Target: SCN10A; (-) strand; PAM type: NNNNGHTT; PAM sequence: GTCTGTTT
ctccataagaaggatgcatt

SEQ ID NO: 10564 - DNA, 20 bp, Artificial Sequence
  Description of Artificial Sequence: Synthetic oligonucleotide
  Target: SCN10A; (-) strand; PAM type: NNNNGHTT; PAM sequence: GCCTGTTT
gaaagtcacttaaactctca

SEQ ID NO: 10565 - DNA, 20 bp, Artificial Sequence
  Description of Artificial Sequence: Synthetic oligonucleotide
  Target: SCN10A; (-) strand; PAM type: NNNNGHTT; PAM sequence: AGGTGCTT
cttggtgcctgcaatgagtc

SEQ ID NO: 10566 - DNA, 20 bp, Artificial Sequence
  Description of Artificial Sequence: Synthetic oligonucleotide
  Target: SCN10A; (-) strand; PAM type: NNNNGHTT; PAM sequence: ATGTGCTT
ttttttaaagcaagaaagtc

SEQ ID NO: 10567 - DNA, 20 bp, Artificial Sequence
  Description of Artificial Sequence: Synthetic oligonucleotide
  Target: SCN10A; (-) strand; PAM type: NNNNGHTT; PAM sequence: GAATGCTT
ggaaaaatggaaagagaaga

SEQ ID NO: 10568 - DNA, 20 bp, Artificial Sequence
  Description of Artificial Sequence: Synthetic oligonucleotide
  Target: SCN10A; (-) strand; PAM type: NNNNGHTT; PAM sequence: TCATGTTT
catggtggaatcagcatgcc

SEQ ID NO: 10569 - DNA, 20 bp, Artificial Sequence
  Description of Artificial Sequence: Synthetic oligonucleotide
  Target: SCN10A; (-) strand; PAM type: NNNNGHTT; PAM sequence: TCCAGCTT
agaactgtctggctttgggg

SEQ ID NO: 10570 - DNA, 20 bp, Artificial Sequence
  Description of Artificial Sequence: Synthetic oligonucleotide
  Target: SCN10A; (-) strand; PAM type: NNNNGHTT; PAM sequence: TCTGGCTT
tactggattcaccagaactg

SEQ ID NO: 10571 - DNA, 20 bp, Artificial Sequence
  Description of Artificial Sequence: Synthetic oligonucleotide
  Target: SCN10A; (-) strand; PAM type: NNNNGHTT; PAM sequence: ACTGGATT
caccaagctggaggtgacct

SEQ ID NO: 10572 - DNA, 20 bp, Artificial Sequence
  Description of Artificial Sequence: Synthetic oligonucleotide
  Target: SCN10A; (-) strand; PAM type: NNNNGHTT; PAM sequence: GCCCGCTT
ccagacagaccggctgccaa

SEQ ID NO: 10573 - DNA, 20 bp, Artificial Sequence
  Description of Artificial Sequence: Synthetic oligonucleotide
  Target: SCN10A; (-) strand; PAM type: NNNNGHTT; PAM sequence: TTGAGTTT
atcttcccaagatcatagag

SEQ ID NO: 10574 - DNA, 20 bp, Artificial Sequence
  Description of Artificial Sequence: Synthetic oligonucleotide
  Target: SCN10A; (-) strand; PAM type: NNNNGHTT; PAM sequence: CATGGATT
aataatactcagatgcttct

SEQ ID NO: 10575 - DNA, 20 bp, Artificial Sequence
  Description of Artificial Sequence: Synthetic oligonucleotide
  Target: SCN10A; (-) strand; PAM type: NNNNGHTT; PAM sequence: AGATGCTT
caggaatagtaataatactc

SEQ ID NO: 10576 - DNA, 20 bp, Artificial Sequence
  Description of Artificial Sequence: Synthetic oligonucleotide
  Target: SCN10A; (-) strand; PAM type: NNNNGHTT; PAM sequence: ACTGGATT
cttaacaagatacaatccat

SEQ ID NO: 10577 - DNA, 20 bp, Artificial Sequence
  Description of Artificial Sequence: Synthetic oligonucleotide
  Target: SCN10A; (-) strand; PAM type: NNNNGHTT; PAM sequence: TGCTGCTT
ggcatctagtttagacatca

SEQ ID NO: 10578 - DNA, 20 bp, Artificial Sequence
  Description of Artificial Sequence: Synthetic oligonucleotide
  Target: SCN10A; (-) strand; PAM type: NNNNGHTT; PAM sequence: TCTAGTTT
gtcggaacttttctttggca

SEQ ID NO: 10579 - DNA, 20 bp, Artificial Sequence
  Description of Artificial Sequence: Synthetic oligonucleotide
  Target: SCN10A; (-) strand; PAM type: NNNNGHTT; PAM sequence: CCACGATT
atgaccacaattaacagtag

SEQ ID NO: 10580 - DNA, 20 bp, Artificial Sequence
  Description of Artificial Sequence: Synthetic oligonucleotide
  Target: SCN10A; (-) strand; PAM type: NNNNGHTT; PAM sequence: GTCTGTTT
taaagacaatctttggactt

SEQ ID NO: 10581 - DNA, 20 bp, Artificial Sequence
  Description of Artificial Sequence: Synthetic oligonucleotide
  Target: SCN10A; (-) strand; PAM type: NNNNGHTT; PAM sequence: AATGGCTT
acccaggctgagctggtggg

SEQ ID NO: 10582 - DNA, 20 bp, Artificial Sequence
  Description of Artificial Sequence: Synthetic oligonucleotide
  Target: SCN10A; (-) strand; PAM type: NNNNGHTT; PAM sequence: TTGGGCTT
gaagctcaagacaattctct

SEQ ID NO: 10583 - DNA, 20 bp, Artificial Sequence
  Description of Artificial Sequence: Synthetic oligonucleotide
  Target: SCN10A; (-) strand; PAM type: NNNNGHTT; PAM sequence: CTGGGATT
ttgtctcagaagtatctgat

SEQ ID NO: 10584 - DNA, 20 bp, Artificial Sequence
  Description of Artificial Sequence: Synthetic oligonucleotide
  Target: SCN10A; (-) strand; PAM type: NNNNGHTT; PAM sequence: ACCAGCTT
agaagtgcccaccctgcttg

SEQ ID NO: 10585 - DNA, 20 bp, Artificial Sequence
  Description of Artificial Sequence: Synthetic oligonucleotide
  Target: SCN10A; (-) strand; PAM type: NNNNGHTT; PAM sequence: CCCTGCTT
agtctgaacagaagtgccca

SEQ ID NO: 10586 - DNA, 20 bp, Artificial Sequence
  Description of Artificial Sequence: Synthetic oligonucleotide
  Target: SCN10A; (-) strand; PAM type: NNNNGHTT; PAM sequence: AGCAGTTT
cagtaaaaatatgtaatgtc

SEQ ID NO: 10587 - DNA, 20 bp, Artificial Sequence
  Description of Artificial Sequence: Synthetic oligonucleotide
  Target: SCN10A; (-) strand; PAM type: NNNNGHTT; PAM sequence: TCAGGTTT
aaattgggtctattcacagt

SEQ ID NO: 10588 - DNA, 20 bp, Artificial Sequence
  Description of Artificial Sequence: Synthetic oligonucleotide
  Target: SCN10A; (-) strand; PAM type: NNNNGHTT; PAM sequence: GCCAGATT
gaatataatatagaaacaca

SEQ ID NO: 10589 - DNA, 20 bp, Artificial Sequence
  Description of Artificial Sequence: Synthetic oligonucleotide
  Target: SCN10A; (-) strand; PAM type: NNNNGHTT; PAM sequence: CAGAGATT
aggtggacttgcagatatgc

SEQ ID NO: 10590 - DNA, 20 bp, Artificial Sequence
  Description of Artificial Sequence: Synthetic oligonucleotide
  Target: SCN10A; (-) strand; PAM type: NNNNGHTT; PAM sequence: GCATGTTT
aaagccgcgagataattaaa

SEQ ID NO: 10591 - DNA, 20 bp, Artificial Sequence
  Description of Artificial Sequence: Synthetic oligonucleotide
  Target: SCN10A; (-) strand; PAM type: NNNNGHTT; PAM sequence: GTCAGATT
tgaatttggaagcagttaaa

SEQ ID NO: 10592 - DNA, 20 bp, Artificial Sequence
  Description of Artificial Sequence: Synthetic oligonucleotide
  Target: SCN10A; (-) strand; PAM type: NNNNGHTT; PAM sequence: ACTGGTTT
gtccccagagccaaatgaac

SEQ ID NO: 10593 - DNA, 20 bp, Artificial Sequence
  Description of Artificial Sequence: Synthetic oligonucleotide
  Target: SCN10A; (-) strand; PAM type: NNNNGHTT; PAM sequence: GAATGCTT
acacagagaagctaaggtga

SEQ ID NO: 10594 - DNA, 20 bp, Artificial Sequence
  Description of Artificial Sequence: Synthetic oligonucleotide
  Target: SCN10A; (-) strand; PAM type: NNNNGHTT; PAM sequence: ATGAGATT
agagatggttttttagggct

SEQ ID NO: 10595 - DNA, 20 bp, Artificial Sequence
  Description of Artificial Sequence: Synthetic oligonucleotide
  Target: SCN10A; (-) strand; PAM type: NNNNGHTT; PAM sequence: GATGGTTT
ttggtgggaattggcataga

SEQ ID NO: 10596 - DNA, 20 bp, Artificial Sequence
  Description of Artificial Sequence: Synthetic oligonucleotide
  Target: SCN10A; (-) strand; PAM type: NNNNGHTT; PAM sequence: TGGAGATT
aacacagttacacatccaca

SEQ ID NO: 10597 - DNA, 20 bp, Artificial Sequence
  Description of Artificial Sequence: Synthetic oligonucleotide
  Target: SCN10A; (-) strand; PAM type: NNNNGHTT; PAM sequence: TGTTGTTT
atgtattatgctttatcagt

SEQ ID NO: 10598 - DNA, 20 bp, Artificial Sequence
  Description of Artificial Sequence: Synthetic oligonucleotide
  Target: SCN10A; (-) strand; PAM type: NNNNGHTT; PAM sequence: TTATGCTT
tcattctttttcacaatgta

SEQ ID NO: 10599 - DNA, 20 bp, Artificial Sequence
  Description of Artificial Sequence: Synthetic oligonucleotide
  Target: SCN10A; (-) strand; PAM type: NNNNGHTT; PAM sequence: TCCAGTTT
ctggtgcacccccctcccac

SEQ ID NO: 10600 - DNA, 20 bp, Artificial Sequence
  Description of Artificial Sequence: Synthetic oligonucleotide
  Target: SCN10A; (-) strand; PAM type: NNNNGHTT; PAM sequence: AACTGATT
ggcacacagttatttctcta

SEQ ID NO: 10601 - DNA, 20 bp, Artificial Sequence
  Description of Artificial Sequence: Synthetic oligonucleotide
  Target: SCN10A; (-) strand; PAM type: NNNNGHTT; PAM sequence: AAAAGCTT
tttccaagccttgtagtgag

SEQ ID NO: 10602 - DNA, 20 bp, Artificial Sequence
  Description of Artificial Sequence: Synthetic oligonucleotide
  Target: SCN10A; (-) strand; PAM type: NNNNGHTT; PAM sequence: CAAAGTTT
aaaataaatttcaaatgcac

SEQ ID NO: 10603 - DNA, 20 bp, Artificial Sequence
  Description of Artificial Sequence: Synthetic oligonucleotide
  Target: SCN10A; (-) strand; PAM type: NNNNGHTT; PAM sequence: CAGTGATT
tgtagtttctaaaatccagt

SEQ ID NO: 10604 - DNA, 20 bp, Artificial Sequence
  Description of Artificial Sequence: Synthetic oligonucleotide
  Target: SCN10A; (-) strand; PAM type: NNNNGHTT; PAM sequence: TGTAGTTT
gctttgccagtttggacatc

SEQ ID NO: 10605 - DNA, 20 bp, Artificial Sequence
  Description of Artificial Sequence: Synthetic oligonucleotide
  Target: SCN10A; (-) strand; PAM type: NNNNGHTT; PAM sequence: GCCAGTTT
tctttagagaactatgcttt

SEQ ID NO: 10606 - DNA, 20 bp, Artificial Sequence
  Description of Artificial Sequence: Synthetic oligonucleotide
  Target: SCN10A; (-) strand; PAM type: NNNNGHTT; PAM sequence: CTATGCTT
gtgccaacttctttagagaa

SEQ ID NO: 10607 - DNA, 20 bp, Artificial Sequence
  Description of Artificial Sequence: Synthetic oligonucleotide
  Target: SCN10A; (-) strand; PAM type: NNNNGHTT; PAM sequence: TGTTGATT
cttttgttccaaacagggat

SEQ ID NO: 10608 - DNA, 20 bp, Artificial Sequence
  Description of Artificial Sequence: Synthetic oligonucleotide
  Target: SCN10A; (-) strand; PAM type: NNNNGHTT; PAM sequence: CAGGGATT
gttcttgcttttgttccaaa

SEQ ID NO: 10609 - DNA, 20 bp, Artificial Sequence
  Description of Artificial Sequence: Synthetic oligonucleotide
  Target: SCN10A; (-) strand; PAM type: NNNNGHTT; PAM sequence: TCTTGCTT
caaaataggtccagggaagt

SEQ ID NO: 10610 - DNA, 20 bp, Artificial Sequence
  Description of Artificial Sequence: Synthetic oligonucleotide
  Target: SCN10A; (-) strand; PAM type: NNNNGHTT; PAM sequence: CTGTGCTT
tcctcattcatgactacttc

SEQ ID NO: 10611 - DNA, 20 bp, Artificial Sequence
  Description of Artificial Sequence: Synthetic oligonucleotide
  Target: SCN10A; (-) strand; PAM type: NNNNGHTT; PAM sequence: GGCTGCTT
tcccatcatgcctcacaggt

SEQ ID NO: 10612 - DNA, 20 bp, Artificial Sequence
  Description of Artificial Sequence: Synthetic oligonucleotide
  Target: SCN10A; (-) strand; PAM type: NNNNGHTT; PAM sequence: GGCTGTTT
atcaagttcaacaatgtcaa

SEQ ID NO: 10613 - DNA, 20 bp, Artificial Sequence
  Description of Artificial Sequence: Synthetic oligonucleotide
  Target: SCN10A; (-) strand; PAM type: NNNNGHTT; PAM sequence: TCATGTTT
cttttgaggtggggccatgg

SEQ ID NO: 10614 - DNA, 20 bp, Artificial Sequence
  Description of Artificial Sequence: Synthetic oligonucleotide
  Target: SCN10A; (-) strand; PAM type: NNNNGHTT; PAM sequence: TGAAGATT
tctgggagaataagagagac

SEQ ID NO: 10615 - DNA, 20 bp, Artificial Sequence
  Description of Artificial Sequence: Synthetic oligonucleotide
  Target: SCN10A; (-) strand; PAM type: NNNNGHTT; PAM sequence: GTTTGTTT
gggggagtttttgtttgttt

SEQ ID NO: 10616 - DNA, 20 bp, Artificial Sequence
  Description of Artificial Sequence: Synthetic oligonucleotide
  Target: SCN10A; (-) strand; PAM type: NNNNGHTT; PAM sequence: GTTTGTTT
gtttgggggagtttttgttt

SEQ ID NO: 10617 - DNA, 20 bp, Artificial Sequence
  Description of Artificial Sequence: Synthetic oligonucleotide
  Target: SCN10A; (-) strand; PAM type: NNNNGHTT; PAM sequence: GTTTGTTT
ttgtgtttgggggagttttt

SEQ ID NO: 10618 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
gtttttgtgtttgggggagt

SEQ ID NO: 10619 - DNA, 20 bp, Artificial Sequence
  Description of Artificial Sequence: Synthetic oligonucleotide
  Target: SCN10A; (-) strand; PAM type: NNNNGHTT; PAM sequence: GGGAGTTT
tttttggtttttgtgtttgg

SEQ ID NO: 10620 - DNA, 20 bp, Artificial Sequence
  Description of Artificial Sequence: Synthetic oligonucleotide
  Target: SCN10A; (-) strand; PAM type: NNNNGHTT; PAM sequence: TTGTGTTT
gaaagaagactttttggttt

SEQ ID NO: 10621 - DNA, 20 bp, Artificial Sequence
  Description of Artificial Sequence: Synthetic oligonucleotide
  Target: SCN10A; (-) strand; PAM type: NNNNGHTT; PAM sequence: TTTGGTTT
ggagaattgaaagaagactt

SEQ ID NO: 10622 - DNA, 20 bp, Artificial Sequence
  Description of Artificial Sequence: Synthetic oligonucleotide
  Target: SCN10A; (-) strand; PAM type: NNNNGHTT; PAM sequence: AGAAGTTT
gtgtacagacaattttttca

SEQ ID NO: 10623 - DNA, 20 bp, Artificial Sequence
  Description of Artificial Sequence: Synthetic oligonucleotide
  Target: SCN10A; (-) strand; PAM type: NNNNGHTT; PAM sequence: AGGGGCTT
gtaggcagaggtcatattga

SEQ ID NO: 10624 - DNA, 20 bp, Artificial Sequence
  Description of Artificial Sequence: Synthetic oligonucleotide
  Target: SCN10A; (-) strand; PAM type: NNNNGHTT; PAM sequence: AGAGGATT
tctttggtgatctaagcaaa

SEQ ID NO: 10625 - DNA, 20 bp, Artificial Sequence
  Description of Artificial Sequence: Synthetic oligonucleotide
  Target: SCN10A; (-) strand; PAM type: NNNNGHTT; PAM sequence: AGGGGCTT
aatgaaacatgaaaaggtcc

SEQ ID NO: 10626 - DNA, 20 bp, Artificial Sequence
  Description of Artificial Sequence: Synthetic oligonucleotide
  Target: SCN10A; (-) strand; PAM type: NNNNGHTT; PAM sequence: AAATGTTT
agacacagttctaacaaact

SEQ ID NO: 10627 - DNA, 20 bp, Artificial Sequence
  Description of Artificial Sequence: Synthetic oligonucleotide
  Target: SCN10A; (-) strand; PAM type: NNNNGHTT; PAM sequence: AGCAGTTT
tgtatatatatatatttgaa

SEQ ID NO: 10628 - DNA, 20 bp, Artificial Sequence
  Description of Artificial Sequence: Synthetic oligonucleotide
  Target: SCN10A; (-) strand; PAM type: NNNNGHTT; PAM sequence: TTGGGTTT
tgagttgagtctgggatata

SEQ ID NO: 10629 - DNA, 20 bp, Artificial Sequence
  Description of Artificial Sequence: Synthetic oligonucleotide
  Target: SCN10A; (-) strand; PAM type: NNNNGHTT; PAM sequence: AGAAGATT
ctttaatggggaaagatgaa

SEQ ID NO: 10630 - DNA, 20 bp, Artificial Sequence
  Description of Artificial Sequence: Synthetic oligonucleotide
  Target: SCN10A; (-) strand; PAM type: NNNNGHTT; PAM sequence: GGGGGCTT
ggagcattttaggggaagaa

SEQ ID NO: 10631 - DNA, 20 bp, Artificial Sequence
  Description of Artificial Sequence: Synthetic oligonucleotide
  Target: SCN10A; (-) strand; PAM type: NNNNGHTT; PAM sequence: ATAAGATT
atgagagctatctaaggggc

SEQ ID NO: 10632 - DNA, 20 bp, Artificial Sequence
  Description of Artificial Sequence: Synthetic oligonucleotide
  Target: SCN10A; (-) strand; PAM type: NNNNGHTT; PAM sequence: CAGTGCTT
ggaagccaagtacaagatgg

SEQ ID NO: 10633 - DNA, 20 bp, Artificial Sequence
  Description of Artificial Sequence: Synthetic oligonucleotide
  Target: SCN10A; (-) strand; PAM type: NNNNGHTT; PAM sequence: AAAGGATT
aagaggagtgaggtgccatt

SEQ ID NO: 10634 - DNA, 20 bp, Artificial Sequence
  Description of Artificial Sequence: Synthetic oligonucleotide
  Target: SCN10A; (-) strand; PAM type: NNNNGHTT; PAM sequence: GTAAGATT
aggatactaagtgaaatatg

SEQ ID NO: 10635 - DNA, 20 bp, Artificial Sequence
  Description of Artificial Sequence: Synthetic oligonucleotide
  Target: SCN10A; (-) strand; PAM type: NNNNGHTT; PAM sequence: GTGAGCTT
ccagaagctgggtcacagca

SEQ ID NO: 10636 - DNA, 20 bp, Artificial Sequence
  Description of Artificial Sequence: Synthetic oligonucleotide
  Target: SCN10A; (-) strand; PAM type: NNNNGHTT; PAM sequence: CTGAGATT
ttctatgcttggcatgcaag

SEQ ID NO: 10637 - DNA, 20 bp, Artificial Sequence
  Description of Artificial Sequence: Synthetic oligonucleotide
  Target: SCN10A; (-) strand; PAM type: NNNNGHTT; PAM sequence: CTATGCTT
actcaaagcatgtgaacctt

SEQ ID NO: 10638 - DNA, 20 bp, Artificial Sequence
  Description of Artificial Sequence: Synthetic oligonucleotide
  Target: SCN10A; (-) strand; PAM type: NNNNGHTT; PAM sequence: AGGAGTTT
aaagtttggcccaaaccaac

SEQ ID NO: 10639 - DNA, 20 bp, Artificial Sequence
  Description of Artificial Sequence: Synthetic oligonucleotide
  Target: SCN10A; (-) strand; PAM type: NNNNGHTT; PAM sequence: GAAAGTTT
ttaagagggattatgcttaa

SEQ ID NO: 10640 - DNA, 20 bp, Artificial Sequence
  Description of Artificial Sequence: Synthetic oligonucleotide
  Target: SCN10A; (-) strand; PAM type: NNNNGHTT; PAM sequence: TTATGCTT
ggccacctctttaagaggga

SEQ ID NO: 10641 - DNA, 20 bp, Artificial Sequence
  Description of Artificial Sequence: Synthetic oligonucleotide
  Target: SCN10A; (-) strand; PAM type: NNNNGHTT; PAM sequence: GAGGGATT
tataaaggccacctctttaa

SEQ ID NO: 10642 - DNA, 20 bp, Artificial Sequence
  Description of Artificial Sequence: Synthetic oligonucleotide
  Target: SCN10A; (-) strand; PAM type: NNNNGHTT; PAM sequence: ATAGGATT
ttcatgctgccagagtcgta

SEQ ID NO: 10643 - DNA, 20 bp, Artificial Sequence
  Description of Artificial Sequence: Synthetic oligonucleotide
  Target: SCN10A; (-) strand; PAM type: NNNNGHTT; PAM sequence: GGATGCTT
acacacatgagacacctgaa

SEQ ID NO: 10644 - DNA, 20 bp, Artificial Sequence
  Description of Artificial Sequence: Synthetic oligonucleotide
  Target: SCN10A; (-) strand; PAM type: NNNNGHTT; PAM sequence: CAAAGTTT
ttaggttaaataaaagaggt

SEQ ID NO: 10645 - DNA, 20 bp, Artificial Sequence
  Description of Artificial Sequence: Synthetic oligonucleotide
  Target: SCN10A; (-) strand; PAM type: NNNNGHTT; PAM sequence: TGATGTTT
aagaaaggccagagaaacaa

SEQ ID NO: 10646 - DNA, 20 bp, Artificial Sequence
  Description of Artificial Sequence: Synthetic oligonucleotide
  Target: SCN10A; (-) strand; PAM type: NNNNGHTT; PAM sequence: GTCTGTTT
atctatgagggcggagatgt

SEQ ID NO: 10647 - DNA, 20 bp, Artificial Sequence
  Description of Artificial Sequence: Synthetic oligonucleotide
  Target: SCN10A; (-) strand; PAM type: NNNNGHTT; PAM sequence: TTATGATT
atactcatcacatttggcta

SEQ ID NO: 10648 - DNA, 20 bp, Artificial Sequence
  Description of Artificial Sequence: Synthetic oligonucleotide
  Target: SCN10A; (-) strand; PAM type: NNNNGHTT; PAM sequence: AAATGCTT
taaatgagtcaggtcaagca

SEQ ID NO: 10649 - DNA, 20 bp, Artificial Sequence
  Description of Artificial Sequence: Synthetic oligonucleotide
  Target: SCN10A; (-) strand; PAM type: NNNNGHTT; PAM sequence: TGAGGATT
acttatcttgtagagttttg

SEQ ID NO: 10650 - DNA, 20 bp, Artificial Sequence
  Description of Artificial Sequence: Synthetic oligonucleotide
  Target: SCN10A; (-) strand; PAM type: NNNNGHTT; PAM sequence: TAGAGTTT
gtgagaatatacttatcttg

SEQ ID NO: 10651 - DNA, 20 bp, Artificial Sequence
  Description of Artificial Sequence: Synthetic oligonucleotide
  Target: SCN10A; (-) strand; PAM type: NNNNGHTT; PAM sequence: CTCAGATT
cttcagtaacttttctgtgc

SEQ ID NO: 10652 - DNA, 20 bp, Artificial Sequence
  Description of Artificial Sequence: Synthetic oligonucleotide
  Target: SCN10A; (-) strand; PAM type: NNNNGHTT; PAM sequence: TGGAGCTT
tatggtacacagtgtgacct

SEQ ID NO: 10653 - DNA, 20 bp, Artificial Sequence
  Description of Artificial Sequence: Synthetic oligonucleotide
  Target: SCN10A; (-) strand; PAM type: NNNNGHTT; PAM sequence: CTGGGTTT
ctgctctggaacccggctgc

SEQ ID NO: 10654 - DNA, 20 bp, Artificial Sequence
  Description of Artificial Sequence: Synthetic oligonucleotide
  Target: SCN10A; (-) strand; PAM type: NNNNGHTT; PAM sequence: ATAAGCTT
ggattcagtggtgaactgat

SEQ ID NO: 10655 - DNA, 20 bp, Artificial Sequence
  Description of Artificial Sequence: Synthetic oligonucleotide
  Target: SCN10A; (-) strand; PAM type: NNNNGHTT; PAM sequence: CTGGGATT
gtgtggcattgcttcaggtg

SEQ ID NO: 10656 - DNA, 20 bp, Artificial Sequence
  Description of Artificial Sequence: Synthetic oligonucleotide
  Target: SCN10A; (-) strand; PAM type: NNNNGHTT; PAM sequence: CATTGCTT
agcccctgttgtgtgtgtgg

SEQ ID NO: 10657 - DNA, 20 bp, Artificial Sequence
  Description of Artificial Sequence: Synthetic oligonucleotide
  Target: SCN10A; (-) strand; PAM type: NNNNGHTT; PAM sequence: TTAAGCTT
tcatttattctcgaaaactg

SEQ ID NO: 10658 - DNA, 20 bp, Artificial Sequence
  Description of Artificial Sequence: Synthetic oligonucleotide
  Target: SCN10A; (-) strand; PAM type: NNNNGHTT; PAM sequence: GTTTGTTT
gcaaacattgaatacaaaca

SEQ ID NO: 10659 - DNA, 20 bp, Artificial Sequence
  Description of Artificial Sequence: Synthetic oligonucleotide
  Target: SCN10A; (-) strand; PAM type: NNNNGHTT; PAM sequence: AACAGTTT
aacagcaaacattgaataca

SEQ ID NO: 10660 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
ttttgtttgtttgttttggt

SEQ ID NO: 10661 - DNA, 20 bp, Artificial Sequence
  Description of Artificial Sequence: Synthetic oligonucleotide
  Target: SCN10A; (-) strand; PAM type: NNNNGHTT; PAM sequence: TTTGGTTT
cttggtttttgtttgtttgt

SEQ ID NO: 10662 - DNA, 20 bp, Artificial Sequence
  Description of Artificial Sequence: Synthetic oligonucleotide
  Target: SCN10A; (-) strand; PAM type: NNNNGHTT; PAM sequence: GTTTGTTT
aggtttcttggtttttgttt

SEQ ID NO: 10663 - DNA, 20 bp, Artificial Sequence
  Description of Artificial Sequence: Synthetic oligonucleotide
  Target: SCN10A; (-) strand; PAM type: NNNNGHTT; PAM sequence: GTTTGTTT
agataggtttcttggttttt

SEQ ID NO: 10664 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
ggccagataggtttcttggt

SEQ ID NO: 10665 - DNA, 20 bp, Artificial Sequence
  Description of Artificial Sequence: Synthetic oligonucleotide
  Target: SCN10A; (-) strand; PAM type: NNNNGHTT; PAM sequence: CTTGGTTT
tttcttggccagataggttt

SEQ ID NO: 10666 - DNA, 20 bp, Artificial Sequence
  Description of Artificial Sequence: Synthetic oligonucleotide
  Target: SCN10A; (-) strand; PAM type: NNNNGHTT; PAM sequence: ATAGGTTT
acaatttctttcttggccag

SEQ ID NO: 10667 - DNA, 20 bp, Artificial Sequence
  Description of Artificial Sequence: Synthetic oligonucleotide
  Target: SCN10A; (-) strand; PAM type: NNNNGHTT; PAM sequence: TTGTGCTT
catttcttgcatacctgagt

SEQ ID NO: 10668 - DNA, 20 bp, Artificial Sequence
  Description of Artificial Sequence: Synthetic oligonucleotide
  Target: SCN10A; (-) strand; PAM type: NNNNGHTT; PAM sequence: CTGAGTTT
aagttacatttcttgcatac

SEQ ID NO: 10669 - DNA, 20 bp, Artificial Sequence
  Description of Artificial Sequence: Synthetic oligonucleotide
  Target: SCN10A; (-) strand; PAM type: NNNNGHTT; PAM sequence: CCAGGTTT
aggaccagctcaactctcct

SEQ ID NO: 10670 - DNA, 20 bp, Artificial Sequence
  Description of Artificial Sequence: Synthetic oligonucleotide
  Target: SCN10A; (-) strand; PAM type: NNNNGHTT; PAM sequence: ATACGCTT
ggagctacaactcaggcaaa

SEQ ID NO: 10671 - DNA, 20 bp, Artificial Sequence
  Description of Artificial Sequence: Synthetic oligonucleotide
  Target: SCN10A; (-) strand; PAM type: NNNNGHTT; PAM sequence: CTTAGCTT
aaaatctggggaaaggcaac

SEQ ID NO: 10672 - DNA, 20 bp, Artificial Sequence
  Description of Artificial Sequence: Synthetic oligonucleotide
  Target: SCN10A; (-) strand; PAM type: NNNNGHTT; PAM sequence: AGACGTTT
aagaaaggcaggagaaacaa

SEQ ID NO: 10673 - DNA, 20 bp, Artificial Sequence
  Description of Artificial Sequence: Synthetic oligonucleotide
  Target: SCN10A; (-) strand; PAM type: NNNNGHTT; PAM sequence: ATCTGTTT
taccagatatgcagagatgt

SEQ ID NO: 10674 - DNA, 20 bp, Artificial Sequence
  Description of Artificial Sequence: Synthetic oligonucleotide
  Target: SCN10A; (-) strand; PAM type: NNNNGHTT; PAM sequence: GAGAGATT
cagaggtggcaagccttaga

SEQ ID NO: 10675 - DNA, 20 bp, Artificial Sequence
  Description of Artificial Sequence: Synthetic oligonucleotide
  Target: SCN10A; (-) strand; PAM type: NNNNGHTT; PAM sequence: GAGGGATT
tagaaaccaaaaaaatgttt

SEQ ID NO: 10676 - DNA, 20 bp, Artificial Sequence
  Description of Artificial Sequence: Synthetic oligonucleotide
  Target: SCN10A; (-) strand; PAM type: NNNNGHTT; PAM sequence: AAATGTTT
gtgagcaatagaaaccaaaa

SEQ ID NO: 10677 - DNA, 20 bp, Artificial Sequence
  Description of Artificial Sequence: Synthetic oligonucleotide
  Target: SCN10A; (-) strand; PAM type: NNNNGHTT; PAM sequence: GTGTGTTT
tgcccctgagaaggagtcct

SEQ ID NO: 10678 - DNA, 20 bp, Artificial Sequence
  Description of Artificial Sequence: Synthetic oligonucleotide
  Target: SCN10A; (-) strand; PAM type: NNNNGHTT; PAM sequence: GGGAGCTT
ctaggctggaggagttgtaa

SEQ ID NO: 10679 - DNA, 20 bp, Artificial Sequence
  Description of Artificial Sequence: Synthetic oligonucleotide
  Target: SCN10A; (-) strand; PAM type: NNNNGHTT; PAM sequence: GCGTGATT
tccacacactttgccataga

SEQ ID NO: 10680 - DNA, 20 bp, Artificial Sequence
  Description of Artificial Sequence: Synthetic oligonucleotide
  Target: SCN10A; (-) strand; PAM type: NNNNGHTT; PAM sequence: CATGGTTT
catggcaaaattatcctttt

SEQ ID NO: 10681 - DNA, 20 bp, Artificial Sequence
  Description of Artificial Sequence: Synthetic oligonucleotide
  Target: SCN10A; (-) strand; PAM type: NNNNGHTT; PAM sequence: ACTAGATT
tgctttgcatgcatcacaaa

SEQ ID NO: 10682 - DNA, 20 bp, Artificial Sequence
  Description of Artificial Sequence: Synthetic oligonucleotide
  Target: SCN10A; (-) strand; PAM type: NNNNGHTT; PAM sequence: ATCTGCTT
catctcttgttcaaattagc

SEQ ID NO: 10683 - DNA, 20 bp, Artificial Sequence
  Description of Artificial Sequence: Synthetic oligonucleotide
  Target: SCN10A; (-) strand; PAM type: NNNNGHTT; PAM sequence: TGTGGTTT
gccccaccatcttttatcaa

SEQ ID NO: 10684 - DNA, 20 bp, Artificial Sequence
  Description of Artificial Sequence: Synthetic oligonucleotide
  Target: SCN10A; (-) strand; PAM type: NNNNGHTT; PAM sequence: CTCTGTTT
aggttaaaggagcgtcctga

SEQ ID NO: 10685 - DNA, 20 bp, Artificial Sequence
  Description of Artificial Sequence: Synthetic oligonucleotide
  Target: SCN10A; (-) strand; PAM type: NNNNGHTT; PAM sequence: ATGAGATT
taagtgacatatgactatat

SEQ ID NO: 10686 - DNA, 20 bp, Artificial Sequence
  Description of Artificial Sequence: Synthetic oligonucleotide
  Target: SCN10A; (-) strand; PAM type: NNNNGHTT; PAM sequence: ATTTGTTT
gatgtatagaaggctatagc

SEQ ID NO: 10687 - DNA, 20 bp, Artificial Sequence
  Description of Artificial Sequence: Synthetic oligonucleotide
  Target: SCN10A; (-) strand; PAM type: NNNNGHTT; PAM sequence: TACAGATT
tattcagcaataacatgctg

SEQ ID NO: 10688 - DNA, 20 bp, Artificial Sequence
  Description of Artificial Sequence: Synthetic oligonucleotide
  Target: SCN10A; (-) strand; PAM type: NNNNGHTT; PAM sequence: AACTGTTT
aaactttctttatgtttatt

SEQ ID NO: 10689 - DNA, 20 bp, Artificial Sequence
  Description of Artificial Sequence: Synthetic oligonucleotide
  Target: SCN10A; (-) strand; PAM type: NNNNGHTT; PAM sequence: TTATGTTT
ggaagctttataaactttct

SEQ ID NO: 10690 - DNA, 20 bp, Artificial Sequence
  Description of Artificial Sequence: Synthetic oligonucleotide
  Target: SCN10A; (-) strand; PAM type: NNNNGHTT; PAM sequence: GGAAGCTT
tttgcttagtcctcatggtt

SEQ ID NO: 10691 - DNA, 20 bp, Artificial Sequence
  Description of Artificial Sequence: Synthetic oligonucleotide
  Target: SCN10A; (-) strand; PAM type: NNNNGHTT; PAM sequence: ATTTGCTT
aaatagtgactactagtatc

SEQ ID NO: 10692 - DNA, 20 bp, Artificial Sequence
  Description of Artificial Sequence: Synthetic oligonucleotide
  Target: SCN10A; (-) strand; PAM type: NNNNGHTT; PAM sequence: AAAGGTTT
ctccttatctccccttgtaa

SEQ ID NO: 10693 - DNA, 20 bp, Artificial Sequence
  Description of Artificial Sequence: Synthetic oligonucleotide
  Target: SCN10A; (-) strand; PAM type: NNNNGHTT; PAM sequence: TTCTGTTT
aagattgactctttaggccc

SEQ ID NO: 10694 - DNA, 20 bp, Artificial Sequence
  Description of Artificial Sequence: Synthetic oligonucleotide
  Target: SCN10A; (-) strand; PAM type: NNNNGHTT; PAM sequence: GAAAGATT
agttaaattaccaggctagt

SEQ ID NO: 10695 - DNA, 20 bp, Artificial Sequence
  Description of Artificial Sequence: Synthetic oligonucleotide
  Target: SCN10A; (-) strand; PAM type: NNNNGHTT; PAM sequence: CCTTGATT
catgtgtctagatattctga

SEQ ID NO: 10696 - DNA, 20 bp, Artificial Sequence
  Description of Artificial Sequence: Synthetic oligonucleotide
  Target: SCN10A; (-) strand; PAM type: NNNNGHTT; PAM sequence: CTGAGATT
ccaccctcctttctctgttc

SEQ ID NO: 10697 - DNA, 20 bp, Artificial Sequence
  Description of Artificial Sequence: Synthetic oligonucleotide
  Target: SCN10A; (-) strand; PAM type: NNNNGHTT; PAM sequence: CTGGGCTT
agtatttacagaggtgtggg

SEQ ID NO: 10698 - DNA, 20 bp, Artificial Sequence
  Description of Artificial Sequence: Synthetic oligonucleotide
  Target: SCN10A; (-) strand; PAM type: NNNNGHTT; PAM sequence: GAGAGTTT
cactccgatgggctaataga

SEQ ID NO: 10699 - DNA, 20 bp, Artificial Sequence
  Description of Artificial Sequence: Synthetic oligonucleotide
  Target: SCN10A; (-) strand; PAM type: NNNNGHTT; PAM sequence: ATGTGATT
tcagtctctgactcaatgtc

SEQ ID NO: 10700 - DNA, 20 bp, Artificial Sequence
  Description of Artificial Sequence: Synthetic oligonucleotide
  Target: SCN10A; (-) strand; PAM type: NNNNGHTT; PAM sequence: TAGTGTTT
agtttcagcaatgatgtttc

SEQ ID NO: 10701 - DNA, 20 bp, Artificial Sequence
  Description of Artificial Sequence: Synthetic oligonucleotide
  Target: SCN10A; (-) strand; PAM type: NNNNGHTT; PAM sequence: TGATGTTT
ctcccctccagtttcagcaa

SEQ ID NO: 10702 - DNA, 20 bp, Artificial Sequence
  Description of Artificial Sequence: Synthetic oligonucleotide
  Target: SCN10A; (-) strand; PAM type: NNNNGHTT; PAM sequence: TCCAGTTT
agttaatgtgagctctcccc

SEQ ID NO: 10703 - DNA, 20 bp, Artificial Sequence
  Description of Artificial Sequence: Synthetic oligonucleotide
  Target: SCN10A; (-) strand; PAM type: NNNNGHTT; PAM sequence: ATTGGATT
tggcaagtcagggattcctc

SEQ ID NO: 10704 - DNA, 20 bp, Artificial Sequence
  Description of Artificial Sequence: Synthetic oligonucleotide
  Target: SCN10A; (-) strand; PAM type: NNNNGHTT; PAM sequence: CAGGGATT
cgcagagtgtaatggcaagt

SEQ ID NO: 10705 - DNA, 20 bp, Artificial Sequence
  Description of Artificial Sequence: Synthetic oligonucleotide
  Target: SCN10A; (-) strand; PAM type: NNNNGHTT; PAM sequence: CCTTGCTT
ctgaatagaagcacagtatt

SEQ ID NO: 10706 - DNA, 20 bp, Artificial Sequence
  Description of Artificial Sequence: Synthetic oligonucleotide
  Target: SCN10A; (-) strand; PAM type: NNNNGHTT; PAM sequence: GGAAGTTT
atggcacccagagaaattca

SEQ ID NO: 10707 - DNA, 20 bp, Artificial Sequence
  Description of Artificial Sequence: Synthetic oligonucleotide
  Target: SCN10A; (-) strand; PAM type: NNNNGHTT; PAM sequence: TCCTGCTT
aaactgaaggacccttctct

SEQ ID NO: 10708 - DNA, 20 bp, Artificial Sequence
  Description of Artificial Sequence: Synthetic oligonucleotide
  Target: SCN10A; (-) strand; PAM type: NNNNGHTT; PAM sequence: GCCTGCTT
catcactgcctcagtgatag

SEQ ID NO: 10709 - DNA, 20 bp, Artificial Sequence
  Description of Artificial Sequence: Synthetic oligonucleotide
  Target: SCN10A; (-) strand; PAM type: NNNNGHTT; PAM sequence: CAGTGCTT
tttgaccccatatttcttat

SEQ ID NO: 10710 - DNA, 20 bp, Artificial Sequence
  Description of Artificial Sequence: Synthetic oligonucleotide
  Target: SCN10A; (-) strand; PAM type: NNNNGHTT; PAM sequence: CCTGGTTT
gcctgaggtcaaacaggttt

SEQ ID NO: 10711 - DNA, 20 bp, Artificial Sequence
  Description of Artificial Sequence: Synthetic oligonucleotide
  Target: SCN10A; (-) strand; PAM type: NNNNGHTT; PAM sequence: ACAGGTTT
ttgagttggcctgaggtcaa

SEQ ID NO: 10712 - DNA, 20 bp, Artificial Sequence
  Description of Artificial Sequence: Synthetic oligonucleotide
  Target: SCN10A; (-) strand; PAM type: NNNNGHTT; PAM sequence: GAGAGATT
agatgagacccagagagaga

SEQ ID NO: 10713 - DNA, 20 bp, Artificial Sequence
  Description of Artificial Sequence: Synthetic oligonucleotide
  Target: SCN10A; (-) strand; PAM type: NNNNGHTT; PAM sequence: GAATGCTT
cgatgtctcggtgagtttgt

SEQ ID NO: 10714 - DNA, 20 bp, Artificial Sequence
  Description of Artificial Sequence: Synthetic oligonucleotide
  Target: SCN10A; (-) strand; PAM type: NNNNGHTT; PAM sequence: GTGAGTTT
ctggagctgtcgatgtctcg

SEQ ID NO: 10715 - DNA, 20 bp, Artificial Sequence
  Description of Artificial Sequence: Synthetic oligonucleotide
  Target: SCN10A; (-) strand; PAM type: NNNNGHTT; PAM sequence: GTGAGCTT
acaccaaccgccgcccacta

SEQ ID NO: 10716 - DNA, 20 bp, Artificial Sequence
  Description of Artificial Sequence: Synthetic oligonucleotide
  Target: SCN10A; (-) strand; PAM type: NNNNGHTT; PAM sequence: ACCAGTTT
ggctctagatttcccagagg

SEQ ID NO: 10717 - DNA, 20 bp, Artificial Sequence
  Description of Artificial Sequence: Synthetic oligonucleotide
  Target: SCN10A; (-) strand; PAM type: NNNNGHTT; PAM sequence: TCTAGATT
ggtagagggaagtgttgggc

SEQ ID NO: 10718 - DNA, 20 bp, Artificial Sequence
  Description of Artificial Sequence: Synthetic oligonucleotide
  Target: SCN10A; (-) strand; PAM type: NNNNGHTT; PAM sequence: CTTAGATT
catgcatacctagaataccc

SEQ ID NO: 10719 - DNA, 20 bp, Artificial Sequence
  Description of Artificial Sequence: Synthetic oligonucleotide
  Target: SCN10A; (-) strand; PAM type: NNNNGHTT; PAM sequence: CAAGGTTT
caactgaactatccaggtga

SEQ ID NO: 10720 - DNA, 20 bp, Artificial Sequence
  Description of Artificial Sequence: Synthetic oligonucleotide
  Target: SCN10A; (-) strand; PAM type: NNNNGHTT; PAM sequence: GACAGCTT
atgtggaaaagtgaacttag

SEQ ID NO: 10721 - DNA, 20 bp, Artificial Sequence
  Description of Artificial Sequence: Synthetic oligonucleotide
  Target: SCN10A; (-) strand; PAM type: NNNNGHTT; PAM sequence: TATTGATT
agattttgatgggaaatgtt

SEQ ID NO: 10722 - DNA, 20 bp, Artificial Sequence
  Description of Artificial Sequence: Synthetic oligonucleotide
  Target: SCN10A; (-) strand; PAM type: NNNNGHTT; PAM sequence: AAATGTTT
caatggaagattttgatggg

SEQ ID NO: 10723 - DNA, 20 bp, Artificial Sequence
  Description of Artificial Sequence: Synthetic oligonucleotide
  Target: SCN10A; (-) strand; PAM type: NNNNGHTT; PAM sequence: GGAAGATT
agccacacagttccctcaat

SEQ ID NO: 10724 - DNA, 20 bp, Artificial Sequence
  Description of Artificial Sequence: Synthetic oligonucleotide
  Target: SCN10A; (-) strand; PAM type: NNNNGHTT; PAM sequence: CTGGGTTT
acactaattctctgagggct

SEQ ID NO: 10725 - DNA, 20 bp, Artificial Sequence
  Description of Artificial Sequence: Synthetic oligonucleotide
  Target: SCN10A; (-) strand; PAM type: NNNNGHTT; PAM sequence: TCAAGTTT
caaatgatggtttattatgg

SEQ ID NO: 10726 - DNA, 20 bp, Artificial Sequence
  Description of Artificial Sequence: Synthetic oligonucleotide
  Target: SCN10A; (-) strand; PAM type: NNNNGHTT; PAM sequence: GATGGTTT
gaccacctgaggacacaaat

SEQ ID NO: 10727 - DNA, 20 bp, Artificial Sequence
  Description of Artificial Sequence: Synthetic oligonucleotide
  Target: SCN10A; (-) strand; PAM type: NNNNGHTT; PAM sequence: TTTAGATT
agtttggtatgaagtcaatg

SEQ ID NO: 10728 - DNA, 20 bp, Artificial Sequence
  Description of Artificial Sequence: Synthetic oligonucleotide
  Target: SCN10A; (-) strand; PAM type: NNNNGHTT; PAM sequence: CAATGTTT
atcagagtttggtatgaagt

SEQ ID NO: 10729 - DNA, 20 bp, Artificial Sequence
  Description of Artificial Sequence: Synthetic oligonucleotide
  Target: SCN10A; (-) strand; PAM type: NNNNGHTT; PAM sequence: CAGAGTTT
gtggaataaatcggtatgat

SEQ ID NO: 10730 - DNA, 20 bp, Artificial Sequence
  Description of Artificial Sequence: Synthetic oligonucleotide
  Target: SCN10A; (-) strand; PAM type: NNNNGHTT; PAM sequence: AGTAGCTT
ttggcaagattctccacttt

SEQ ID NO: 10731 - DNA, 20 bp, Artificial Sequence
  Description of Artificial Sequence: Synthetic oligonucleotide
  Target: SCN10A; (-) strand; PAM type: NNNNGHTT; PAM sequence: GCAAGATT
agtaaggagaaccccaattg

SEQ ID NO: 10732 - DNA, 20 bp, Artificial Sequence
  Description of Artificial Sequence: Synthetic oligonucleotide
  Target: SCN10A; (-) strand; PAM type: NNNNGHTT; PAM sequence: AGGGGATT
aacttcagttctgtgagata

SEQ ID NO: 10733 - DNA, 20 bp, Artificial Sequence
  Description of Artificial Sequence: Synthetic oligonucleotide
  Target: SCN10A; (-) strand; PAM type: NNNNGHTT; PAM sequence: TCAGGCTT
ataatggttgctaaacagga

SEQ ID NO: 10734 - DNA, 20 bp, Artificial Sequence
  Description of Artificial Sequence: Synthetic oligonucleotide
  Target: SCN10A; (-) strand; PAM type: NNNNGHTT; PAM sequence: CTGAGCTT
agagtactctatttataata

SEQ ID NO: 10735 - DNA, 20 bp, Artificial Sequence
  Description of Artificial Sequence: Synthetic oligonucleotide
  Target: SCN10A; (-) strand; PAM type: NNNNGHTT; PAM sequence: GAAGGATT
ctcatttgcttcaaaaattg

SEQ ID NO: 10736 - DNA, 20 bp, Artificial Sequence
  Description of Artificial Sequence: Synthetic oligonucleotide
  Target: SCN10A; (-) strand; PAM type: NNNNGHTT; PAM sequence: ATTTGCTT
tggatgtgtcaatttttctc

SEQ ID NO: 10737 - DNA, 20 bp, Artificial Sequence
  Description of Artificial Sequence: Synthetic oligonucleotide
  Target: SCN10A; (-) strand; PAM type: NNNNGHTT; PAM sequence: GTTTGCTT
tcttctcagtttcttcattg

SEQ ID NO: 10738 - DNA, 20 bp, Artificial Sequence
  Description of Artificial Sequence: Synthetic oligonucleotide
  Target: SCN10A; (-) strand; PAM type: NNNNGHTT; PAM sequence: ATTGGTTT
attttcttctcagtttcttc

SEQ ID NO: 10739 - DNA, 20 bp, Artificial Sequence
  Description of Artificial Sequence: Synthetic oligonucleotide
  Target: SCN10A; (-) strand; PAM type: NNNNGHTT; PAM sequence: CTCAGTTT
tatgcaaccaaaattttctt

SEQ ID NO: 10740 - DNA, 20 bp, Artificial Sequence
  Description of Artificial Sequence: Synthetic oligonucleotide
  Target: SCN10A; (-) strand; PAM type: NNNNGHTT; PAM sequence: TAATGCTT
gatgaattttaaagcaattc

SEQ ID NO: 10741 - DNA, 20 bp, Artificial Sequence
  Description of Artificial Sequence: Synthetic oligonucleotide
  Target: SCN10A; (-) strand; PAM type: NNNNGHTT; PAM sequence: GAGGGTTT
aatatatagaagagacccag

SEQ ID NO: 10742 - DNA, 20 bp, Artificial Sequence
  Description of Artificial Sequence: Synthetic oligonucleotide
  Target: SCN10A; (-) strand; PAM type: NNNNGHTT; PAM sequence: TGCAGTTT
catgtggtaaatagacctaa

SEQ ID NO: 10743 - DNA, 20 bp, Artificial Sequence
  Description of Artificial Sequence: Synthetic oligonucleotide
  Target: SCN10A; (-) strand; PAM type: NNNNGHTT; PAM sequence: AATTGATT
ttaagtacttctttaatgct

SEQ ID NO: 10744 - DNA, 20 bp, Artificial Sequence
  Description of Artificial Sequence: Synthetic oligonucleotide
  Target: SCN10A; (-) strand; PAM type: NNNNGHTT; PAM sequence: GAGAGTTT
tctagtaattgaagacttga

SEQ ID NO: 10745 - DNA, 20 bp, Artificial Sequence
  Description of Artificial Sequence: Synthetic oligonucleotide
  Target: SCN10A; (-) strand; PAM type: NNNNGHTT; PAM sequence: AAAGGCTT
ggggctggataggtatcaga

SEQ ID NO: 10746 - DNA, 20 bp, Artificial Sequence
  Description of Artificial Sequence: Synthetic oligonucleotide
  Target: SCN10A; (-) strand; PAM type: NNNNGHTT; PAM sequence: TGGTGTTT
gtgtattagagacacataca

SEQ ID NO: 10747 - DNA, 20 bp, Artificial Sequence
  Description of Artificial Sequence: Synthetic oligonucleotide
  Target: SCN10A; (-) strand; PAM type: NNNNGHTT; PAM sequence: TAAGGATT
ctagaacatgttcttttccc

SEQ ID NO: 10748 - DNA, 20 bp, Artificial Sequence
  Description of Artificial Sequence: Synthetic oligonucleotide
  Target: SCN10A; (-) strand; PAM type: NNNNGHTT; PAM sequence: AGGTGCTT
cttgttcattcaacaatact

SEQ ID NO: 10749 - DNA, 20 bp, Artificial Sequence
  Description of Artificial Sequence: Synthetic oligonucleotide
  Target: SCN10A; (-) strand; PAM type: NNNNGHTT; PAM sequence: TGATGCTT
atgtgtgcttgtctctccag

SEQ ID NO: 10750 - DNA, 20 bp, Artificial Sequence
  Description of Artificial Sequence: Synthetic oligonucleotide
  Target: SCN10A; (-) strand; PAM type: NNNNGHTT; PAM sequence: GTGTGCTT
ggatgtccaataattggtat

SEQ ID NO: 10751 - DNA, 20 bp, Artificial Sequence
  Description of Artificial Sequence: Synthetic oligonucleotide
  Target: SCN10A; (-) strand; PAM type: NNNNGHTT; PAM sequence: CACAGATT
cccccattctgtcagcccca

SEQ ID NO: 10752 - DNA, 20 bp, Artificial Sequence
  Description of Artificial Sequence: Synthetic oligonucleotide
  Target: SCN10A; (-) strand; PAM type: NNNNGHTT; PAM sequence: TTGGGCTT
gaaatgtcaatgacactgaa

SEQ ID NO: 10753 - DNA, 20 bp, Artificial Sequence
  Description of Artificial Sequence: Synthetic oligonucleotide
  Target: SCN10A; (-) strand; PAM type: NNNNGHTT; PAM sequence: CACAGCTT
aatcacagaacaggatgaat

SEQ ID NO: 10754 - DNA, 20 bp, Artificial Sequence
  Description of Artificial Sequence: Synthetic oligonucleotide
  Target: SCN10A; (-) strand; PAM type: NNNNGHTT; PAM sequence: TCTTGCTT
tgcatctgtgccctcctctt

SEQ ID NO: 10755 - DNA, 20 bp, Artificial Sequence
  Description of Artificial Sequence: Synthetic oligonucleotide
  Target: SCN10A; (-) strand; PAM type: NNNNGHTT; PAM sequence: CTCAGATT
gcaataccatctctccaacc

SEQ ID NO: 10756 - DNA, 20 bp, Artificial Sequence
  Description of Artificial Sequence: Synthetic oligonucleotide
  Target: SCN10A; (-) strand; PAM type: NNNNGHTT; PAM sequence: TTATGCTT
ggatcaacatggctattttt

SEQ ID NO: 10757 - DNA, 20 bp, Artificial Sequence
  Description of Artificial Sequence: Synthetic oligonucleotide
  Target: SCN10A; (-) strand; PAM type: NNNNGHTT; PAM sequence: CCACGCTT
ttgcactgcaactttcctcg

SEQ ID NO: 10758 - DNA, 20 bp, Artificial Sequence
  Description of Artificial Sequence: Synthetic oligonucleotide
  Target: SCN10A; (-) strand; PAM type: NNNNGHTT; PAM sequence: AATGGCTT
gtgacacaatccagcctggg

SEQ ID NO: 10759 - DNA, 20 bp, Artificial Sequence
  Description of Artificial Sequence: Synthetic oligonucleotide
  Target: SCN10A; (-) strand; PAM type: NNNNGHTT; PAM sequence: AAAAGTTT
ctgtcacctgttgttatcag

SEQ ID NO: 10760 - DNA, 20 bp, Artificial Sequence
  Description of Artificial Sequence: Synthetic oligonucleotide
  Target: SCN10A; (-) strand; PAM type: NNNNGHTT; PAM sequence: CTTAGTTT
aggtggtttttattttttta

SEQ ID NO: 10761 - DNA, 20 bp, Artificial Sequence
  Description of Artificial Sequence: Synthetic oligonucleotide
  Target: SCN10A; (-) strand; PAM type: NNNNGHTT; PAM sequence: GGTGGTTT
ttttttttctgatgcgtcga

SEQ ID NO: 10762 - DNA, 20 bp, Artificial Sequence
  Description of Artificial Sequence: Synthetic oligonucleotide
  Target: SCN10A; (-) strand; PAM type: NNNNGHTT; PAM sequence: GTCAGCTT
ggtgtctgcggacatcaaag

SEQ ID NO: 10763 - DNA, 20 bp, Artificial Sequence
  Description of Artificial Sequence: Synthetic oligonucleotide
  Target: SCN10A; (-) strand; PAM type: NNNNGHTT; PAM sequence: CCCGGTTT
gaggacactggaggaagaac

SEQ ID NO: 10764 - DNA, 20 bp, Artificial Sequence
  Description of Artificial Sequence: Synthetic oligonucleotide
  Target: SCN10A; (-) strand; PAM type: NNNNGHTT; PAM sequence: TGGTGATT
ggattgggcaatcaaatggg

SEQ ID NO: 10765 - DNA, 20 bp, Artificial Sequence
  Description of Artificial Sequence: Synthetic oligonucleotide
  Target: SCN10A; (-) strand; PAM type: NNNNGHTT; PAM sequence: TCAGGATT
tccaatttgactcccaggtt

SEQ ID NO: 10766 - DNA, 20 bp, Artificial Sequence
  Description of Artificial Sequence: Synthetic oligonucleotide
  Target: SCN10A; (-) strand; PAM type: NNNNGHTT; PAM sequence: CCAGGTTT
aggggagtccaatttgactc

SEQ ID NO: 10767 - DNA, 20 bp, Artificial Sequence
  Description of Artificial Sequence: Synthetic oligonucleotide
  Target: SCN10A; (-) strand; PAM type: NNNNGHTT; PAM sequence: TTGGGATT
agggaagtggatcaacaaga

SEQ ID NO: 10768 - DNA, 20 bp, Artificial Sequence
  Description of Artificial Sequence: Synthetic oligonucleotide
  Target: SCN10A; (-) strand; PAM type: NNNNGHTT; PAM sequence: ACAAGATT
caccttagggaagtggatca

SEQ ID NO: 10769 - DNA, 20 bp, Artificial Sequence
  Description of Artificial Sequence: Synthetic oligonucleotide
  Target: SCN10A; (-) strand; PAM type: NNNNGHTT; PAM sequence: TAAAGATT
agaggctcaggtttgtgctc

SEQ ID NO: 10770 - DNA, 20 bp, Artificial Sequence
  Description of Artificial Sequence: Synthetic oligonucleotide
  Target: SCN10A; (-) strand; PAM type: NNNNGHTT; PAM sequence: TCAGGTTT
agcgcaggatggtaagaggc

SEQ ID NO: 10771 - DNA, 20 bp, Artificial Sequence
  Description of Artificial Sequence: Synthetic oligonucleotide
  Target: SCN10A; (-) strand; PAM type: NNNNGHTT; PAM sequence: TAGGGATT
ttcgcaggtgctagcagcac

SEQ ID NO: 10772 - DNA, 20 bp, Artificial Sequence
  Description of Artificial Sequence: Synthetic oligonucleotide
  Target: SCN10A; (-) strand; PAM type: NNNNGHTT; PAM sequence: CTCTGTTT
tggtcctaacccttcagctt

SEQ ID NO: 10773 - DNA, 20 bp, Artificial Sequence
  Description of Artificial Sequence: Synthetic oligonucleotide
  Target: SCN10A; (-) strand; PAM type: NNNNGHTT; PAM sequence: TTCAGCTT
caccaccctggtcctaaccc

SEQ ID NO: 10774 - DNA, 20 bp, Artificial Sequence
  Description of Artificial Sequence: Synthetic oligonucleotide
  Target: SCN10A; (-) strand; PAM type: NNNNGHTT; PAM sequence: GCCAGCTT
tcctaccttgaggcaagggg

SEQ ID NO: 10775 - DNA, 20 bp, Artificial Sequence
  Description of Artificial Sequence: Synthetic oligonucleotide
  Target: SCN10A; (-) strand; PAM type: NNNNGHTT; PAM sequence: TTCAGCTT
gttctcagctagagaccagc

SEQ ID NO: 10776 - DNA, 20 bp, Artificial Sequence
  Description of Artificial Sequence: Synthetic oligonucleotide
  Target: SCN10A; (-) strand; PAM type: NNNNGHTT; PAM sequence: ACCAGCTT
aggagtgttctcagctagag

SEQ ID NO: 10777 - DNA, 20 bp, Artificial Sequence
  Description of Artificial Sequence: Synthetic oligonucleotide
  Target: SCN10A; (-) strand; PAM type: NNNNGHTT; PAM sequence: TGAGGATT
ttctcaaagaagaagctaag

SEQ ID NO: 10778 - DNA, 20 bp, Artificial Sequence
  Description of Artificial Sequence: Synthetic oligonucleotide
  Target: SCN10A; (-) strand; PAM type: NNNNGHTT; PAM sequence: TCAGGTTT
gcctcagggaccatattaga

SEQ ID NO: 10779 - DNA, 20 bp, Artificial Sequence
  Description of Artificial Sequence: Synthetic oligonucleotide
  Target: SCN10A; (-) strand; PAM type: NNNNGHTT; PAM sequence: CACCGTTT
actagccacttcaattaggg

SEQ ID NO: 10780 - DNA, 20 bp, Artificial Sequence
  Description of Artificial Sequence: Synthetic oligonucleotide
  Target: SCN10A; (-) strand; PAM type: NNNNGHTT; PAM sequence: GGAAGCTT
gcaggaggtttgtgaggagt

SEQ ID NO: 10781 - DNA, 20 bp, Artificial Sequence
  Description of Artificial Sequence: Synthetic oligonucleotide
  Target: SCN10A; (-) strand; PAM type: NNNNGHTT; PAM sequence: GGAGGTTT
gagatgctccggaaggagca

SEQ ID NO: 10782 - DNA, 20 bp, Artificial Sequence
  Description of Artificial Sequence: Synthetic oligonucleotide
  Target: SCN10A; (-) strand; PAM type: NNNNGHTT; PAM sequence: ACAGGTTT
ggggtccatgtgctatgggt

SEQ ID NO: 10783 - DNA, 20 bp, Artificial Sequence
  Description of Artificial Sequence: Synthetic oligonucleotide
  Target: SCN10A; (-) strand; PAM type: NNNNGHTT; PAM sequence: CTGTGCTT
ctggtgggtcagctgcatgg

SEQ ID NO: 10784 - DNA, 20 bp, Artificial Sequence
  Description of Artificial Sequence: Synthetic oligonucleotide
  Target: SCN10A; (-) strand; PAM type: NNNNGHTT; PAM sequence: ACAGGATT
tcactgttccgcctcatgac

SEQ ID NO: 10785 - DNA, 20 bp, Artificial Sequence
  Description of Artificial Sequence: Synthetic oligonucleotide
  Target: SCN10A; (-) strand; PAM type: NNNNGHTT; PAM sequence: TTGGGCTT
accagctttgattcctttgc

SEQ ID NO: 10786 - DNA, 20 bp, Artificial Sequence
  Description of Artificial Sequence: Synthetic oligonucleotide
  Target: SCN10A; (-) strand; PAM type: NNNNGHTT; PAM sequence: CTTTGCTT
aactacaccagctttgattc

SEQ ID NO: 10787 - DNA, 20 bp, Artificial Sequence
  Description of Artificial Sequence: Synthetic oligonucleotide
  Target: SCN10A; (-) strand; PAM type: NNNNGHTT; PAM sequence: CTTTGATT
ccggattttaactacaccag

SEQ ID NO: 10788 - DNA, 20 bp, Artificial Sequence
  Description of Artificial Sequence: Synthetic oligonucleotide
  Target: SCN10A; (-) strand; PAM type: NNNNGHTT; PAM sequence: ACCAGCTT
acaacccggattttaactac

SEQ ID NO: 10789 - DNA, 20 bp, Artificial Sequence
  Description of Artificial Sequence: Synthetic oligonucleotide
  Target: SCN10A; (-) strand; PAM type: NNNNGHTT; PAM sequence: CCCGGATT
tgccttaaaacttctgacaa

SEQ ID NO: 10790 - DNA, 20 bp, Artificial Sequence
  Description of Artificial Sequence: Synthetic oligonucleotide
  Target: SCN10A; (-) strand; PAM type: NNNNGHTT; PAM sequence: CCCCGTTT
tgacgtgaaagtattagcgt

SEQ ID NO: 10791 - DNA, 20 bp, Artificial Sequence
  Description of Artificial Sequence: Synthetic oligonucleotide
  Target: SCN10A; (-) strand; PAM type: NNNNGHTT; PAM sequence: AAGAGCTT
ttccctggtatgaactggca

SEQ ID NO: 10792 - DNA, 20 bp, Artificial Sequence
  Description of Artificial Sequence: Synthetic oligonucleotide
  Target: SCN10A; (-) strand; PAM type: NNNNGHTT; PAM sequence: TCAGGTTT
tgcagatgatgccaacaggc

SEQ ID NO: 10793 - DNA, 20 bp, Artificial Sequence
  Description of Artificial Sequence: Synthetic oligonucleotide
  Target: SCN10A; (-) strand; PAM type: NNNNGHTT; PAM sequence: TAGTGTTT
aacattgagtgattaaatta

SEQ ID NO: 10794 - DNA, 20 bp, Artificial Sequence
  Description of Artificial Sequence: Synthetic oligonucleotide
  Target: SCN10A; (-) strand; PAM type: NNNNGHTT; PAM sequence: GAGTGATT
atctgtaaagaaagaacatt

SEQ ID NO: 10795 - DNA, 20 bp, Artificial Sequence
  Description of Artificial Sequence: Synthetic oligonucleotide
  Target: SCN10A; (-) strand; PAM type: NNNNGHTT; PAM sequence: CCCAGATT
caactgacttctttctgacc

SEQ ID NO: 10796 - DNA, 20 bp, Artificial Sequence
  Description of Artificial Sequence: Synthetic oligonucleotide
  Target: SCN10A; (-) strand; PAM type: NNNNGHTT; PAM sequence: CGTAGTTT
aataaatatattgacacctg

SEQ ID NO: 10797 - DNA, 20 bp, Artificial Sequence
  Description of Artificial Sequence: Synthetic oligonucleotide
  Target: SCN10A; (-) strand; PAM type: NNNNGHTT; PAM sequence: AGATGCTT
tttacgctccctgagctgac

SEQ ID NO: 10798 - DNA, 20 bp, Artificial Sequence
  Description of Artificial Sequence: Synthetic oligonucleotide
  Target: SCN10A; (-) strand; PAM type: NNNNGHTT; PAM sequence: TGCTGTTT
ctggacttcaaacgaggcat

SEQ ID NO: 10799 - DNA, 20 bp, Artificial Sequence
  Description of Artificial Sequence: Synthetic oligonucleotide
  Target: SCN10A; (-) strand; PAM type: NNNNGHTT; PAM sequence: AACTGATT
cgaagtggagatagacttgg

SEQ ID NO: 10800 - DNA, 20 bp, Artificial Sequence
  Description of Artificial Sequence: Synthetic oligonucleotide
  Target: SCN10A; (-) strand; PAM type: NNNNGHTT; PAM sequence: GGTGGATT
tgtttatatgcagtggctat

SEQ ID NO: 10801 - DNA, 20 bp, Artificial Sequence
  Description of Artificial Sequence: Synthetic oligonucleotide
  Target: SCN10A; (-) strand; PAM type: NNNNGHTT; PAM sequence: AACTGTTT
atttaatcctcagagcagtg

SEQ ID NO: 10802 - DNA, 20 bp, Artificial Sequence
  Description of Artificial Sequence: Synthetic oligonucleotide
  Target: SCN10A; (-) strand; PAM type: NNNNGHTT; PAM sequence: TGCAGTTT
aaacaataggaattttcctt

SEQ ID NO: 10803 - DNA, 20 bp, Artificial Sequence
  Description of Artificial Sequence: Synthetic oligonucleotide
  Target: SCN10A; (-) strand; PAM type: NNNNGHTT; PAM sequence: AGCAGCTT
ttattccagtttatcctttc

SEQ ID NO: 10804 - DNA, 20 bp, Artificial Sequence
  Description of Artificial Sequence: Synthetic oligonucleotide
  Target: SCN10A; (-) strand; PAM type: NNNNGHTT; PAM sequence: TCCAGTTT
tgttcttccacatatattat

SEQ ID NO: 10805 - DNA, 20 bp, Artificial Sequence
  Description of Artificial Sequence: Synthetic oligonucleotide
  Target: SCN10A; (-) strand; PAM type: NNNNGHTT; PAM sequence: ATCAGTTT
catgagagggttgttctgac

SEQ ID NO: 10806 - DNA, 20 bp, Artificial Sequence
  Description of Artificial Sequence: Synthetic oligonucleotide
  Target: SCN10A; (-) strand; PAM type: NNNNGHTT; PAM sequence: GAGAGCTT
tctcacccacctccatggct

SEQ ID NO: 10807 - DNA, 20 bp, Artificial Sequence
  Description of Artificial Sequence: Synthetic oligonucleotide
  Target: SCN10A; (-) strand; PAM type: NNNNGHTT; PAM sequence: TGCTGCTT
gaggacccctcagctctgcc

SEQ ID NO: 10808 - DNA, 20 bp, Artificial Sequence
  Description of Artificial Sequence: Synthetic oligonucleotide
  Target: SCN10A; (-) strand; PAM type: NNNNGHTT; PAM sequence: GATAGTTT
tccaggctgggtgaatacga

SEQ ID NO: 10809 - DNA, 20 bp, Artificial Sequence
  Description of Artificial Sequence: Synthetic oligonucleotide
  Target: SCN10A; (-) strand; PAM type: NNNNGHTT; PAM sequence: GTGAGCTT
tcctggaggtggtgtttgag

SEQ ID NO: 10810 - DNA, 20 bp, Artificial Sequence
  Description of Artificial Sequence: Synthetic oligonucleotide
  Target: SCN10A; (-) strand; PAM type: NNNNGHTT; PAM sequence: TGGTGTTT
tagggaaggcttcctggagg

SEQ ID NO: 10811 - DNA, 20 bp, Artificial Sequence
  Description of Artificial Sequence: Synthetic oligonucleotide
  Target: SCN10A; (-) strand; PAM type: NNNNGHTT; PAM sequence: GAAGGCTT
gaggcaagagagaaagtagg

SEQ ID NO: 10812 - DNA, 20 bp, Artificial Sequence
  Description of Artificial Sequence: Synthetic oligonucleotide
  Target: SCN10A; (-) strand; PAM type: NNNNGHTT; PAM sequence: AGAGGCTT
tggaaaacaagttctttact

SEQ ID NO: 10813 - DNA, 20 bp, Artificial Sequence
  Description of Artificial Sequence: Synthetic oligonucleotide
  Target: SCN10A; (-) strand; PAM type: NNNNGHTT; PAM sequence: GCTAGTTT
ccaaatccagcctataagct

SEQ ID NO: 10814 - DNA, 20 bp, Artificial Sequence
  Description of Artificial Sequence: Synthetic oligonucleotide
  Target: SCN10A; (-) strand; PAM type: NNNNGHTT; PAM sequence: TTTAGATT
tttaaaatagagataggaaa

SEQ ID NO: 10815 - DNA, 20 bp, Artificial Sequence
  Description of Artificial Sequence: Synthetic oligonucleotide
  Target: SCN10A; (-) strand; PAM type: NNNNGHTT; PAM sequence: CACTGTTT
gccatgtggaaatgtgggtt

SEQ ID NO: 10816 - DNA, 20 bp, Artificial Sequence
  Description of Artificial Sequence: Synthetic oligonucleotide
  Target: SCN10A; (-) strand; PAM type: NNNNGHTT; PAM sequence: TCCAGCTT
gggacagccccactgctcgg

SEQ ID NO: 10817 - DNA, 20 bp, Artificial Sequence
  Description of Artificial Sequence: Synthetic oligonucleotide
  Target: SCN10A; (-) strand; PAM type: NNNNGHTT; PAM sequence: GCCAGATT
aatttcgaattcttacagag

SEQ ID NO: 10818 - DNA, 20 bp, Artificial Sequence
  Description of Artificial Sequence: Synthetic oligonucleotide
  Target: SCN10A; (-) strand; PAM type: NNNNGHTT; PAM sequence: CTAGGCTT
tttgcaaggcttcttcaggc

SEQ ID NO: 10819 - DNA, 20 bp, Artificial Sequence
  Description of Artificial Sequence: Synthetic oligonucleotide
  Target: SCN10A; (-) strand; PAM type: NNNNGHTT; PAM sequence: CAAGGCTT
agaaaaacagtggaagtttg

SEQ ID NO: 10820 - DNA, 20 bp, Artificial Sequence
  Description of Artificial Sequence: Synthetic oligonucleotide
  Target: SCN10A; (-) strand; PAM type: NNNNGHTT; PAM sequence: GGAAGTTT
agtgttcccagaaaaacagt

SEQ ID NO: 10821 - DNA, 20 bp, Artificial Sequence
  Description of Artificial Sequence: Synthetic oligonucleotide
  Target: SCN10A; (-) strand; PAM type: NNNNGHTT; PAM sequence: TCATGATT
aaaacaacaatgtatttaat

SEQ ID NO: 10822 - DNA, 20 bp, Artificial Sequence
  Description of Artificial Sequence: Synthetic oligonucleotide
  Target: SCN10A; (-) strand; PAM type: NNNNGHTT; PAM sequence: GTTAGCTT
catggggagggaatgtatga

SEQ ID NO: 10823 - DNA, 20 bp, Artificial Sequence
  Description of Artificial Sequence: Synthetic oligonucleotide
  Target: SCN10A; (-) strand; PAM type: NNNNGHTT; PAM sequence: TGAGGCTT
ggagggttcagaaccatctg

SEQ ID NO: 10824 - DNA, 20 bp, Artificial Sequence
  Description of Artificial Sequence: Synthetic oligonucleotide
  Target: SCN10A; (-) strand; PAM type: NNNNGHTT; PAM sequence: CAAGGCTT
ggaatattgcattcaccaca

SEQ ID NO: 10825 - DNA, 20 bp, Artificial Sequence
  Description of Artificial Sequence: Synthetic oligonucleotide
  Target: SCN10A; (-) strand; PAM type: NNNNGHTT; PAM sequence: CACTGCTT
gggagattgagagccgaagt

SEQ ID NO: 10826 - DNA, 20 bp, Artificial Sequence
  Description of Artificial Sequence: Synthetic oligonucleotide
  Target: SCN10A; (-) strand; PAM type: NNNNGHTT; PAM sequence: GGGAGATT
agtcattctacctctgctgg

SEQ ID NO: 10827 - DNA, 20 bp, Artificial Sequence
  Description of Artificial Sequence: Synthetic oligonucleotide
  Target: SCN10A; (-) strand; PAM type: NNNNGHTT; PAM sequence: TTGTGTTT
gccaaaatggttctcttgag

SEQ ID NO: 10828 - DNA, 20 bp, Artificial Sequence
  Description of Artificial Sequence: Synthetic oligonucleotide
  Target: SCN10A; (-) strand; PAM type: NNNNGHTT; PAM sequence: AAGTGTTT
atcctcaccatcttctgcct

SEQ ID NO: 10829 - DNA, 20 bp, Artificial Sequence
  Description of Artificial Sequence: Synthetic oligonucleotide
  Target: SCN10A; (-) strand; PAM type: NNNNGHTT; PAM sequence: CCCTGATT
cctgaaggtcattgtggggg

SEQ ID NO: 10830 - DNA, 20 bp, Artificial Sequence
  Description of Artificial Sequence: Synthetic oligonucleotide
  Target: SCN10A; (-) strand; PAM type: NNNNGHTT; PAM sequence: GCAAGCTT
gcctgcctctcagagtaaat

SEQ ID NO: 10831 - DNA, 20 bp, Artificial Sequence
  Description of Artificial Sequence: Synthetic oligonucleotide
  Target: SCN10A; (-) strand; PAM type: NNNNGHTT; PAM sequence: AGTAGCTT
caaattactggggtgaagtt

SEQ ID NO: 10832 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
ttttctttctcttggtctat

SEQ ID NO: 10833 - DNA, 20 bp, Artificial Sequence
  Description of Artificial Sequence: Synthetic oligonucleotide
  Target: SCN10A; (-) strand; PAM type: NNNNGHTT; PAM sequence: CTCTGTTT
ttctattgctaaactcacct

SEQ ID NO: 10834 - DNA, 20 bp, Artificial Sequence
  Description of Artificial Sequence: Synthetic oligonucleotide
  Target: SCN10A; (-) strand; PAM type: NNNNGHTT; PAM sequence: CAGTGTTT
ttatgccccagtgactgtct

SEQ ID NO: 10835 - DNA, 20 bp, Artificial Sequence
  Description of Artificial Sequence: Synthetic oligonucleotide
  Target: SCN10A; (-) strand; PAM type: NNNNGHTT; PAM sequence: CTGTGCTT
gtatccttctttgctgccag

SEQ ID NO: 10836 - DNA, 20 bp, Artificial Sequence
  Description of Artificial Sequence: Synthetic oligonucleotide
  Target: SCN10A; (-) strand; PAM type: NNNNGHTT; PAM sequence: AGTTGATT
cgaagctgctctcccaaaga

SEQ ID NO: 10837 - DNA, 20 bp, Artificial Sequence
  Description of Artificial Sequence: Synthetic oligonucleotide
  Target: SCN10A; (-) strand; PAM type: NNNNGHTT; PAM sequence: GATTGCTT
ctaaccaaaaataaatccta

SEQ ID NO: 10838 - DNA, 20 bp, Artificial Sequence
  Description of Artificial Sequence: Synthetic oligonucleotide
  Target: SCN10A; (-) strand; PAM type: NNNNGHTT; PAM sequence: CCTAGATT
atgactaaccaaaaataaat

SEQ ID NO: 10839 - DNA, 20 bp, Artificial Sequence
  Description of Artificial Sequence: Synthetic oligonucleotide
  Target: SCN10A; (-) strand; PAM type: NNNNGHTT; PAM sequence: AGTGGATT
gactgacacatgtagtgctc

SEQ ID NO: 10840 - DNA, 20 bp, Artificial Sequence
  Description of Artificial Sequence: Synthetic oligonucleotide
  Target: SCN10A; (-) strand; PAM type: NNNNGHTT; PAM sequence: CCTGGTTT
tgccaaggttttacctcctc

SEQ ID NO: 10841 - DNA, 20 bp, Artificial Sequence
  Description of Artificial Sequence: Synthetic oligonucleotide
  Target: SCN10A; (-) strand; PAM type: NNNNGHTT; PAM sequence: CAAGGTTT
ctcattcctcagggctctgc

SEQ ID NO: 10842 - DNA, 20 bp, Artificial Sequence
  Description of Artificial Sequence: Synthetic oligonucleotide
  Target: SCN10A; (-) strand; PAM type: NNNNGHTT; PAM sequence: TGATGCTT
aaactttctgaaatgggact

SEQ ID NO: 10843 - DNA, 20 bp, Artificial Sequence
  Description of Artificial Sequence: Synthetic oligonucleotide
  Target: SCN10A; (-) strand; PAM type: NNNNGHTT; PAM sequence: TCTTGATT
ggaaaaaagaattaggcaat

SEQ ID NO: 10844 - DNA, 20 bp, Artificial Sequence
  Description of Artificial Sequence: Synthetic oligonucleotide
  Target: SCN10A; (-) strand; PAM type: NNNNGHTT; PAM sequence: CACTGTTT
gaaagcagtcccagtatctt

SEQ ID NO: 10845 - DNA, 20 bp, Artificial Sequence
  Description of Artificial Sequence: Synthetic oligonucleotide
  Target: SCN10A; (-) strand; PAM type: NNNNGHTT; PAM sequence: AAAGGATT
ttttatttataccttaaact

SEQ ID NO: 10846 - DNA, 20 bp, Artificial Sequence
  Description of Artificial Sequence: Synthetic oligonucleotide
  Target: SCN10A; (-) strand; PAM type: NNNNGHTT; PAM sequence: GTGGGATT
cttcactttctgttctggtt

SEQ ID NO: 10847 - DNA, 20 bp, Artificial Sequence
  Description of Artificial Sequence: Synthetic oligonucleotide
  Target: SCN10A; (-) strand; PAM type: NNNNGHTT; PAM sequence: GTTGGTTT
catttattcacagagcatat

SEQ ID NO: 10848 - DNA, 20 bp, Artificial Sequence
  Description of Artificial Sequence: Synthetic oligonucleotide
  Target: SCN10A; (-) strand; PAM type: NNNNGHTT; PAM sequence: AACAGTTT
agagttcttagagcattaaa

SEQ ID NO: 10849 - DNA, 20 bp, Artificial Sequence
  Description of Artificial Sequence: Synthetic oligonucleotide
  Target: SCN10A; (-) strand; PAM type: NNNNGHTT; PAM sequence: CCTTGCTT
gctgcatgcatccccaggac

SEQ ID NO: 10850 - DNA, 20 bp, Artificial Sequence
  Description of Artificial Sequence: Synthetic oligonucleotide
  Target: SCN10A; (-) strand; PAM type: NNNNGHTT; PAM sequence: ACTAGATT
agtctatagatggcagtgtc

SEQ ID NO: 10851 - DNA, 20 bp, Artificial Sequence
  Description of Artificial Sequence: Synthetic oligonucleotide
  Target: SCN10A; (-) strand; PAM type: NNNNGHTT; PAM sequence: CTGTGTTT
gagactggttggtcaaactc

SEQ ID NO: 10852 - DNA, 20 bp, Artificial Sequence
  Description of Artificial Sequence: Synthetic oligonucleotide
  Target: SCN10A; (-) strand; PAM type: NNNNGHTT; PAM sequence: CCAAGATT
accgcttcgggggttgcttt

SEQ ID NO: 10853 - DNA, 20 bp, Artificial Sequence
  Description of Artificial Sequence: Synthetic oligonucleotide
  Target: SCN10A; (-) strand; PAM type: NNNNGHTT; PAM sequence: GGTTGCTT
ccacagagtaccgcttcggg

SEQ ID NO: 10854 - DNA, 20 bp, Artificial Sequence
  Description of Artificial Sequence: Synthetic oligonucleotide
  Target: SCN10A; (-) strand; PAM type: NNNNGHTT; PAM sequence: TACCGCTT
ctggggttcttgccacagag

SEQ ID NO: 10855 - DNA, 20 bp, Artificial Sequence
  Description of Artificial Sequence: Synthetic oligonucleotide
  Target: SCN10A; (-) strand; PAM type: NNNNGHTT; PAM sequence: TTCAGCTT
aagaaggttcttcatctcag

SEQ ID NO: 10856 - DNA, 20 bp, Artificial Sequence
  Description of Artificial Sequence: Synthetic oligonucleotide
  Target: SCN10A; (-) strand; PAM type: NNNNGHTT; PAM sequence: TGGGGCTT
gatttgcatgggtgtccatg

SEQ ID NO: 10857 - DNA, 20 bp, Artificial Sequence
  Description of Artificial Sequence: Synthetic oligonucleotide
  Target: SCN10A; (-) strand; PAM type: NNNNGHTT; PAM sequence: AAAAGATT
tattgaaataaaataaaata

SEQ ID NO: 10858 - DNA, 20 bp, Artificial Sequence
  Description of Artificial Sequence: Synthetic oligonucleotide
  Target: SCN10A; (-) strand; PAM type: NNNNGHTT; PAM sequence: ACCTGTTT
tttctgtgcaacccaacacc

SEQ ID NO: 10859 - DNA, 20 bp, Artificial Sequence
  Description of Artificial Sequence: Synthetic oligonucleotide
  Target: SCN10A; (-) strand; PAM type: NNNNGHTT; PAM sequence: CACAGTTT
catatgcatgcttatagcag

SEQ ID NO: 10860 - DNA, 20 bp, Artificial Sequence
  Description of Artificial Sequence: Synthetic oligonucleotide
  Target: SCN10A; (-) strand; PAM type: NNNNGHTT; PAM sequence: GCATGCTT
ttaaaaagacacttgcatat

SEQ ID NO: 10861 - DNA, 20 bp, Artificial Sequence
  Description of Artificial Sequence: Synthetic oligonucleotide
  Target: SCN10A; (-) strand; PAM type: NNNNGHTT; PAM sequence: TGGAGATT
aaccactaaggaaaacgtta

SEQ ID NO: 10862 - DNA, 20 bp, Artificial Sequence
  Description of Artificial Sequence: Synthetic oligonucleotide
  Target: SCN10A; (-) strand; PAM type: NNNNGHTT; PAM sequence: CTATGCTT
gagagaaaaatctttgttat

SEQ ID NO: 10863 - DNA, 20 bp, Artificial Sequence
  Description of Artificial Sequence: Synthetic oligonucleotide
  Target: SCN10A; (-) strand; PAM type: NNNNGHTT; PAM sequence: ATTGGCTT
ttggaaaaactcttctagac

SEQ ID NO: 10864 - DNA, 20 bp, Artificial Sequence
  Description of Artificial Sequence: Synthetic oligonucleotide
  Target: SCN10A; (-) strand; PAM type: NNNNGHTT; PAM sequence: AAAGGCTT
aaatcaattcaagatggata

SEQ ID NO: 10865 - DNA, 20 bp, Artificial Sequence
  Description of Artificial Sequence: Synthetic oligonucleotide
  Target: SCN10A; (-) strand; PAM type: NNNNGHTT; PAM sequence: AGCTGATT
aaatctggaggcatcacctt

SEQ ID NO: 10866 - DNA, 20 bp, Artificial Sequence
  Description of Artificial Sequence: Synthetic oligonucleotide
  Target: SCN10A; (-) strand; PAM type: NNNNGHTT; PAM sequence: TACAGATT
ccttactgccaaaagcaata

SEQ ID NO: 10867 - DNA, 20 bp, Artificial Sequence
  Description of Artificial Sequence: Synthetic oligonucleotide
  Target: SCN10A; (-) strand; PAM type: NNNNGHTT; PAM sequence: GAAAGATT
atatacctaaccaaaaaggt

SEQ ID NO: 10868 - DNA, 20 bp, Artificial Sequence
  Description of Artificial Sequence: Synthetic oligonucleotide
  Target: SCN10A; (-) strand; PAM type: NNNNGHTT; PAM sequence: TAAAGTTT
gatctaataaatgaattcag

SEQ ID NO: 10869 - DNA, 20 bp, Artificial Sequence
  Description of Artificial Sequence: Synthetic oligonucleotide
  Target: SCN10A; (-) strand; PAM type: NNNNGHTT; PAM sequence: TTATGATT
tgacaaaatccagcatccca

SEQ ID NO: 10870 - DNA, 20 bp, Artificial Sequence
  Description of Artificial Sequence: Synthetic oligonucleotide
  Target: SCN10A; (-) strand; PAM type: NNNNGHTT; PAM sequence: GGATGATT
gtttcataccagggaggtag

SEQ ID NO: 10871 - DNA, 20 bp, Artificial Sequence
  Description of Artificial Sequence: Synthetic oligonucleotide
  Target: SCN10A; (-) strand; PAM type: NNNNGHTT; PAM sequence: GGGGGTTT
agataacacaccatgatcaa

SEQ ID NO: 10872 - DNA, 20 bp, Artificial Sequence
  Description of Artificial Sequence: Synthetic oligonucleotide
  Target: SCN10A; (-) strand; PAM type: NNNNGHTT; PAM sequence: ACTGGATT
gaaaaaaagtccaggagcag

SEQ ID NO: 10873 - DNA, 20 bp, Artificial Sequence
  Description of Artificial Sequence: Synthetic oligonucleotide
  Target: SCN10A; (-) strand; PAM type: NNNNGHTT; PAM sequence: GCGAGATT
aaacagaccaataacaagta

SEQ ID NO: 10874 - DNA, 20 bp, Artificial Sequence
  Description of Artificial Sequence: Synthetic oligonucleotide
  Target: SCN10A; (-) strand; PAM type: NNNNGHTT; PAM sequence: CTTAGATT
tcctggaaatatacaactgt

SEQ ID NO: 10875 - DNA, 20 bp, Artificial Sequence
  Description of Artificial Sequence: Synthetic oligonucleotide
  Target: SCN10A; (-) strand; PAM type: NNNNGHTT; PAM sequence: GCAAGATT
agaaaattgattgaccattg

SEQ ID NO: 10876 - DNA, 20 bp, Artificial Sequence
  Description of Artificial Sequence: Synthetic oligonucleotide
  Target: SCN10A; (-) strand; PAM type: NNNNGHTT; PAM sequence: AATTGATT
ttctttaaaaagatatagaa

SEQ ID NO: 10877 - DNA, 20 bp, Artificial Sequence
  Description of Artificial Sequence: Synthetic oligonucleotide
  Target: SCN10A; (-) strand; PAM type: NNNNGHTT; PAM sequence: GGAAGTTT
gtcaacaatgaaatcaagat

SEQ ID NO: 10878 - DNA, 20 bp, Artificial Sequence
  Description of Artificial Sequence: Synthetic oligonucleotide
  Target: SCN10A; (-) strand; PAM type: NNNNGHTT; PAM sequence: TAAAGTTT
cttcataagtgaagacaaga

SEQ ID NO: 10879 - DNA, 20 bp, Artificial Sequence
  Description of Artificial Sequence: Synthetic oligonucleotide
  Target: SCN10A; (-) strand; PAM type: NNNNGHTT; PAM sequence: CTAAGCTT
gaatattgtatgaagagaaa

SEQ ID NO: 10880 - DNA, 20 bp, Artificial Sequence
  Description of Artificial Sequence: Synthetic oligonucleotide
  Target: SCN10A; (-) strand; PAM type: NNNNGHTT; PAM sequence: AAGGGATT
actgaaaccttgcaagccag

SEQ ID NO: 10881 - DNA, 20 bp, Artificial Sequence
  Description of Artificial Sequence: Synthetic oligonucleotide
  Target: SCN10A; (-) strand; PAM type: NNNNGHTT; PAM sequence: AGCAGATT
ctgatttacataagattaac

SEQ ID NO: 10882 - DNA, 20 bp, Artificial Sequence
  Description of Artificial Sequence: Synthetic oligonucleotide
  Target: SCN10A; (-) strand; PAM type: NNNNGHTT; PAM sequence: ATAAGATT
ggaaaggttatctgatttac

SEQ ID NO: 10883 - DNA, 20 bp, Artificial Sequence
  Description of Artificial Sequence: Synthetic oligonucleotide
  Target: SCN10A; (-) strand; PAM type: NNNNGHTT; PAM sequence: ATCTGATT
taacctataaaggaaaggtt

SEQ ID NO: 10884 - DNA, 20 bp, Artificial Sequence
  Description of Artificial Sequence: Synthetic oligonucleotide
  Target: SCN10A; (-) strand; PAM type: NNNNGHTT; PAM sequence: AAAAGTTT
ccaaggaagaatagaaatct

SEQ ID NO: 10885 - DNA, 20 bp, Artificial Sequence
  Description of Artificial Sequence: Synthetic oligonucleotide
  Target: SCN10A; (-) strand; PAM type: NNNNGHTT; PAM sequence: CAAAGCTT
agaacttcagagctcgaaga

SEQ ID NO: 10886 - DNA, 20 bp, Artificial Sequence
  Description of Artificial Sequence: Synthetic oligonucleotide
  Target: SCN10A; (-) strand; PAM type: NNNNGHTT; PAM sequence: GAAAGTTT
gagaaatacaaaatgcagtg

SEQ ID NO: 10887 - DNA, 20 bp, Artificial Sequence
  Description of Artificial Sequence: Synthetic oligonucleotide
  Target: SCN10A; (-) strand; PAM type: NNNNGHTT; PAM sequence: AAGTGATT
aattcagaaggctgattatt

SEQ ID NO: 10888 - DNA, 20 bp, Artificial Sequence
  Description of Artificial Sequence: Synthetic oligonucleotide
  Target: SCN10A; (-) strand; PAM type: NNNNGHTT; PAM sequence: GGCTGATT
aaaaaaaaaagaattcagaa

SEQ ID NO: 10889 - DNA, 20 bp, Artificial Sequence
  Description of Artificial Sequence: Synthetic oligonucleotide
  Target: SCN10A; (-) strand; PAM type: NNNNGHTT; PAM sequence: AATTGCTT
tcaggagactgaggcaggag

SEQ ID NO: 10890 - DNA, 20 bp, Artificial Sequence
  Description of Artificial Sequence: Synthetic oligonucleotide
  Target: SCN10A; (-) strand; PAM type: NNNNGHTT; PAM sequence: AGGGGATT
tctcaggaagccccatcccc

SEQ ID NO: 10891 - DNA, 20 bp, Artificial Sequence
  Description of Artificial Sequence: Synthetic oligonucleotide
  Target: SCN10A; (-) strand; PAM type: NNNNGHTT; PAM sequence: GTGAGCTT
tttaccctggccaacttagg

SEQ ID NO: 10892 - DNA, 20 bp, Artificial Sequence
  Description of Artificial Sequence: Synthetic oligonucleotide
  Target: SCN10A; (-) strand; PAM type: NNNNGHTT; PAM sequence: GGAAGCTT
cacaaaacccagaaactctc

SEQ ID NO: 10893 - DNA, 20 bp, Artificial Sequence
  Description of Artificial Sequence: Synthetic oligonucleotide
  Target: SCN10A; (-) strand; PAM type: NNNNGHTT; PAM sequence: TCATGCTT
tgagggatgcggtccaaaag

SEQ ID NO: 10894 - DNA, 20 bp, Artificial Sequence
  Description of Artificial Sequence: Synthetic oligonucleotide
  Target: SCN10A; (-) strand; PAM type: NNNNGHTT; PAM sequence: AGAAGTTT
gggaggggtcacaggatgaa

SEQ ID NO: 10895 - DNA, 20 bp, Artificial Sequence
  Description of Artificial Sequence: Synthetic oligonucleotide
  Target: SCN10A; (-) strand; PAM type: NNNNGHTT; PAM sequence: TCCAGCTT
ccttgtaggcactcccagtc

SEQ ID NO: 10896 - DNA, 20 bp, Artificial Sequence
  Description of Artificial Sequence: Synthetic oligonucleotide
  Target: SCN10A; (-) strand; PAM type: NNNNGHTT; PAM sequence: GAACGTTT
agtgtggagactcacaccat

SEQ ID NO: 10897 - DNA, 20 bp, Artificial Sequence
  Description of Artificial Sequence: Synthetic oligonucleotide
  Target: SCN10A; (-) strand; PAM type: NNNNGHTT; PAM sequence: GCTGGATT
ctgagagatccttggaactg

SEQ ID NO: 10898 - DNA, 20 bp, Artificial Sequence
  Description of Artificial Sequence: Synthetic oligonucleotide
  Target: SCN10A; (-) strand; PAM type: NNNNGHTT; PAM sequence: AGAGGATT
ccttgataaagatactggca

SEQ ID NO: 10899 - DNA, 20 bp, Artificial Sequence
  Description of Artificial Sequence: Synthetic oligonucleotide
  Target: SCN10A; (-) strand; PAM type: NNNNGHTT; PAM sequence: GCATGTTT
tcaccttggtgatattcttt

SEQ ID NO: 10900 - DNA, 20 bp, Artificial Sequence
  Description of Artificial Sequence: Synthetic oligonucleotide
  Target: SCN10A; (-) strand; PAM type: NNNNGHTT; PAM sequence: TCTTGTTT
tctttttccctcagtctgtg

SEQ ID NO: 10901 - DNA, 20 bp, Artificial Sequence
  Description of Artificial Sequence: Synthetic oligonucleotide
  Target: SCN10A; (-) strand; PAM type: NNNNGHTT; PAM sequence: TCCAGCTT
tgggagtttttagatgagcc

SEQ ID NO: 10902 - DNA, 20 bp, Artificial Sequence
  Description of Artificial Sequence: Synthetic oligonucleotide
  Target: SCN10A; (-) strand; PAM type: NNNNGHTT; PAM sequence: GGGAGTTT
cactccagtttctaaaaact

SEQ ID NO: 10903 - DNA, 20 bp, Artificial Sequence
  Description of Artificial Sequence: Synthetic oligonucleotide
  Target: SCN10A; (-) strand; PAM type: NNNNGHTT; PAM sequence: TCCAGTTT
taccactcatcagtctgcac

SEQ ID NO: 10904 - DNA, 20 bp, Artificial Sequence
  Description of Artificial Sequence: Synthetic oligonucleotide
  Target: SCN10A; (-) strand; PAM type: NNNNGHTT; PAM sequence: TTCAGCTT
attccctgcttcagccagtt

SEQ ID NO: 10905 - DNA, 20 bp, Artificial Sequence
  Description of Artificial Sequence: Synthetic oligonucleotide
  Target: SCN10A; (-) strand; PAM type: NNNNGHTT; PAM sequence: GCCAGTTT
tctgggtattccctgcttca

SEQ ID NO: 10906 - DNA, 20 bp, Artificial Sequence
  Description of Artificial Sequence: Synthetic oligonucleotide
  Target: SCN10A; (-) strand; PAM type: NNNNGHTT; PAM sequence: CCCTGCTT
ttggcttgcttctgggtatt

SEQ ID NO: 10907 - DNA, 20 bp, Artificial Sequence
  Description of Artificial Sequence: Synthetic oligonucleotide
  Target: SCN10A; (-) strand; PAM type: NNNNGHTT; PAM sequence: GCTTGCTT
gggctctgcagcatagcttg

SEQ ID NO: 10908 - DNA, 20 bp, Artificial Sequence
  Description of Artificial Sequence: Synthetic oligonucleotide
  Target: SCN10A; (-) strand; PAM type: NNNNGHTT; PAM sequence: CTTGGCTT
tctggggctctgcagcatag

SEQ ID NO: 10909 - DNA, 20 bp, Artificial Sequence
  Description of Artificial Sequence: Synthetic oligonucleotide
  Target: SCN10A; (-) strand; PAM type: NNNNGHTT; PAM sequence: CATAGCTT
gcagttctggggctctgcag

SEQ ID NO: 10910 - DNA, 20 bp, Artificial Sequence
  Description of Artificial Sequence: Synthetic oligonucleotide
  Target: SCN10A; (-) strand; PAM type: NNNNGHTT; PAM sequence: CCTTGCTT
acttatcaccctcccccaaa

SEQ ID NO: 10911 - DNA, 20 bp, Artificial Sequence
  Description of Artificial Sequence: Synthetic oligonucleotide
  Target: SCN10A; (-) strand; PAM type: NNNNGHTT; PAM sequence: AACAGTTT
caatccatttctggagcaga

SEQ ID NO: 10912 - DNA, 20 bp, Artificial Sequence
  Description of Artificial Sequence: Synthetic oligonucleotide
  Target: SCN10A; (-) strand; PAM type: NNNNGHTT; PAM sequence: AACTGTTT
atatgcatttttcagtatgc

SEQ ID NO: 10913 - DNA, 20 bp, Artificial Sequence
  Description of Artificial Sequence: Synthetic oligonucleotide
  Target: SCN10A; (-) strand; PAM type: NNNNGHTT; PAM sequence: AGTTGTTT
cagaagtgaatagggagggg

SEQ ID NO: 10914 - DNA, 20 bp, Artificial Sequence
  Description of Artificial Sequence: Synthetic oligonucleotide
  Target: SCN10A; (-) strand; PAM type: NNNNGHTT; PAM sequence: ACCAGATT
agcatcttcatgggctctaa

SEQ ID NO: 10915 - DNA, 20 bp, Artificial Sequence
  Description of Artificial Sequence: Synthetic oligonucleotide
  Target: SCN10A; (-) strand; PAM type: NNNNGHTT; PAM sequence: TTTGGTTT
tttttcagttgtttggttgc

SEQ ID NO: 10916 - DNA, 20 bp, Artificial Sequence
  Description of Artificial Sequence: Synthetic oligonucleotide
  Target: SCN10A; (-) strand; PAM type: NNNNGHTT; PAM sequence: GGTTGCTT
tttttttttttcagttgttt

SEQ ID NO: 10917 - DNA, 20 bp, Artificial Sequence
  Description of Artificial Sequence: Synthetic oligonucleotide
  Target: SCN10A; (-) strand; PAM type: NNNNGHTT; PAM sequence: AGTTGTTT
ttcttttttttttttttttc

SEQ ID NO: 10918 - DNA, 20 bp, Artificial Sequence
  Description of Artificial Sequence: Synthetic oligonucleotide
  Target: SCN10A; (-) strand; PAM type: NNNNGHTT; PAM sequence: TACAGTTT
gagccacagcgcctggccaa

SEQ ID NO: 10919 - DNA, 20 bp, Artificial Sequence
  Description of Artificial Sequence: Synthetic oligonucleotide
  Target: SCN10A; (-) strand; PAM type: NNNNGHTT; PAM sequence: CTGCGATT
cgcctcggcctcccaaagtg

SEQ ID NO: 10920 - DNA, 20 bp, Artificial Sequence
  Description of Artificial Sequence: Synthetic oligonucleotide
  Target: SCN10A; (-) strand; PAM type: NNNNGHTT; PAM sequence: CGGGGTTT
ttttgtatttttagtagaga

SEQ ID NO: 10921 - DNA, 20 bp, Artificial Sequence
  Description of Artificial Sequence: Synthetic oligonucleotide
  Target: SCN10A; (-) strand; PAM type: NNNNGHTT; PAM sequence: TGTTGTTT
gttgttgttgctgttgttgt

SEQ ID NO: 10922 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
acaggtttttttttttttgt

SEQ ID NO: 10923 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
attagtacaggttttttttt

SEQ ID NO: 10924 - DNA, 20 bp, Artificial Sequence
  Description of Artificial Sequence: Synthetic oligonucleotide
  Target: SCN10A; (-) strand; PAM type: NNNNGHTT; PAM sequence: ACAGGTTT
aactctctaaaaatattagt

SEQ ID NO: 10925 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
ttttacttttgctatcatat

SEQ ID NO: 10926 - DNA, 20 bp, Artificial Sequence
  Description of Artificial Sequence: Synthetic oligonucleotide
  Target: SCN10A; (-) strand; PAM type: NNNNGHTT; PAM sequence: TAGTGTTT
ttatttacaagtccgcctat

SEQ ID NO: 10927 - DNA, 20 bp, Artificial Sequence
  Description of Artificial Sequence: Synthetic oligonucleotide
  Target: SCN10A; (-) strand; PAM type: NNNNGHTT; PAM sequence: GTGAGATT
gcttttttgttccacttcct

SEQ ID NO: 10928 - DNA, 20 bp, Artificial Sequence
  Description of Artificial Sequence: Synthetic oligonucleotide
  Target: SCN10A; (-) strand; PAM type: NNNNGHTT; PAM sequence: TTCTGCTT
ttttatcacttcctatccat

SEQ ID NO: 10929 - DNA, 20 bp, Artificial Sequence
  Description of Artificial Sequence: Synthetic oligonucleotide
  Target: SCN10A; (-) strand; PAM type: NNNNGHTT; PAM sequence: GTCTGATT
gtcaaacaatatacctccta

SEQ ID NO: 10930 - DNA, 20 bp, Artificial Sequence
  Description of Artificial Sequence: Synthetic oligonucleotide
  Target: SCN10A; (-) strand; PAM type: NNNNGHTT; PAM sequence: GACAGTTT
tcatatattctaccttcttt

SEQ ID NO: 10931 - DNA, 20 bp, Artificial Sequence
  Description of Artificial Sequence: Synthetic oligonucleotide
  Target: SCN10A; (-) strand; PAM type: NNNNGHTT; PAM sequence: CCCAGCTT
tacaggtacataccaccatg

SEQ ID NO: 10932 - DNA, 20 bp, Artificial Sequence
  Description of Artificial Sequence: Synthetic oligonucleotide
  Target: SCN10A; (-) strand; PAM type: NNNNGHTT; PAM sequence: TCTTGTTT
ccctggatcgcatatatgtt

SEQ ID NO: 10933 - DNA, 20 bp, Artificial Sequence
  Description of Artificial Sequence: Synthetic oligonucleotide
  Target: SCN10A; (-) strand; PAM type: NNNNGHTT; PAM sequence: ATATGTTT
gcctcttccctggatcgcat

SEQ ID NO: 10934 - DNA, 20 bp, Artificial Sequence
  Description of Artificial Sequence: Synthetic oligonucleotide
  Target: SCN10A; (-) strand; PAM type: NNNNGHTT; PAM sequence: TTTGGATT
tttttcttcttcattctttt

SEQ ID NO: 10935 - DNA, 20 bp, Artificial Sequence
  Description of Artificial Sequence: Synthetic oligonucleotide
  Target: SCN10A; (-) strand; PAM type: NNNNGHTT; PAM sequence: TAGAGATT
cctgatgcacagctgttttc

SEQ ID NO: 10936 - DNA, 20 bp, Artificial Sequence
  Description of Artificial Sequence: Synthetic oligonucleotide
  Target: SCN10A; (-) strand; PAM type: NNNNGHTT; PAM sequence: AGCTGTTT
gttttctaggcctgatgcac

SEQ ID NO: 10937 - DNA, 20 bp, Artificial Sequence
  Description of Artificial Sequence: Synthetic oligonucleotide
  Target: SCN10A; (-) strand; PAM type: NNNNGHTT; PAM sequence: AGATGTTT
cttctgcctcattctgacct

SEQ ID NO: 10938 - DNA, 20 bp, Artificial Sequence
  Description of Artificial Sequence: Synthetic oligonucleotide
  Target: SCN10A; (-) strand; PAM type: NNNNGHTT; PAM sequence: TGTTGCTT
ctcttctccagatgtttaat

SEQ ID NO: 10939 - DNA, 20 bp, Artificial Sequence
  Description of Artificial Sequence: Synthetic oligonucleotide
  Target: SCN10A; (-) strand; PAM type: NNNNGHTT; PAM sequence: AGATGTTT
ttgttcccaaactcttctcc

SEQ ID NO: 10940 - DNA, 20 bp, Artificial Sequence
  Description of Artificial Sequence: Synthetic oligonucleotide
  Target: SCN10A; (-) strand; PAM type: NNNNGHTT; PAM sequence: CTCAGTTT
ggattttatttttttgtttg

SEQ ID NO: 10941 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
agttaataaggattttattt

SEQ ID NO: 10942 - DNA, 20 bp, Artificial Sequence
  Description of Artificial Sequence: Synthetic oligonucleotide
  Target: SCN10A; (-) strand; PAM type: NNNNGHTT; PAM sequence: TAAGGATT
tttgctttccttggagttaa

SEQ ID NO: 10943 - DNA, 20 bp, Artificial Sequence
  Description of Artificial Sequence: Synthetic oligonucleotide
  Target: SCN10A; (-) strand; PAM type: NNNNGHTT; PAM sequence: TTTTGCTT
atttcctttttgcacaatgt

SEQ ID NO: 10944 - DNA, 20 bp, Artificial Sequence
  Description of Artificial Sequence: Synthetic oligonucleotide
  Target: SCN10A; (-) strand; PAM type: NNNNGHTT; PAM sequence: CAATGTTT
gactatatttcctttttgca

SEQ ID NO: 10945 - DNA, 20 bp, Artificial Sequence
  Description of Artificial Sequence: Synthetic oligonucleotide
  Target: SCN10A; (-) strand; PAM type: NNNNGHTT; PAM sequence: CACTGTTT
acattacattgctaagtaaa

SEQ ID NO: 10946 - DNA, 20 bp, Artificial Sequence
  Description of Artificial Sequence: Synthetic oligonucleotide
  Target: SCN10A; (-) strand; PAM type: NNNNGHTT; PAM sequence: ATTGGCTT
ttcaatttctgatgttattt

SEQ ID NO: 10947 - DNA, 20 bp, Artificial Sequence
  Description of Artificial Sequence: Synthetic oligonucleotide
  Target: SCN10A; (-) strand; PAM type: NNNNGHTT; PAM sequence: TTTAGCTT
tctttccagaggccaccact

SEQ ID NO: 10948 - DNA, 20 bp, Artificial Sequence
  Description of Artificial Sequence: Synthetic oligonucleotide
  Target: SCN10A; (-) strand; PAM type: NNNNGHTT; PAM sequence: TAAAGATT
taaaaggtcacagagtttta

SEQ ID NO: 10949 - DNA, 20 bp, Artificial Sequence
  Description of Artificial Sequence: Synthetic oligonucleotide
  Target: SCN10A; (-) strand; PAM type: NNNNGHTT; PAM sequence: CAGAGTTT
gttcataatttaaaaggtca

SEQ ID NO: 10950 - DNA, 20 bp, Artificial Sequence
  Description of Artificial Sequence: Synthetic oligonucleotide
  Target: SCN10A; (-) strand; PAM type: NNNNGHTT; PAM sequence: ACACGATT
agattcctaaatgatttcaa

SEQ ID NO: 10951 - DNA, 20 bp, Artificial Sequence
  Description of Artificial Sequence: Synthetic oligonucleotide
  Target: SCN10A; (-) strand; PAM type: NNNNGHTT; PAM sequence: AAATGATT
gcaaccagatatagattcct

SEQ ID NO: 10952 - DNA, 20 bp, Artificial Sequence
  Description of Artificial Sequence: Synthetic oligonucleotide
  Target: SCN10A; (-) strand; PAM type: NNNNGHTT; PAM sequence: TATAGATT
caagcagctatgcaaccaga

SEQ ID NO: 10953 - DNA, 20 bp, Artificial Sequence
  Description of Artificial Sequence: Synthetic oligonucleotide
  Target: SCN10A; (-) strand; PAM type: NNNNGHTT; PAM sequence: TTAAGATT
caacaacctataattctgag

SEQ ID NO: 10954 - DNA, 20 bp, Artificial Sequence
  Description of Artificial Sequence: Synthetic oligonucleotide
  Target: SCN10A; (-) strand; PAM type: NNNNGHTT; PAM sequence: CAAAGCTT
gacaaaccagaaatatccat

SEQ ID NO: 10955 - DNA, 20 bp, Artificial Sequence
  Description of Artificial Sequence: Synthetic oligonucleotide
  Target: SCN10A; (-) strand; PAM type: NNNNGHTT; PAM sequence: GTTTGATT
tccataatttctgggtctgt

SEQ ID NO: 10956 - DNA, 20 bp, Artificial Sequence
  Description of Artificial Sequence: Synthetic oligonucleotide
  Target: SCN10A; (-) strand; PAM type: NNNNGHTT; PAM sequence: CTGTGTTT
tctctccataatttctgggt

SEQ ID NO: 10957 - DNA, 20 bp, Artificial Sequence
  Description of Artificial Sequence: Synthetic oligonucleotide
  Target: SCN10A; (-) strand; PAM type: NNNNGHTT; PAM sequence: TTGGGCTT
agcacttaggaaataacaca

SEQ ID NO: 10958 - DNA, 20 bp, Artificial Sequence
  Description of Artificial Sequence: Synthetic oligonucleotide
  Target: SCN10A; (-) strand; PAM type: NNNNGHTT; PAM sequence: CAATGATT
cttgactttttcccaatacc

SEQ ID NO: 10959 - DNA, 20 bp, Artificial Sequence
  Description of Artificial Sequence: Synthetic oligonucleotide
  Target: SCN10A; (-) strand; PAM type: NNNNGHTT; PAM sequence: TCGGGATT
ttgttttcagagcctgaata

SEQ ID NO: 10960 - DNA, 20 bp, Artificial Sequence
  Description of Artificial Sequence: Synthetic oligonucleotide
  Target: SCN10A; (-) strand; PAM type: NNNNGHTT; PAM sequence: CTTTGTTT
agaatttgaatattatgaat

SEQ ID NO: 10961 - DNA, 20 bp, Artificial Sequence
  Description of Artificial Sequence: Synthetic oligonucleotide
  Target: SCN10A; (-) strand; PAM type: NNNNGHTT; PAM sequence: AAATGTTT
agttttaaaaataaggaatg

SEQ ID NO: 10962 - DNA, 20 bp, Artificial Sequence
  Description of Artificial Sequence: Synthetic oligonucleotide
  Target: SCN10A; (-) strand; PAM type: NNNNGHTT; PAM sequence: CAGAGTTT
gcaaatgggaagggcttaca

SEQ ID NO: 10963 - DNA, 20 bp, Artificial Sequence
  Description of Artificial Sequence: Synthetic oligonucleotide
  Target: SCN10A; (-) strand; PAM type: NNNNGHTT; PAM sequence: AAGGGCTT
tgctttggctggcaaatggg

SEQ ID NO: 10964 - DNA, 20 bp, Artificial Sequence
  Description of Artificial Sequence: Synthetic oligonucleotide
  Target: SCN10A; (-) strand; PAM type: NNNNGHTT; PAM sequence: AATTGCTT
gaggctgctctcccacactg

SEQ ID NO: 10965 - DNA, 20 bp, Artificial Sequence
  Description of Artificial Sequence: Synthetic oligonucleotide
  Target: SCN10A; (-) strand; PAM type: NNNNGHTT; PAM sequence: AACTGATT
cagtggaaattgtgaataca

SEQ ID NO: 10966 - DNA, 20 bp, Artificial Sequence
  Description of Artificial Sequence: Synthetic oligonucleotide
  Target: SCN10A; (-) strand; PAM type: NNNNGHTT; PAM sequence: TTCTGATT
gtctgtaatatgcctccaga

SEQ ID NO: 10967 - DNA, 20 bp, Artificial Sequence
  Description of Artificial Sequence: Synthetic oligonucleotide
  Target: SCN10A; (-) strand; PAM type: NNNNGHTT; PAM sequence: TCCAGATT
ctgggggtctgtaatatgcc

SEQ ID NO: 10968 - DNA, 20 bp, Artificial Sequence
  Description of Artificial Sequence: Synthetic oligonucleotide
  Target: SCN10A; (-) strand; PAM type: NNNNGHTT; PAM sequence: AAAAGTTT
atttctgttcgggattataa

SEQ ID NO: 10969 - DNA, 20 bp, Artificial Sequence
  Description of Artificial Sequence: Synthetic oligonucleotide
  Target: SCN10A; (-) strand; PAM type: NNNNGHTT; PAM sequence: TCGGGATT
tttaatgggtacatttctgt

SEQ ID NO: 10970 - DNA, 20 bp, Artificial Sequence
  Description of Artificial Sequence: Synthetic oligonucleotide
  Target: SCN10A; (-) strand; PAM type: NNNNGHTT; PAM sequence: GCATGATT
aacgcaaaagaacaaatgtt

SEQ ID NO: 10971 - DNA, 20 bp, Artificial Sequence
  Description of Artificial Sequence: Synthetic oligonucleotide
  Target: SCN10A; (-) strand; PAM type: NNNNGHTT; PAM sequence: ATGAGATT
tcattcagttttaaaaatga

SEQ ID NO: 10972 - DNA, 20 bp, Artificial Sequence
  Description of Artificial Sequence: Synthetic oligonucleotide
  Target: SCN10A; (-) strand; PAM type: NNNNGHTT; PAM sequence: TTCAGTTT
atgtaaacaattgaatatca

SEQ ID NO: 10973 - DNA, 20 bp, Artificial Sequence
  Description of Artificial Sequence: Synthetic oligonucleotide
  Target: SCN10A; (-) strand; PAM type: NNNNGHTT; PAM sequence: TAATGTTT
aggtatgttggcttatgcac

SEQ ID NO: 10974 - DNA, 20 bp, Artificial Sequence
  Description of Artificial Sequence: Synthetic oligonucleotide
  Target: SCN10A; (-) strand; PAM type: NNNNGHTT; PAM sequence: GTTGGCTT
aaacagactttaaaaggtat

SEQ ID NO: 10975 - DNA, 20 bp, Artificial Sequence
  Description of Artificial Sequence: Synthetic oligonucleotide
  Target: SCN10A; (-) strand; PAM type: NNNNGHTT; PAM sequence: ATTAGTTT
gctctctggtttaattaaaa

SEQ ID NO: 10976 - DNA, 20 bp, Artificial Sequence
  Description of Artificial Sequence: Synthetic oligonucleotide
  Target: SCN10A; (-) strand; PAM type: NNNNGHTT; PAM sequence: TCTGGTTT
taattttaaaagaagagctc

SEQ ID NO: 10977 - DNA, 20 bp, Artificial Sequence
  Description of Artificial Sequence: Synthetic oligonucleotide
  Target: SCN10A; (-) strand; PAM type: NNNNGHTT; PAM sequence: ACCAGTTT
tcctgctggtaagatacaaa

SEQ ID NO: 10978 - DNA, 20 bp, Artificial Sequence
  Description of Artificial Sequence: Synthetic oligonucleotide
  Target: SCN10A; (-) strand; PAM type: NNNNGHTT; PAM sequence: TAAGGCTT
tctctactacaagcacaaaa

SEQ ID NO: 10979 - DNA, 20 bp, Artificial Sequence
  Description of Artificial Sequence: Synthetic oligonucleotide
  Target: SCN10A; (-) strand; PAM type: NNNNGHTT; PAM sequence: TAAAGTTT
acttccatattattttccaa

SEQ ID NO: 10980 - DNA, 20 bp, Artificial Sequence
  Description of Artificial Sequence: Synthetic oligonucleotide
  Target: SCN10A; (-) strand; PAM type: NNNNGHTT; PAM sequence: TAACGTTT
gtacccaatttattatctgc

SEQ ID NO: 10981 - DNA, 20 bp, Artificial Sequence
  Description of Artificial Sequence: Synthetic oligonucleotide
  Target: SCN10A; (-) strand; PAM type: NNNNGHTT; PAM sequence: ATCTGTTT
tgtaaaaatacaaagcatga

SEQ ID NO: 10982 - DNA, 20 bp, Artificial Sequence
  Description of Artificial Sequence: Synthetic oligonucleotide
  Target: SCN10A; (-) strand; PAM type: NNNNGHTT; PAM sequence: AGTGGTTT
aaaagagtcatcacttcgaa

SEQ ID NO: 10983 - DNA, 20 bp, Artificial Sequence
  Description of Artificial Sequence: Synthetic oligonucleotide
  Target: SCN10A; (-) strand; PAM type: NNNNGHTT; PAM sequence: TGTCGCTT
cttgcatttgccattattac

SEQ ID NO: 10984 - DNA, 20 bp, Artificial Sequence
  Description of Artificial Sequence: Synthetic oligonucleotide
  Target: SCN10A; (-) strand; PAM type: NNNNGHTT; PAM sequence: GGCAGTTT
ttaacatggagttaatcata

SEQ ID NO: 10985 - DNA, 20 bp, Artificial Sequence
  Description of Artificial Sequence: Synthetic oligonucleotide
  Target: SCN10A; (-) strand; PAM type: NNNNGHTT; PAM sequence: AACTGATT
aacagtgtatgtgcttcaaa

SEQ ID NO: 10986 - DNA, 20 bp, Artificial Sequence
  Description of Artificial Sequence: Synthetic oligonucleotide
  Target: SCN10A; (-) strand; PAM type: NNNNGHTT; PAM sequence: ATGTGCTT
tatgttttcaaaaacagtgt

SEQ ID NO: 10987 - DNA, 20 bp, Artificial Sequence
  Description of Artificial Sequence: Synthetic oligonucleotide
  Target: SCN10A; (-) strand; PAM type: NNNNGHTT; PAM sequence: TTATGTTT
ttcatagaatttctaacttt

SEQ ID NO: 10988 - DNA, 20 bp, Artificial Sequence
  Description of Artificial Sequence: Synthetic oligonucleotide
  Target: SCN10A; (-) strand; PAM type: NNNNGHTT; PAM sequence: GTAAGATT
ataattttaaaatctaacat

SEQ ID NO: 10989 - DNA, 20 bp, Artificial Sequence
  Description of Artificial Sequence: Synthetic oligonucleotide
  Target: SCN10A; (-) strand; PAM type: NNNNGHTT; PAM sequence: CAATGTTT
tcatctctctccatctccta

SEQ ID NO: 10990 - DNA, 20 bp, Artificial Sequence
  Description of Artificial Sequence: Synthetic oligonucleotide
  Target: SCN10A; (-) strand; PAM type: NNNNGHTT; PAM sequence: CTTTGTTT
ggaactccaacttattctta

SEQ ID NO: 10991 - DNA, 20 bp, Artificial Sequence
  Description of Artificial Sequence: Synthetic oligonucleotide
  Target: SCN10A; (-) strand; PAM type: NNNNGHTT; PAM sequence: GCTGGATT
tggttccagctgatcatttt

SEQ ID NO: 10992 - DNA, 20 bp, Artificial Sequence
  Description of Artificial Sequence: Synthetic oligonucleotide
  Target: SCN10A; (-) strand; PAM type: NNNNGHTT; PAM sequence: ACAGGTTT
tatagtaaatctgtaaacta

SEQ ID NO: 10993 - DNA, 20 bp, Artificial Sequence
  Description of Artificial Sequence: Synthetic oligonucleotide
  Target: SCN10A; (-) strand; PAM type: NNNNGHTT; PAM sequence: GTTGGCTT
gactttcatcatgaatgggt

SEQ ID NO: 10994 - DNA, 20 bp, Artificial Sequence
  Description of Artificial Sequence: Synthetic oligonucleotide
  Target: SCN10A; (-) strand; PAM type: NNNNGHTT; PAM sequence: TCTTGTTT
ttatatcaattttttccatt

SEQ ID NO: 10995 - DNA, 20 bp, Artificial Sequence
  Description of Artificial Sequence: Synthetic oligonucleotide
  Target: SCN10A; (-) strand; PAM type: NNNNGHTT; PAM sequence: TGATGTTT
cttctaatgtttcactatta

SEQ ID NO: 10996 - DNA, 20 bp, Artificial Sequence
  Description of Artificial Sequence: Synthetic oligonucleotide
  Target: SCN10A; (-) strand; PAM type: NNNNGHTT; PAM sequence: TAATGTTT
gattttaaagtgtgtgcttc

SEQ ID NO: 10997 - DNA, 20 bp, Artificial Sequence
  Description of Artificial Sequence: Synthetic oligonucleotide
  Target: SCN10A; (-) strand; PAM type: NNNNGHTT; PAM sequence: GTGTGCTT
tttgctcttgattttaaagt

SEQ ID NO: 10998 - DNA, 20 bp, Artificial Sequence
  Description of Artificial Sequence: Synthetic oligonucleotide
  Target: SCN10A; (-) strand; PAM type: NNNNGHTT; PAM sequence: TCTTGATT
agtgagcatatttattttgc

SEQ ID NO: 10999 - DNA, 20 bp, Artificial Sequence
  Description of Artificial Sequence: Synthetic oligonucleotide
  Target: SCN10A; (-) strand; PAM type: NNNNGHTT; PAM sequence: TTATGATT
tgacaaacttgtttcttcct

SEQ ID NO: 11000 - DNA, 20 bp, Artificial Sequence
  Description of Artificial Sequence: Synthetic oligonucleotide
  Target: SCN10A; (-) strand; PAM type: NNNNGHTT; PAM sequence: ACTTGTTT
ttatctgcaaataatgacaa

SEQ ID NO: 11001 - DNA, 20 bp, Artificial Sequence
  Description of Artificial Sequence: Synthetic oligonucleotide
  Target: SCN10A; (-) strand; PAM type: NNNNGHTT; PAM sequence: TGTAGATT
tccttaaagttaaatttttc

SEQ ID NO: 11002 - DNA, 20 bp, Artificial Sequence
  Description of Artificial Sequence: Synthetic oligonucleotide
  Target: SCN10A; (-) strand; PAM type: NNNNGHTT; PAM sequence: TAGTGATT
taatattattaatttctata

SEQ ID NO: 11003 - DNA, 20 bp, Artificial Sequence
  Description of Artificial Sequence: Synthetic oligonucleotide
  Target: SCN10A; (-) strand; PAM type: NNNNGHTT; PAM sequence: AATTGATT
ctttgtttggtaatgcactg

SEQ ID NO: 11004 - DNA, 20 bp, Artificial Sequence
  Description of Artificial Sequence: Synthetic oligonucleotide
  Target: SCN10A; (-) strand; PAM type: NNNNGHTT; PAM sequence: CTTTGTTT
ttcttacaactctgtggaaa

SEQ ID NO: 11005 - DNA, 20 bp, Artificial Sequence
  Description of Artificial Sequence: Synthetic oligonucleotide
  Target: SCN10A; (-) strand; PAM type: NNNNGHTT; PAM sequence: ATCAGTTT
ttgtttctttacttttccat

SEQ ID NO: 11006 - DNA, 20 bp, Artificial Sequence
  Description of Artificial Sequence: Synthetic oligonucleotide
  Target: SCN10A; (-) strand; PAM type: NNNNGHTT; PAM sequence: TCTTGTTT
ttcttgaaaattattttggt

SEQ ID NO: 11007 - DNA, 20 bp, Artificial Sequence
  Description of Artificial Sequence: Synthetic oligonucleotide
  Target: SCN10A; (-) strand; PAM type: NNNNGHTT; PAM sequence: GGTCGATT
tctatagtaagatttgacct

SEQ ID NO: 11008 - DNA, 20 bp, Artificial Sequence
  Description of Artificial Sequence: Synthetic oligonucleotide
  Target: SCN10A; (-) strand; PAM type: NNNNGHTT; PAM sequence: GTAAGATT
gtggatttaaatgctctata

SEQ ID NO: 11009 - DNA, 20 bp, Artificial Sequence
  Description of Artificial Sequence: Synthetic oligonucleotide
  Target: SCN10A; (-) strand; PAM type: NNNNGHTT; PAM sequence: CGTGGATT
cacatcctgagtcaacacca

SEQ ID NO: 11010 - DNA, 20 bp, Artificial Sequence
  Description of Artificial Sequence: Synthetic oligonucleotide
  Target: SCN10A; (-) strand; PAM type: NNNNGHTT; PAM sequence: ATCTGTTT
cagattcccatgtctactga

SEQ ID NO: 11011 - DNA, 20 bp, Artificial Sequence
  Description of Artificial Sequence: Synthetic oligonucleotide
  Target: SCN10A; (-) strand; PAM type: NNNNGHTT; PAM sequence: ACCAGATT
taccactgcttctgccatgc

SEQ ID NO: 11012 - DNA, 20 bp, Artificial Sequence
  Description of Artificial Sequence: Synthetic oligonucleotide
  Target: SCN10A; (-) strand; PAM type: NNNNGHTT; PAM sequence: CACTGCTT
atttcccaagtggttcctac

SEQ ID NO: 11013 - DNA, 20 bp, Artificial Sequence
  Description of Artificial Sequence: Synthetic oligonucleotide
  Target: SCN10A; (-) strand; PAM type: NNNNGHTT; PAM sequence: TATGGATT
aggcttccaatatttttcca

SEQ ID NO: 11014 - DNA, 20 bp, Artificial Sequence
  Description of Artificial Sequence: Synthetic oligonucleotide
  Target: SCN10A; (-) strand; PAM type: NNNNGHTT; PAM sequence: ATAGGCTT
ttgtatgtgtgtggtatgag

SEQ ID NO: 11015 - DNA, 20 bp, Artificial Sequence
  Description of Artificial Sequence: Synthetic oligonucleotide
  Target: SCN10A; (-) strand; PAM type: NNNNGHTT; PAM sequence: TACAGTTT
ctgtgttttctcctcaaagt

SEQ ID NO: 11016 - DNA, 20 bp, Artificial Sequence
  Description of Artificial Sequence: Synthetic oligonucleotide
  Target: SCN10A; (-) strand; PAM type: NNNNGHTT; PAM sequence: CTGTGTTT
tattccataaagatattatc

SEQ ID NO: 11017 - DNA, 20 bp, Artificial Sequence
  Description of Artificial Sequence: Synthetic oligonucleotide
  Target: SCN10A; (-) strand; PAM type: NNNNGHTT; PAM sequence: TTGGGATT
gatgttttaaaattatgttt

SEQ ID NO: 11018 - DNA, 20 bp, Artificial Sequence
  Description of Artificial Sequence: Synthetic oligonucleotide
  Target: SCN10A; (-) strand; PAM type: NNNNGHTT; PAM sequence: TTATGTTT
ctttatctgatgttttaaaa

SEQ ID NO: 11019 - DNA, 20 bp, Artificial Sequence
  Description of Artificial Sequence: Synthetic oligonucleotide
  Target: SCN10A; (-) strand; PAM type: NNNNGHTT; PAM sequence: TGATGTTT
ttttatatgtgtgctttatc

SEQ ID NO: 11020 - DNA, 20 bp, Artificial Sequence
  Description of Artificial Sequence: Synthetic oligonucleotide
  Target: SCN10A; (-) strand; PAM type: NNNNGHTT; PAM sequence: GTGTGCTT
gaactgttatcattttatat

SEQ ID NO: 11021 - DNA, 20 bp, Artificial Sequence
  Description of Artificial Sequence: Synthetic oligonucleotide
  Target: SCN10A; (-) strand; PAM type: NNNNGHTT; PAM sequence: TATTGATT
ttaacactgcatgcataaag

SEQ ID NO: 11022 - DNA, 20 bp, Artificial Sequence
  Description of Artificial Sequence: Synthetic oligonucleotide
  Target: SCN10A; (-) strand; PAM type: NNNNGHTT; PAM sequence: GGGTGTTT
tctactgcaaacggggaagt

SEQ ID NO: 11023 - DNA, 20 bp, Artificial Sequence
  Description of Artificial Sequence: Synthetic oligonucleotide
  Target: SCN10A; (-) strand; PAM type: NNNNGHTT; PAM sequence: AAATGTTT
aatttggttgtagagaagat

SEQ ID NO: 11024 - DNA, 20 bp, Artificial Sequence
  Description of Artificial Sequence: Synthetic oligonucleotide
  Target: SCN10A; (-) strand; PAM type: NNNNGHTT; PAM sequence: CCTGGTTT
ctttcctactctccccatgc

SEQ ID NO: 11025 - DNA, 20 bp, Artificial Sequence
  Description of Artificial Sequence: Synthetic oligonucleotide
  Target: SCN10A; (-) strand; PAM type: NNNNGHTT; PAM sequence: CTCAGATT
gaagaaactagaggttcttc

SEQ ID NO: 11026 - DNA, 20 bp, Artificial Sequence
  Description of Artificial Sequence: Synthetic oligonucleotide
  Target: SCN10A; (-) strand; PAM type: NNNNGHTT; PAM sequence: TTTTGCTT
ttccattttctaatcccctc

SEQ ID NO: 11027 - DNA, 20 bp, Artificial Sequence
  Description of Artificial Sequence: Synthetic oligonucleotide
  Target: SCN10A; (-) strand; PAM type: NNNNGHTT; PAM sequence: GTCTGCTT
ttctgcgtgcctgcctatct

SEQ ID NO: 11028 - DNA, 20 bp, Artificial Sequence
  Description of Artificial Sequence: Synthetic oligonucleotide
  Target: SCN10A; (-) strand; PAM type: NNNNGHTT; PAM sequence: ATTAGCTT
ccattattccttgctgaaac

SEQ ID NO: 11029 - DNA, 20 bp, Artificial Sequence
  Description of Artificial Sequence: Synthetic oligonucleotide
  Target: SCN10A; (-) strand; PAM type: NNNNGHTT; PAM sequence: AGTTGTTT
gcaaattgataatagccatt

SEQ ID NO: 11030 - DNA, 20 bp, Artificial Sequence
  Description of Artificial Sequence: Synthetic oligonucleotide
  Target: SCN10A; (-) strand; PAM type: NNNNGHTT; PAM sequence: ACTAGATT
ggcctcgtggaaataatcag

SEQ ID NO: 11031 - DNA, 20 bp, Artificial Sequence
  Description of Artificial Sequence: Synthetic oligonucleotide
  Target: SCN10A; (-) strand; PAM type: NNNNGHTT; PAM sequence: AGGAGATT
aattatcaaatccattcttt

SEQ ID NO: 11032 - DNA, 20 bp, Artificial Sequence
  Description of Artificial Sequence: Synthetic oligonucleotide
  Target: SCN10A; (-) strand; PAM type: NNNNGHTT; PAM sequence: TGAAGTTT
tttcatttgcatggatgaag

SEQ ID NO: 11033 - DNA, 20 bp, Artificial Sequence
  Description of Artificial Sequence: Synthetic oligonucleotide
  Target: SCN10A; (-) strand; PAM type: NNNNGHTT; PAM sequence: AACAGATT
tgttttatagaaattagctg

SEQ ID NO: 11034 - DNA, 20 bp, Artificial Sequence
  Description of Artificial Sequence: Synthetic oligonucleotide
  Target: SCN10A; (-) strand; PAM type: NNNNGHTT; PAM sequence: AGCTGTTT
cccaaaaaaatcccagcagc

SEQ ID NO: 11035 - DNA, 20 bp, Artificial Sequence
  Description of Artificial Sequence: Synthetic oligonucleotide
  Target: SCN10A; (-) strand; PAM type: NNNNGHTT; PAM sequence: AGAAGATT
atgtctcatgtgactggatt

SEQ ID NO: 11036 - DNA, 20 bp, Artificial Sequence
  Description of Artificial Sequence: Synthetic oligonucleotide
  Target: SCN10A; (-) strand; PAM type: NNNNGHTT; PAM sequence: ACTGGATT
attaaaggatgtctcatgtg

SEQ ID NO: 11037 - DNA, 20 bp, Artificial Sequence
  Description of Artificial Sequence: Synthetic oligonucleotide
  Target: SCN10A; (-) strand; PAM type: NNNNGHTT; PAM sequence: AACAGTTT
cgagggaaggaaagataaaa

SEQ ID NO: 11038 - DNA, 20 bp, Artificial Sequence
  Description of Artificial Sequence: Synthetic oligonucleotide
  Target: SCN10A; (-) strand; PAM type: NNNNGHTT; PAM sequence: ATCTGATT
taatataattaatataatgt

SEQ ID NO: 11039 - DNA, 20 bp, Artificial Sequence
  Description of Artificial Sequence: Synthetic oligonucleotide
  Target: SCN10A; (-) strand; PAM type: NNNNGHTT; PAM sequence: CCATGATT
gcaaacaaagaaagcaggat

SEQ ID NO: 11040 - DNA, 20 bp, Artificial Sequence
  Description of Artificial Sequence: Synthetic oligonucleotide
  Target: SCN10A; (-) strand; PAM type: NNNNGHTT; PAM sequence: AATGGATT
ctgtcatgtcactaaatata

SEQ ID NO: 11041 - DNA, 20 bp, Artificial Sequence
  Description of Artificial Sequence: Synthetic oligonucleotide
  Target: SCN10A; (-) strand; PAM type: NNNNGHTT; PAM sequence: ATTTGCTT
caaataagaaaatcgctcga

SEQ ID NO: 11042 - DNA, 20 bp, Artificial Sequence
  Description of Artificial Sequence: Synthetic oligonucleotide
  Target: SCN10A; (-) strand; PAM type: NNNNGHTT; PAM sequence: TGCTGCTT
tgttgatgttgagttgtctc

SEQ ID NO: 11043 - DNA, 20 bp, Artificial Sequence
  Description of Artificial Sequence: Synthetic oligonucleotide
  Target: SCN10A; (-) strand; PAM type: NNNNGHTT; PAM sequence: CGATGATT
agttgtaagaggatcaactt

SEQ ID NO: 11044 - DNA, 20 bp, Artificial Sequence
  Description of Artificial Sequence: Synthetic oligonucleotide
  Target: SCN10A; (-) strand; PAM type: NNNNGHTT; PAM sequence: CTCAGCTT
tggtcaacgatgagttcttc

SEQ ID NO: 11045 - DNA, 20 bp, Artificial Sequence
  Description of Artificial Sequence: Synthetic oligonucleotide
  Target: SCN10A; (-) strand; PAM type: NNNNGHTT; PAM sequence: ATTTGCTT
ggagctgtttcacctttcca

SEQ ID NO: 11046 - DNA, 20 bp, Artificial Sequence
  Description of Artificial Sequence: Synthetic oligonucleotide
  Target: SCN10A; (-) strand; PAM type: NNNNGHTT; PAM sequence: AGCTGTTT
tatgaggcacccatttatgg

SEQ ID NO: 11047 - DNA, 20 bp, Artificial Sequence
  Description of Artificial Sequence: Synthetic oligonucleotide
  Target: SCN10A; (-) strand; PAM type: NNNNGHTT; PAM sequence: CTTAGCTT
cgattttttaaacatttttc

SEQ ID NO: 11048 - DNA, 20 bp, Artificial Sequence
  Description of Artificial Sequence: Synthetic oligonucleotide
  Target: SCN10A; (-) strand; PAM type: NNNNGHTT; PAM sequence: TGACGATT
gagacgacaacacttcaaaa

SEQ ID NO: 11049 - DNA, 20 bp, Artificial Sequence
  Description of Artificial Sequence: Synthetic oligonucleotide
  Target: SCN10A; (-) strand; PAM type: NNNNGHTT; PAM sequence: ATCTGATT
actttttatcgcacatcaca

SEQ ID NO: 11050 - DNA, 20 bp, Artificial Sequence
  Description of Artificial Sequence: Synthetic oligonucleotide
  Target: SCN10A; (-) strand; PAM type: NNNNGHTT; PAM sequence: TGGAGCTT
ttgggttttgggaagtgctt

SEQ ID NO: 11051 - DNA, 20 bp, Artificial Sequence
  Description of Artificial Sequence: Synthetic oligonucleotide
  Target: SCN10A; (-) strand; PAM type: NNNNGHTT; PAM sequence: AAGTGCTT
ggtgcaagttgggttttggg

SEQ ID NO: 11052 - DNA, 20 bp, Artificial Sequence
  Description of Artificial Sequence: Synthetic oligonucleotide
  Target: SCN10A; (-) strand; PAM type: NNNNGHTT; PAM sequence: TTGGGTTT
acgactttttttggtgcaag

SEQ ID NO: 11053 - DNA, 20 bp, Artificial Sequence
  Description of Artificial Sequence: Synthetic oligonucleotide
  Target: SCN10A; (-) strand; PAM type: NNNNGHTT; PAM sequence: CTGGGATT
tctcagatgtaatggctttg

SEQ ID NO: 11054 - DNA, 20 bp, Artificial Sequence
  Description of Artificial Sequence: Synthetic oligonucleotide
  Target: SCN10A; (-) strand; PAM type: NNNNGHTT; PAM sequence: AATGGCTT
tgaacatatttctcagatgt

SEQ ID NO: 11055 - DNA, 20 bp, Artificial Sequence
  Description of Artificial Sequence: Synthetic oligonucleotide
  Target: SCN10A; (-) strand; PAM type: NNNNGHTT; PAM sequence: CATCGATT
ttgcagttttctgtgcatct

SEQ ID NO: 11056 - DNA, 20 bp, Artificial Sequence
  Description of Artificial Sequence: Synthetic oligonucleotide
  Target: SCN10A; (-) strand; PAM type: NNNNGHTT; PAM sequence: TGCAGTTT
ccaatgccagctgcaggcct

SEQ ID NO: 11057 - DNA, 20 bp, Artificial Sequence
  Description of Artificial Sequence: Synthetic oligonucleotide
  Target: SCN10A; (-) strand; PAM type: NNNNGHTT; PAM sequence: AGATGCTT
tcacctgcaaaaagttgttc

SEQ ID NO: 11058 - DNA, 20 bp, Artificial Sequence
  Description of Artificial Sequence: Synthetic oligonucleotide
  Target: SCN10A; (-) strand; PAM type: NNNNGHTT; PAM sequence: AAGTGTTT
ctgcatcccgctggttatgg

SEQ ID NO: 11059 - DNA, 20 bp, Artificial Sequence
  Description of Artificial Sequence: Synthetic oligonucleotide
  Target: SCN10A; (-) strand; PAM type: NNNNGHTT; PAM sequence: TTGGGATT
gtagcataaaaatccatgct

SEQ ID NO: 11060 - DNA, 20 bp, Artificial Sequence
  Description of Artificial Sequence: Synthetic oligonucleotide
  Target: SCN10A; (-) strand; PAM type: NNNNGHTT; PAM sequence: CCATGCTT
tattcctgtagcataaaaat

SEQ ID NO: 11061 - DNA, 20 bp, Artificial Sequence
  Description of Artificial Sequence: Synthetic oligonucleotide
  Target: SCN10A; (-) strand; PAM type: NNNNGHTT; PAM sequence: GTTTGTTT
tttttgccaatgagaaatga

SEQ ID NO: 11062 - DNA, 20 bp, Artificial Sequence
  Description of Artificial Sequence: Synthetic oligonucleotide
  Target: SCN10A; (-) strand; PAM type: NNNNGHTT; PAM sequence: ATGAGTTT
cacatttttgccaatgagaa

SEQ ID NO: 11063 - DNA, 20 bp, Artificial Sequence
  Description of Artificial Sequence: Synthetic oligonucleotide
  Target: SCN10A; (-) strand; PAM type: NNNNGHTT; PAM sequence: TGGGGTTT
tgaaaaggtacaaaagtaat

SEQ ID NO: 11064 - DNA, 20 bp, Artificial Sequence
  Description of Artificial Sequence: Synthetic oligonucleotide
  Target: SCN10A; (-) strand; PAM type: NNNNGHTT; PAM sequence: ATAAGTTT
attataattataaatttata

SEQ ID NO: 11065 - DNA, 20 bp, Artificial Sequence
  Description of Artificial Sequence: Synthetic oligonucleotide
  Target: SCN10A; (-) strand; PAM type: NNNNGHTT; PAM sequence: CACGGTTT
acactaaggacaatgtatta

SEQ ID NO: 11066 - DNA, 20 bp, Artificial Sequence
  Description of Artificial Sequence: Synthetic oligonucleotide
  Target: SCN10A; (-) strand; PAM type: NNNNGHTT; PAM sequence: TTTTGATT
caccaaatggaaatgagaga

SEQ ID NO: 11067 - DNA, 20 bp, Artificial Sequence
  Description of Artificial Sequence: Synthetic oligonucleotide
  Target: SCN10A; (-) strand; PAM type: NNNNGHTT; PAM sequence: GAGAGATT
aggaatcaccaaatggaaat

SEQ ID NO: 11068 - DNA, 20 bp, Artificial Sequence
  Description of Artificial Sequence: Synthetic oligonucleotide
  Target: SCN10A; (-) strand; PAM type: NNNNGHTT; PAM sequence: TGCTGCTT
agcagagtatgttcacttac

SEQ ID NO: 11069 - DNA, 20 bp, Artificial Sequence
  Description of Artificial Sequence: Synthetic oligonucleotide
  Target: SCN10A; (-) strand; PAM type: NNNNGHTT; PAM sequence: CAGGGTTT
tggtaaatcacttagcagat

SEQ ID NO: 11070 - DNA, 20 bp, Artificial Sequence
  Description of Artificial Sequence: Synthetic oligonucleotide
  Target: SCN10A; (-) strand; PAM type: NNNNGHTT; PAM sequence: ATATGTTT
aaatatggaagatagaatgc

SEQ ID NO: 11071 - DNA, 20 bp, Artificial Sequence
  Description of Artificial Sequence: Synthetic oligonucleotide
  Target: SCN10A; (-) strand; PAM type: NNNNGHTT; PAM sequence: TGGAGATT
tgagttatttgggagttatt

SEQ ID NO: 11072 - DNA, 20 bp, Artificial Sequence
  Description of Artificial Sequence: Synthetic oligonucleotide
  Target: SCN10A; (-) strand; PAM type: NNNNGHTT; PAM sequence: TGGAGTTT
taaaatgtctatgcttcttt

SEQ ID NO: 11073 - DNA, 20 bp, Artificial Sequence
  Description of Artificial Sequence: Synthetic oligonucleotide
  Target: SCN10A; (-) strand; PAM type: NNNNGHTT; PAM sequence: CTATGCTT
tcatatagcatgtaaaatgt

SEQ ID NO: 11074 - DNA, 20 bp, Artificial Sequence
  Description of Artificial Sequence: Synthetic oligonucleotide
  Target: SCN10A; (-) strand; PAM type: NNNNGHTT; PAM sequence: TTATGTTT
tttgttttaaaataattaat

SEQ ID NO: 11075 - DNA, 20 bp, Artificial Sequence
  Description of Artificial Sequence: Synthetic oligonucleotide
  Target: SCN10A; (-) strand; PAM type: NNNNGHTT; PAM sequence: ATTTGTTT
aggctgactaatacacaaac

SEQ ID NO: 11076 - DNA, 20 bp, Artificial Sequence
  Description of Artificial Sequence: Synthetic oligonucleotide
  Target: SCN10A; (-) strand; PAM type: NNNNGHTT; PAM sequence: TCCAGATT
cccaatctcaggcttcaacc

SEQ ID NO: 11077 - DNA, 20 bp, Artificial Sequence
  Description of Artificial Sequence: Synthetic oligonucleotide
  Target: SCN10A; (-) strand; PAM type: NNNNGHTT; PAM sequence: TCAGGCTT
actatgctgacatcccaatc

SEQ ID NO: 11078 - DNA, 20 bp, Artificial Sequence
  Description of Artificial Sequence: Synthetic oligonucleotide
  Target: SCN10A; (-) strand; PAM type: NNNNGHTT; PAM sequence: GACAGCTT
gtgtccttataagagaaaga

SEQ ID NO: 11079 - DNA, 20 bp, Artificial Sequence
  Description of Artificial Sequence: Synthetic oligonucleotide
  Target: SCN10A; (-) strand; PAM type: NNNNGHTT; PAM sequence: AGGTGATT
tggagattgggcctctaagg

SEQ ID NO: 11080 - DNA, 20 bp, Artificial Sequence
  Description of Artificial Sequence: Synthetic oligonucleotide
  Target: SCN10A; (-) strand; PAM type: NNNNGHTT; PAM sequence: TGGAGATT
aaccccccatgttgctatgt

SEQ ID NO: 11081 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
aatcaagcaaaactaaacta

SEQ ID NO: 11082 - DNA, 20 bp, Artificial Sequence
  Description of Artificial Sequence: Synthetic oligonucleotide
  Target: SCN10A; (-) strand; PAM type: NNNNGHTT; PAM sequence: TAAAGTTT
ataaacaaggttcatttata

SEQ ID NO: 11083 - DNA, 20 bp, Artificial Sequence
  Description of Artificial Sequence: Synthetic oligonucleotide
  Target: SCN10A; (-) strand; PAM type: NNNNGHTT; PAM sequence: AAAGGATT
gaacaaaaaaagccaaatgc

SEQ ID NO: 11084 - DNA, 20 bp, Artificial Sequence
  Description of Artificial Sequence: Synthetic oligonucleotide
  Target: SCN10A; (-) strand; PAM type: NNNNGHTT; PAM sequence: GAAAGTTT
acaccagattacagctacaa

SEQ ID NO: 11085 - DNA, 20 bp, Artificial Sequence
  Description of Artificial Sequence: Synthetic oligonucleotide
  Target: SCN10A; (-) strand; PAM type: NNNNGHTT; PAM sequence: ACCAGATT
agaaatatgtacttgtggac

SEQ ID NO: 11086 - DNA, 20 bp, Artificial Sequence
  Description of Artificial Sequence: Synthetic oligonucleotide
  Target: SCN10A; (-) strand; PAM type: NNNNGHTT; PAM sequence: CTATGTTT
tctattacacccttaggtac

SEQ ID NO: 11087 - DNA, 20 bp, Artificial Sequence
  Description of Artificial Sequence: Synthetic oligonucleotide
  Target: SCN10A; (-) strand; PAM type: NNNNGHTT; PAM sequence: CTGAGATT
agttgcaaattaaaatcaca

SEQ ID NO: 11088 - DNA, 20 bp, Artificial Sequence
  Description of Artificial Sequence: Synthetic oligonucleotide
  Target: SCN10A; (-) strand; PAM type: NNNNGHTT; PAM sequence: AAGTGCTT
ctttaagagcatgaaaaagc

SEQ ID NO: 11089 - DNA, 20 bp, Artificial Sequence
  Description of Artificial Sequence: Synthetic oligonucleotide
  Target: SCN10A; (-) strand; PAM type: NNNNGHTT; PAM sequence: ATAAGCTT
agccgacttgatcgtggtgg

SEQ ID NO: 11090 - DNA, 20 bp, Artificial Sequence
  Description of Artificial Sequence: Synthetic oligonucleotide
  Target: SCN10A; (-) strand; PAM type: NNNNGHTT; PAM sequence: ACCAGCTT
tattgacttgcgtatgttga

SEQ ID NO: 11091 - DNA, 20 bp, Artificial Sequence
  Description of Artificial Sequence: Synthetic oligonucleotide
  Target: SCN10A; (-) strand; PAM type: NNNNGHTT; PAM sequence: TTACGTTT
ggttctgtttgtgtgatgga

SEQ ID NO: 11092 - DNA, 20 bp, Artificial Sequence
  Description of Artificial Sequence: Synthetic oligonucleotide
  Target: SCN10A; (-) strand; PAM type: NNNNGHTT; PAM sequence: GATGGATT
gtcattggttctgtttgtgt

SEQ ID NO: 11093 - DNA, 20 bp, Artificial Sequence
  Description of Artificial Sequence: Synthetic oligonucleotide
  Target: SCN10A; (-) strand; PAM type: NNNNGHTT; PAM sequence: TTCTGTTT
cacgtggtttttgtcattgg

SEQ ID NO: 11094 - DNA, 20 bp, Artificial Sequence
  Description of Artificial Sequence: Synthetic oligonucleotide
  Target: SCN10A; (-) strand; PAM type: NNNNGHTT; PAM sequence: CGTGGTTT
tgcatctattgagataatca

SEQ ID NO: 11095 - DNA, 20 bp, Artificial Sequence
  Description of Artificial Sequence: Synthetic oligonucleotide
  Target: SCN10A; (-) strand; PAM type: NNNNGHTT; PAM sequence: GAGAGCTT
ccatcaatacctagtttatt

SEQ ID NO: 11096 - DNA, 20 bp, Artificial Sequence
  Description of Artificial Sequence: Synthetic oligonucleotide
  Target: SCN10A; (-) strand; PAM type: NNNNGHTT; PAM sequence: CCTAGTTT
tgagatacattccatcaata

SEQ ID NO: 11097 - DNA, 20 bp, Artificial Sequence
  Description of Artificial Sequence: Synthetic oligonucleotide
  Target: SCN10A; (-) strand; PAM type: NNNNGHTT; PAM sequence: GGGGGCTT
cattcagtatgatattggct

SEQ ID NO: 11098 - DNA, 20 bp, Artificial Sequence
  Description of Artificial Sequence: Synthetic oligonucleotide
  Target: SCN10A; (-) strand; PAM type: NNNNGHTT; PAM sequence: TCCAGTTT
tggttttcaaaggaaatgct

SEQ ID NO: 11099 - DNA, 20 bp, Artificial Sequence
  Description of Artificial Sequence: Synthetic oligonucleotide
  Target: SCN10A; (-) strand; PAM type: NNNNGHTT; PAM sequence: AAATGCTT
cttgtgctggttttcaaagg

SEQ ID NO: 11100 - DNA, 20 bp, Artificial Sequence
  Description of Artificial Sequence: Synthetic oligonucleotide
  Target: SCN10A; (-) strand; PAM type: NNNNGHTT; PAM sequence: GCTGGTTT
atagggcattcttgtcttgt

SEQ ID NO: 11101 - DNA, 20 bp, Artificial Sequence
  Description of Artificial Sequence: Synthetic oligonucleotide
  Target: SCN10A; (-) strand; PAM type: NNNNGHTT; PAM sequence: TGGGGTTT
gagattttgggctgagatga

SEQ ID NO: 11102 - DNA, 20 bp, Artificial Sequence
  Description of Artificial Sequence: Synthetic oligonucleotide
  Target: SCN10A; (-) strand; PAM type: NNNNGHTT; PAM sequence: AGGAGATT
tgaagttgcttatcagctta

SEQ ID NO: 11103 - DNA, 20 bp, Artificial Sequence
  Description of Artificial Sequence: Synthetic oligonucleotide
  Target: SCN10A; (-) strand; PAM type: NNNNGHTT; PAM sequence: ATCAGCTT
agactttgctgaagttgctt

SEQ ID NO: 11104 - DNA, 20 bp, Artificial Sequence
  Description of Artificial Sequence: Synthetic oligonucleotide
  Target: SCN10A; (-) strand; PAM type: NNNNGHTT; PAM sequence: AGTTGCTT
gtatcctgagactttgctga

SEQ ID NO: 11105 - DNA, 20 bp, Artificial Sequence
  Description of Artificial Sequence: Synthetic oligonucleotide
  Target: SCN10A; (-) strand; PAM type: NNNNGHTT; PAM sequence: CATTGATT
gaatgcttgtgatttttgca

SEQ ID NO: 11106 - DNA, 20 bp, Artificial Sequence
  Description of Artificial Sequence: Synthetic oligonucleotide
  Target: SCN10A; (-) strand; PAM type: NNNNGHTT; PAM sequence: TTGTGATT
ttattggtgtatgggaatgc

SEQ ID NO: 11107 - DNA, 20 bp, Artificial Sequence
  Description of Artificial Sequence: Synthetic oligonucleotide
  Target: SCN10A; (-) strand; PAM type: NNNNGHTT; PAM sequence: GAATGCTT
tgtctgttattggtgtatgg

SEQ ID NO: 11108 - DNA, 20 bp, Artificial Sequence
  Description of Artificial Sequence: Synthetic oligonucleotide
  Target: SCN10A; (-) strand; PAM type: NNNNGHTT; PAM sequence: CTCGGTTT
agttcactcatgatttggct

SEQ ID NO: 11109 - DNA, 20 bp, Artificial Sequence
  Description of Artificial Sequence: Synthetic oligonucleotide
  Target: SCN10A; (-) strand; PAM type: NNNNGHTT; PAM sequence: TCATGATT
aattgtgaatgggagttcac

SEQ ID NO: 11110 - DNA, 20 bp, Artificial Sequence
  Description of Artificial Sequence: Synthetic oligonucleotide
  Target: SCN10A; (-) strand; PAM type: NNNNGHTT; PAM sequence: CAGTGATT
tcctctcttatttccttgag

SEQ ID NO: 11111 - DNA, 20 bp, Artificial Sequence
  Description of Artificial Sequence: Synthetic oligonucleotide
  Target: SCN10A; (-) strand; PAM type: NNNNGHTT; PAM sequence: GAATGTTT
ttttcctatccatgagcatg

SEQ ID NO: 11112 - DNA, 20 bp, Artificial Sequence
  Description of Artificial Sequence: Synthetic oligonucleotide
  Target: SCN10A; (-) strand; PAM type: NNNNGHTT; PAM sequence: TATTGATT
cagtatggccattttcacaa

SEQ ID NO: 11113 - DNA, 20 bp, Artificial Sequence
  Description of Artificial Sequence: Synthetic oligonucleotide
  Target: SCN10A; (-) strand; PAM type: NNNNGHTT; PAM sequence: GGTAGCTT
attctgtgaagaaagtcagt

SEQ ID NO: 11114 - DNA, 20 bp, Artificial Sequence
  Description of Artificial Sequence: Synthetic oligonucleotide
  Target: SCN10A; (-) strand; PAM type: NNNNGHTT; PAM sequence: AGTAGATT
ttgttccacatgaaatttaa

SEQ ID NO: 11115 - DNA, 20 bp, Artificial Sequence
  Description of Artificial Sequence: Synthetic oligonucleotide
  Target: SCN10A; (-) strand; PAM type: NNNNGHTT; PAM sequence: TTTTGCTT
gatgcctccaactttcttct

SEQ ID NO: 11116 - DNA, 20 bp, Artificial Sequence
  Description of Artificial Sequence: Synthetic oligonucleotide
  Target: SCN10A; (-) strand; PAM type: NNNNGHTT; PAM sequence: TATAGCTT
tggttactgtagctttgtag

SEQ ID NO: 11117 - DNA, 20 bp, Artificial Sequence
  Description of Artificial Sequence: Synthetic oligonucleotide
  Target: SCN10A; (-) strand; PAM type: NNNNGHTT; PAM sequence: TGTAGCTT
tacctcgctgttttggttac

SEQ ID NO: 11118 - DNA, 20 bp, Artificial Sequence
  Description of Artificial Sequence: Synthetic oligonucleotide
  Target: SCN10A; (-) strand; PAM type: NNNNGHTT; PAM sequence: CGCTGTTT
ctgttttggtaccagtacct

SEQ ID NO: 11119 - DNA, 20 bp, Artificial Sequence
  Description of Artificial Sequence: Synthetic oligonucleotide
  Target: SCN10A; (-) strand; PAM type: NNNNGHTT; PAM sequence: ATCTGTTT
tctgttccattggtctagat

SEQ ID NO: 11120 - DNA, 20 bp, Artificial Sequence
  Description of Artificial Sequence: Synthetic oligonucleotide
  Target: SCN10A; (-) strand; PAM type: NNNNGHTT; PAM sequence: TCAAGTTT
ttccccattgcttgcttttg

SEQ ID NO: 11121 - DNA, 20 bp, Artificial Sequence
  Description of Artificial Sequence: Synthetic oligonucleotide
  Target: SCN10A; (-) strand; PAM type: NNNNGHTT; PAM sequence: GCTTGCTT
tagggaatcctttccccatt

SEQ ID NO: 11122 - DNA, 20 bp, Artificial Sequence
  Description of Artificial Sequence: Synthetic oligonucleotide
  Target: SCN10A; (-) strand; PAM type: NNNNGHTT; PAM sequence: CATTGCTT
taaatagggaatcctttccc

SEQ ID NO: 11123 - DNA, 20 bp, Artificial Sequence
  Description of Artificial Sequence: Synthetic oligonucleotide
  Target: SCN10A; (-) strand; PAM type: NNNNGHTT; PAM sequence: GCCAGTTT
caattttctgcctaaggcta

SEQ ID NO: 11124 - DNA, 20 bp, Artificial Sequence
  Description of Artificial Sequence: Synthetic oligonucleotide
  Target: SCN10A; (-) strand; PAM type: NNNNGHTT; PAM sequence: TCTAGTTT
tgtaaggtataaggaaggga

SEQ ID NO: 11125 - DNA, 20 bp, Artificial Sequence
  Description of Artificial Sequence: Synthetic oligonucleotide
  Target: SCN10A; (-) strand; PAM type: NNNNGHTT; PAM sequence: TTATGTTT
ggtttttatggttttaggtc

SEQ ID NO: 11126 - DNA, 20 bp, Artificial Sequence
  Description of Artificial Sequence: Synthetic oligonucleotide
  Target: SCN10A; (-) strand; PAM type: NNNNGHTT; PAM sequence: TATGGTTT
aggttttcttctagggtttt

SEQ ID NO: 11127 - DNA, 20 bp, Artificial Sequence
  Description of Artificial Sequence: Synthetic oligonucleotide
  Target: SCN10A; (-) strand; PAM type: NNNNGHTT; PAM sequence: TAGGGTTT
gtattgcctaggttttcttc

SEQ ID NO: 11128 - DNA, 20 bp, Artificial Sequence
  Description of Artificial Sequence: Synthetic oligonucleotide
  Target: SCN10A; (-) strand; PAM type: NNNNGHTT; PAM sequence: CTAGGTTT
tatgtcctgaagggtattgc

SEQ ID NO: 11129 - DNA, 20 bp, Artificial Sequence
  Description of Artificial Sequence: Synthetic oligonucleotide
  Target: SCN10A; (-) strand; PAM type: NNNNGHTT; PAM sequence: CATTGCTT
tcaattttggcttttgtcac

SEQ ID NO: 11130 - DNA, 20 bp, Artificial Sequence
  Description of Artificial Sequence: Synthetic oligonucleotide
  Target: SCN10A; (-) strand; PAM type: NNNNGHTT; PAM sequence: TTTGGCTT
attggattccatttgtcaat

SEQ ID NO: 11131 - DNA, 20 bp, Artificial Sequence
  Description of Artificial Sequence: Synthetic oligonucleotide
  Target: SCN10A; (-) strand; PAM type: NNNNGHTT; PAM sequence: ATTGGATT
tgcagaagctctttagttta

SEQ ID NO: 11132 - DNA, 20 bp, Artificial Sequence
  Description of Artificial Sequence: Synthetic oligonucleotide
  Target: SCN10A; (-) strand; PAM type: NNNNGHTT; PAM sequence: TTTAGTTT
cttttgctgtgcagaagctc

SEQ ID NO: 11133 - DNA, 20 bp, Artificial Sequence
  Description of Artificial Sequence: Synthetic oligonucleotide
  Target: SCN10A; (-) strand; PAM type: NNNNGHTT; PAM sequence: GATAGTTT
ggttacctattcactctgat

SEQ ID NO: 11134 - DNA, 20 bp, Artificial Sequence
  Description of Artificial Sequence: Synthetic oligonucleotide
  Target: SCN10A; (-) strand; PAM type: NNNNGHTT; PAM sequence: GATAGATT
tattagccctttgtcagatt

SEQ ID NO: 11135 - DNA, 20 bp, Artificial Sequence
  Description of Artificial Sequence: Synthetic oligonucleotide
  Target: SCN10A; (-) strand; PAM type: NNNNGHTT; PAM sequence: GTCAGATT
attctggatattagcccttt

SEQ ID NO: 11136 - DNA, 20 bp, Artificial Sequence
  Description of Artificial Sequence: Synthetic oligonucleotide
  Target: SCN10A; (-) strand; PAM type: NNNNGHTT; PAM sequence: TGTAGATT
gtaaatttgtttaagttttt

SEQ ID NO: 11137 - DNA, 20 bp, Artificial Sequence
  Description of Artificial Sequence: Synthetic oligonucleotide
  Target: SCN10A; (-) strand; PAM type: NNNNGHTT; PAM sequence: TTAAGTTT
gttttttcttgtaaatttgt

SEQ ID NO: 11138 - DNA, 20 bp, Artificial Sequence
  Description of Artificial Sequence: Synthetic oligonucleotide
  Target: SCN10A; (-) strand; PAM type: NNNNGHTT; PAM sequence: ATTTGTTT
ggagttgttttttcttgtaa

SEQ ID NO: 11139 - DNA, 20 bp, Artificial Sequence
  Description of Artificial Sequence: Synthetic oligonucleotide
  Target: SCN10A; (-) strand; PAM type: NNNNGHTT; PAM sequence: AGTTGTTT
ctttgcccactttttgatgg

SEQ ID NO: 11140 - DNA, 20 bp, Artificial Sequence
  Description of Artificial Sequence: Synthetic oligonucleotide
  Target: SCN10A; (-) strand; PAM type: NNNNGHTT; PAM sequence: ATATGTTT
gtgatgatgagctttttatc

SEQ ID NO: 11141 - DNA, 20 bp, Artificial Sequence
  Description of Artificial Sequence: Synthetic oligonucleotide
  Target: SCN10A; (-) strand; PAM type: NNNNGHTT; PAM sequence: ATGAGCTT
ttctctaatgaccagtgatg

SEQ ID NO: 11142 - DNA, 20 bp, Artificial Sequence
  Description of Artificial Sequence: Synthetic oligonucleotide
  Target: SCN10A; (-) strand; PAM type: NNNNGHTT; PAM sequence: TGTGGTTT
ggtatgagactccatctcat

SEQ ID NO: 11143 - DNA, 20 bp, Artificial Sequence
  Description of Artificial Sequence: Synthetic oligonucleotide
  Target: SCN10A; (-) strand; PAM type: NNNNGHTT; PAM sequence: TGTTGTTT
tccacatcctctccagcatc

SEQ ID NO: 11144 - DNA, 20 bp, Artificial Sequence
  Description of Artificial Sequence: Synthetic oligonucleotide
  Target: SCN10A; (-) strand; PAM type: NNNNGHTT; PAM sequence: TGGTGTTT
aatggaattgctgggtcaaa

SEQ ID NO: 11145 - DNA, 20 bp, Artificial Sequence
  Description of Artificial Sequence: Synthetic oligonucleotide
  Target: SCN10A; (-) strand; PAM type: NNNNGHTT; PAM sequence: GCATGCTT
tagtgccacaataaacatac

SEQ ID NO: 11146 - DNA, 20 bp, Artificial Sequence
  Description of Artificial Sequence: Synthetic oligonucleotide
  Target: SCN10A; (-) strand; PAM type: NNNNGHTT; PAM sequence: GGGCGTTT
ttatccagtctatcactgat

SEQ ID NO: 11147 - DNA, 20 bp, Artificial Sequence
  Description of Artificial Sequence: Synthetic oligonucleotide
  Target: SCN10A; (-) strand; PAM type: NNNNGHTT; PAM sequence: TCCAGCTT
gtttgctgagaatgatggtt

SEQ ID NO: 11148 - DNA, 20 bp, Artificial Sequence
  Description of Artificial Sequence: Synthetic oligonucleotide
  Target: SCN10A; (-) strand; PAM type: NNNNGHTT; PAM sequence: GATGGTTT
tatgtcagtttgctgagaat

SEQ ID NO: 11149 - DNA, 20 bp, Artificial Sequence
  Description of Artificial Sequence: Synthetic oligonucleotide
  Target: SCN10A; (-) strand; PAM type: NNNNGHTT; PAM sequence: GTCAGTTT
gtttggttttctgttcttat

SEQ ID NO: 11150 - DNA, 20 bp, Artificial Sequence
  Description of Artificial Sequence: Synthetic oligonucleotide
  Target: SCN10A; (-) strand; PAM type: NNNNGHTT; PAM sequence: TTTGGTTT
atgagtgagaacatgcggtg

SEQ ID NO: 11151 - DNA, 20 bp, Artificial Sequence
  Description of Artificial Sequence: Synthetic oligonucleotide
  Target: SCN10A; (-) strand; PAM type: NNNNGHTT; PAM sequence: CGGTGTTT
cacctatgagtgagaacatg

SEQ ID NO: 11152 - DNA, 20 bp, Artificial Sequence
  Description of Artificial Sequence: Synthetic oligonucleotide
  Target: SCN10A; (-) strand; PAM type: NNNNGHTT; PAM sequence: GGTGGTTT
cataggtatacacatgtcat

SEQ ID NO: 11153 - DNA, 20 bp, Artificial Sequence
  Description of Artificial Sequence: Synthetic oligonucleotide
  Target: SCN10A; (-) strand; PAM type: NNNNGHTT; PAM sequence: GCAGGTTT
ggggtacatgtgcagaaagt

SEQ ID NO: 11154 - DNA, 20 bp, Artificial Sequence
  Description of Artificial Sequence: Synthetic oligonucleotide
  Target: SCN10A; (-) strand; PAM type: NNNNGHTT; PAM sequence: ACTTGCTT
tctaggtggatcaacacctc

SEQ ID NO: 11155 - DNA, 20 bp, Artificial Sequence
  Description of Artificial Sequence: Synthetic oligonucleotide
  Target: SCN10A; (-) strand; PAM type: NNNNGHTT; PAM sequence: GTAAGATT
tgaagcagtgtgccattggt

SEQ ID NO: 11156 - DNA, 20 bp, Artificial Sequence
  Description of Artificial Sequence: Synthetic oligonucleotide
  Target: SCN10A; (-) strand; PAM type: NNNNGHTT; PAM sequence: TCGAGATT
agaactcattctactggatg

SEQ ID NO: 11157 - DNA, 20 bp, Artificial Sequence
  Description of Artificial Sequence: Synthetic oligonucleotide
  Target: SCN10A; (-) strand; PAM type: NNNNGHTT; PAM sequence: AAAAGTTT
aactttaaattttcttcctc

SEQ ID NO: 11158 - DNA, 20 bp, Artificial Sequence
  Description of Artificial Sequence: Synthetic oligonucleotide
  Target: SCN10A; (-) strand; PAM type: NNNNGHTT; PAM sequence: ACAGGCTT
atcctcaaatcaatatttca

SEQ ID NO: 11159 - DNA, 20 bp, Artificial Sequence
  Description of Artificial Sequence: Synthetic oligonucleotide
  Target: SCN10A; (-) strand; PAM type: NNNNGHTT; PAM sequence: AAATGATT
aatattgtaaagactcccaa

SEQ ID NO: 11160 - DNA, 20 bp, Artificial Sequence
  Description of Artificial Sequence: Synthetic oligonucleotide
  Target: SCN10A; (-) strand; PAM type: NNNNGHTT; PAM sequence: CTCAGATT
aatcagtggggagacatgtt

SEQ ID NO: 11161 - DNA, 20 bp, Artificial Sequence
  Description of Artificial Sequence: Synthetic oligonucleotide
  Target: SCN10A; (-) strand; PAM type: NNNNGHTT; PAM sequence: TAAAGTTT
aaattataataagtattgtg

SEQ ID NO: 11162 - DNA, 20 bp, Artificial Sequence
  Description of Artificial Sequence: Synthetic oligonucleotide
  Target: SCN10A; (-) strand; PAM type: NNNNGHTT; PAM sequence: ATAAGATT
aaaatgtcaagtatctagga

SEQ ID NO: 11163 - DNA, 20 bp, Artificial Sequence
  Description of Artificial Sequence: Synthetic oligonucleotide
  Target: SCN10A; (-) strand; PAM type: NNNNGHTT; PAM sequence: AATAGTTT
gacactagcaacaaacagaa

SEQ ID NO: 11164 - DNA, 20 bp, Artificial Sequence
  Description of Artificial Sequence: Synthetic oligonucleotide
  Target: SCN10A; (-) strand; PAM type: NNNNGHTT; PAM sequence: ATAAGATT
gaagatgtaatttacagata

SEQ ID NO: 11165 - DNA, 20 bp, Artificial Sequence
  Description of Artificial Sequence: Synthetic oligonucleotide
  Target: SCN10A; (-) strand; PAM type: NNNNGHTT; PAM sequence: GAAAGCTT
catacttaattgtgaacatg

SEQ ID NO: 11166 - DNA, 20 bp, Artificial Sequence
  Description of Artificial Sequence: Synthetic oligonucleotide
  Target: SCN10A; (-) strand; PAM type: NNNNGHTT; PAM sequence: CATTGTTT
tcactctgataaagggtatt

SEQ ID NO: 11167 - DNA, 20 bp, Artificial Sequence
  Description of Artificial Sequence: Synthetic oligonucleotide
  Target: SCN10A; (-) strand; PAM type: NNNNGHTT; PAM sequence: AGGGGATT
aaagtataataattttaaaa

SEQ ID NO: 11168 - DNA, 20 bp, Artificial Sequence
  Description of Artificial Sequence: Synthetic oligonucleotide
  Target: SCN10A; (-) strand; PAM type: NNNNGHTT; PAM sequence: TAAAGTTT
ttgatgctaaaatcatttga

SEQ ID NO: 11169 - DNA, 20 bp, Artificial Sequence
  Description of Artificial Sequence: Synthetic oligonucleotide
  Target: SCN10A; (-) strand; PAM type: NNNNGHTT; PAM sequence: AATAGATT
aaatacgttatatttttatt

SEQ ID NO: 11170 - DNA, 20 bp, Artificial Sequence
  Description of Artificial Sequence: Synthetic oligonucleotide
  Target: SCN10A; (-) strand; PAM type: NNNNGHTT; PAM sequence: CAGAGCTT
ttataataacaggtgctttg

SEQ ID NO: 11171 - DNA, 20 bp, Artificial Sequence
  Description of Artificial Sequence: Synthetic oligonucleotide
  Target: SCN10A; (-) strand; PAM type: NNNNGHTT; PAM sequence: AGGTGCTT
atacctttggttataataac

SEQ ID NO: 11172 - DNA, 20 bp, Artificial Sequence
  Description of Artificial Sequence: Synthetic oligonucleotide
  Target: SCN10A; (-) strand; PAM type: NNNNGHTT; PAM sequence: TCCAGCTT
tctgggagggatgcttccac

SEQ ID NO: 11173 - DNA, 20 bp, Artificial Sequence
  Description of Artificial Sequence: Synthetic oligonucleotide
  Target: SCN10A; (-) strand; PAM type: NNNNGHTT; PAM sequence: GGATGCTT
catatccacacatctgggag

SEQ ID NO: 11174 - DNA, 20 bp, Artificial Sequence
  Description of Artificial Sequence: Synthetic oligonucleotide
  Target: SCN10A; (-) strand; PAM type: NNNNGHTT; PAM sequence: GGGAGTTT
cccctatagtttcagaatct

SEQ ID NO: 11175 - DNA, 20 bp, Artificial Sequence
  Description of Artificial Sequence: Synthetic oligonucleotide
  Target: SCN10A; (-) strand; PAM type: NNNNGHTT; PAM sequence: TATAGTTT
aggttagtgggtgaaacccc

SEQ ID NO: 11176 - DNA, 20 bp, Artificial Sequence
  Description of Artificial Sequence: Synthetic oligonucleotide
  Target: SCN10A; (-) strand; PAM type: NNNNGHTT; PAM sequence: TCATGCTT
aaatgaagctgtttaagtta

SEQ ID NO: 11177 - DNA, 20 bp, Artificial Sequence
  Description of Artificial Sequence: Synthetic oligonucleotide
  Target: SCN10A; (-) strand; PAM type: NNNNGHTT; PAM sequence: AGCTGTTT
agaaaataactcataaatga

SEQ ID NO: 11178 - DNA, 20 bp, Artificial Sequence
  Description of Artificial Sequence: Synthetic oligonucleotide
  Target: SCN10A; (-) strand; PAM type: NNNNGHTT; PAM sequence: GTATGCTT
aaatgtatgccttagagaag

SEQ ID NO: 11179 - DNA, 20 bp, Artificial Sequence
  Description of Artificial Sequence: Synthetic oligonucleotide
  Target: SCN10A; (-) strand; PAM type: NNNNGHTT; PAM sequence: GGGAGATT
gctgcatattgcaatttttg

SEQ ID NO: 11180 - DNA, 20 bp, Artificial Sequence
  Description of Artificial Sequence: Synthetic oligonucleotide
  Target: SCN10A; (-) strand; PAM type: NNNNGHTT; PAM sequence: TACAGATT
gattttcagtttcaaagaga

SEQ ID NO: 11181 - DNA, 20 bp, Artificial Sequence
  Description of Artificial Sequence: Synthetic oligonucleotide
  Target: SCN10A; (-) strand; PAM type: NNNNGHTT; PAM sequence: TTCAGTTT
tttcataaacatacatgatt

SEQ ID NO: 11182 - DNA, 20 bp, Artificial Sequence
  Description of Artificial Sequence: Synthetic oligonucleotide
  Target: SCN10A; (-) strand; PAM type: NNNNGHTT; PAM sequence: ACATGATT
gagatttgtttcataaacat

SEQ ID NO: 11183 - DNA, 20 bp, Artificial Sequence
  Description of Artificial Sequence: Synthetic oligonucleotide
  Target: SCN10A; (-) strand; PAM type: NNNNGHTT; PAM sequence: ATTTGTTT
caggtctctccttctgtgag

SEQ ID NO: 11184 - DNA, 20 bp, Artificial Sequence
  Description of Artificial Sequence: Synthetic oligonucleotide
  Target: SCN10A; (-) strand; PAM type: NNNNGHTT; PAM sequence: GTGAGATT
ataaccaggtctctccttct

SEQ ID NO: 11185 - DNA, 20 bp, Artificial Sequence
  Description of Artificial Sequence: Synthetic oligonucleotide
  Target: SCN10A; (-) strand; PAM type: NNNNGHTT; PAM sequence: TTTTGCTT
atcattattgtaccatctct

SEQ ID NO: 11186 - DNA, 20 bp, Artificial Sequence
  Description of Artificial Sequence: Synthetic oligonucleotide
  Target: SCN10A; (-) strand; PAM type: NNNNGHTT; PAM sequence: AGTAGATT
cttccagagaaaattgagtg

SEQ ID NO: 11187 - DNA, 20 bp, Artificial Sequence
  Description of Artificial Sequence: Synthetic oligonucleotide
  Target: SCN10A; (-) strand; PAM type: NNNNGHTT; PAM sequence: TTCAGTTT
aacacaggcctttcaggtgg

SEQ ID NO: 11188 - DNA, 20 bp, Artificial Sequence
  Description of Artificial Sequence: Synthetic oligonucleotide
  Target: SCN10A; (-) strand; PAM type: NNNNGHTT; PAM sequence: CTCAGCTT
catcacagagacttggtgat

SEQ ID NO: 11189 - DNA, 20 bp, Artificial Sequence
  Description of Artificial Sequence: Synthetic oligonucleotide
  Target: SCN10A; (-) strand; PAM type: NNNNGHTT; PAM sequence: CTAAGATT
gatcataaagctaatattgg

SEQ ID NO: 11190 - DNA, 20 bp, Artificial Sequence
  Description of Artificial Sequence: Synthetic oligonucleotide
  Target: SCN10A; (-) strand; PAM type: NNNNGHTT; PAM sequence: CCTAGCTT
aacatggacaaagtactcag

SEQ ID NO: 11191 - DNA, 20 bp, Artificial Sequence
  Description of Artificial Sequence: Synthetic oligonucleotide
  Target: SCN10A; (-) strand; PAM type: NNNNGHTT; PAM sequence: CTCAGCTT
tattttttgtcagcctgttt

SEQ ID NO: 11192 - DNA, 20 bp, Artificial Sequence
  Description of Artificial Sequence: Synthetic oligonucleotide
  Target: SCN10A; (-) strand; PAM type: NNNNGHTT; PAM sequence: GCCTGTTT
ttaacttttattttttgtca

SEQ ID NO: 11193 - DNA, 20 bp, Artificial Sequence
  Description of Artificial Sequence: Synthetic oligonucleotide
  Target: SCN10A; (-) strand; PAM type: NNNNGHTT; PAM sequence: CAGAGTTT
ctgtttccttctatcttgct

SEQ ID NO: 11194 - DNA, 20 bp, Artificial Sequence
  Description of Artificial Sequence: Synthetic oligonucleotide
  Target: SCN10A; (-) strand; PAM type: NNNNGHTT; PAM sequence: GTCTGTTT
aggacattttggaaaaggga

SEQ ID NO: 11195 - DNA, 20 bp, Artificial Sequence
  Description of Artificial Sequence: Synthetic oligonucleotide
  Target: SCN10A; (-) strand; PAM type: NNNNGHTT; PAM sequence: GAAGGCTT
gccattttgtatactgaaat

SEQ ID NO: 11196 - DNA, 20 bp, Artificial Sequence
  Description of Artificial Sequence: Synthetic oligonucleotide
  Target: SCN10A; (-) strand; PAM type: NNNNGHTT; PAM sequence: CCAAGTTT
ttgtacctcttcacttatct

SEQ ID NO: 11197 - DNA, 20 bp, Artificial Sequence
  Description of Artificial Sequence: Synthetic oligonucleotide
  Target: SCN10A; (-) strand; PAM type: NNNNGHTT; PAM sequence: GAAAGTTT
ctgatgaaactaattcccat

SEQ ID NO: 11198 - DNA, 20 bp, Artificial Sequence
  Description of Artificial Sequence: Synthetic oligonucleotide
  Target: SCN10A; (-) strand; PAM type: NNNNGHTT; PAM sequence: TGGGGTTT
cactccagcctaatcctact

SEQ ID NO: 11199 - DNA, 20 bp, Artificial Sequence
  Description of Artificial Sequence: Synthetic oligonucleotide
  Target: SCN10A; (-) strand; PAM type: NNNNGHTT; PAM sequence: TTTAGATT
ccaagtgggaacaatttacc

SEQ ID NO: 11200 - DNA, 20 bp, Artificial Sequence
  Description of Artificial Sequence: Synthetic oligonucleotide
  Target: SCN10A; (-) strand; PAM type: NNNNGHTT; PAM sequence: TCAAGTTT
tctgtaggtcaagtttatct

SEQ ID NO: 11201 - DNA, 20 bp, Artificial Sequence
  Description of Artificial Sequence: Synthetic oligonucleotide
  Target: SCN10A; (-) strand; PAM type: NNNNGHTT; PAM sequence: TCAAGTTT
tgttgtactctctctgtagg

SEQ ID NO: 11202 - DNA, 20 bp, Artificial Sequence
  Description of Artificial Sequence: Synthetic oligonucleotide
  Target: SCN10A; (-) strand; PAM type: NNNNGHTT; PAM sequence: TGTGGTTT
attgtaagtcagcaggaaaa

SEQ ID NO: 11203 - DNA, 20 bp, Artificial Sequence
  Description of Artificial Sequence: Synthetic oligonucleotide
  Target: SCN10A; (-) strand; PAM type: NNNNGHTT; PAM sequence: CTTGGATT
gacacgattttagtttaatc

SEQ ID NO: 11204 - DNA, 20 bp, Artificial Sequence
  Description of Artificial Sequence: Synthetic oligonucleotide
  Target: SCN10A; (-) strand; PAM type: NNNNGHTT; PAM sequence: TTTAGTTT
tgtagaattggagacacgat

SEQ ID NO: 11205 - DNA, 20 bp, Artificial Sequence
  Description of Artificial Sequence: Synthetic oligonucleotide
  Target: SCN10A; (-) strand; PAM type: NNNNGHTT; PAM sequence: ACACGATT
aaatatttgtagaattggag

SEQ ID NO: 11206 - DNA, 20 bp, Artificial Sequence
  Description of Artificial Sequence: Synthetic oligonucleotide
  Target: SCN10A; (-) strand; PAM type: NNNNGHTT; PAM sequence: GAATGTTT
attctaatcacatttgctat

SEQ ID NO: 11207 - DNA, 20 bp, Artificial Sequence
  Description of Artificial Sequence: Synthetic oligonucleotide
  Target: SCN10A; (-) strand; PAM type: NNNNGHTT; PAM sequence: AATTGCTT
ttgagatttgatgagtaaat

SEQ ID NO: 11208 - DNA, 20 bp, Artificial Sequence
  Description of Artificial Sequence: Synthetic oligonucleotide
  Target: SCN10A; (-) strand; PAM type: NNNNGHTT; PAM sequence: TTGAGATT
cagtgaatattctcttcatc

SEQ ID NO: 11209 - DNA, 20 bp, Artificial Sequence
  Description of Artificial Sequence: Synthetic oligonucleotide
  Target: SCN10A; (-) strand; PAM type: NNNNGHTT; PAM sequence: TATGGATT
caaacatacaaactcctctt

SEQ ID NO: 11210 - DNA, 20 bp, Artificial Sequence
  Description of Artificial Sequence: Synthetic oligonucleotide
  Target: SCN10A; (-) strand; PAM type: NNNNGHTT; PAM sequence: TGTTGCTT
gtcgtctctgcttgggtagt

SEQ ID NO: 11211 - DNA, 20 bp, Artificial Sequence
  Description of Artificial Sequence: Synthetic oligonucleotide
  Target: SCN10A; (-) strand; PAM type: NNNNGHTT; PAM sequence: CTCTGCTT
ttattctctcaatgtgtcgt

SEQ ID NO: 11212 - DNA, 20 bp, Artificial Sequence
  Description of Artificial Sequence: Synthetic oligonucleotide
  Target: SCN10A; (-) strand; PAM type: NNNNGHTT; PAM sequence: TAGAGATT
cagttcaaaagcctctgaag

SEQ ID NO: 11213 - DNA, 20 bp, Artificial Sequence
  Description of Artificial Sequence: Synthetic oligonucleotide
  Target: SCN10A; (-) strand; PAM type: NNNNGHTT; PAM sequence: TTCAGATT
tctgagctgaatcttgaatt

SEQ ID NO: 11214 - DNA, 20 bp, Artificial Sequence
  Description of Artificial Sequence: Synthetic oligonucleotide
  Target: SCN10A; (-) strand; PAM type: NNNNGHTT; PAM sequence: TTACGTTT
ttctggctggccagcaagaa

SEQ ID NO: 11215 - DNA, 20 bp, Artificial Sequence
  Description of Artificial Sequence: Synthetic oligonucleotide
  Target: SCN10A; (-) strand; PAM type: NNNNGHTT; PAM sequence: TTACGTTT
cacagcttgatgaagttgca

SEQ ID NO: 11216 - DNA, 20 bp, Artificial Sequence
  Description of Artificial Sequence: Synthetic oligonucleotide
  Target: SCN10A; (-) strand; PAM type: NNNNGHTT; PAM sequence: CACAGCTT
gcacactcaacatgaagctg

SEQ ID NO: 11217 - DNA, 20 bp, Artificial Sequence
  Description of Artificial Sequence: Synthetic oligonucleotide
  Target: SCN10A; (-) strand; PAM type: NNNNGHTT; PAM sequence: GTTGGATT
ccctaactctgaggcagatt

SEQ ID NO: 11218 - DNA, 20 bp, Artificial Sequence
  Description of Artificial Sequence: Synthetic oligonucleotide
  Target: SCN10A; (-) strand; PAM type: NNNNGHTT; PAM sequence: GGCAGATT
accctgctccctaactctga

SEQ ID NO: 11219 - DNA, 20 bp, Artificial Sequence
  Description of Artificial Sequence: Synthetic oligonucleotide
  Target: SCN10A; (-) strand; PAM type: NNNNGHTT; PAM sequence: GAAGGCTT
tggtaaccagccttttctta

SEQ ID NO: 11220 - DNA, 20 bp, Artificial Sequence
  Description of Artificial Sequence: Synthetic oligonucleotide
  Target: SCN10A; (-) strand; PAM type: NNNNGHTT; PAM sequence: CCTGGCTT
ttctttatgacaaatttagc

SEQ ID NO: 11221 - DNA, 20 bp, Artificial Sequence
  Description of Artificial Sequence: Synthetic oligonucleotide
  Target: SCN10A; (-) strand; PAM type: NNNNGHTT; PAM sequence: GAAGGATT
cctaagatccttggtcatcg

SEQ ID NO: 11222 - DNA, 20 bp, Artificial Sequence
  Description of Artificial Sequence: Synthetic oligonucleotide
  Target: SCN10A; (-) strand; PAM type: NNNNGHTT; PAM sequence: TTTGGTTT
gtagaaaaaagatactttgg

SEQ ID NO: 11223 - DNA, 20 bp, Artificial Sequence
  Description of Artificial Sequence: Synthetic oligonucleotide
  Target: SCN10A; (-) strand; PAM type: NNNNGHTT; PAM sequence: TTTGGTTT
aactagtagaaaaaagatac

SEQ ID NO: 11224 - DNA, 20 bp, Artificial Sequence
  Description of Artificial Sequence: Synthetic oligonucleotide
  Target: SCN10A; (-) strand; PAM type: NNNNGHTT; PAM sequence: AGGGGATT
taatgtcagaagctgctttc

SEQ ID NO: 11225 - DNA, 20 bp, Artificial Sequence
  Description of Artificial Sequence: Synthetic oligonucleotide
  Target: SCN10A; (-) strand; PAM type: NNNNGHTT; PAM sequence: AGCTGCTT
ttgttttaggtaatgtcaga

SEQ ID NO: 11226 - DNA, 20 bp, Artificial Sequence
  Description of Artificial Sequence: Synthetic oligonucleotide
  Target: SCN10A; (-) strand; PAM type: NNNNGHTT; PAM sequence: AATTGTTT
ggtcaaatgtctactatatg

SEQ ID NO: 11227 - DNA, 20 bp, Artificial Sequence
  Description of Artificial Sequence: Synthetic oligonucleotide
  Target: SCN10A; (-) strand; PAM type: NNNNGHTT; PAM sequence: TAATGATT
gttcatgccatacaagactg

SEQ ID NO: 11228 - DNA, 20 bp, Artificial Sequence
  Description of Artificial Sequence: Synthetic oligonucleotide
  Target: SCN10A; (-) strand; PAM type: NNNNGHTT; PAM sequence: GCAGGTTT
aaattactcaaaaactacta

SEQ ID NO: 11229 - DNA, 20 bp, Artificial Sequence
  Description of Artificial Sequence: Synthetic oligonucleotide
  Target: SCN10A; (-) strand; PAM type: NNNNGHTT; PAM sequence: GGCTGCTT
ccatagccatgctgagaagt

SEQ ID NO: 11230 - DNA, 20 bp, Artificial Sequence
  Description of Artificial Sequence: Synthetic oligonucleotide
  Target: SCN10A; (-) strand; PAM type: NNNNGHTT; PAM sequence: GTCCGCTT
cattctcaccacggtgtgtg

SEQ ID NO: 11231 - DNA, 20 bp, Artificial Sequence
  Description of Artificial Sequence: Synthetic oligonucleotide
  Target: SCN10A; (-) strand; PAM type: NNNNGHTT; PAM sequence: GGAGGTTT
aaaacatcctctttatgagg

SEQ ID NO: 11232 - DNA, 20 bp, Artificial Sequence
  Description of Artificial Sequence: Synthetic oligonucleotide
  Target: SCN10A; (-) strand; PAM type: NNNNGHTT; PAM sequence: TTTGGATT
tttatgcaacacacaggtgg

SEQ ID NO: 11233 - DNA, 20 bp, Artificial Sequence
  Description of Artificial Sequence: Synthetic oligonucleotide
  Target: SCN10A; (-) strand; PAM type: NNNNGHTT; PAM sequence: GGTGGTTT
aagtgtttatgcaacacaca

SEQ ID NO: 11234 - DNA, 20 bp, Artificial Sequence
  Description of Artificial Sequence: Synthetic oligonucleotide
  Target: SCN10A; (-) strand; PAM type: NNNNGHTT; PAM sequence: AAGTGTTT
gcagtcccaagacacagaag

SEQ ID NO: 11235 - DNA, 20 bp, Artificial Sequence
  Description of Artificial Sequence: Synthetic oligonucleotide
  Target: SCN10A; (-) strand; PAM type: NNNNGHTT; PAM sequence: AATGGCTT
tgaggtcattagattgaaaa

SEQ ID NO: 11236 - DNA, 20 bp, Artificial Sequence
  Description of Artificial Sequence: Synthetic oligonucleotide
  Target: SCN10A; (-) strand; PAM type: NNNNGHTT; PAM sequence: ATTAGATT
cccaaaagtacaatgaggtc

SEQ ID NO: 11237 - DNA, 20 bp, Artificial Sequence
  Description of Artificial Sequence: Synthetic oligonucleotide
  Target: SCN10A; (-) strand; PAM type: NNNNGHTT; PAM sequence: GCACGATT
tctgtccactcatatccttt

SEQ ID NO: 11238 - DNA, 20 bp, Artificial Sequence
  Description of Artificial Sequence: Synthetic oligonucleotide
  Target: SCN10A; (-) strand; PAM type: NNNNGHTT; PAM sequence: CCCGGTTT
gaacaaagggaggaccattt

SEQ ID NO: 11239 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
gaggtccactttctgttttg

SEQ ID NO: 11240 - DNA, 20 bp, Artificial Sequence
  Description of Artificial Sequence: Synthetic oligonucleotide
  Target: SCN10A; (-) strand; PAM type: NNNNGHTT; PAM sequence: TTTTGTTT
cattggaggtccactttctg

SEQ ID NO: 11241 - DNA, 20 bp, Artificial Sequence
  Description of Artificial Sequence: Synthetic oligonucleotide
  Target: SCN10A; (-) strand; PAM type: NNNNGHTT; PAM sequence: TTCTGTTT
tttctcattggaggtccact

SEQ ID NO: 11242 - DNA, 20 bp, Artificial Sequence
  Description of Artificial Sequence: Synthetic oligonucleotide
  Target: SCN10A; (-) strand; PAM type: NNNNGHTT; PAM sequence: TCTTGTTT
aaacatggttgtataaggaa

SEQ ID NO: 11243 - DNA, 20 bp, Artificial Sequence
  Description of Artificial Sequence: Synthetic oligonucleotide
  Target: SCN10A; (-) strand; PAM type: NNNNGHTT; PAM sequence: TCATGTTT
taagcctgagataatgcctc

SEQ ID NO: 11244 - DNA, 20 bp, Artificial Sequence
  Description of Artificial Sequence: Synthetic oligonucleotide
  Target: SCN10A; (-) strand; PAM type: NNNNGHTT; PAM sequence: TATGGCTT
tcttgctgagagggtgagga

SEQ ID NO: 11245 - DNA, 20 bp, Artificial Sequence
  Description of Artificial Sequence: Synthetic oligonucleotide
  Target: SCN10A; (-) strand; PAM type: NNNNGHTT; PAM sequence: TGAGGATT
cataacacctcttaccagcc

SEQ ID NO: 11246 - DNA, 20 bp, Artificial Sequence
  Description of Artificial Sequence: Synthetic oligonucleotide
  Target: SCN10A; (-) strand; PAM type: NNNNGHTT; PAM sequence: AGAGGATT
cctcagagggagaaaccagg

SEQ ID NO: 11247 - DNA, 20 bp, Artificial Sequence
  Description of Artificial Sequence: Synthetic oligonucleotide
  Target: SCN10A; (-) strand; PAM type: NNNNGHTT; PAM sequence: GCATGTTT
cgagccaaaaaatggtgaat

SEQ ID NO: 11248 - DNA, 20 bp, Artificial Sequence
  Description of Artificial Sequence: Synthetic oligonucleotide
  Target: SCN10A; (-) strand; PAM type: NNNNGHTT; PAM sequence: AAGAGCTT
tgagaatcagtagtttaaac

SEQ ID NO: 11249 - DNA, 20 bp, Artificial Sequence
  Description of Artificial Sequence: Synthetic oligonucleotide
  Target: SCN10A; (-) strand; PAM type: NNNNGHTT; PAM sequence: AGTAGTTT
aatcaaaaagtttgagaatc

SEQ ID NO: 11250 - DNA, 20 bp, Artificial Sequence
  Description of Artificial Sequence: Synthetic oligonucleotide
  Target: SCN10A; (-) strand; PAM type: NNNNGHTT; PAM sequence: AAAAGTTT
agtaataatccctgaaatca

SEQ ID NO: 11251 - DNA, 20 bp, Artificial Sequence
  Description of Artificial Sequence: Synthetic oligonucleotide
  Target: SCN10A; (-) strand; PAM type: NNNNGHTT; PAM sequence: TAAGGTTT
aagttatttggggtcctcaa

SEQ ID NO: 11252 - DNA, 20 bp, Artificial Sequence
  Description of Artificial Sequence: Synthetic oligonucleotide
  Target: SCN10A; (-) strand; PAM type: NNNNGHTT; PAM sequence: CTGAGTTT
ttcccgtgttttaaaatttc

SEQ ID NO: 11253 - DNA, 20 bp, Artificial Sequence
  Description of Artificial Sequence: Synthetic oligonucleotide
  Target: SCN10A; (-) strand; PAM type: NNNNGHTT; PAM sequence: CCGTGTTT
gaatgtgtgcctgtatattc

SEQ ID NO: 11254 - DNA, 20 bp, Artificial Sequence
  Description of Artificial Sequence: Synthetic oligonucleotide
  Target: SCN10A; (-) strand; PAM type: NNNNGHTT; PAM sequence: GTGGGTTT
gtgtccccaaaactgtttta

SEQ ID NO: 11255 - DNA, 20 bp, Artificial Sequence
  Description of Artificial Sequence: Synthetic oligonucleotide
  Target: SCN10A; (-) strand; PAM type: NNNNGHTT; PAM sequence: AACTGTTT
ggaacccctggtgtccccaa

SEQ ID NO: 11256 - DNA, 20 bp, Artificial Sequence
  Description of Artificial Sequence: Synthetic oligonucleotide
  Target: SCN10A; (-) strand; PAM type: NNNNGHTT; PAM sequence: CAGAGCTT
tcaaaagcagataactgctg

SEQ ID NO: 11257 - DNA, 20 bp, Artificial Sequence
  Description of Artificial Sequence: Synthetic oligonucleotide
  Target: SCN10A; (-) strand; PAM type: NNNNGHTT; PAM sequence: TAAAGATT
tgggtgatgtggcagtctgc

SEQ ID NO: 11258 - DNA, 20 bp, Artificial Sequence
  Description of Artificial Sequence: Synthetic oligonucleotide
  Target: SCN10A; (-) strand; PAM type: NNNNGHTT; PAM sequence: CGTCGCTT
ccctcgaaactaacaacttc

SEQ ID NO: 11259 - DNA, 20 bp, Artificial Sequence
  Description of Artificial Sequence: Synthetic oligonucleotide
  Target: SCN10A; (-) strand; PAM type: NNNNGHTT; PAM sequence: AAAAGATT
tgttgacaatgtcaataaat

SEQ ID NO: 11260 - DNA, 20 bp, Artificial Sequence
  Description of Artificial Sequence: Synthetic oligonucleotide
  Target: SCN10A; (-) strand; PAM type: NNNNGHTT; PAM sequence: TTGGGATT
tgttctagattgacttagcc

SEQ ID NO: 11261 - DNA, 20 bp, Artificial Sequence
  Description of Artificial Sequence: Synthetic oligonucleotide
  Target: SCN10A; (-) strand; PAM type: NNNNGHTT; PAM sequence: TCTAGATT
cagcagttcaggggaactgt

SEQ ID NO: 11262 - DNA, 20 bp, Artificial Sequence
  Description of Artificial Sequence: Synthetic oligonucleotide
  Target: SCN10A; (-) strand; PAM type: NNNNGHTT; PAM sequence: ATATGATT
aactgctgactagggatacc

SEQ ID NO: 11263 - DNA, 20 bp, Artificial Sequence
  Description of Artificial Sequence: Synthetic oligonucleotide
  Target: SCN10A; (-) strand; PAM type: NNNNGHTT; PAM sequence: ATTGGCTT
atgaactaggaaatatggtc

SEQ ID NO: 11264 - DNA, 20 bp, Artificial Sequence
  Description of Artificial Sequence: Synthetic oligonucleotide
  Target: SCN10A; (-) strand; PAM type: NNNNGHTT; PAM sequence: TTCTGTTT
atggtatgaagttggcagag

SEQ ID NO: 11265 - DNA, 20 bp, Artificial Sequence
  Description of Artificial Sequence: Synthetic oligonucleotide
  Target: SCN10A; (-) strand; PAM type: NNNNGHTT; PAM sequence: GGAGGTTT
gctgcagacacaggtgagtt

SEQ ID NO: 11266 - DNA, 20 bp, Artificial Sequence
  Description of Artificial Sequence: Synthetic oligonucleotide
  Target: SCN10A; (-) strand; PAM type: NNNNGHTT; PAM sequence: GAAAGTTT
ggatgggctctgcatcaagg

SEQ ID NO: 11267 - DNA, 20 bp, Artificial Sequence
  Description of Artificial Sequence: Synthetic oligonucleotide
  Target: SCN10A; (-) strand; PAM type: NNNNGHTT; PAM sequence: CCAAGCTT
gtgagataggagggcaaaat

SEQ ID NO: 11268 - DNA, 20 bp, Artificial Sequence
  Description of Artificial Sequence: Synthetic oligonucleotide
  Target: SCN10A; (-) strand; PAM type: NNNNGHTT; PAM sequence: CAGAGATT
gagacagaggttgcagtgag

SEQ ID NO: 11269 - DNA, 20 bp, Artificial Sequence
  Description of Artificial Sequence: Synthetic oligonucleotide
  Target: SCN10A; (-) strand; PAM type: NNNNGHTT; PAM sequence: AATTGCTT
tcgggaggctgaggtgggag

SEQ ID NO: 11270 - DNA, 20 bp, Artificial Sequence
  Description of Artificial Sequence: Synthetic oligonucleotide
  Target: SCN10A; (-) strand; PAM type: NNNNGHTT; PAM sequence: AATTGCTT
ttaatgtaataatgcatgaa

SEQ ID NO: 11271 - DNA, 20 bp, Artificial Sequence
  Description of Artificial Sequence: Synthetic oligonucleotide
  Target: SCN10A; (-) strand; PAM type: NNNNGHTT; PAM sequence: CTGAGTTT
agagattgtggcaaacatac

SEQ ID NO: 11272 - DNA, 20 bp, Artificial Sequence
  Description of Artificial Sequence: Synthetic oligonucleotide
  Target: SCN10A; (-) strand; PAM type: NNNNGHTT; PAM sequence: AAGAGATT
gggaatgatgagatgtttcc

SEQ ID NO: 11273 - DNA, 20 bp, Artificial Sequence
  Description of Artificial Sequence: Synthetic oligonucleotide
  Target: SCN10A; (-) strand; PAM type: NNNNGHTT; PAM sequence: AGATGTTT
gtgaagatatgggaatgatg

SEQ ID NO: 11274 - DNA, 20 bp, Artificial Sequence
  Description of Artificial Sequence: Synthetic oligonucleotide
  Target: SCN10A; (-) strand; PAM type: NNNNGHTT; PAM sequence: CTGAGCTT
tgagtttagtttggggcatg

SEQ ID NO: 11275 - DNA, 20 bp, Artificial Sequence
  Description of Artificial Sequence: Synthetic oligonucleotide
  Target: SCN10A; (-) strand; PAM type: NNNNGHTT; PAM sequence: TTTAGTTT
agtgaggagataattatgag

SEQ ID NO: 11276 - DNA, 20 bp, Artificial Sequence
  Description of Artificial Sequence: Synthetic oligonucleotide
  Target: SCN10A; (-) strand; PAM type: NNNNGHTT; PAM sequence: ATGAGTTT
aaagaagtgaggagataatt

SEQ ID NO: 11277 - DNA, 20 bp, Artificial Sequence
  Description of Artificial Sequence: Synthetic oligonucleotide
  Target: SCN10A; (-) strand; PAM type: NNNNGHTT; PAM sequence: GTTTGATT
cagaagcaacagcactagat

SEQ ID NO: 11278 - DNA, 20 bp, Artificial Sequence
  Description of Artificial Sequence: Synthetic oligonucleotide
  Target: SCN10A; (-) strand; PAM type: NNNNGHTT; PAM sequence: AGATGTTT
gaggcagaagcaacagcact

SEQ ID NO: 11279 - DNA, 20 bp, Artificial Sequence
  Description of Artificial Sequence: Synthetic oligonucleotide
  Target: SCN10A; (-) strand; PAM type: NNNNGHTT; PAM sequence: CAGTGATT
atacgaggccagtgagatga

SEQ ID NO: 11280 - DNA, 20 bp, Artificial Sequence
  Description of Artificial Sequence: Synthetic oligonucleotide
  Target: SCN10A; (-) strand; PAM type: NNNNGHTT; PAM sequence: ACCAGATT
ttaaataaagatatcacata

SEQ ID NO: 11281 - DNA, 20 bp, Artificial Sequence
  Description of Artificial Sequence: Synthetic oligonucleotide
  Target: SCN10A; (-) strand; PAM type: NNNNGHTT; PAM sequence: GAATGATT
gagtgctatggagagcttta

SEQ ID NO: 11282 - DNA, 20 bp, Artificial Sequence
  Description of Artificial Sequence: Synthetic oligonucleotide
  Target: SCN10A; (-) strand; PAM type: NNNNGHTT; PAM sequence: GAGAGCTT
gggttatcttgagtgctatg

SEQ ID NO: 11283 - DNA, 20 bp, Artificial Sequence
  Description of Artificial Sequence: Synthetic oligonucleotide
  Target: SCN10A; (-) strand; PAM type: NNNNGHTT; PAM sequence: CACAGTTT
ccatgctggagaggtcagcg

SEQ ID NO: 11284 - DNA, 20 bp, Artificial Sequence
  Description of Artificial Sequence: Synthetic oligonucleotide
  Target: SCN10A; (-) strand; PAM type: NNNNGHTT; PAM sequence: AGAGGATT
gccaagagtacaagaataag

SEQ ID NO: 11285 - DNA, 20 bp, Artificial Sequence
  Description of Artificial Sequence: Synthetic oligonucleotide
  Target: SCN10A; (-) strand; PAM type: NNNNGHTT; PAM sequence: AGATGTTT
gcaaacagaaattacaaatc

SEQ ID NO: 11286 - DNA, 20 bp, Artificial Sequence
  Description of Artificial Sequence: Synthetic oligonucleotide
  Target: SCN10A; (-) strand; PAM type: NNNNGHTT; PAM sequence: CTGAGCTT
agatgtgagtccagctctca

SEQ ID NO: 11287 - DNA, 20 bp, Artificial Sequence
  Description of Artificial Sequence: Synthetic oligonucleotide
  Target: SCN10A; (-) strand; PAM type: NNNNGHTT; PAM sequence: TTAAGTTT
gttctttagtttttcagcta

SEQ ID NO: 11288 - DNA, 20 bp, Artificial Sequence
  Description of Artificial Sequence: Synthetic oligonucleotide
  Target: SCN10A; (-) strand; PAM type: NNNNGHTT; PAM sequence: TTTAGTTT
tttttctgaacaaaatgttc

SEQ ID NO: 11289 - DNA, 20 bp, Artificial Sequence
  Description of Artificial Sequence: Synthetic oligonucleotide
  Target: SCN10A; (-) strand; PAM type: NNNNGHTT; PAM sequence: CTGTGATT
ttatattcctattattggat

SEQ ID NO: 11290 - DNA, 20 bp, Artificial Sequence
  Description of Artificial Sequence: Synthetic oligonucleotide
  Target: SCN10A; (-) strand; PAM type: NNNNGHTT; PAM sequence: GTGAGCTT
tctgcttgactttggggtgt

SEQ ID NO: 11291 - DNA, 20 bp, Artificial Sequence
  Description of Artificial Sequence: Synthetic oligonucleotide
  Target: SCN10A; (-) strand; PAM type: NNNNGHTT; PAM sequence: ATCTGCTT
taagcactgcctctgccacc

SEQ ID NO: 11292 - DNA, 20 bp, Artificial Sequence
  Description of Artificial Sequence: Synthetic oligonucleotide
  Target: SCN10A; (-) strand; PAM type: NNNNGHTT; PAM sequence: ATTTGATT
aggatctccatcataggggt

SEQ ID NO: 11293 - DNA, 20 bp, Artificial Sequence
  Description of Artificial Sequence: Synthetic oligonucleotide
  Target: SCN10A; (-) strand; PAM type: NNNNGHTT; PAM sequence: ATTGGATT
agtgtctatatcacagaggt

SEQ ID NO: 11294 - DNA, 20 bp, Artificial Sequence
  Description of Artificial Sequence: Synthetic oligonucleotide
  Target: SCN10A; (-) strand; PAM type: NNNNGHTT; PAM sequence: CAGTGTTT
attaaagacactgaagtcaa

SEQ ID NO: 11295 - DNA, 20 bp, Artificial Sequence
  Description of Artificial Sequence: Synthetic oligonucleotide
  Target: SCN10A; (-) strand; PAM type: NNNNGHTT; PAM sequence: CTTTGTTT
gaagagaaagttaacttaat

SEQ ID NO: 11296 - DNA, 20 bp, Artificial Sequence
  Description of Artificial Sequence: Synthetic oligonucleotide
  Target: SCN10A; (-) strand; PAM type: NNNNGHTT; PAM sequence: CTGGGATT
tgttactaaacaactgagtc

SEQ ID NO: 11297 - DNA, 20 bp, Artificial Sequence
  Description of Artificial Sequence: Synthetic oligonucleotide
  Target: SCN10A; (-) strand; PAM type: NNNNGHTT; PAM sequence: TCTGGCTT
ccagctccaggacctggaat

SEQ ID NO: 11298 - DNA, 20 bp, Artificial Sequence
  Description of Artificial Sequence: Synthetic oligonucleotide
  Target: SCN10A; (-) strand; PAM type: NNNNGHTT; PAM sequence: GTCTGCTT
gaagtcagtctcatagctga

SEQ ID NO: 11299 - DNA, 20 bp, Artificial Sequence
  Description of Artificial Sequence: Synthetic oligonucleotide
  Target: SCN10A; (-) strand; PAM type: NNNNGHTT; PAM sequence: GAGGGATT
aacaattttgtccttagctg

SEQ ID NO: 11300 - DNA, 20 bp, Artificial Sequence
  Description of Artificial Sequence: Synthetic oligonucleotide
  Target: SCN10A; (-) strand; PAM type: NNNNGHTT; PAM sequence: AATAGTTT
agataaactacttgcacccc

SEQ ID NO: 11301 - DNA, 20 bp, Artificial Sequence
  Description of Artificial Sequence: Synthetic oligonucleotide
  Target: SCN10A; (-) strand; PAM type: NNNNGHTT; PAM sequence: TACTGCTT
gagtaaatggctcataaaaa

SEQ ID NO: 11302 - DNA, 20 bp, Artificial Sequence
  Description of Artificial Sequence: Synthetic oligonucleotide
  Target: SCN10A; (-) strand; PAM type: NNNNGHTT; PAM sequence: CCCAGTTT
ctcagtgaaacaattctgag

SEQ ID NO: 11303 - DNA, 20 bp, Artificial Sequence
  Description of Artificial Sequence: Synthetic oligonucleotide
  Target: SCN10A; (-) strand; PAM type: NNNNGHTT; PAM sequence: CAGGGCTT
acttcctgcctctgtctgcc

SEQ ID NO: 11304 - DNA, 20 bp, Artificial Sequence
  Description of Artificial Sequence: Synthetic oligonucleotide
  Target: SCN10A; (-) strand; PAM type: NNNNGHTT; PAM sequence: TAGGGATT
cattcaactagactctaaaa

SEQ ID NO: 11305 - DNA, 20 bp, Artificial Sequence
  Description of Artificial Sequence: Synthetic oligonucleotide
  Target: SCN10A; (-) strand; PAM type: NNNNGHTT; PAM sequence: ATGTGCTT
atatggctacctcacaaagg

SEQ ID NO: 11306 - DNA, 20 bp, Artificial Sequence
  Description of Artificial Sequence: Synthetic oligonucleotide
  Target: SCN10A; (-) strand; PAM type: NNNNGHTT; PAM sequence: CTTGGATT
ctaaactagaatagatattt

SEQ ID NO: 11307 - DNA, 20 bp, Artificial Sequence
  Description of Artificial Sequence: Synthetic oligonucleotide
  Target: SCN10A; (-) strand; PAM type: NNNNGHTT; PAM sequence: CCGAGCTT
agactgtttgaaagccaggg

SEQ ID NO: 11308 - DNA, 20 bp, Artificial Sequence
  Description of Artificial Sequence: Synthetic oligonucleotide
  Target: SCN10A; (-) strand; PAM type: NNNNGHTT; PAM sequence: GACTGTTT
tacctgcaaaaactcatgca

SEQ ID NO: 11309 - DNA, 20 bp, Artificial Sequence
  Description of Artificial Sequence: Synthetic oligonucleotide
  Target: SCN10A; (-) strand; PAM type: NNNNGHTT; PAM sequence: GCTTGCTT
aatgcccaccgaatagaaag

SEQ ID NO: 11310 - DNA, 20 bp, Artificial Sequence
  Description of Artificial Sequence: Synthetic oligonucleotide
  Target: SCN10A; (-) strand; PAM type: NNNNGHTT; PAM sequence: AAAGGCTT
gctgaatgcccaccgaatag

SEQ ID NO: 11311 - DNA, 20 bp, Artificial Sequence
  Description of Artificial Sequence: Synthetic oligonucleotide
  Target: SCN10A; (-) strand; PAM type: NNNNGHTT; PAM sequence: CTGTGATT
gaggtcaaggctgcaatgag

SEQ ID NO: 11312 - DNA, 20 bp, Artificial Sequence
  Description of Artificial Sequence: Synthetic oligonucleotide
  Target: SCN10A; (-) strand; PAM type: NNNNGHTT; PAM sequence: TGAAGATT
gaaaaaccccatcaaaaata

SEQ ID NO: 11313 - DNA, 20 bp, Artificial Sequence
  Description of Artificial Sequence: Synthetic oligonucleotide
  Target: SCN10A; (+) strand; PAM type: NNNNGHTT; PAM sequence: TTAGGTTT
tttgtacccttttggtaacc

SEQ ID NO: 11314 - DNA, 20 bp, Artificial Sequence
  Description of Artificial Sequence: Synthetic oligonucleotide
  Target: SCN10A; (+) strand; PAM type: NNNNGHTT; PAM sequence: TGTGGCTT
tttggtaaccttaggttttg

SEQ ID NO: 11315 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
ttaatgtaatttatgaatat

SEQ ID NO: 11316 - DNA, 20 bp, Artificial Sequence
  Description of Artificial Sequence: Synthetic oligonucleotide
  Target: SCN10A; (+) strand; PAM type: NNNNGHTT; PAM sequence: ATTTGTTT
tactttactctgtcttttct

SEQ ID NO: 11317 - DNA, 20 bp, Artificial Sequence
  Description of Artificial Sequence: Synthetic oligonucleotide
  Target: SCN10A; (+) strand; PAM type: NNNNGHTT; PAM sequence: CCGGGTTT
attctgtatgtctctatatc

SEQ ID NO: 11318 - DNA, 20 bp, Artificial Sequence
  Description of Artificial Sequence: Synthetic oligonucleotide
  Target: SCN10A; (+) strand; PAM type: NNNNGHTT; PAM sequence: TTAAGTTT
tttttaattattattatact

SEQ ID NO: 11319 - DNA, 20 bp, Artificial Sequence
  Description of Artificial Sequence: Synthetic oligonucleotide
  Target: SCN10A; (+) strand; PAM type: NNNNGHTT; PAM sequence: GCAGGTTT
aggatacatgagcacaacgt

SEQ ID NO: 11320 - DNA, 20 bp, Artificial Sequence
  Description of Artificial Sequence: Synthetic oligonucleotide
  Target: SCN10A; (+) strand; PAM type: NNNNGHTT; PAM sequence: CGGTGTTT
cacctatgagtgagaacatg

SEQ ID NO: 11321 - DNA, 20 bp, Artificial Sequence
  Description of Artificial Sequence: Synthetic oligonucleotide
  Target: SCN10A; (+) strand; PAM type: NNNNGHTT; PAM sequence: TTTGGTTT
atgagtgagaacatgcggtg

SEQ ID NO: 11322 - DNA, 20 bp, Artificial Sequence
  Description of Artificial Sequence: Synthetic oligonucleotide
  Target: SCN10A; (+) strand; PAM type: NNNNGHTT; PAM sequence: GATAGTTT
ttggttttttttgtccttgc

SEQ ID NO: 11323 - DNA, 20 bp, Artificial Sequence
  Description of Artificial Sequence: Synthetic oligonucleotide
  Target: SCN10A; (+) strand; PAM type: NNNNGHTT; PAM sequence: GATGGTTT
tgcgatagtttgctgagaat

SEQ ID NO: 11324 - DNA, 20 bp, Artificial Sequence
  Description of Artificial Sequence: Synthetic oligonucleotide
  Target: SCN10A; (+) strand; PAM type: NNNNGHTT; PAM sequence: TCCAGCTT
gtttgctgagaatgatggtt

SEQ ID NO: 11325 - DNA, 20 bp, Artificial Sequence
  Description of Artificial Sequence: Synthetic oligonucleotide
  Target: SCN10A; (+) strand; PAM type: NNNNGHTT; PAM sequence: GTATGATT
gtgcatgtgtctttatagca

SEQ ID NO: 11326 - DNA, 20 bp, Artificial Sequence
  Description of Artificial Sequence: Synthetic oligonucleotide
  Target: SCN10A; (+) strand; PAM type: NNNNGHTT; PAM sequence: CAATGATT
aattgccacaccgacttcca

SEQ ID NO: 11327 - DNA, 20 bp, Artificial Sequence
  Description of Artificial Sequence: Synthetic oligonucleotide
  Target: SCN10A; (+) strand; PAM type: NNNNGHTT; PAM sequence: ACTAGTTT
ccgacttccacaatgattga

SEQ ID NO: 11328 - DNA, 20 bp, Artificial Sequence
  Description of Artificial Sequence: Synthetic oligonucleotide
  Target: SCN10A; (+) strand; PAM type: NNNNGHTT; PAM sequence: TGTTGTTT
tccacatcctctccagcacc

SEQ ID NO: 11329 - DNA, 20 bp, Artificial Sequence
  Description of Artificial Sequence: Synthetic oligonucleotide
  Target: SCN10A; (+) strand; PAM type: NNNNGHTT; PAM sequence: TGTGGTTT
ggtgtgagatggtatctcat

SEQ ID NO: 11330 - DNA, 20 bp, Artificial Sequence
  Description of Artificial Sequence: Synthetic oligonucleotide
  Target: SCN10A; (+) strand; PAM type: NNNNGHTT; PAM sequence: TTTTGATT
gagatggtatctcattgtgg

SEQ ID NO: 11331 - DNA, 20 bp, Artificial Sequence
  Description of Artificial Sequence: Synthetic oligonucleotide
  Target: SCN10A; (+) strand; PAM type: NNNNGHTT; PAM sequence: ATGTGTTT
gtgatgatgagcattttttc

SEQ ID NO: 11332 - DNA, 20 bp, Artificial Sequence
  Description of Artificial Sequence: Synthetic oligonucleotide
  Target: SCN10A; (+) strand; PAM type: NNNNGHTT; PAM sequence: ATGGGATT
tatccttcgcccactttttg

SEQ ID NO: 11333 - DNA, 20 bp, Artificial Sequence
  Description of Artificial Sequence: Synthetic oligonucleotide
  Target: SCN10A; (+) strand; PAM type: NNNNGHTT; PAM sequence: ATTTGTTT
tgggatttttttccttgtaa

SEQ ID NO: 11334 - DNA, 20 bp, Artificial Sequence
  Description of Artificial Sequence: Synthetic oligonucleotide
  Target: SCN10A; (+) strand; PAM type: NNNNGHTT; PAM sequence: TGTAGATT
gtaaatttgtttgagttcat

SEQ ID NO: 11335 - DNA, 20 bp, Artificial Sequence
  Description of Artificial Sequence: Synthetic oligonucleotide
  Target: SCN10A; (+) strand; PAM type: NNNNGHTT; PAM sequence: GTAGGTTT
caaaaattttctcccatcct

SEQ ID NO: 11336 - DNA, 20 bp, Artificial Sequence
  Description of Artificial Sequence: Synthetic oligonucleotide
  Target: SCN10A; (+) strand; PAM type: NNNNGHTT; PAM sequence: GGTGGTTT
aggtttctgttcactctgat

SEQ ID NO: 11337 - DNA, 20 bp, Artificial Sequence
  Description of Artificial Sequence: Synthetic oligonucleotide
  Target: SCN10A; (+) strand; PAM type: NNNNGHTT; PAM sequence: TTTAGTTT
cttttgctgctcagaagctc

SEQ ID NO: 11338 - DNA, 20 bp, Artificial Sequence
  Description of Artificial Sequence: Synthetic oligonucleotide
  Target: SCN10A; (+) strand; PAM type: NNNNGHTT; PAM sequence: CATTGCTT
tcaattttgacttttgttgc

SEQ ID NO: 11339 - DNA, 20 bp, Artificial Sequence
  Description of Artificial Sequence: Synthetic oligonucleotide
  Target: SCN10A; (+) strand; PAM type: NNNNGHTT; PAM sequence: TGGTGTTT
acttttgttgccattgcttt

SEQ ID NO: 11340 - DNA, 20 bp, Artificial Sequence
  Description of Artificial Sequence: Synthetic oligonucleotide
  Target: SCN10A; (+) strand; PAM type: NNNNGHTT; PAM sequence: TAGGGTTT
gtattgcctaggttctcttc

SEQ ID NO: 11341 - DNA, 20 bp, Artificial Sequence
  Description of Artificial Sequence: Synthetic oligonucleotide
  Target: SCN10A; (+) strand; PAM type: NNNNGHTT; PAM sequence: TATGGTTT
aggttctcttctagggtttt

SEQ ID NO: 11342 - DNA, 20 bp, Artificial Sequence
  Description of Artificial Sequence: Synthetic oligonucleotide
  Target: SCN10A; (+) strand; PAM type: NNNNGHTT; PAM sequence: TCCAGTTT
tataaggtgtaaggaaggga

SEQ ID NO: 11343 - DNA, 20 bp, Artificial Sequence
  Description of Artificial Sequence: Synthetic oligonucleotide
  Target: SCN10A; (+) strand; PAM type: NNNNGHTT; PAM sequence: TTCAGCTT
gtgtaaggaagggatccagt

SEQ ID NO: 11344 - DNA, 20 bp, Artificial Sequence
  Description of Artificial Sequence: Synthetic oligonucleotide
  Target: SCN10A; (+) strand; PAM type: NNNNGHTT; PAM sequence: GCCAGTTT
cagctttctccatatggcta

SEQ ID NO: 11345 - DNA, 20 bp, Artificial Sequence
  Description of Artificial Sequence: Synthetic oligonucleotide
  Target: SCN10A; (+) strand; PAM type: NNNNGHTT; PAM sequence: TCTTGTTT
tagggaatcctttccccatt

SEQ ID NO: 11346 - DNA, 20 bp, Artificial Sequence
  Description of Artificial Sequence: Synthetic oligonucleotide
  Target: SCN10A; (+) strand; PAM type: NNNNGHTT; PAM sequence: TCAGGTTT
ttccccatttcttgtttttg

SEQ ID NO: 11347 - DNA, 20 bp, Artificial Sequence
  Description of Artificial Sequence: Synthetic oligonucleotide
  Target: SCN10A; (+) strand; PAM type: NNNNGHTT; PAM sequence: CTCTGTTT
tctgttccattggtctatat

SEQ ID NO: 11348 - DNA, 20 bp, Artificial Sequence
  Description of Artificial Sequence: Synthetic oligonucleotide
  Target: SCN10A; (+) strand; PAM type: NNNNGHTT; PAM sequence: TGCTGTTT
ctgttttggtaccagtacca

SEQ ID NO: 11349 - DNA, 20 bp, Artificial Sequence
  Description of Artificial Sequence: Synthetic oligonucleotide
  Target: SCN10A; (+) strand; PAM type: NNNNGHTT; PAM sequence: TATAGTTT
tggttactgtagccttgtaa

SEQ ID NO: 11350 - DNA, 20 bp, Artificial Sequence
  Description of Artificial Sequence: Synthetic oligonucleotide
  Target: SCN10A; (+) strand; PAM type: NNNNGHTT; PAM sequence: TCCAGCTT
aagtcaggtagcgtgatgcc

SEQ ID NO: 11351 - DNA, 20 bp, Artificial Sequence
  Description of Artificial Sequence: Synthetic oligonucleotide
  Target: SCN10A; (+) strand; PAM type: NNNNGHTT; PAM sequence: AATTGCTT
atgagtgaactcccattcac

SEQ ID NO: 11352 - DNA, 20 bp, Artificial Sequence
  Description of Artificial Sequence: Synthetic oligonucleotide
  Target: SCN10A; (+) strand; PAM type: NNNNGHTT; PAM sequence: TATAGATT
ccatactgcccaaggtaatt

SEQ ID NO: 11353 - DNA, 20 bp, Artificial Sequence
  Description of Artificial Sequence: Synthetic oligonucleotide
  Target: SCN10A; (+) strand; PAM type: NNNNGHTT; PAM sequence: TCCTGTTT
cattgccaagtcaatcctaa

SEQ ID NO: 11354 - DNA, 20 bp, Artificial Sequence
  Description of Artificial Sequence: Synthetic oligonucleotide
  Target: SCN10A; (+) strand; PAM type: NNNNGHTT; PAM sequence: TTTTGATT
ttttttttttaaccttactt

SEQ ID NO: 11355 - DNA, 20 bp, Artificial Sequence
  Description of Artificial Sequence: Synthetic oligonucleotide
  Target: SCN10A; (+) strand; PAM type: NNNNGHTT; PAM sequence: AATTGTTT
ccttacttttttgattggct

SEQ ID NO: 11356 - DNA, 20 bp, Artificial Sequence
  Description of Artificial Sequence: Synthetic oligonucleotide
  Target: SCN10A; (+) strand; PAM type: NNNNGHTT; PAM sequence: TTCTGATT
ttggaaatgatatactctat

SEQ ID NO: 11357 - DNA, 20 bp, Artificial Sequence
  Description of Artificial Sequence: Synthetic oligonucleotide
  Target: SCN10A; (+) strand; PAM type: NNNNGHTT; PAM sequence: TGCAGTTT
ccatctgtgtctatgtgtta

SEQ ID NO: 11358 - DNA, 20 bp, Artificial Sequence
  Description of Artificial Sequence: Synthetic oligonucleotide
  Target: SCN10A; (+) strand; PAM type: NNNNGHTT; PAM sequence: CGGTGTTT
aatggtataaaaagttaggg

SEQ ID NO: 11359 - DNA, 20 bp, Artificial Sequence
  Description of Artificial Sequence: Synthetic oligonucleotide
  Target: SCN10A; (+) strand; PAM type: NNNNGHTT; PAM sequence: GAGAGATT
tatcctcacattctgggcca

SEQ ID NO: 11360 - DNA, 20 bp, Artificial Sequence
  Description of Artificial Sequence: Synthetic oligonucleotide
  Target: SCN10A; (+) strand; PAM type: NNNNGHTT; PAM sequence: TCTAGTTT
acattctgggccagagagat

SEQ ID NO: 11361 - DNA, 20 bp, Artificial Sequence
  Description of Artificial Sequence: Synthetic oligonucleotide
  Target: SCN10A; (+) strand; PAM type: NNNNGHTT; PAM sequence: TCTAGTTT
caggttggctcccatggaaa

SEQ ID NO: 11362 - DNA, 20 bp, Artificial Sequence
  Description of Artificial Sequence: Synthetic oligonucleotide
  Target: SCN10A; (+) strand; PAM type: NNNNGHTT; PAM sequence: CAATGTTT
tgtatattgcatcccttttc

SEQ ID NO: 11363 - DNA, 20 bp, Artificial Sequence
  Description of Artificial Sequence: Synthetic oligonucleotide
  Target: SCN10A; (+) strand; PAM type: NNNNGHTT; PAM sequence: AATGGATT
tttgtgcagaaaaaatgaga

SEQ ID NO: 11364 - DNA, 20 bp, Artificial Sequence
  Description of Artificial Sequence: Synthetic oligonucleotide
  Target: SCN10A; (+) strand; PAM type: NNNNGHTT; PAM sequence: ATTAGTTT
gcagaaaaaatgagaaatgg

SEQ ID NO: 11365 - DNA, 20 bp, Artificial Sequence
  Description of Artificial Sequence: Synthetic oligonucleotide
  Target: SCN10A; (+) strand; PAM type: NNNNGHTT; PAM sequence: CCTAGCTT
cgttgccttccatgtctcct

SEQ ID NO: 11366 - DNA, 20 bp, Artificial Sequence
  Description of Artificial Sequence: Synthetic oligonucleotide
  Target: SCN10A; (+) strand; PAM type: NNNNGHTT; PAM sequence: CTCCGATT
cttggcctgcacatgtatct

SEQ ID NO: 11367 - DNA, 20 bp, Artificial Sequence
  Description of Artificial Sequence: Synthetic oligonucleotide
  Target: SCN10A; (+) strand; PAM type: NNNNGHTT; PAM sequence: GTGTGTTT
tacagctgtcttttctttgt

SEQ ID NO: 11368 - DNA, 20 bp, Artificial Sequence
  Description of Artificial Sequence: Synthetic oligonucleotide
  Target: SCN10A; (+) strand; PAM type: NNNNGHTT; PAM sequence: ATTGGATT
atattttagcaacaccagtc

SEQ ID NO: 11369 - DNA, 20 bp, Artificial Sequence
  Description of Artificial Sequence: Synthetic oligonucleotide
  Target: SCN10A; (+) strand; PAM type: NNNNGHTT; PAM sequence: ATTTGTTT
tagggctcaccttcatctga

SEQ ID NO: 11370 - DNA, 20 bp, Artificial Sequence
  Description of Artificial Sequence: Synthetic oligonucleotide
  Target: SCN10A; (+) strand; PAM type: NNNNGHTT; PAM sequence: CTATGTTT
cataaagttgaattatgttc

SEQ ID NO: 11371 - DNA, 20 bp, Artificial Sequence
  Description of Artificial Sequence: Synthetic oligonucleotide
  Target: SCN10A; (+) strand; PAM type: NNNNGHTT; PAM sequence: ATCTGCTT
atacttttgagaatagtatc

SEQ ID NO: 11372 - DNA, 20 bp, Artificial Sequence
  Description of Artificial Sequence: Synthetic oligonucleotide
  Target: SCN10A; (+) strand; PAM type: NNNNGHTT; PAM sequence: GATGGTTT
tgctttaatagaaccagtct

SEQ ID NO: 11373 - DNA, 20 bp, Artificial Sequence
  Description of Artificial Sequence: Synthetic oligonucleotide
  Target: SCN10A; (+) strand; PAM type: NNNNGHTT; PAM sequence: GATGGCTT
acacttgggctagtatctca

SEQ ID NO: 11374 - DNA, 20 bp, Artificial Sequence
  Description of Artificial Sequence: Synthetic oligonucleotide
  Target: SCN10A; (+) strand; PAM type: NNNNGHTT; PAM sequence: ATGGGATT
atggctttttcatcatccac

SEQ ID NO: 11375 - DNA, 20 bp, Artificial Sequence
  Description of Artificial Sequence: Synthetic oligonucleotide
  Target: SCN10A; (+) strand; PAM type: NNNNGHTT; PAM sequence: AGCTGATT
aaatcaggcattcagagaat

SEQ ID NO: 11376 - DNA, 20 bp, Artificial Sequence
  Description of Artificial Sequence: Synthetic oligonucleotide
  Target: SCN10A; (+) strand; PAM type: NNNNGHTT; PAM sequence: GATGGCTT
tcagagaatagctgatttga

SEQ ID NO: 11377 - DNA, 20 bp, Artificial Sequence
  Description of Artificial Sequence: Synthetic oligonucleotide
  Target: SCN10A; (+) strand; PAM type: NNNNGHTT; PAM sequence: CTGTGCTT
catgtgagatgtatcagcca

SEQ ID NO: 11378 - DNA, 20 bp, Artificial Sequence
  Description of Artificial Sequence: Synthetic oligonucleotide
  Target: SCN10A; (+) strand; PAM type: NNNNGHTT; PAM sequence: TTGTGATT
ttggctatatatttgaatct

SEQ ID NO: 11379 - DNA, 20 bp, Artificial Sequence
  Description of Artificial Sequence: Synthetic oligonucleotide
  Target: SCN10A; (+) strand; PAM type: NNNNGHTT; PAM sequence: CTTTGCTT
cctatgttgttatagggagt

SEQ ID NO: 11380 - DNA, 20 bp, Artificial Sequence
  Description of Artificial Sequence: Synthetic oligonucleotide
  Target: SCN10A; (+) strand; PAM type: NNNNGHTT; PAM sequence: GGGGGCTT
gttcatacaattaatctttt

SEQ ID NO: 11381 - DNA, 20 bp, Artificial Sequence
  Description of Artificial Sequence: Synthetic oligonucleotide
  Target: SCN10A; (+) strand; PAM type: NNNNGHTT; PAM sequence: TCATGATT
tatctactggatcatcattc

SEQ ID NO: 11382 - DNA, 20 bp, Artificial Sequence
  Description of Artificial Sequence: Synthetic oligonucleotide
  Target: SCN10A; (+) strand; PAM type: NNNNGHTT; PAM sequence: TTCTGATT
tctcatgattatactttttc

SEQ ID NO: 11383 - DNA, 20 bp, Artificial Sequence
  Description of Artificial Sequence: Synthetic oligonucleotide
  Target: SCN10A; (+) strand; PAM type: NNNNGHTT; PAM sequence: GTCTGATT
taaaaactctcctccttaat

SEQ ID NO: 11384 - DNA, 20 bp, Artificial Sequence
  Description of Artificial Sequence: Synthetic oligonucleotide
  Target: SCN10A; (+) strand; PAM type: NNNNGHTT; PAM sequence: GAGTGCTT
gccatttcagcctcagaaaa

SEQ ID NO: 11385 - DNA, 20 bp, Artificial Sequence
  Description of Artificial Sequence: Synthetic oligonucleotide
  Target: SCN10A; (+) strand; PAM type: NNNNGHTT; PAM sequence: TTAGGATT
ccagacaattggtggaaaag

SEQ ID NO: 11386 - DNA, 20 bp, Artificial Sequence
  Description of Artificial Sequence: Synthetic oligonucleotide
  Target: SCN10A; (+) strand; PAM type: NNNNGHTT; PAM sequence: TGATGCTT
gaaataagagaaaaataaaa

SEQ ID NO: 11387 - DNA, 20 bp, Artificial Sequence
  Description of Artificial Sequence: Synthetic oligonucleotide
  Target: SCN10A; (+) strand; PAM type: NNNNGHTT; PAM sequence: AAAGGCTT
ttaattttaatggatatctc

SEQ ID NO: 11388 - DNA, 20 bp, Artificial Sequence
  Description of Artificial Sequence: Synthetic oligonucleotide
  Target: SCN10A; (+) strand; PAM type: NNNNGHTT; PAM sequence: AGAAGTTT
ctttggaagttctggtcctg

SEQ ID NO: 11389 - DNA, 20 bp, Artificial Sequence
  Description of Artificial Sequence: Synthetic oligonucleotide
  Target: SCN10A; (+) strand; PAM type: NNNNGHTT; PAM sequence: ATCTGATT
agtttgtctcagtaaatata

SEQ ID NO: 11390 - DNA, 20 bp, Artificial Sequence
  Description of Artificial Sequence: Synthetic oligonucleotide
  Target: SCN10A; (+) strand; PAM type: NNNNGHTT; PAM sequence: CTTAGCTT
gaaatcacagtggaagtgct

SEQ ID NO: 11391 - DNA, 20 bp, Artificial Sequence
  Description of Artificial Sequence: Synthetic oligonucleotide
  Target: SCN10A; (+) strand; PAM type: NNNNGHTT; PAM sequence: GATGGTTT
tctgactcctatttgtgtat

SEQ ID NO: 11392 - DNA, 20 bp, Artificial Sequence
  Description of Artificial Sequence: Synthetic oligonucleotide
  Target: SCN10A; (+) strand; PAM type: NNNNGHTT; PAM sequence: GGTGGCTT
ggggcaatcagctccatact

SEQ ID NO: 11393 - DNA, 20 bp, Artificial Sequence
  Description of Artificial Sequence: Synthetic oligonucleotide
  Target: SCN10A; (+) strand; PAM type: NNNNGHTT; PAM sequence: AGCAGTTT
ggtgggaatgatgtggcaga

SEQ ID NO: 11394 - DNA, 20 bp, Artificial Sequence
  Description of Artificial Sequence: Synthetic oligonucleotide
  Target: SCN10A; (+) strand; PAM type: NNNNGHTT; PAM sequence: TTCAGATT
aatgatgtggcagaagcagt

SEQ ID NO: 11395 - DNA, 20 bp, Artificial Sequence
  Description of Artificial Sequence: Synthetic oligonucleotide
  Target: SCN10A; (+) strand; PAM type: NNNNGHTT; PAM sequence: TCTTGCTT
tgacagtggctgaaatgtct

SEQ ID NO: 11396 - DNA, 20 bp, Artificial Sequence
  Description of Artificial Sequence: Synthetic oligonucleotide
  Target: SCN10A; (+) strand; PAM type: NNNNGHTT; PAM sequence: GGATGATT
gtggttgctattggttcata

SEQ ID NO: 11397 - DNA, 20 bp, Artificial Sequence
  Description of Artificial Sequence: Synthetic oligonucleotide
  Target: SCN10A; (+) strand; PAM type: NNNNGHTT; PAM sequence: GAAAGATT
ttggttcataggatgatttt

SEQ ID NO: 11398 - DNA, 20 bp, Artificial Sequence
  Description of Artificial Sequence: Synthetic oligonucleotide
  Target: SCN10A; (+) strand; PAM type: NNNNGHTT; PAM sequence: CCCGGATT
gccttcagagaatccaactc

SEQ ID NO: 11399 - DNA, 20 bp, Artificial Sequence
  Description of Artificial Sequence: Synthetic oligonucleotide
  Target: SCN10A; (+) strand; PAM type: NNNNGHTT; PAM sequence: TTTCGATT
ggtccatctggatcagtata

SEQ ID NO: 11400 - DNA, 20 bp, Artificial Sequence
  Description of Artificial Sequence: Synthetic oligonucleotide
  Target: SCN10A; (+) strand; PAM type: NNNNGHTT; PAM sequence: TTGGGTTT
tctggatcagtatatttcga

SEQ ID NO: 11401 - DNA, 20 bp, Artificial Sequence
  Description of Artificial Sequence: Synthetic oligonucleotide
  Target: SCN10A; (+) strand; PAM type: NNNNGHTT; PAM sequence: TTGGGATT
cagtatatttcgattgggtt

SEQ ID NO: 11402 - DNA, 20 bp, Artificial Sequence
  Description of Artificial Sequence: Synthetic oligonucleotide
  Target: SCN10A; (+) strand; PAM type: NNNNGHTT; PAM sequence: GGCAGATT
ctctggtgccattgctgttg

SEQ ID NO: 11403 - DNA, 20 bp, Artificial Sequence
  Description of Artificial Sequence: Synthetic oligonucleotide
  Target: SCN10A; (+) strand; PAM type: NNNNGHTT; PAM sequence: CTCTGCTT
caaagttggctgtgatgaca

SEQ ID NO: 11404 - DNA, 20 bp, Artificial Sequence
  Description of Artificial Sequence: Synthetic oligonucleotide
  Target: SCN10A; (+) strand; PAM type: NNNNGHTT; PAM sequence: CTTTGCTT
ttggctgtgatgacactctg

SEQ ID NO: 11405 - DNA, 20 bp, Artificial Sequence
  Description of Artificial Sequence: Synthetic oligonucleotide
  Target: SCN10A; (+) strand; PAM type: NNNNGHTT; PAM sequence: TGCAGTTT
caagttcagctggaagtgac

SEQ ID NO: 11406 - DNA, 20 bp, Artificial Sequence
  Description of Artificial Sequence: Synthetic oligonucleotide
  Target: SCN10A; (+) strand; PAM type: NNNNGHTT; PAM sequence: GCCTGTTT
ccacaggctcacagtctttg

SEQ ID NO: 11407 - DNA, 20 bp, Artificial Sequence
  Description of Artificial Sequence: Synthetic oligonucleotide
  Target: SCN10A; (+) strand; PAM type: NNNNGHTT; PAM sequence: TTATGATT
tctgtgaaggccaggacccc

SEQ ID NO: 11408 - DNA, 20 bp, Artificial Sequence
  Description of Artificial Sequence: Synthetic oligonucleotide
  Target: SCN10A; (+) strand; PAM type: NNNNGHTT; PAM sequence: TGAAGATT
cctctccctacctcctactg

SEQ ID NO: 11409 - DNA, 20 bp, Artificial Sequence
  Description of Artificial Sequence: Synthetic oligonucleotide
  Target: SCN10A; (+) strand; PAM type: NNNNGHTT; PAM sequence: CTCTGTTT
cctcctactgtgaagattga

SEQ ID NO: 11410 - DNA, 20 bp, Artificial Sequence
  Description of Artificial Sequence: Synthetic oligonucleotide
  Target: SCN10A; (+) strand; PAM type: NNNNGHTT; PAM sequence: TGAGGATT
gtgttaattacaagggggcc

SEQ ID NO: 11411 - DNA, 20 bp, Artificial Sequence
  Description of Artificial Sequence: Synthetic oligonucleotide
  Target: SCN10A; (+) strand; PAM type: NNNNGHTT; PAM sequence: AAGGGATT
ctggctgacagctaaagcat

SEQ ID NO: 11412 - DNA, 20 bp, Artificial Sequence
  Description of Artificial Sequence: Synthetic oligonucleotide
  Target: SCN10A; (+) strand; PAM type: NNNNGHTT; PAM sequence: ATTTGTTT
gctgtctgcacaatgcctta

SEQ ID NO: 11413 - DNA, 20 bp, Artificial Sequence
  Description of Artificial Sequence: Synthetic oligonucleotide
  Target: SCN10A; (+) strand; PAM type: NNNNGHTT; PAM sequence: AGCTGTTT
tttttttttttttcggttcc

SEQ ID NO: 11414 - DNA, 20 bp, Artificial Sequence
  Description of Artificial Sequence: Synthetic oligonucleotide
  Target: SCN10A; (+) strand; PAM type: NNNNGHTT; PAM sequence: ATAGGTTT
ctttatgttagggcctggag

SEQ ID NO: 11415 - DNA, 20 bp, Artificial Sequence
  Description of Artificial Sequence: Synthetic oligonucleotide
  Target: SCN10A; (+) strand; PAM type: NNNNGHTT; PAM sequence: AGATGTTT
ctatatgatgtctaacttga

SEQ ID NO: 11416 - DNA, 20 bp, Artificial Sequence
  Description of Artificial Sequence: Synthetic oligonucleotide
  Target: SCN10A; (+) strand; PAM type: NNNNGHTT; PAM sequence: GTTTGATT
atgatgtctaacttgaagat

SEQ ID NO: 11417 - DNA, 20 bp, Artificial Sequence
  Description of Artificial Sequence: Synthetic oligonucleotide
  Target: SCN10A; (+) strand; PAM type: NNNNGHTT; PAM sequence: TTTGGATT
acttgggaaataattataat

SEQ ID NO: 11418 - DNA, 20 bp, Artificial Sequence
  Description of Artificial Sequence: Synthetic oligonucleotide
  Target: SCN10A; (+) strand; PAM type: NNNNGHTT; PAM sequence: TCCAGTTT
tggaagaccttctgtgaatt

SEQ ID NO: 11419 - DNA, 20 bp, Artificial Sequence
  Description of Artificial Sequence: Synthetic oligonucleotide
  Target: SCN10A; (+) strand; PAM type: NNNNGHTT; PAM sequence: GAAAGATT
ggaggtaaggagagagggta

SEQ ID NO: 11420 - DNA, 20 bp, Artificial Sequence
  Description of Artificial Sequence: Synthetic oligonucleotide
  Target: SCN10A; (+) strand; PAM type: NNNNGHTT; PAM sequence: GTGGGTTT
gagggtagaaagattgatat

SEQ ID NO: 11421 - DNA, 20 bp, Artificial Sequence
  Description of Artificial Sequence: Synthetic oligonucleotide
  Target: SCN10A; (+) strand; PAM type: NNNNGHTT; PAM sequence: TTCTGCTT
aagattgatatgtgggtttt

SEQ ID NO: 11422 - DNA, 20 bp, Artificial Sequence
  Description of Artificial Sequence: Synthetic oligonucleotide
  Target: SCN10A; (+) strand; PAM type: NNNNGHTT; PAM sequence: AAGGGATT
tgcttattttccagctctat

SEQ ID NO: 11423 - DNA, 20 bp, Artificial Sequence
  Description of Artificial Sequence: Synthetic oligonucleotide
  Target: SCN10A; (+) strand; PAM type: NNNNGHTT; PAM sequence: CTATGTTT
tcatagaactaagtacttgg

SEQ ID NO: 11424 - DNA, 20 bp, Artificial Sequence
  Description of Artificial Sequence: Synthetic oligonucleotide
  Target: SCN10A; (+) strand; PAM type: NNNNGHTT; PAM sequence: ACATGATT
gacacagaaggacaaaaacg

SEQ ID NO: 11425 - DNA, 20 bp, Artificial Sequence
  Description of Artificial Sequence: Synthetic oligonucleotide
  Target: SCN10A; (+) strand; PAM type: NNNNGHTT; PAM sequence: GGTGGTTT
atgggagcagagaatagaat

SEQ ID NO: 11426 - DNA, 20 bp, Artificial Sequence
  Description of Artificial Sequence: Synthetic oligonucleotide
  Target: SCN10A; (+) strand; PAM type: NNNNGHTT; PAM sequence: ACATGTTT
gaaatatttggaggttatgg

SEQ ID NO: 11427 - DNA, 20 bp, Artificial Sequence
  Description of Artificial Sequence: Synthetic oligonucleotide
  Target: SCN10A; (+) strand; PAM type: NNNNGHTT; PAM sequence: GATGGTTT
tttctggcattgatggtggt

SEQ ID NO: 11428 - DNA, 20 bp, Artificial Sequence
  Description of Artificial Sequence: Synthetic oligonucleotide
  Target: SCN10A; (+) strand; PAM type: NNNNGHTT; PAM sequence: TATAGCTT
agttgtgtacattaaacatg

SEQ ID NO: 11429 - DNA, 20 bp, Artificial Sequence
  Description of Artificial Sequence: Synthetic oligonucleotide
  Target: SCN10A; (+) strand; PAM type: NNNNGHTT; PAM sequence: CTGTGTTT
gaaatacacgcaacccaagg

SEQ ID NO: 11430 - DNA, 20 bp, Artificial Sequence
  Description of Artificial Sequence: Synthetic oligonucleotide
  Target: SCN10A; (+) strand; PAM type: NNNNGHTT; PAM sequence: GCATGATT
atgccaggtgaagctggtga

SEQ ID NO: 11431 - DNA, 20 bp, Artificial Sequence
  Description of Artificial Sequence: Synthetic oligonucleotide
  Target: SCN10A; (+) strand; PAM type: NNNNGHTT; PAM sequence: AGAAGATT
tgacaggcagcaagttcatt

SEQ ID NO: 11432 - DNA, 20 bp, Artificial Sequence
  Description of Artificial Sequence: Synthetic oligonucleotide
  Target: SCN10A; (+) strand; PAM type: NNNNGHTT; PAM sequence: CTCAGCTT
agattggagcctgttctaaa

SEQ ID NO: 11433 - DNA, 20 bp, Artificial Sequence
  Description of Artificial Sequence: Synthetic oligonucleotide
  Target: SCN10A; (+) strand; PAM type: NNNNGHTT; PAM sequence: ACCTGCTT
tataaaataaggataataac

SEQ ID NO: 11434 - DNA, 20 bp, Artificial Sequence
  Description of Artificial Sequence: Synthetic oligonucleotide
  Target: SCN10A; (+) strand; PAM type: NNNNGHTT; PAM sequence: TAGAGATT
tccctaatagaacagttgtg

SEQ ID NO: 11435 - DNA, 20 bp, Artificial Sequence
  Description of Artificial Sequence: Synthetic oligonucleotide
  Target: SCN10A; (+) strand; PAM type: NNNNGHTT; PAM sequence: AACAGATT
caatccatctccttttccag

SEQ ID NO: 11436 - DNA, 20 bp, Artificial Sequence
  Description of Artificial Sequence: Synthetic oligonucleotide
  Target: SCN10A; (+) strand; PAM type: NNNNGHTT; PAM sequence: CCCTGCTT
ctcacattacaccacctgcc

SEQ ID NO: 11437 - DNA, 20 bp, Artificial Sequence
  Description of Artificial Sequence: Synthetic oligonucleotide
  Target: SCN10A; (+) strand; PAM type: NNNNGHTT; PAM sequence: GAGTGATT
cggtctgaggttctcaggag

SEQ ID NO: 11438 - DNA, 20 bp, Artificial Sequence
  Description of Artificial Sequence: Synthetic oligonucleotide
  Target: SCN10A; (+) strand; PAM type: NNNNGHTT; PAM sequence: CTTGGTTT
aaaagttggttggttatttc

SEQ ID NO: 11439 - DNA, 20 bp, Artificial Sequence
  Description of Artificial Sequence: Synthetic oligonucleotide
  Target: SCN10A; (+) strand; PAM type: NNNNGHTT; PAM sequence: TGGGGCTT
caaagacccccaaacagagg

SEQ ID NO: 11440 - DNA, 20 bp, Artificial Sequence
  Description of Artificial Sequence: Synthetic oligonucleotide
  Target: SCN10A; (+) strand; PAM type: NNNNGHTT; PAM sequence: GGTTGATT
gaagacggccacaaagaact

SEQ ID NO: 11441 - DNA, 20 bp, Artificial Sequence
  Description of Artificial Sequence: Synthetic oligonucleotide
  Target: SCN10A; (+) strand; PAM type: NNNNGHTT; PAM sequence: AAAAGCTT
aggaccatgatggtgatgtc

SEQ ID NO: 11442 - DNA, 20 bp, Artificial Sequence
  Description of Artificial Sequence: Synthetic oligonucleotide
  Target: SCN10A; (+) strand; PAM type: NNNNGHTT; PAM sequence: ATGAGTTT
ggcatctgtgttatctgtag

SEQ ID NO: 11443 - DNA, 20 bp, Artificial Sequence
  Description of Artificial Sequence: Synthetic oligonucleotide
  Target: SCN10A; (+) strand; PAM type: NNNNGHTT; PAM sequence: AGCTGTTT
gtcttctctactagacaatg

SEQ ID NO: 11444 - DNA, 20 bp, Artificial Sequence
  Description of Artificial Sequence: Synthetic oligonucleotide
  Target: SCN10A; (+) strand; PAM type: NNNNGHTT; PAM sequence: CTTTGTTT
aagggctataccttccttaa

SEQ ID NO: 11445 - DNA, 20 bp, Artificial Sequence
  Description of Artificial Sequence: Synthetic oligonucleotide
  Target: SCN10A; (+) strand; PAM type: NNNNGHTT; PAM sequence: AGCTGCTT
gcacattgcaagagttcaag

SEQ ID NO: 11446 - DNA, 20 bp, Artificial Sequence
  Description of Artificial Sequence: Synthetic oligonucleotide
  Target: SCN10A; (+) strand; PAM type: NNNNGHTT; PAM sequence: GGTTGTTT
agggcgtagggtcaagtctt

SEQ ID NO: 11447 - DNA, 20 bp, Artificial Sequence
  Description of Artificial Sequence: Synthetic oligonucleotide
  Target: SCN10A; (+) strand; PAM type: NNNNGHTT; PAM sequence: CCACGCTT
cttgatcccaaccccattcc

SEQ ID NO: 11448 - DNA, 20 bp, Artificial Sequence
  Description of Artificial Sequence: Synthetic oligonucleotide
  Target: SCN10A; (+) strand; PAM type: NNNNGHTT; PAM sequence: TCTTGCTT
ctgtgtcttgtaaaacccct

SEQ ID NO: 11449 - DNA, 20 bp, Artificial Sequence
  Description of Artificial Sequence: Synthetic oligonucleotide
  Target: SCN10A; (+) strand; PAM type: NNNNGHTT; PAM sequence: TGAAGCTT
tgtaaaaccccttcttgctt

SEQ ID NO: 11450 - DNA, 20 bp, Artificial Sequence
  Description of Artificial Sequence: Synthetic oligonucleotide
  Target: SCN10A; (+) strand; PAM type: NNNNGHTT; PAM sequence: CCTAGTTT
cttgctttgaagctttgcca

SEQ ID NO: 11451 - DNA, 20 bp, Artificial Sequence
  Description of Artificial Sequence: Synthetic oligonucleotide
  Target: SCN10A; (+) strand; PAM type: NNNNGHTT; PAM sequence: TGCCGCTT
ttttgtcacttcttcattac

SEQ ID NO: 11452 - DNA, 20 bp, Artificial Sequence
  Description of Artificial Sequence: Synthetic oligonucleotide
  Target: SCN10A; (+) strand; PAM type: NNNNGHTT; PAM sequence: CTTGGTTT
atgtgcattactctttgtct

SEQ ID NO: 11453 - DNA, 20 bp, Artificial Sequence
  Description of Artificial Sequence: Synthetic oligonucleotide
  Target: SCN10A; (+) strand; PAM type: NNNNGHTT; PAM sequence: CCTAGTTT
attgcacaaatctctaatga

SEQ ID NO: 11454 - DNA, 20 bp, Artificial Sequence
  Description of Artificial Sequence: Synthetic oligonucleotide
  Target: SCN10A; (+) strand; PAM type: NNNNGHTT; PAM sequence: CAGAGCTT
cactcctcagcccacatcaa

SEQ ID NO: 11455 - DNA, 20 bp, Artificial Sequence
  Description of Artificial Sequence: Synthetic oligonucleotide
  Target: SCN10A; (+) strand; PAM type: NNNNGHTT; PAM sequence: CAGAGATT
agcttttgcctctatcctga

SEQ ID NO: 11456 - DNA, 20 bp, Artificial Sequence
  Description of Artificial Sequence: Synthetic oligonucleotide
  Target: SCN10A; (+) strand; PAM type: NNNNGHTT; PAM sequence: GGACGCTT
tcccataatattagatccaa

SEQ ID NO: 11457 - DNA, 20 bp, Artificial Sequence
  Description of Artificial Sequence: Synthetic oligonucleotide
  Target: SCN10A; (+) strand; PAM type: NNNNGHTT; PAM sequence: TGTTGCTT
agtacccttctaccttgaaa

SEQ ID NO: 11458 - DNA, 20 bp, Artificial Sequence
  Description of Artificial Sequence: Synthetic oligonucleotide
  Target: SCN10A; (+) strand; PAM type: NNNNGHTT; PAM sequence: TTCTGCTT
gtctccaccatgccttacat

SEQ ID NO: 11459 - DNA, 20 bp, Artificial Sequence
  Description of Artificial Sequence: Synthetic oligonucleotide
  Target: SCN10A; (+) strand; PAM type: NNNNGHTT; PAM sequence: AACTGTTT
tatatgtgcaacttttggcc

SEQ ID NO: 11460 - DNA, 20 bp, Artificial Sequence
  Description of Artificial Sequence: Synthetic oligonucleotide
  Target: SCN10A; (+) strand; PAM type: NNNNGHTT; PAM sequence: TTCTGCTT
tgatgaggctgatccttgcc

SEQ ID NO: 11461 - DNA, 20 bp, Artificial Sequence
  Description of Artificial Sequence: Synthetic oligonucleotide
  Target: SCN10A; (+) strand; PAM type: NNNNGHTT; PAM sequence: GGGGGATT
acatctttcctggggcagga

SEQ ID NO: 11462 - DNA, 20 bp, Artificial Sequence
  Description of Artificial Sequence: Synthetic oligonucleotide
  Target: SCN10A; (+) strand; PAM type: NNNNGHTT; PAM sequence: TGAAGTTT
catcgttaagtggctgggtg

SEQ ID NO: 11463 - DNA, 20 bp, Artificial Sequence
  Description of Artificial Sequence: Synthetic oligonucleotide
  Target: SCN10A; (+) strand; PAM type: NNNNGHTT; PAM sequence: AGTAGCTT
attctgactttagggaatgg

SEQ ID NO: 11464 - DNA, 20 bp, Artificial Sequence
  Description of Artificial Sequence: Synthetic oligonucleotide
  Target: SCN10A; (+) strand; PAM type: NNNNGHTT; PAM sequence: CTTGGATT
ggagtagcttgctagctgct

SEQ ID NO: 11465 - DNA, 20 bp, Artificial Sequence
  Description of Artificial Sequence: Synthetic oligonucleotide
  Target: SCN10A; (+) strand; PAM type: NNNNGHTT; PAM sequence: GGGTGATT
gctctcagagacgatgaagt

SEQ ID NO: 11466 - DNA, 20 bp, Artificial Sequence
  Description of Artificial Sequence: Synthetic oligonucleotide
  Target: SCN10A; (+) strand; PAM type: NNNNGHTT; PAM sequence: GATTGATT
tcagagacgatgaagtgggt

SEQ ID NO: 11467 - DNA, 20 bp, Artificial Sequence
  Description of Artificial Sequence: Synthetic oligonucleotide
  Target: SCN10A; (+) strand; PAM type: NNNNGHTT; PAM sequence: AGCTGCTT
tataaagtggagtatgtgag

SEQ ID NO: 11468 - DNA, 20 bp, Artificial Sequence
  Description of Artificial Sequence: Synthetic oligonucleotide
  Target: SCN10A; (+) strand; PAM type: NNNNGHTT; PAM sequence: TATTGATT
gagtatgtgagagctgcttt

SEQ ID NO: 11469 - DNA, 20 bp, Artificial Sequence
  Description of Artificial Sequence: Synthetic oligonucleotide
  Target: SCN10A; (+) strand; PAM type: NNNNGHTT; PAM sequence: ACAAGATT
taacttttcctatggaagaa

SEQ ID NO: 11470 - DNA, 20 bp, Artificial Sequence
  Description of Artificial Sequence: Synthetic oligonucleotide
  Target: SCN10A; (+) strand; PAM type: NNNNGHTT; PAM sequence: CAGTGCTT
atggggcagaaatcctgtgt

SEQ ID NO: 11471 - DNA, 20 bp, Artificial Sequence
  Description of Artificial Sequence: Synthetic oligonucleotide
  Target: SCN10A; (+) strand; PAM type: NNNNGHTT; PAM sequence: ACCAGCTT
gtcagtgctttgctggtatg

SEQ ID NO: 11472 - DNA, 20 bp, Artificial Sequence
  Description of Artificial Sequence: Synthetic oligonucleotide
  Target: SCN10A; (+) strand; PAM type: NNNNGHTT; PAM sequence: CTTGGATT
gagtgggaatttccttttgc

SEQ ID NO: 11473 - DNA, 20 bp, Artificial Sequence
  Description of Artificial Sequence: Synthetic oligonucleotide
  Target: SCN10A; (+) strand; PAM type: NNNNGHTT; PAM sequence: TCCGGCTT
actttgaagagggaagatga

SEQ ID NO: 11474 - DNA, 20 bp, Artificial Sequence
  Description of Artificial Sequence: Synthetic oligonucleotide
  Target: SCN10A; (+) strand; PAM type: NNNNGHTT; PAM sequence: TGCTGCTT
ggagtgcagccatctgcagg

SEQ ID NO: 11475 - DNA, 20 bp, Artificial Sequence
  Description of Artificial Sequence: Synthetic oligonucleotide
  Target: SCN10A; (+) strand; PAM type: NNNNGHTT; PAM sequence: CTCTGCTT
atctgcaggtgctgcttgga

SEQ ID NO: 11476 - DNA, 20 bp, Artificial Sequence
  Description of Artificial Sequence: Synthetic oligonucleotide
  Target: SCN10A; (+) strand; PAM type: NNNNGHTT; PAM sequence: TGCTGATT
gctgcttggactctgctttg

SEQ ID NO: 11477 - DNA, 20 bp, Artificial Sequence
  Description of Artificial Sequence: Synthetic oligonucleotide
  Target: SCN10A; (+) strand; PAM type: NNNNGHTT; PAM sequence: CAAAGTTT
tgttggcatccctgccactt

SEQ ID NO: 11478 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
gcatccctgccacttcaaag

SEQ ID NO: 11479 - DNA, 20 bp, Artificial Sequence
  Description of Artificial Sequence: Synthetic oligonucleotide
  Target: SCN10A; (+) strand; PAM type: NNNNGHTT; PAM sequence: GAGTGTTT
aaattagggaacaaaggaaa

SEQ ID NO: 11480 - DNA, 20 bp, Artificial Sequence
  Description of Artificial Sequence: Synthetic oligonucleotide
  Target: SCN10A; (+) strand; PAM type: NNNNGHTT; PAM sequence: CCTTGCTT
aacaaaggaaagagtgttta

SEQ ID NO: 11481 - DNA, 20 bp, Artificial Sequence
  Description of Artificial Sequence: Synthetic oligonucleotide
  Target: SCN10A; (+) strand; PAM type: NNNNGHTT; PAM sequence: TGAGGTTT
ctcaggaacagaattggtta

SEQ ID NO: 11482 - DNA, 20 bp, Artificial Sequence
  Description of Artificial Sequence: Synthetic oligonucleotide
  Target: SCN10A; (+) strand; PAM type: NNNNGHTT; PAM sequence: TGCAGCTT
catcctcggaggatcttagt

SEQ ID NO: 11483 - DNA, 20 bp, Artificial Sequence
  Description of Artificial Sequence: Synthetic oligonucleotide
  Target: SCN10A; (+) strand; PAM type: NNNNGHTT; PAM sequence: TGGTGATT
tgcagcttaattaggagaaa

SEQ ID NO: 11484 - DNA, 20 bp, Artificial Sequence
  Description of Artificial Sequence: Synthetic oligonucleotide
  Target: SCN10A; (+) strand; PAM type: NNNNGHTT; PAM sequence: ATATGATT
ctccagggtccctttttgaa

SEQ ID NO: 11485 - DNA, 20 bp, Artificial Sequence
  Description of Artificial Sequence: Synthetic oligonucleotide
  Target: SCN10A; (+) strand; PAM type: NNNNGHTT; PAM sequence: GGAAGCTT
tgttgtcttccttgagggga

SEQ ID NO: 11486 - DNA, 20 bp, Artificial Sequence
  Description of Artificial Sequence: Synthetic oligonucleotide
  Target: SCN10A; (+) strand; PAM type: NNNNGHTT; PAM sequence: GAGAGATT
gaagaagctgggatgtcaaa

SEQ ID NO: 11487 - DNA, 20 bp, Artificial Sequence
  Description of Artificial Sequence: Synthetic oligonucleotide
  Target: SCN10A; (+) strand; PAM type: NNNNGHTT; PAM sequence: TCATGTTT
ggggaaggtgccaaaaactt

SEQ ID NO: 11488 - DNA, 20 bp, Artificial Sequence
  Description of Artificial Sequence: Synthetic oligonucleotide
  Target: SCN10A; (+) strand; PAM type: NNNNGHTT; PAM sequence: TGTGGATT
tccttggcatctggctcaaa

SEQ ID NO: 11489 - DNA, 20 bp, Artificial Sequence
  Description of Artificial Sequence: Synthetic oligonucleotide
  Target: SCN10A; (+) strand; PAM type: NNNNGHTT; PAM sequence: AGCTGCTT
gtaaaggccagtgtggactc

SEQ ID NO: 11490 - DNA, 20 bp, Artificial Sequence
  Description of Artificial Sequence: Synthetic oligonucleotide
  Target: SCN10A; (+) strand; PAM type: NNNNGHTT; PAM sequence: GCTTGCTT
aggccagtgtggactcagct

SEQ ID NO: 11491 - DNA, 20 bp, Artificial Sequence
  Description of Artificial Sequence: Synthetic oligonucleotide
  Target: SCN10A; (+) strand; PAM type: NNNNGHTT; PAM sequence: TCTTGATT
ggttcactcaaatccagtta

SEQ ID NO: 11492 - DNA, 20 bp, Artificial Sequence
  Description of Artificial Sequence: Synthetic oligonucleotide
  Target: SCN10A; (+) strand; PAM type: NNNNGHTT; PAM sequence: GGGTGATT
tccagttatcttgattgtat

SEQ ID NO: 11493 - DNA, 20 bp, Artificial Sequence
  Description of Artificial Sequence: Synthetic oligonucleotide
  Target: SCN10A; (+) strand; PAM type: NNNNGHTT; PAM sequence: AAATGTTT
tcatcacttttttctcttgt

SEQ ID NO: 11494 - DNA, 20 bp, Artificial Sequence
  Description of Artificial Sequence: Synthetic oligonucleotide
  Target: SCN10A; (+) strand; PAM type: NNNNGHTT; PAM sequence: CAAAGTTT
tgtttttcactttgttctga

SEQ ID NO: 11495 - DNA, 20 bp, Artificial Sequence
  Description of Artificial Sequence: Synthetic oligonucleotide
  Target: SCN10A; (+) strand; PAM type: NNNNGHTT; PAM sequence: CCTTGATT
taaattatgcaaatcctata

SEQ ID NO: 11496 - DNA, 20 bp, Artificial Sequence
  Description of Artificial Sequence: Synthetic oligonucleotide
  Target: SCN10A; (+) strand; PAM type: NNNNGHTT; PAM sequence: AATAGCTT
accttgatttaaaaaaatct

SEQ ID NO: 11497 - DNA, 20 bp, Artificial Sequence
  Description of Artificial Sequence: Synthetic oligonucleotide
  Target: SCN10A; (+) strand; PAM type: NNNNGHTT; PAM sequence: AAAGGCTT
tctccataattcatttaggg

SEQ ID NO: 11498 - DNA, 20 bp, Artificial Sequence
  Description of Artificial Sequence: Synthetic oligonucleotide
  Target: SCN10A; (+) strand; PAM type: NNNNGHTT; PAM sequence: CTGTGATT
aattgtgtcatcagcaatac

SEQ ID NO: 11499 - DNA, 20 bp, Artificial Sequence
  Description of Artificial Sequence: Synthetic oligonucleotide
  Target: SCN10A; (+) strand; PAM type: NNNNGHTT; PAM sequence: GAAAGTTT
aatgctgcatcttagccaca

SEQ ID NO: 11500 - DNA, 20 bp, Artificial Sequence
  Description of Artificial Sequence: Synthetic oligonucleotide
  Target: SCN10A; (+) strand; PAM type: NNNNGHTT; PAM sequence: AGAGGCTT
gtgctatcttagggcctctc

SEQ ID NO: 11501 - DNA, 20 bp, Artificial Sequence
  Description of Artificial Sequence: Synthetic oligonucleotide
  Target: SCN10A; (+) strand; PAM type: NNNNGHTT; PAM sequence: TGATGTTT
cttagggcctctcagaggct

SEQ ID NO: 11502 - DNA, 20 bp, Artificial Sequence
  Description of Artificial Sequence: Synthetic oligonucleotide
  Target: SCN10A; (+) strand; PAM type: NNNNGHTT; PAM sequence: ACAAGTTT
agaccatgatacataaccac

SEQ ID NO: 11503 - DNA, 20 bp, Artificial Sequence
  Description of Artificial Sequence: Synthetic oligonucleotide
  Target: SCN10A; (+) strand; PAM type: NNNNGHTT; PAM sequence: CTTAGCTT
tctaactacccttactgtca

SEQ ID NO: 11504 - DNA, 20 bp, Artificial Sequence
  Description of Artificial Sequence: Synthetic oligonucleotide
  Target: SCN10A; (+) strand; PAM type: NNNNGHTT; PAM sequence: CAGTGCTT
ctaaaactgttggagaaact

SEQ ID NO: 11505 - DNA, 20 bp, Artificial Sequence
  Description of Artificial Sequence: Synthetic oligonucleotide
  Target: SCN10A; (+) strand; PAM type: NNNNGHTT; PAM sequence: AACAGATT
agaaactcagtgcttccccc

SEQ ID NO: 11506 - DNA, 20 bp, Artificial Sequence
  Description of Artificial Sequence: Synthetic oligonucleotide
  Target: SCN10A; (+) strand; PAM type: NNNNGHTT; PAM sequence: GTATGTTT
atttcaaatagctgtaaaag

SEQ ID NO: 11507 - DNA, 20 bp, Artificial Sequence
  Description of Artificial Sequence: Synthetic oligonucleotide
  Target: SCN10A; (+) strand; PAM type: NNNNGHTT; PAM sequence: AGTTGCTT
tgtttactccagaagaccag

SEQ ID NO: 11508 - DNA, 20 bp, Artificial Sequence
  Description of Artificial Sequence: Synthetic oligonucleotide
  Target: SCN10A; (+) strand; PAM type: NNNNGHTT; PAM sequence: GTTGGATT
acacaggcatagactgtcat

SEQ ID NO: 11509 - DNA, 20 bp, Artificial Sequence
  Description of Artificial Sequence: Synthetic oligonucleotide
  Target: SCN10A; (+) strand; PAM type: NNNNGHTT; PAM sequence: ATGGGCTT
ggctcaccaggggccgtggg

SEQ ID NO: 11510 - DNA, 20 bp, Artificial Sequence
  Description of Artificial Sequence: Synthetic oligonucleotide
  Target: SCN10A; (+) strand; PAM type: NNNNGHTT; PAM sequence: TGGGGCTT
ggggccgtgggatgggcttc

SEQ ID NO: 11511 - DNA, 20 bp, Artificial Sequence
  Description of Artificial Sequence: Synthetic oligonucleotide
  Target: SCN10A; (+) strand; PAM type: NNNNGHTT; PAM sequence: GCCAGTTT
gcctgggtctctaaagcaaa

SEQ ID NO: 11512 - DNA, 20 bp, Artificial Sequence
  Description of Artificial Sequence: Synthetic oligonucleotide
  Target: SCN10A; (+) strand; PAM type: NNNNGHTT; PAM sequence: TTGGGCTT
gttcattccagtaaaattct

SEQ ID NO: 11513 - DNA, 20 bp, Artificial Sequence
  Description of Artificial Sequence: Synthetic oligonucleotide
  Target: SCN10A; (+) strand; PAM type: NNNNGHTT; PAM sequence: AAGAGATT
cacagtccctcccagggggc

SEQ ID NO: 11514 - DNA, 20 bp, Artificial Sequence
  Description of Artificial Sequence: Synthetic oligonucleotide
  Target: SCN10A; (+) strand; PAM type: NNNNGHTT; PAM sequence: AGATGTTT
gccagaaactgcaccaacga

SEQ ID NO: 11515 - DNA, 20 bp, Artificial Sequence
  Description of Artificial Sequence: Synthetic oligonucleotide
  Target: SCN10A; (+) strand; PAM type: NNNNGHTT; PAM sequence: TTAGGATT
aacgaagatgttttcctccc

SEQ ID NO: 11516 - DNA, 20 bp, Artificial Sequence
  Description of Artificial Sequence: Synthetic oligonucleotide
  Target: SCN10A; (+) strand; PAM type: NNNNGHTT; PAM sequence: ATTAGTTT
ttcctcccttaggattgggt

SEQ ID NO: 11517 - DNA, 20 bp, Artificial Sequence
  Description of Artificial Sequence: Synthetic oligonucleotide
  Target: SCN10A; (+) strand; PAM type: NNNNGHTT; PAM sequence: TTTGGATT
tagtttttctttaggggccc

SEQ ID NO: 11518 - DNA, 20 bp, Artificial Sequence
  Description of Artificial Sequence: Synthetic oligonucleotide
  Target: SCN10A; (+) strand; PAM type: NNNNGHTT; PAM sequence: TTTAGCTT
tcttcattcaaactctcacc

SEQ ID NO: 11519 - DNA, 20 bp, Artificial Sequence
  Description of Artificial Sequence: Synthetic oligonucleotide
  Target: SCN10A; (+) strand; PAM type: NNNNGHTT; PAM sequence: ACATGTTT
gaaagccacctattttaata

SEQ ID NO: 11520 - DNA, 20 bp, Artificial Sequence
  Description of Artificial Sequence: Synthetic oligonucleotide
  Target: SCN10A; (+) strand; PAM type: NNNNGHTT; PAM sequence: AAGGGCTT
tgagaagatctgtggacaca

SEQ ID NO: 11521 - DNA, 20 bp, Artificial Sequence
  Description of Artificial Sequence: Synthetic oligonucleotide
  Target: SCN10A; (+) strand; PAM type: NNNNGHTT; PAM sequence: CAAGGATT
gtcatgctgagaactctgac

SEQ ID NO: 11522 - DNA, 20 bp, Artificial Sequence
  Description of Artificial Sequence: Synthetic oligonucleotide
  Target: SCN10A; (+) strand; PAM type: NNNNGHTT; PAM sequence: TGCAGTTT
ctgaccaaggattcagtaga

SEQ ID NO: 11523 - DNA, 20 bp, Artificial Sequence
  Description of Artificial Sequence: Synthetic oligonucleotide
  Target: SCN10A; (+) strand; PAM type: NNNNGHTT; PAM sequence: ATCTGTTT
acctaatatctccctctgta

SEQ ID NO: 11524 - DNA, 20 bp, Artificial Sequence
  Description of Artificial Sequence: Synthetic oligonucleotide
  Target: SCN10A; (+) strand; PAM type: NNNNGHTT; PAM sequence: CTCAGTTT
tctgtaatctgtttcttgac

SEQ ID NO: 11525 - DNA, 20 bp, Artificial Sequence
  Description of Artificial Sequence: Synthetic oligonucleotide
  Target: SCN10A; (+) strand; PAM type: NNNNGHTT; PAM sequence: AAATGATT
tctcatctgtaaaatgagag

SEQ ID NO: 11526 - DNA, 20 bp, Artificial Sequence
  Description of Artificial Sequence: Synthetic oligonucleotide
  Target: SCN10A; (+) strand; PAM type: NNNNGHTT; PAM sequence: GATTGCTT
atctgtaaaatgagagaaat

SEQ ID NO: 11527 - DNA, 20 bp, Artificial Sequence
  Description of Artificial Sequence: Synthetic oligonucleotide
  Target: SCN10A; (+) strand; PAM type: NNNNGHTT; PAM sequence: CAAGGATT
cttatgctcagaaccctggg

SEQ ID NO: 11528 - DNA, 20 bp, Artificial Sequence
  Description of Artificial Sequence: Synthetic oligonucleotide
  Target: SCN10A; (+) strand; PAM type: NNNNGHTT; PAM sequence: TCAGGATT
ttatgctcagtgatctttgt

SEQ ID NO: 11529 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
tcagtgatctttgttcagga

SEQ ID NO: 11530 - DNA, 20 bp, Artificial Sequence
  Description of Artificial Sequence: Synthetic oligonucleotide
  Target: SCN10A; (+) strand; PAM type: NNNNGHTT; PAM sequence: AGGGGTTT
atgagaaaactgagactcag

SEQ ID NO: 11531 - DNA, 20 bp, Artificial Sequence
  Description of Artificial Sequence: Synthetic oligonucleotide
  Target: SCN10A; (+) strand; PAM type: NNNNGHTT; PAM sequence: CCAGGTTT
gttgagtcaggaatgcaaac

SEQ ID NO: 11532 - DNA, 20 bp, Artificial Sequence
  Description of Artificial Sequence: Synthetic oligonucleotide
  Target: SCN10A; (+) strand; PAM type: NNNNGHTT; PAM sequence: CTGGGATT
ttataaacatgagaggttat

SEQ ID NO: 11533 - DNA, 20 bp, Artificial Sequence
  Description of Artificial Sequence: Synthetic oligonucleotide
  Target: SCN10A; (+) strand; PAM type: NNNNGHTT; PAM sequence: ATTCGATT
aacatgagaggttatctggg

SEQ ID NO: 11534 - DNA, 20 bp, Artificial Sequence
  Description of Artificial Sequence: Synthetic oligonucleotide
  Target: SCN10A; (+) strand; PAM type: NNNNGHTT; PAM sequence: TTGGGATT
cctccccatcccaaggaggg

SEQ ID NO: 11535 - DNA, 20 bp, Artificial Sequence
  Description of Artificial Sequence: Synthetic oligonucleotide
  Target: SCN10A; (+) strand; PAM type: NNNNGHTT; PAM sequence: CCCTGCTT
agttctagatccctttcttt

SEQ ID NO: 11536 - DNA, 20 bp, Artificial Sequence
  Description of Artificial Sequence: Synthetic oligonucleotide
  Target: SCN10A; (+) strand; PAM type: NNNNGHTT; PAM sequence: GTTGGCTT
agtgatgggctgtgagtagt

SEQ ID NO: 11537 - DNA, 20 bp, Artificial Sequence
  Description of Artificial Sequence: Synthetic oligonucleotide
  Target: SCN10A; (+) strand; PAM type: NNNNGHTT; PAM sequence: TAAGGCTT
tgggcagggaacaggaaata

SEQ ID NO: 11538 - DNA, 20 bp, Artificial Sequence
  Description of Artificial Sequence: Synthetic oligonucleotide
  Target: SCN10A; (+) strand; PAM type: NNNNGHTT; PAM sequence: TGTTGATT
caccacttatcttttttttc

SEQ ID NO: 11539 - DNA, 20 bp, Artificial Sequence
  Description of Artificial Sequence: Synthetic oligonucleotide
  Target: SCN10A; (+) strand; PAM type: NNNNGHTT; PAM sequence: AAGAGATT
tgtcaattatgaccccaaca

SEQ ID NO: 11540 - DNA, 20 bp, Artificial Sequence
  Description of Artificial Sequence: Synthetic oligonucleotide
  Target: SCN10A; (+) strand; PAM type: NNNNGHTT; PAM sequence: AGGTGATT
taagacatggacctgggtgc

SEQ ID NO: 11541 - DNA, 20 bp, Artificial Sequence
  Description of Artificial Sequence: Synthetic oligonucleotide
  Target: SCN10A; (+) strand; PAM type: NNNNGHTT; PAM sequence: GCAGGATT
agtaactgtgtagagcacat

SEQ ID NO: 11542 - DNA, 20 bp, Artificial Sequence
  Description of Artificial Sequence: Synthetic oligonucleotide
  Target: SCN10A; (+) strand; PAM type: NNNNGHTT; PAM sequence: CCTGGCTT
ccccaatagtgtctccccag

SEQ ID NO: 11543 - DNA, 20 bp, Artificial Sequence
  Description of Artificial Sequence: Synthetic oligonucleotide
  Target: SCN10A; (+) strand; PAM type: NNNNGHTT; PAM sequence: TTGAGATT
ttcttttcttttcttttttt

SEQ ID NO: 11544 - DNA, 20 bp, Artificial Sequence
  Description of Artificial Sequence: Synthetic oligonucleotide
  Target: SCN10A; (+) strand; PAM type: NNNNGHTT; PAM sequence: AAGAGATT
aacttctgcctcccgggttc

SEQ ID NO: 11545 - DNA, 20 bp, Artificial Sequence
  Description of Artificial Sequence: Synthetic oligonucleotide
  Target: SCN10A; (+) strand; PAM type: NNNNGHTT; PAM sequence: TGGGGTTT
ctttcatattttagtagaga

SEQ ID NO: 11546 - DNA, 20 bp, Artificial Sequence
  Description of Artificial Sequence: Synthetic oligonucleotide
  Target: SCN10A; (+) strand; PAM type: NNNNGHTT; PAM sequence: CTAGGATT
cacctcggcctcccaaagtg

SEQ ID NO: 11547 - DNA, 20 bp, Artificial Sequence
  Description of Artificial Sequence: Synthetic oligonucleotide
  Target: SCN10A; (+) strand; PAM type: NNNNGHTT; PAM sequence: CTGGGTTT
accactgcgcctggcccatc

SEQ ID NO: 11548 - DNA, 20 bp, Artificial Sequence
  Description of Artificial Sequence: Synthetic oligonucleotide
  Target: SCN10A; (+) strand; PAM type: NNNNGHTT; PAM sequence: CTGAGATT
cctgggttttatgatagttc

SEQ ID NO: 11549 - DNA, 20 bp, Artificial Sequence
  Description of Artificial Sequence: Synthetic oligonucleotide
  Target: SCN10A; (+) strand; PAM type: NNNNGHTT; PAM sequence: CCTTGATT
acctcattcctccctatgca

SEQ ID NO: 11550 - DNA, 20 bp, Artificial Sequence
  Description of Artificial Sequence: Synthetic oligonucleotide
  Target: SCN10A; (+) strand; PAM type: NNNNGHTT; PAM sequence: CCTTGCTT
caccttgatttagctactac

SEQ ID NO: 11551 - DNA, 20 bp, Artificial Sequence
  Description of Artificial Sequence: Synthetic oligonucleotide
  Target: SCN10A; (+) strand; PAM type: NNNNGHTT; PAM sequence: TGATGCTT
actgtctcttagaggttatc

SEQ ID NO: 11552 - DNA, 20 bp, Artificial Sequence
  Description of Artificial Sequence: Synthetic oligonucleotide
  Target: SCN10A; (+) strand; PAM type: NNNNGHTT; PAM sequence: AAGGGCTT
ggagagagtcctgtgttgga

SEQ ID NO: 11553 - DNA, 20 bp, Artificial Sequence
  Description of Artificial Sequence: Synthetic oligonucleotide
  Target: SCN10A; (+) strand; PAM type: NNNNGHTT; PAM sequence: TGATGATT
gttacttgactaatctcata

SEQ ID NO: 11554 - DNA, 20 bp, Artificial Sequence
  Description of Artificial Sequence: Synthetic oligonucleotide
  Target: SCN10A; (+) strand; PAM type: NNNNGHTT; PAM sequence: GGCTGTTT
tttaaagtaatcccacatgt

SEQ ID NO: 11555 - DNA, 20 bp, Artificial Sequence
  Description of Artificial Sequence: Synthetic oligonucleotide
  Target: SCN10A; (+) strand; PAM type: NNNNGHTT; PAM sequence: TAAGGTTT
gtctgctctgtgcacttgcc

SEQ ID NO: 11556 - DNA, 20 bp, Artificial Sequence
  Description of Artificial Sequence: Synthetic oligonucleotide
  Target: SCN10A; (+) strand; PAM type: NNNNGHTT; PAM sequence: TTCAGCTT
aagacctccatgttcctgcc

SEQ ID NO: 11557 - DNA, 20 bp, Artificial Sequence
  Description of Artificial Sequence: Synthetic oligonucleotide
  Target: SCN10A; (+) strand; PAM type: NNNNGHTT; PAM sequence: AGCTGTTT
gcctgttacagcacttaatg

SEQ ID NO: 11558 - DNA, 20 bp, Artificial Sequence
  Description of Artificial Sequence: Synthetic oligonucleotide
  Target: SCN10A; (+) strand; PAM type: NNNNGHTT; PAM sequence: GTCTGTTT
ctgttttaattcacctatta

SEQ ID NO: 11559 - DNA, 20 bp, Artificial Sequence
  Description of Artificial Sequence: Synthetic oligonucleotide
  Target: SCN10A; (+) strand; PAM type: NNNNGHTT; PAM sequence: CAGAGATT
cctggcataccagagctact

SEQ ID NO: 11560 - DNA, 20 bp, Artificial Sequence
  Description of Artificial Sequence: Synthetic oligonucleotide
  Target: SCN10A; (+) strand; PAM type: NNNNGHTT; PAM sequence: GAGTGATT
ggtagatgaaggcaagaaat

SEQ ID NO: 11561 - DNA, 20 bp, Artificial Sequence
  Description of Artificial Sequence: Synthetic oligonucleotide
  Target: SCN10A; (+) strand; PAM type: NNNNGHTT; PAM sequence: ATGTGTTT
aagaaagaaagacaggatga

SEQ ID NO: 11562 - DNA, 20 bp, Artificial Sequence
  Description of Artificial Sequence: Synthetic oligonucleotide
  Target: SCN10A; (+) strand; PAM type: NNNNGHTT; PAM sequence: CTGTGTTT
gtgtctattttgtacaggtt

SEQ ID NO: 11563 - DNA, 20 bp, Artificial Sequence
  Description of Artificial Sequence: Synthetic oligonucleotide
  Target: SCN10A; (+) strand; PAM type: NNNNGHTT; PAM sequence: TGGAGTTT
gacccagaagaagctgccag

SEQ ID NO: 11564 - DNA, 20 bp, Artificial Sequence
  Description of Artificial Sequence: Synthetic oligonucleotide
  Target: SCN10A; (+) strand; PAM type: NNNNGHTT; PAM sequence: GCTGGATT
cccaatgccccaccccctct

SEQ ID NO: 11565 - DNA, 20 bp, Artificial Sequence
  Description of Artificial Sequence: Synthetic oligonucleotide
  Target: SCN10A; (+) strand; PAM type: NNNNGHTT; PAM sequence: GGCTGCTT
tctctttctatactcattca

SEQ ID NO: 11566 - DNA, 20 bp, Artificial Sequence
  Description of Artificial Sequence: Synthetic oligonucleotide
  Target: SCN10A; (+) strand; PAM type: NNNNGHTT; PAM sequence: GATGGATT
agagacattgggcagctgaa

SEQ ID NO: 11567 - DNA, 20 bp, Artificial Sequence
  Description of Artificial Sequence: Synthetic oligonucleotide
  Target: SCN10A; (+) strand; PAM type: NNNNGHTT; PAM sequence: ATGAGTTT
gggttgcagtgagaagatgg

SEQ ID NO: 11568 - DNA, 20 bp, Artificial Sequence
  Description of Artificial Sequence: Synthetic oligonucleotide
  Target: SCN10A; (+) strand; PAM type: NNNNGHTT; PAM sequence: AATAGCTT
acctaaatccatattcacaa

SEQ ID NO: 11569 - DNA, 20 bp, Artificial Sequence
  Description of Artificial Sequence: Synthetic oligonucleotide
  Target: SCN10A; (+) strand; PAM type: NNNNGHTT; PAM sequence: TAGTGTTT
ctatttcaatcttcgggtcc

SEQ ID NO: 11570 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
agttaatttcaaaagcccac

SEQ ID NO: 11571 - DNA, 20 bp, Artificial Sequence
  Description of Artificial Sequence: Synthetic oligonucleotide
  Target: SCN10A; (+) strand; PAM type: NNNNGHTT; PAM sequence: TGATGATT
agggaaaaatttacaggacc

SEQ ID NO: 11572 - DNA, 20 bp, Artificial Sequence
  Description of Artificial Sequence: Synthetic oligonucleotide
  Target: SCN10A; (+) strand; PAM type: NNNNGHTT; PAM sequence: GGGTGATT
tggcaataagaggcagagtt

SEQ ID NO: 11573 - DNA, 20 bp, Artificial Sequence
  Description of Artificial Sequence: Synthetic oligonucleotide
  Target: SCN10A; (+) strand; PAM type: NNNNGHTT; PAM sequence: AGATGCTT
agttgggtgattgagataat

SEQ ID NO: 11574 - DNA, 20 bp, Artificial Sequence
  Description of Artificial Sequence: Synthetic oligonucleotide
  Target: SCN10A; (+) strand; PAM type: NNNNGHTT; PAM sequence: CGATGATT
gataatagatgcttgtggag

SEQ ID NO: 11575 - DNA, 20 bp, Artificial Sequence
  Description of Artificial Sequence: Synthetic oligonucleotide
  Target: SCN10A; (+) strand; PAM type: NNNNGHTT; PAM sequence: TCAGGATT
gatgcttgtggagcgatgat

SEQ ID NO: 11576 - DNA, 20 bp, Artificial Sequence
  Description of Artificial Sequence: Synthetic oligonucleotide
  Target: SCN10A; (+) strand; PAM type: NNNNGHTT; PAM sequence: AGAAGTTT
taccaaaacctgcagaccag

SEQ ID NO: 11577 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
acctgcagaccagagaagtt

SEQ ID NO: 11578 - DNA, 20 bp, Artificial Sequence
  Description of Artificial Sequence: Synthetic oligonucleotide
  Target: SCN10A; (+) strand; PAM type: NNNNGHTT; PAM sequence: GTTTGTTT
gcagaccagagaagtttttt

SEQ ID NO: 11579 - DNA, 20 bp, Artificial Sequence
  Description of Artificial Sequence: Synthetic oligonucleotide
  Target: SCN10A; (+) strand; PAM type: NNNNGHTT; PAM sequence: TAGTGATT
accaccacacctcgtggtgg

SEQ ID NO: 11580 - DNA, 20 bp, Artificial Sequence
  Description of Artificial Sequence: Synthetic oligonucleotide
  Target: SCN10A; (+) strand; PAM type: NNNNGHTT; PAM sequence: CAGGGTTT
ttttgtacttttagcagaga

SEQ ID NO: 11581 - DNA, 20 bp, Artificial Sequence
  Description of Artificial Sequence: Synthetic oligonucleotide
  Target: SCN10A; (+) strand; PAM type: NNNNGHTT; PAM sequence: GGTGGTTT
ggtttcggcatgttggccag

SEQ ID NO: 11582 - DNA, 20 bp, Artificial Sequence
  Description of Artificial Sequence: Synthetic oligonucleotide
  Target: SCN10A; (+) strand; PAM type: NNNNGHTT; PAM sequence: CTGGGATT
cgcctcagcctcccaaagtg

SEQ ID NO: 11583 - DNA, 20 bp, Artificial Sequence
  Description of Artificial Sequence: Synthetic oligonucleotide
  Target: SCN10A; (+) strand; PAM type: NNNNGHTT; PAM sequence: AGAAGTTT
accgtgcctggccagatgag

SEQ ID NO: 11584 - DNA, 20 bp, Artificial Sequence
  Description of Artificial Sequence: Synthetic oligonucleotide
  Target: SCN10A; (+) strand; PAM type: NNNNGHTT; PAM sequence: AAGGGCTT
cgcagagcgcgaagggttcg

SEQ ID NO: 11585 - DNA, 20 bp, Artificial Sequence
  Description of Artificial Sequence: Synthetic oligonucleotide
  Target: SCN10A; (+) strand; PAM type: NNNNGHTT; PAM sequence: CTAGGTTT
gagagggcagaaacatcact

SEQ ID NO: 11586 - DNA, 20 bp, Artificial Sequence
  Description of Artificial Sequence: Synthetic oligonucleotide
  Target: SCN10A; (+) strand; PAM type: NNNNGHTT; PAM sequence: AAGAGTTT
actccaatgagaggtctaga

SEQ ID NO: 11587 - DNA, 20 bp, Artificial Sequence
  Description of Artificial Sequence: Synthetic oligonucleotide
  Target: SCN10A; (+) strand; PAM type: NNNNGHTT; PAM sequence: CCAAGCTT
aacctctggtacgtaggtgg

SEQ ID NO: 11588 - DNA, 20 bp, Artificial Sequence
  Description of Artificial Sequence: Synthetic oligonucleotide
  Target: SCN10A; (+) strand; PAM type: NNNNGHTT; PAM sequence: AACTGATT
tcaggcctcaacaaccttga

SEQ ID NO: 11589 - DNA, 20 bp, Artificial Sequence
  Description of Artificial Sequence: Synthetic oligonucleotide
  Target: SCN10A; (+) strand; PAM type: NNNNGHTT; PAM sequence: AGTGGTTT
agaagtggggtggaaagaat

SEQ ID NO: 11590 - DNA, 20 bp, Artificial Sequence
  Description of Artificial Sequence: Synthetic oligonucleotide
  Target: SCN10A; (+) strand; PAM type: NNNNGHTT; PAM sequence: CCCTGATT
gggtctaattcccatttgaa

SEQ ID NO: 11591 - DNA, 20 bp, Artificial Sequence
  Description of Artificial Sequence: Synthetic oligonucleotide
  Target: SCN10A; (+) strand; PAM type: NNNNGHTT; PAM sequence: GTGAGCTT
catttgaaccctgatttttt

SEQ ID NO: 11592 - DNA, 20 bp, Artificial Sequence
  Description of Artificial Sequence: Synthetic oligonucleotide
  Target: SCN10A; (+) strand; PAM type: NNNNGHTT; PAM sequence: AAAAGTTT
gatagctctgcagttcttca

SEQ ID NO: 11593 - DNA, 20 bp, Artificial Sequence
  Description of Artificial Sequence: Synthetic oligonucleotide
  Target: SCN10A; (+) strand; PAM type: NNNNGHTT; PAM sequence: TCTAGCTT
tctggtatgggtccatgaga

SEQ ID NO: 11594 - DNA, 20 bp, Artificial Sequence
  Description of Artificial Sequence: Synthetic oligonucleotide
  Target: SCN10A; (+) strand; PAM type: NNNNGHTT; PAM sequence: GTCAGTTT
ttgtgagccccttttggtct

SEQ ID NO: 11595 - DNA, 20 bp, Artificial Sequence
  Description of Artificial Sequence: Synthetic oligonucleotide
  Target: SCN10A; (+) strand; PAM type: NNNNGHTT; PAM sequence: CTCAGCTT
gatggtgggctgaattcagg

SEQ ID NO: 11596 - DNA, 20 bp, Artificial Sequence
  Description of Artificial Sequence: Synthetic oligonucleotide
  Target: SCN10A; (+) strand; PAM type: NNNNGHTT; PAM sequence: AGGAGCTT
cagttaggtgggatgcacac

SEQ ID NO: 11597 - DNA, 20 bp, Artificial Sequence
  Description of Artificial Sequence: Synthetic oligonucleotide
  Target: SCN10A; (+) strand; PAM type: NNNNGHTT; PAM sequence: AAGGGCTT
acacaggagcttcagaaaag

SEQ ID NO: 11598 - DNA, 20 bp, Artificial Sequence
  Description of Artificial Sequence: Synthetic oligonucleotide
  Target: SCN10A; (+) strand; PAM type: NNNNGHTT; PAM sequence: AGTGGCTT
caatgtccattctttggatg

SEQ ID NO: 11599 - DNA, 20 bp, Artificial Sequence
  Description of Artificial Sequence: Synthetic oligonucleotide
  Target: SCN10A; (+) strand; PAM type: NNNNGHTT; PAM sequence: GGAGGTTT
gcctgggtgcatgagggtag

SEQ ID NO: 11600 - DNA, 20 bp, Artificial Sequence
  Description of Artificial Sequence: Synthetic oligonucleotide
  Target: SCN10A; (+) strand; PAM type: NNNNGHTT; PAM sequence: ATCTGATT
gcatctattctccactgcaa

SEQ ID NO: 11601 - DNA, 20 bp, Artificial Sequence
  Description of Artificial Sequence: Synthetic oligonucleotide
  Target: SCN10A; (+) strand; PAM type: NNNNGHTT; PAM sequence: CTGTGCTT
ggagatagtgagtatttatt

SEQ ID NO: 11602 - DNA, 20 bp, Artificial Sequence
  Description of Artificial Sequence: Synthetic oligonucleotide
  Target: SCN10A; (+) strand; PAM type: NNNNGHTT; PAM sequence: TTCTGTTT
agtgagtatttattctgtgc

SEQ ID NO: 11603 - DNA, 20 bp, Artificial Sequence
  Description of Artificial Sequence: Synthetic oligonucleotide
  Target: SCN10A; (+) strand; PAM type: NNNNGHTT; PAM sequence: GGGTGATT
cagctggatgaaaagttgaa

SEQ ID NO: 11604 - DNA, 20 bp, Artificial Sequence
  Description of Artificial Sequence: Synthetic oligonucleotide
  Target: SCN10A; (+) strand; PAM type: NNNNGHTT; PAM sequence: GATAGATT
aaggatacaatgataaatag

SEQ ID NO: 11605 - DNA, 20 bp, Artificial Sequence
  Description of Artificial Sequence: Synthetic oligonucleotide
  Target: SCN10A; (+) strand; PAM type: NNNNGHTT; PAM sequence: TATTGTTT
tactatagttaataatagca

SEQ ID NO: 11606 - DNA, 20 bp, Artificial Sequence
  Description of Artificial Sequence: Synthetic oligonucleotide
  Target: SCN10A; (+) strand; PAM type: NNNNGHTT; PAM sequence: TATGGTTT
ttgtatcccttaaaaattga

SEQ ID NO: 11607 - DNA, 20 bp, Artificial Sequence
  Description of Artificial Sequence: Synthetic oligonucleotide
  Target: SCN10A; (+) strand; PAM type: NNNNGHTT; PAM sequence: ATAAGTTT
tgctgttctcatgatagtga

SEQ ID NO: 11608 - DNA, 20 bp, Artificial Sequence
  Description of Artificial Sequence: Synthetic oligonucleotide
  Target: SCN10A; (+) strand; PAM type: NNNNGHTT; PAM sequence: GGGAGTTT
gatgtgacggtattataagg

SEQ ID NO: 11609 - DNA, 20 bp, Artificial Sequence
  Description of Artificial Sequence: Synthetic oligonucleotide
  Target: SCN10A; (+) strand; PAM type: NNNNGHTT; PAM sequence: CCATGATT
tcgcacctcctttccttttg

SEQ ID NO: 11610 - DNA, 20 bp, Artificial Sequence
  Description of Artificial Sequence: Synthetic oligonucleotide
  Target: SCN10A; (+) strand; PAM type: NNNNGHTT; PAM sequence: TAAGGCTT
ctttccttttgccatgattg

SEQ ID NO: 11611 - DNA, 20 bp, Artificial Sequence
  Description of Artificial Sequence: Synthetic oligonucleotide
  Target: SCN10A; (+) strand; PAM type: NNNNGHTT; PAM sequence: GCATGCTT
agaaggatgagtgagtagaa

SEQ ID NO: 11612 - DNA, 20 bp, Artificial Sequence
  Description of Artificial Sequence: Synthetic oligonucleotide
  Target: SCN10A; (+) strand; PAM type: NNNNGHTT; PAM sequence: AGATGATT
gaatgagtgaacagaatgtt

SEQ ID NO: 11613 - DNA, 20 bp, Artificial Sequence
  Description of Artificial Sequence: Synthetic oligonucleotide
  Target: SCN10A; (+) strand; PAM type: NNNNGHTT; PAM sequence: GGAAGTTT
aggatgatgaatagatggaa

SEQ ID NO: 11614 - DNA, 20 bp, Artificial Sequence
  Description of Artificial Sequence: Synthetic oligonucleotide
  Target: SCN10A; (+) strand; PAM type: NNNNGHTT; PAM sequence: AAAAGATT
gatggaaggaagtttagaat

SEQ ID NO: 11615 - DNA, 20 bp, Artificial Sequence
  Description of Artificial Sequence: Synthetic oligonucleotide
  Target: SCN10A; (+) strand; PAM type: NNNNGHTT; PAM sequence: GGATGTTT
tggaagaaataaagatggat

SEQ ID NO: 11616 - DNA, 20 bp, Artificial Sequence
  Description of Artificial Sequence: Synthetic oligonucleotide
  Target: SCN10A; (+) strand; PAM type: NNNNGHTT; PAM sequence: GACCGTTT
gatggatgaaatgagtgcat

SEQ ID NO: 11617 - DNA, 20 bp, Artificial Sequence
  Description of Artificial Sequence: Synthetic oligonucleotide
  Target: SCN10A; (+) strand; PAM type: NNNNGHTT; PAM sequence: AGGTGATT
aatgagtgcatgaccgttta

SEQ ID NO: 11618 - DNA, 20 bp, Artificial Sequence
  Description of Artificial Sequence: Synthetic oligonucleotide
  Target: SCN10A; (+) strand; PAM type: NNNNGHTT; PAM sequence: CTCAGATT
cacagaattatcacccatga

SEQ ID NO: 11619 - DNA, 20 bp, Artificial Sequence
  Description of Artificial Sequence: Synthetic oligonucleotide
  Target: SCN10A; (+) strand; PAM type: NNNNGHTT; PAM sequence: TCCAGCTT
atgttctgtgctgaacctca

SEQ ID NO: 11620 - DNA, 20 bp, Artificial Sequence
  Description of Artificial Sequence: Synthetic oligonucleotide
  Target: SCN10A; (+) strand; PAM type: NNNNGHTT; PAM sequence: AGCTGCTT
gggcagaccttgctgctggc

SEQ ID NO: 11621 - DNA, 20 bp, Artificial Sequence
  Description of Artificial Sequence: Synthetic oligonucleotide
  Target: SCN10A; (+) strand; PAM type: NNNNGHTT; PAM sequence: CCCTGCTT
ccaacacagcacatgcctca

SEQ ID NO: 11622 - DNA, 20 bp, Artificial Sequence
  Description of Artificial Sequence: Synthetic oligonucleotide
  Target: SCN10A; (+) strand; PAM type: NNNNGHTT; PAM sequence: CAGGGATT
acacagtcaattctctaatg

SEQ ID NO: 11623 - DNA, 20 bp, Artificial Sequence
  Description of Artificial Sequence: Synthetic oligonucleotide
  Target: SCN10A; (+) strand; PAM type: NNNNGHTT; PAM sequence: AGGTGATT
tgcatatttcatagctcccc

SEQ ID NO: 11624 - DNA, 20 bp, Artificial Sequence
  Description of Artificial Sequence: Synthetic oligonucleotide
  Target: SCN10A; (+) strand; PAM type: NNNNGHTT; PAM sequence: GGAAGATT
ggaccacagaaccgcaggtg

SEQ ID NO: 11625 - DNA, 20 bp, Artificial Sequence
  Description of Artificial Sequence: Synthetic oligonucleotide
  Target: SCN10A; (+) strand; PAM type: NNNNGHTT; PAM sequence: AGAGGATT
cactttggatgtaaaaatgc

SEQ ID NO: 11626 - DNA, 20 bp, Artificial Sequence
  Description of Artificial Sequence: Synthetic oligonucleotide
  Target: SCN10A; (+) strand; PAM type: NNNNGHTT; PAM sequence: CTGAGCTT
agcccttgagggccaggtct

SEQ ID NO: 11627 - DNA, 20 bp, Artificial Sequence
  Description of Artificial Sequence: Synthetic oligonucleotide
  Target: SCN10A; (+) strand; PAM type: NNNNGHTT; PAM sequence: CAAAGCTT
accctgtcagtgtactccag

SEQ ID NO: 11628 - DNA, 20 bp, Artificial Sequence
  Description of Artificial Sequence: Synthetic oligonucleotide
  Target: SCN10A; (+) strand; PAM type: NNNNGHTT; PAM sequence: GTGGGCTT
actccagcaaagctttcacc

SEQ ID NO: 11629 - DNA, 20 bp, Artificial Sequence
  Description of Artificial Sequence: Synthetic oligonucleotide
  Target: SCN10A; (+) strand; PAM type: NNNNGHTT; PAM sequence: AGGGGATT
ccctgaccacagtccctgga

SEQ ID NO: 11630 - DNA, 20 bp, Artificial Sequence
  Description of Artificial Sequence: Synthetic oligonucleotide
  Target: SCN10A; (+) strand; PAM type: NNNNGHTT; PAM sequence: GTCAGCTT
ccctggaaggggatttggta

SEQ ID NO: 11631 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
tagtcagcttgccagtagca

SEQ ID NO: 11632 - DNA, 20 bp, Artificial Sequence
  Description of Artificial Sequence: Synthetic oligonucleotide
  Target: SCN10A; (+) strand; PAM type: NNNNGHTT; PAM sequence: ATTGGATT
gagaaagaaaaccttctcaa

SEQ ID NO: 11633 - DNA, 20 bp, Artificial Sequence
  Description of Artificial Sequence: Synthetic oligonucleotide
  Target: SCN10A; (+) strand; PAM type: NNNNGHTT; PAM sequence: CTTTGTTT
caaagggatgctaacagtga

SEQ ID NO: 11634 - DNA, 20 bp, Artificial Sequence
  Description of Artificial Sequence: Synthetic oligonucleotide
  Target: SCN10A; (+) strand; PAM type: NNNNGHTT; PAM sequence: GGCAGTTT
agcatcaacggatgttcaca

SEQ ID NO: 11635 - DNA, 20 bp, Artificial Sequence
  Description of Artificial Sequence: Synthetic oligonucleotide
  Target: SCN10A; (+) strand; PAM type: NNNNGHTT; PAM sequence: TGCTGTTT
aaattcaaattaaaagaaga

SEQ ID NO: 11636 - DNA, 20 bp, Artificial Sequence
  Description of Artificial Sequence: Synthetic oligonucleotide
  Target: SCN10A; (+) strand; PAM type: NNNNGHTT; PAM sequence: CGGGGTTT
ttttgtatttttagtagaga

SEQ ID NO: 11637 - DNA, 20 bp, Artificial Sequence
  Description of Artificial Sequence: Synthetic oligonucleotide
  Target: SCN10A; (+) strand; PAM type: NNNNGHTT; PAM sequence: CACCGTTT
ttttagtagagacggggttt

SEQ ID NO: 11638 - DNA, 20 bp, Artificial Sequence
  Description of Artificial Sequence: Synthetic oligonucleotide
  Target: SCN10A; (+) strand; PAM type: NNNNGHTT; PAM sequence: CTGGGATT
cgcctcagcctcccaaagtg

SEQ ID NO: 11639 - DNA, 20 bp, Artificial Sequence
  Description of Artificial Sequence: Synthetic oligonucleotide
  Target: SCN10A; (+) strand; PAM type: NNNNGHTT; PAM sequence: AGAGGTTT
ccaaattggcaatgtgactc

SEQ ID NO: 11640 - DNA, 20 bp, Artificial Sequence
  Description of Artificial Sequence: Synthetic oligonucleotide
  Target: SCN10A; (+) strand; PAM type: NNNNGHTT; PAM sequence: GATGGCTT
gatgcagacacccccttcct

SEQ ID NO: 11641 - DNA, 20 bp, Artificial Sequence
  Description of Artificial Sequence: Synthetic oligonucleotide
  Target: SCN10A; (+) strand; PAM type: NNNNGHTT; PAM sequence: AAATGCTT
gaaactgtgtccaccttggg

SEQ ID NO: 11642 - DNA, 20 bp, Artificial Sequence
  Description of Artificial Sequence: Synthetic oligonucleotide
  Target: SCN10A; (+) strand; PAM type: NNNNGHTT; PAM sequence: GGGGGATT
ctcagccagggacagtgaca

SEQ ID NO: 11643 - DNA, 20 bp, Artificial Sequence
  Description of Artificial Sequence: Synthetic oligonucleotide
  Target: SCN10A; (+) strand; PAM type: NNNNGHTT; PAM sequence: TTGTGCTT
ggacagctctttggtgtcct

SEQ ID NO: 11644 - DNA, 20 bp, Artificial Sequence
  Description of Artificial Sequence: Synthetic oligonucleotide
  Target: SCN10A; (+) strand; PAM type: NNNNGHTT; PAM sequence: CAGGGCTT
ctttggtgtcctttgtgctt

SEQ ID NO: 11645 - DNA, 20 bp, Artificial Sequence
  Description of Artificial Sequence: Synthetic oligonucleotide
  Target: SCN10A; (+) strand; PAM type: NNNNGHTT; PAM sequence: GCCGGATT
tttccatgggatcagctgaa

SEQ ID NO: 11646 - DNA, 20 bp, Artificial Sequence
  Description of Artificial Sequence: Synthetic oligonucleotide
  Target: SCN10A; (+) strand; PAM type: NNNNGHTT; PAM sequence: CTCAGCTT
caactgaacccacatctttt

SEQ ID NO: 11647 - DNA, 20 bp, Artificial Sequence
  Description of Artificial Sequence: Synthetic oligonucleotide
  Target: SCN10A; (+) strand; PAM type: NNNNGHTT; PAM sequence: TTCCGATT
aacccacatcttttctcagc

SEQ ID NO: 11648 - DNA, 20 bp, Artificial Sequence
  Description of Artificial Sequence: Synthetic oligonucleotide
  Target: SCN10A; (+) strand; PAM type: NNNNGHTT; PAM sequence: GGGAGATT
tctaggacgaggactaagat

SEQ ID NO: 11649 - DNA, 20 bp, Artificial Sequence
  Description of Artificial Sequence: Synthetic oligonucleotide
  Target: SCN10A; (+) strand; PAM type: NNNNGHTT; PAM sequence: TAGAGATT
atgtgtattagaagtaaaca

SEQ ID NO: 11650 - DNA, 20 bp, Artificial Sequence
  Description of Artificial Sequence: Synthetic oligonucleotide
  Target: SCN10A; (+) strand; PAM type: NNNNGHTT; PAM sequence: TGTGGTTT
gaggttatagaatgcataaa

SEQ ID NO: 11651 - DNA, 20 bp, Artificial Sequence
  Description of Artificial Sequence: Synthetic oligonucleotide
  Target: SCN10A; (+) strand; PAM type: NNNNGHTT; PAM sequence: GCATGTTT
gatgagaaagaggtatacca

SEQ ID NO: 11652 - DNA, 20 bp, Artificial Sequence
  Description of Artificial Sequence: Synthetic oligonucleotide
  Target: SCN10A; (+) strand; PAM type: NNNNGHTT; PAM sequence: GTGAGTTT
gtataccagcatgttttcaa

SEQ ID NO: 11653 - DNA, 20 bp, Artificial Sequence
  Description of Artificial Sequence: Synthetic oligonucleotide
  Target: SCN10A; (+) strand; PAM type: NNNNGHTT; PAM sequence: GGATGATT
tctttgagtgatagggaaat

SEQ ID NO: 11654 - DNA, 20 bp, Artificial Sequence
  Description of Artificial Sequence: Synthetic oligonucleotide
  Target: SCN10A; (+) strand; PAM type: NNNNGHTT; PAM sequence: CTGAGCTT
gctggcgcagtgctgcaggt

SEQ ID NO: 11655 - DNA, 20 bp, Artificial Sequence
  Description of Artificial Sequence: Synthetic oligonucleotide
  Target: SCN10A; (+) strand; PAM type: NNNNGHTT; PAM sequence: CTTGGCTT
gccccgaaactctcttctcc

SEQ ID NO: 11656 - DNA, 20 bp, Artificial Sequence
  Description of Artificial Sequence: Synthetic oligonucleotide
  Target: SCN10A; (+) strand; PAM type: NNNNGHTT; PAM sequence: CCTAGTTT
tggctttgcgtcattgccac

SEQ ID NO: 11657 - DNA, 20 bp, Artificial Sequence
  Description of Artificial Sequence: Synthetic oligonucleotide
  Target: SCN10A; (+) strand; PAM type: NNNNGHTT; PAM sequence: AGCAGTTT
aaagctgaggccatgcaccg

SEQ ID NO: 11658 - DNA, 20 bp, Artificial Sequence
  Description of Artificial Sequence: Synthetic oligonucleotide
  Target: SCN10A; (+) strand; PAM type: NNNNGHTT; PAM sequence: GGTTGTTT
ggaggcctagatatttagta

SEQ ID NO: 11659 - DNA, 20 bp, Artificial Sequence
  Description of Artificial Sequence: Synthetic oligonucleotide
  Target: SCN10A; (+) strand; PAM type: NNNNGHTT; PAM sequence: TTGGGCTT
acctgaagcccctcatgcct

SEQ ID NO: 11660 - DNA, 20 bp, Artificial Sequence
  Description of Artificial Sequence: Synthetic oligonucleotide
  Target: SCN10A; (+) strand; PAM type: NNNNGHTT; PAM sequence: TTGAGATT
ttggtctattggcggagtag

SEQ ID NO: 11661 - DNA, 20 bp, Artificial Sequence
  Description of Artificial Sequence: Synthetic oligonucleotide
  Target: SCN10A; (+) strand; PAM type: NNNNGHTT; PAM sequence: AGGAGCTT
ggagtagttgagattgtgta

SEQ ID NO: 11662 - DNA, 20 bp, Artificial Sequence
  Description of Artificial Sequence: Synthetic oligonucleotide
  Target: SCN10A; (+) strand; PAM type: NNNNGHTT; PAM sequence: GGGAGCTT
gggcagtgcaagcatcacct

SEQ ID NO: 11663 - DNA, 20 bp, Artificial Sequence
  Description of Artificial Sequence: Synthetic oligonucleotide
  Target: SCN10A; (+) strand; PAM type: NNNNGHTT; PAM sequence: CACAGATT
tgcaaattctcaggccctgc

SEQ ID NO: 11664 - DNA, 20 bp, Artificial Sequence
  Description of Artificial Sequence: Synthetic oligonucleotide
  Target: SCN10A; (+) strand; PAM type: NNNNGHTT; PAM sequence: GGGAGATT
ctgcatttgaacaagctcct

SEQ ID NO: 11665 - DNA, 20 bp, Artificial Sequence
  Description of Artificial Sequence: Synthetic oligonucleotide
  Target: SCN10A; (+) strand; PAM type: NNNNGHTT; PAM sequence: TAATGATT
aattttgagaagtgctattg

SEQ ID NO: 11666 - DNA, 20 bp, Artificial Sequence
  Description of Artificial Sequence: Synthetic oligonucleotide
  Target: SCN10A; (+) strand; PAM type: NNNNGHTT; PAM sequence: GTGAGCTT
tgctattgtaatgattttct

SEQ ID NO: 11667 - DNA, 20 bp, Artificial Sequence
  Description of Artificial Sequence: Synthetic oligonucleotide
  Target: SCN10A; (+) strand; PAM type: NNNNGHTT; PAM sequence: AGTGGTTT
agtaattagtagcatttgga

SEQ ID NO: 11668 - DNA, 20 bp, Artificial Sequence
  Description of Artificial Sequence: Synthetic oligonucleotide
  Target: SCN10A; (+) strand; PAM type: NNNNGHTT; PAM sequence: AGGGGCTT
aggtcagagggtgggaagcc

SEQ ID NO: 11669 - DNA, 20 bp, Artificial Sequence
  Description of Artificial Sequence: Synthetic oligonucleotide
  Target: SCN10A; (+) strand; PAM type: NNNNGHTT; PAM sequence: TCGGGATT
agggtgggaagccaggggct

SEQ ID NO: 11670 - DNA, 20 bp, Artificial Sequence
  Description of Artificial Sequence: Synthetic oligonucleotide
  Target: SCN10A; (+) strand; PAM type: NNNNGHTT; PAM sequence: CTGGGTTT
gggattaaataagggcaaag

SEQ ID NO: 11671 - DNA, 20 bp, Artificial Sequence
  Description of Artificial Sequence: Synthetic oligonucleotide
  Target: SCN10A; (+) strand; PAM type: NNNNGHTT; PAM sequence: GTCAGTTT
gccttttaaacattttgagt

SEQ ID NO: 11672 - DNA, 20 bp, Artificial Sequence
  Description of Artificial Sequence: Synthetic oligonucleotide
  Target: SCN10A; (+) strand; PAM type: NNNNGHTT; PAM sequence: AAATGCTT
aggcatacactcactcactc

SEQ ID NO: 11673 - DNA, 20 bp, Artificial Sequence
  Description of Artificial Sequence: Synthetic oligonucleotide
  Target: SCN10A; (+) strand; PAM type: NNNNGHTT; PAM sequence: CCAGGTTT
actcactcaaatgcttgcag

SEQ ID NO: 11674 - DNA, 20 bp, Artificial Sequence
  Description of Artificial Sequence: Synthetic oligonucleotide
  Target: SCN10A; (+) strand; PAM type: NNNNGHTT; PAM sequence: TTTGGATT
actgatgcagctccagggcc

SEQ ID NO: 11675 - DNA, 20 bp, Artificial Sequence
  Description of Artificial Sequence: Synthetic oligonucleotide
  Target: SCN10A; (+) strand; PAM type: NNNNGHTT; PAM sequence: AGGAGATT
ctccagggcctttggattgt

SEQ ID NO: 11676 - DNA, 20 bp, Artificial Sequence
  Description of Artificial Sequence: Synthetic oligonucleotide
  Target: SCN10A; (+) strand; PAM type: NNNNGHTT; PAM sequence: GGAGGATT
attgtaggagattcctatct

SEQ ID NO: 11677 - DNA, 20 bp, Artificial Sequence
  Description of Artificial Sequence: Synthetic oligonucleotide
  Target: SCN10A; (+) strand; PAM type: NNNNGHTT; PAM sequence: TCCAGTTT
cccatggactcttggtggta

SEQ ID NO: 11678 - DNA, 20 bp, Artificial Sequence
  Description of Artificial Sequence: Synthetic oligonucleotide
  Target: SCN10A; (+) strand; PAM type: NNNNGHTT; PAM sequence: TGATGTTT
atcatcagtcttgcccactc

SEQ ID NO: 11679 - DNA, 20 bp, Artificial Sequence
  Description of Artificial Sequence: Synthetic oligonucleotide
  Target: SCN10A; (+) strand; PAM type: NNNNGHTT; PAM sequence: TGGGGATT
gggccacgacgtggctggga

SEQ ID NO: 11680 - DNA, 20 bp, Artificial Sequence
  Description of Artificial Sequence: Synthetic oligonucleotide
  Target: SCN10A; (+) strand; PAM type: NNNNGHTT; PAM sequence: TCTTGATT
attccctttatagaatggac

SEQ ID NO: 11681 - DNA, 20 bp, Artificial Sequence
  Description of Artificial Sequence: Synthetic oligonucleotide
  Target: SCN10A; (+) strand; PAM type: NNNNGHTT; PAM sequence: TTCTGCTT
aaagatgactaagacacagg

SEQ ID NO: 11682 - DNA, 20 bp, Artificial Sequence
  Description of Artificial Sequence: Synthetic oligonucleotide
  Target: SCN10A; (+) strand; PAM type: NNNNGHTT; PAM sequence: AAAAGATT
tctgcttttgagagctaaac

SEQ ID NO: 11683 - DNA, 20 bp, Artificial Sequence
  Description of Artificial Sequence: Synthetic oligonucleotide
  Target: SCN10A; (+) strand; PAM type: NNNNGHTT; PAM sequence: AAGAGTTT
ggtccttcatggtccaaatc

SEQ ID NO: 11684 - DNA, 20 bp, Artificial Sequence
  Description of Artificial Sequence: Synthetic oligonucleotide
  Target: SCN10A; (+) strand; PAM type: NNNNGHTT; PAM sequence: TGGTGTTT
tccaaatcaagagttttcag

SEQ ID NO: 11685 - DNA, 20 bp, Artificial Sequence
  Description of Artificial Sequence: Synthetic oligonucleotide
  Target: SCN10A; (+) strand; PAM type: NNNNGHTT; PAM sequence: CTACGTTT
agtggtgtttatggtggtga

SEQ ID NO: 11686 - DNA, 20 bp, Artificial Sequence
  Description of Artificial Sequence: Synthetic oligonucleotide
  Target: SCN10A; (+) strand; PAM type: NNNNGHTT; PAM sequence: GCTGGTTT
ccccctttcaactcaagagg

SEQ ID NO: 11687 - DNA, 20 bp, Artificial Sequence
  Description of Artificial Sequence: Synthetic oligonucleotide
  Target: SCN10A; (+) strand; PAM type: NNNNGHTT; PAM sequence: AGGGGTTT
ggctggtttagaactcacgg

SEQ ID NO: 11688 - DNA, 20 bp, Artificial Sequence
  Description of Artificial Sequence: Synthetic oligonucleotide
  Target: SCN10A; (+) strand; PAM type: NNNNGHTT; PAM sequence: CACAGCTT
ggagtgaggcagcaagtggg

SEQ ID NO: 11689 - DNA, 20 bp, Artificial Sequence
  Description of Artificial Sequence: Synthetic oligonucleotide
  Target: SCN10A; (+) strand; PAM type: NNNNGHTT; PAM sequence: GCTTGTTT
tgaggcagcaagtgggcaca

SEQ ID NO: 11690 - DNA, 20 bp, Artificial Sequence
  Description of Artificial Sequence: Synthetic oligonucleotide
  Target: SCN10A; (+) strand; PAM type: NNNNGHTT; PAM sequence: ACTGGATT
cccaggtgagtgttcgctca

SEQ ID NO: 11691 - DNA, 20 bp, Artificial Sequence
  Description of Artificial Sequence: Synthetic oligonucleotide
  Target: SCN10A; (+) strand; PAM type: NNNNGHTT; PAM sequence: TCAGGATT
tgccagctcagggatcttcc

SEQ ID NO: 11692 - DNA, 20 bp, Artificial Sequence
  Description of Artificial Sequence: Synthetic oligonucleotide
  Target: SCN10A; (+) strand; PAM type: NNNNGHTT; PAM sequence: AGGAGCTT
gtccaccgtgctgccctcag

SEQ ID NO: 11693 - DNA, 20 bp, Artificial Sequence
  Description of Artificial Sequence: Synthetic oligonucleotide
  Target: SCN10A; (+) strand; PAM type: NNNNGHTT; PAM sequence: CCATGTTT
cactgcaggttcaactgcac

SEQ ID NO: 11694 - DNA, 20 bp, Artificial Sequence
  Description of Artificial Sequence: Synthetic oligonucleotide
  Target: SCN10A; (+) strand; PAM type: NNNNGHTT; PAM sequence: AGAGGCTT
gctcttctccctggagcccc

SEQ ID NO: 11695 - DNA, 20 bp, Artificial Sequence
  Description of Artificial Sequence: Synthetic oligonucleotide
  Target: SCN10A; (+) strand; PAM type: NNNNGHTT; PAM sequence: CTGGGCTT
ataacgactctcagcattca

SEQ ID NO: 11696 - DNA, 20 bp, Artificial Sequence
  Description of Artificial Sequence: Synthetic oligonucleotide
  Target: SCN10A; (+) strand; PAM type: NNNNGHTT; PAM sequence: GATAGCTT
gctctcatattagtaaacct

SEQ ID NO: 11697 - DNA, 20 bp, Artificial Sequence
  Description of Artificial Sequence: Synthetic oligonucleotide
  Target: SCN10A; (+) strand; PAM type: NNNNGHTT; PAM sequence: AGCGGCTT
ccctcacccagtgggaacca

SEQ ID NO: 11698 - DNA, 20 bp, Artificial Sequence
  Description of Artificial Sequence: Synthetic oligonucleotide
  Target: SCN10A; (+) strand; PAM type: NNNNGHTT; PAM sequence: AAGGGCTT
agctgacattcttcaagctg

SEQ ID NO: 11699 - DNA, 20 bp, Artificial Sequence
  Description of Artificial Sequence: Synthetic oligonucleotide
  Target: SCN10A; (+) strand; PAM type: NNNNGHTT; PAM sequence: TATAGCTT
tttatagatgcctctttccc

SEQ ID NO: 11700 - DNA, 20 bp, Artificial Sequence
  Description of Artificial Sequence: Synthetic oligonucleotide
  Target: SCN10A; (+) strand; PAM type: NNNNGHTT; PAM sequence: GCTTGTTT
tagatgcctctttccctata

SEQ ID NO: 11701 - DNA, 20 bp, Artificial Sequence
  Description of Artificial Sequence: Synthetic oligonucleotide
  Target: SCN10A; (+) strand; PAM type: NNNNGHTT; PAM sequence: TCAAGATT
ttccctatagcttgtttcct

SEQ ID NO: 11702 - DNA, 20 bp, Artificial Sequence
  Description of Artificial Sequence: Synthetic oligonucleotide
  Target: SCN10A; (+) strand; PAM type: NNNNGHTT; PAM sequence: TTTCGTTT
gactttctttgtgcgttgtc

SEQ ID NO: 11703 - DNA, 20 bp, Artificial Sequence
  Description of Artificial Sequence: Synthetic oligonucleotide
  Target: SCN10A; (+) strand; PAM type: NNNNGHTT; PAM sequence: TTAAGCTT
tttgacaagcagcatctcat

SEQ ID NO: 11704 - DNA, 20 bp, Artificial Sequence
  Description of Artificial Sequence: Synthetic oligonucleotide
  Target: SCN10A; (+) strand; PAM type: NNNNGHTT; PAM sequence: TTCAGTTT
ctaccaagtaggcattacca

SEQ ID NO: 11705 - DNA, 20 bp, Artificial Sequence
  Description of Artificial Sequence: Synthetic oligonucleotide
  Target: SCN10A; (+) strand; PAM type: NNNNGHTT; PAM sequence: AGAGGTTT
atgaataaatggcggctcag

SEQ ID NO: 11706 - DNA, 20 bp, Artificial Sequence
  Description of Artificial Sequence: Synthetic oligonucleotide
  Target: SCN10A; (+) strand; PAM type: NNNNGHTT; PAM sequence: CACAGCTT
tgggaactgatcttaggtcc

SEQ ID NO: 11707 - DNA, 20 bp, Artificial Sequence
  Description of Artificial Sequence: Synthetic oligonucleotide
  Target: SCN10A; (+) strand; PAM type: NNNNGHTT; PAM sequence: GTGAGATT
atacctagaaccaccctgga

SEQ ID NO: 11708 - DNA, 20 bp, Artificial Sequence
  Description of Artificial Sequence: Synthetic oligonucleotide
  Target: SCN10A; (+) strand; PAM type: NNNNGHTT; PAM sequence: TGCGGATT
tatggtgaaagttgaaattg

SEQ ID NO: 11709 - DNA, 20 bp, Artificial Sequence
  Description of Artificial Sequence: Synthetic oligonucleotide
  Target: SCN10A; (+) strand; PAM type: NNNNGHTT; PAM sequence: ATGTGATT
ccaggataagaaatgaggtt

SEQ ID NO: 11710 - DNA, 20 bp, Artificial Sequence
  Description of Artificial Sequence: Synthetic oligonucleotide
  Target: SCN10A; (+) strand; PAM type: NNNNGHTT; PAM sequence: AAGAGTTT
catcacaggctgccagagcc

SEQ ID NO: 11711 - DNA, 20 bp, Artificial Sequence
  Description of Artificial Sequence: Synthetic oligonucleotide
  Target: SCN10A; (+) strand; PAM type: NNNNGHTT; PAM sequence: CTATGTTT
aagactatagctagatagac

SEQ ID NO: 11712 - DNA, 20 bp, Artificial Sequence
  Description of Artificial Sequence: Synthetic oligonucleotide
  Target: SCN10A; (+) strand; PAM type: NNNNGHTT; PAM sequence: AGTTGTTT
aagatgtgtgaccttaggca

SEQ ID NO: 11713 - DNA, 20 bp, Artificial Sequence
  Description of Artificial Sequence: Synthetic oligonucleotide
  Target: SCN10A; (+) strand; PAM type: NNNNGHTT; PAM sequence: CCCAGCTT
cctctctaatcttcattttt

SEQ ID NO: 11714 - DNA, 20 bp, Artificial Sequence
  Description of Artificial Sequence: Synthetic oligonucleotide
  Target: SCN10A; (+) strand; PAM type: NNNNGHTT; PAM sequence: AGCTGTTT
aggctagatctgcatcattc

SEQ ID NO: 11715 - DNA, 20 bp, Artificial Sequence
  Description of Artificial Sequence: Synthetic oligonucleotide
  Target: SCN10A; (+) strand; PAM type: NNNNGHTT; PAM sequence: TAGCGCTT
gttttgatgactaaatatgt

SEQ ID NO: 11716 - DNA, 20 bp, Artificial Sequence
  Description of Artificial Sequence: Synthetic oligonucleotide
  Target: SCN10A; (+) strand; PAM type: NNNNGHTT; PAM sequence: AAGTGCTT
cttgtaaaacactttgcacg

SEQ ID NO: 11717 - DNA, 20 bp, Artificial Sequence
  Description of Artificial Sequence: Synthetic oligonucleotide
  Target: SCN10A; (+) strand; PAM type: NNNNGHTT; PAM sequence: AATAGATT
ttgcacgaagtgcttggctc

SEQ ID NO: 11718 - DNA, 20 bp, Artificial Sequence
  Description of Artificial Sequence: Synthetic oligonucleotide
  Target: SCN10A; (+) strand; PAM type: NNNNGHTT; PAM sequence: AAATGCTT
aagagccccaaagtaactga

SEQ ID NO: 11719 - DNA, 20 bp, Artificial Sequence
  Description of Artificial Sequence: Synthetic oligonucleotide
  Target: SCN10A; (+) strand; PAM type: NNNNGHTT; PAM sequence: CACAGCTT
ggagagctacagactcaaag

SEQ ID NO: 11720 - DNA, 20 bp, Artificial Sequence
  Description of Artificial Sequence: Synthetic oligonucleotide
  Target: SCN10A; (+) strand; PAM type: NNNNGHTT; PAM sequence: ACCAGCTT
aggttagcgagggttgatat

SEQ ID NO: 11721 - DNA, 20 bp, Artificial Sequence
  Description of Artificial Sequence: Synthetic oligonucleotide
  Target: SCN10A; (+) strand; PAM type: NNNNGHTT; PAM sequence: ATGTGCTT
tatattatcaaatggctcaa

SEQ ID NO: 11722 - DNA, 20 bp, Artificial Sequence
  Description of Artificial Sequence: Synthetic oligonucleotide
  Target: SCN10A; (+) strand; PAM type: NNNNGHTT; PAM sequence: TAAAGATT
aggacttcttaggatgctgg

SEQ ID NO: 11723 - DNA, 20 bp, Artificial Sequence
  Description of Artificial Sequence: Synthetic oligonucleotide
  Target: SCN10A; (+) strand; PAM type: NNNNGHTT; PAM sequence: CCCTGTTT
ctcacctgctgccccccact

SEQ ID NO: 11724 - DNA, 20 bp, Artificial Sequence
  Description of Artificial Sequence: Synthetic oligonucleotide
  Target: SCN10A; (+) strand; PAM type: NNNNGHTT; PAM sequence: GAAAGCTT
ctcaaacgccaactcctctg

SEQ ID NO: 11725 - DNA, 20 bp, Artificial Sequence
  Description of Artificial Sequence: Synthetic oligonucleotide
  Target: SCN10A; (+) strand; PAM type: NNNNGHTT; PAM sequence: CATGGTTT
aactcctctggaaagcttgg

SEQ ID NO: 11726 - DNA, 20 bp, Artificial Sequence
  Description of Artificial Sequence: Synthetic oligonucleotide
  Target: SCN10A; (+) strand; PAM type: NNNNGHTT; PAM sequence: ATCAGATT
tcatcctccaagtcatcaag

SEQ ID NO: 11727 - DNA, 20 bp, Artificial Sequence
  Description of Artificial Sequence: Synthetic oligonucleotide
  Target: SCN10A; (+) strand; PAM type: NNNNGHTT; PAM sequence: GTCGGATT
tgggcacagagacccacaca

SEQ ID NO: 11728 - DNA, 20 bp, Artificial Sequence
  Description of Artificial Sequence: Synthetic oligonucleotide
  Target: SCN10A; (+) strand; PAM type: NNNNGHTT; PAM sequence: GGGAGCTT
tgctcatccctggggcctct

SEQ ID NO: 11729 - DNA, 20 bp, Artificial Sequence
  Description of Artificial Sequence: Synthetic oligonucleotide
  Target: SCN10A; (+) strand; PAM type: NNNNGHTT; PAM sequence: GGGAGTTT
cagccttggagctggagagt

SEQ ID NO: 11730 - DNA, 20 bp, Artificial Sequence
  Description of Artificial Sequence: Synthetic oligonucleotide
  Target: SCN10A; (+) strand; PAM type: NNNNGHTT; PAM sequence: GCCTGTTT
tgctgaagaagctgcaaaga

SEQ ID NO: 11731 - DNA, 20 bp, Artificial Sequence
  Description of Artificial Sequence: Synthetic oligonucleotide
  Target: SCN10A; (+) strand; PAM type: NNNNGHTT; PAM sequence: GGAAGATT
ctgaagagaaggaatggaag

SEQ ID NO: 11732 - DNA, 20 bp, Artificial Sequence
  Description of Artificial Sequence: Synthetic oligonucleotide
  Target: SCN10A; (+) strand; PAM type: NNNNGHTT; PAM sequence: GAAAGTTT
ctttctgagagcagttgagg

SEQ ID NO: 11733 - DNA, 20 bp, Artificial Sequence
  Description of Artificial Sequence: Synthetic oligonucleotide
  Target: SCN10A; (+) strand; PAM type: NNNNGHTT; PAM sequence: CGAGGCTT
gagtgacccgcctcagtgga

SEQ ID NO: 11734 - DNA, 20 bp, Artificial Sequence
  Description of Artificial Sequence: Synthetic oligonucleotide
  Target: SCN10A; (+) strand; PAM type: NNNNGHTT; PAM sequence: TGCTGCTT
ctggaatcctgggcacatct

SEQ ID NO: 11735 - DNA, 20 bp, Artificial Sequence
  Description of Artificial Sequence: Synthetic oligonucleotide
  Target: SCN10A; (+) strand; PAM type: NNNNGHTT; PAM sequence: CAGAGTTT
gtgggctcagcctggaagaa

SEQ ID NO: 11736 - DNA, 20 bp, Artificial Sequence
  Description of Artificial Sequence: Synthetic oligonucleotide
  Target: SCN10A; (+) strand; PAM type: NNNNGHTT; PAM sequence: TCTGGATT
gggtggaaaagactaaagag

SEQ ID NO: 11737 - DNA, 20 bp, Artificial Sequence
  Description of Artificial Sequence: Synthetic oligonucleotide
  Target: SCN10A; (+) strand; PAM type: NNNNGHTT; PAM sequence: TGTTGCTT
actaaagagtctggatttgt

SEQ ID NO: 11738 - DNA, 20 bp, Artificial Sequence
  Description of Artificial Sequence: Synthetic oligonucleotide
  Target: SCN10A; (+) strand; PAM type: NNNNGHTT; PAM sequence: CTTGGTTT
tttgttgttgcttccctttt

SEQ ID NO: 11739 - DNA, 20 bp, Artificial Sequence
  Description of Artificial Sequence: Synthetic oligonucleotide
  Target: SCN10A; (+) strand; PAM type: NNNNGHTT; PAM sequence: TTTAGCTT
tgttgcttcccttttcttgg

SEQ ID NO: 11740 - DNA, 20 bp, Artificial Sequence
  Description of Artificial Sequence: Synthetic oligonucleotide
  Target: SCN10A; (+) strand; PAM type: NNNNGHTT; PAM sequence: AGGGGCTT
gatgtccagggcaataagaa

SEQ ID NO: 11741 - DNA, 20 bp, Artificial Sequence
  Description of Artificial Sequence: Synthetic oligonucleotide
  Target: SCN10A; (+) strand; PAM type: NNNNGHTT; PAM sequence: TGGGGCTT
ctggggcggagaaggggtat

SEQ ID NO: 11742 - DNA, 20 bp, Artificial Sequence
  Description of Artificial Sequence: Synthetic oligonucleotide
  Target: SCN10A; (+) strand; PAM type: NNNNGHTT; PAM sequence: AGGGGCTT
attggcaagtgagtctccag

SEQ ID NO: 11743 - DNA, 20 bp, Artificial Sequence
  Description of Artificial Sequence: Synthetic oligonucleotide
  Target: SCN10A; (+) strand; PAM type: NNNNGHTT; PAM sequence: AGTAGATT
ggggcttcctccaaacatgg

SEQ ID NO: 11744 - DNA, 20 bp, Artificial Sequence
  Description of Artificial Sequence: Synthetic oligonucleotide
  Target: SCN10A; (+) strand; PAM type: NNNNGHTT; PAM sequence: TGCAGCTT
ctgctcccagctaggacctg

SEQ ID NO: 11745 - DNA, 20 bp, Artificial Sequence
  Description of Artificial Sequence: Synthetic oligonucleotide
  Target: SCN10A; (+) strand; PAM type: NNNNGHTT; PAM sequence: AAATGTTT
gctcttacttccctgaataa

SEQ ID NO: 11746 - DNA, 20 bp, Artificial Sequence
  Description of Artificial Sequence: Synthetic oligonucleotide
  Target: SCN10A; (+) strand; PAM type: NNNNGHTT; PAM sequence: CTCAGATT
aaaaatgttttctgagcccc

SEQ ID NO: 11747 - DNA, 20 bp, Artificial Sequence
  Description of Artificial Sequence: Synthetic oligonucleotide
  Target: SCN10A; (+) strand; PAM type: NNNNGHTT; PAM sequence: CACCGTTT
ttcctttaacagctaataga

SEQ ID NO: 11748 - DNA, 20 bp, Artificial Sequence
  Description of Artificial Sequence: Synthetic oligonucleotide
  Target: SCN10A; (+) strand; PAM type: NNNNGHTT; PAM sequence: TCTTGATT
cccatgagtaagcattattt

SEQ ID NO: 11749 - DNA, 20 bp, Artificial Sequence
  Description of Artificial Sequence: Synthetic oligonucleotide
  Target: SCN10A; (+) strand; PAM type: NNNNGHTT; PAM sequence: AGGAGATT
tttaaggaaattagatcttg

SEQ ID NO: 11750 - DNA, 20 bp, Artificial Sequence
  Description of Artificial Sequence: Synthetic oligonucleotide
  Target: SCN10A; (+) strand; PAM type: NNNNGHTT; PAM sequence: CAGAGATT
ccacctagtaaatggtggag

SEQ ID NO: 11751 - DNA, 20 bp, Artificial Sequence
  Description of Artificial Sequence: Synthetic oligonucleotide
  Target: SCN10A; (+) strand; PAM type: NNNNGHTT; PAM sequence: AAAAGTTT
atgaatcccacatgaatttg

SEQ ID NO: 11752 - DNA, 20 bp, Artificial Sequence
  Description of Artificial Sequence: Synthetic oligonucleotide
  Target: SCN10A; (+) strand; PAM type: NNNNGHTT; PAM sequence: CAAAGCTT
ctgggcataaaaatgcagat

SEQ ID NO: 11753 - DNA, 20 bp, Artificial Sequence
  Description of Artificial Sequence: Synthetic oligonucleotide
  Target: SCN10A; (+) strand; PAM type: NNNNGHTT; PAM sequence: TATGGATT
gtcaagaaaaggatgaggca

SEQ ID NO: 11754 - DNA, 20 bp, Artificial Sequence
  Description of Artificial Sequence: Synthetic oligonucleotide
  Target: SCN10A; (+) strand; PAM type: NNNNGHTT; PAM sequence: GGTAGTTT
gatattttttcggttgttac

SEQ ID NO: 11755 - DNA, 20 bp, Artificial Sequence
  Description of Artificial Sequence: Synthetic oligonucleotide
  Target: SCN10A; (+) strand; PAM type: NNNNGHTT; PAM sequence: AGCTGCTT
tacggtagttttcccctagg

SEQ ID NO: 11756 - DNA, 20 bp, Artificial Sequence
  Description of Artificial Sequence: Synthetic oligonucleotide
  Target: SCN10A; (+) strand; PAM type: NNNNGHTT; PAM sequence: CTGAGTTT
gaggttccccagtgccccca

SEQ ID NO: 11757 - DNA, 20 bp, Artificial Sequence
  Description of Artificial Sequence: Synthetic oligonucleotide
  Target: SCN10A; (+) strand; PAM type: NNNNGHTT; PAM sequence: GTGTGTTT
gtttccgatgatcttgatga

SEQ ID NO: 11758 - DNA, 20 bp, Artificial Sequence
  Description of Artificial Sequence: Synthetic oligonucleotide
  Target: SCN10A; (+) strand; PAM type: NNNNGHTT; PAM sequence: CCAGGATT
atgagtgtgtttaaggtggg

SEQ ID NO: 11759 - DNA, 20 bp, Artificial Sequence
  Description of Artificial Sequence: Synthetic oligonucleotide
  Target: SCN10A; (+) strand; PAM type: NNNNGHTT; PAM sequence: GCCAGCTT
ttaaggtgggccaggatttg

SEQ ID NO: 11760 - DNA, 20 bp, Artificial Sequence
  Description of Artificial Sequence: Synthetic oligonucleotide
  Target: SCN10A; (+) strand; PAM type: NNNNGHTT; PAM sequence: TCAGGTTT
ctgcagagaaacagagaccg

SEQ ID NO: 11761 - DNA, 20 bp, Artificial Sequence
  Description of Artificial Sequence: Synthetic oligonucleotide
  Target: SCN10A; (+) strand; PAM type: NNNNGHTT; PAM sequence: TAAAGTTT
tgtgctcattacctttcatc

SEQ ID NO: 11762 - DNA, 20 bp, Artificial Sequence
  Description of Artificial Sequence: Synthetic oligonucleotide
  Target: SCN10A; (+) strand; PAM type: NNNNGHTT; PAM sequence: GGGCGTTT
cctctcatcccattaaacca

SEQ ID NO: 11763 - DNA, 20 bp, Artificial Sequence
  Description of Artificial Sequence: Synthetic oligonucleotide
  Target: SCN10A; (+) strand; PAM type: NNNNGHTT; PAM sequence: CACTGCTT
aaaccagggcgttttctgga

SEQ ID NO: 11764 - DNA, 20 bp, Artificial Sequence
  Description of Artificial Sequence: Synthetic oligonucleotide
  Target: SCN10A; (+) strand; PAM type: NNNNGHTT; PAM sequence: ATGTGCTT
tctatggttcataagtatca

SEQ ID NO: 11765 - DNA, 20 bp, Artificial Sequence
  Description of Artificial Sequence: Synthetic oligonucleotide
  Target: SCN10A; (+) strand; PAM type: NNNNGHTT; PAM sequence: ACAAGCTT
gggctcacaaataagtgaga

SEQ ID NO: 11766 - DNA, 20 bp, Artificial Sequence
  Description of Artificial Sequence: Synthetic oligonucleotide
  Target: SCN10A; (+) strand; PAM type: NNNNGHTT; PAM sequence: ACCAGCTT
ggacaacatctgttgctccc

SEQ ID NO: 11767 - DNA, 20 bp, Artificial Sequence
  Description of Artificial Sequence: Synthetic oligonucleotide
  Target: SCN10A; (+) strand; PAM type: NNNNGHTT; PAM sequence: CCATGATT
agctttgaaactgcaaatgt

SEQ ID NO: 11768 - DNA, 20 bp, Artificial Sequence
  Description of Artificial Sequence: Synthetic oligonucleotide
  Target: SCN10A; (+) strand; PAM type: NNNNGHTT; PAM sequence: AGTTGATT
tcatggactcagcattcata

SEQ ID NO: 11769 - DNA, 20 bp, Artificial Sequence
  Description of Artificial Sequence: Synthetic oligonucleotide
  Target: SCN10A; (+) strand; PAM type: NNNNGHTT; PAM sequence: AATGGTTT
gctcttgctctcatggaacc

SEQ ID NO: 11770 - DNA, 20 bp, Artificial Sequence
  Description of Artificial Sequence: Synthetic oligonucleotide
  Target: SCN10A; (+) strand; PAM type: NNNNGHTT; PAM sequence: ATGTGTTT
atcatcaagcataaaaatgt

SEQ ID NO: 11771 - DNA, 20 bp, Artificial Sequence
  Description of Artificial Sequence: Synthetic oligonucleotide
  Target: SCN10A; (+) strand; PAM type: NNNNGHTT; PAM sequence: GTGTGTTT
ctgtcagtctgtcagtcaag

SEQ ID NO: 11772 - DNA, 20 bp, Artificial Sequence
  Description of Artificial Sequence: Synthetic oligonucleotide
  Target: SCN10A; (+) strand; PAM type: NNNNGHTT; PAM sequence: TGTGGCTT
gcacctactaagagccaggc

SEQ ID NO: 11773 - DNA, 20 bp, Artificial Sequence
  Description of Artificial Sequence: Synthetic oligonucleotide
  Target: SCN10A; (+) strand; PAM type: NNNNGHTT; PAM sequence: GGAGGTTT
cgtgagtaaatcccacggga

SEQ ID NO: 11774 - DNA, 20 bp, Artificial Sequence
  Description of Artificial Sequence: Synthetic oligonucleotide
  Target: SCN10A; (+) strand; PAM type: NNNNGHTT; PAM sequence: CAGAGCTT
tactctcctcatatgggaag

SEQ ID NO: 11775 - DNA, 20 bp, Artificial Sequence
  Description of Artificial Sequence: Synthetic oligonucleotide
  Target: SCN10A; (+) strand; PAM type: NNNNGHTT; PAM sequence: CCCTGCTT
taagcctagcaggaatttct

SEQ ID NO: 11776 - DNA, 20 bp, Artificial Sequence
  Description of Artificial Sequence: Synthetic oligonucleotide
  Target: SCN10A; (+) strand; PAM type: NNNNGHTT; PAM sequence: ATAGGATT
aacaacaaagtggtgctcat

SEQ ID NO: 11777 - DNA, 20 bp, Artificial Sequence
  Description of Artificial Sequence: Synthetic oligonucleotide
  Target: SCN10A; (+) strand; PAM type: NNNNGHTT; PAM sequence: TCAGGTTT
tggaggaacctgcctttatc

SEQ ID NO: 11778 - DNA, 20 bp, Artificial Sequence
  Description of Artificial Sequence: Synthetic oligonucleotide
  Target: SCN10A; (+) strand; PAM type: NNNNGHTT; PAM sequence: AATTGTTT
tttcaaactattccctcaaa

SEQ ID NO: 11779 - DNA, 20 bp, Artificial Sequence
  Description of Artificial Sequence: Synthetic oligonucleotide
  Target: SCN10A; (+) strand; PAM type: NNNNGHTT; PAM sequence: GAAGGTTT
aaaattaaaaatattatgaa

SEQ ID NO: 11780 - DNA, 20 bp, Artificial Sequence
  Description of Artificial Sequence: Synthetic oligonucleotide
  Target: SCN10A; (+) strand; PAM type: NNNNGHTT; PAM sequence: ATCAGATT
atattatgaagaaggtttgc

SEQ ID NO: 11781 - DNA, 20 bp, Artificial Sequence
  Description of Artificial Sequence: Synthetic oligonucleotide
  Target: SCN10A; (+) strand; PAM type: NNNNGHTT; PAM sequence: CACAGTTT
aaggtttgcatcagatttga

SEQ ID NO: 11782 - DNA, 20 bp, Artificial Sequence
  Description of Artificial Sequence: Synthetic oligonucleotide
  Target: SCN10A; (+) strand; PAM type: NNNNGHTT; PAM sequence: GAGAGTTT
agacatagaggatagaatga

SEQ ID NO: 11783 - DNA, 20 bp, Artificial Sequence
  Description of Artificial Sequence: Synthetic oligonucleotide
  Target: SCN10A; (+) strand; PAM type: NNNNGHTT; PAM sequence: TAAAGATT
attgaagaaaattacaaaac

SEQ ID NO: 11784 - DNA, 20 bp, Artificial Sequence
  Description of Artificial Sequence: Synthetic oligonucleotide
  Target: SCN10A; (+) strand; PAM type: NNNNGHTT; PAM sequence: AGAAGATT
gcagaacaccaaagatggat

SEQ ID NO: 11785 - DNA, 20 bp, Artificial Sequence
  Description of Artificial Sequence: Synthetic oligonucleotide
  Target: SCN10A; (+) strand; PAM type: NNNNGHTT; PAM sequence: TTAGGCTT
agaaatcaataactaaattt

SEQ ID NO: 11786 - DNA, 20 bp, Artificial Sequence
  Description of Artificial Sequence: Synthetic oligonucleotide
  Target: SCN10A; (+) strand; PAM type: NNNNGHTT; PAM sequence: TTGAGTTT
tcagtaacttacaaaaattc

SEQ ID NO: 11787 - DNA, 20 bp, Artificial Sequence
  Description of Artificial Sequence: Synthetic oligonucleotide
  Target: SCN10A; (+) strand; PAM type: NNNNGHTT; PAM sequence: TGGAGTTT
ttggaaccaggatggccgac

SEQ ID NO: 11788 - DNA, 20 bp, Artificial Sequence
  Description of Artificial Sequence: Synthetic oligonucleotide
  Target: SCN10A; (+) strand; PAM type: NNNNGHTT; PAM sequence: ATGAGCTT
ccgactggagtttgtgcaga

SEQ ID NO: 11789 - DNA, 20 bp, Artificial Sequence
  Description of Artificial Sequence: Synthetic oligonucleotide
  Target: SCN10A; (+) strand; PAM type: NNNNGHTT; PAM sequence: CCCAGATT
catattgcatactaactccc

SEQ ID NO: 11790 - DNA, 20 bp, Artificial Sequence
  Description of Artificial Sequence: Synthetic oligonucleotide
  Target: SCN10A; (+) strand; PAM type: NNNNGHTT; PAM sequence: CTGAGCTT
gacagcacagggagacagat

SEQ ID NO: 11791 - DNA, 20 bp, Artificial Sequence
  Description of Artificial Sequence: Synthetic oligonucleotide
  Target: SCN10A; (+) strand; PAM type: NNNNGHTT; PAM sequence: GCCAGCTT
gacctcctgtcttcttgcca

SEQ ID NO: 11792 - DNA, 20 bp, Artificial Sequence
  Description of Artificial Sequence: Synthetic oligonucleotide
  Target: SCN10A; (+) strand; PAM type: NNNNGHTT; PAM sequence: TTAAGCTT
ttgccagccagcttgcagta

SEQ ID NO: 11793 - DNA, 20 bp, Artificial Sequence
  Description of Artificial Sequence: Synthetic oligonucleotide
  Target: SCN10A; (+) strand; PAM type: NNNNGHTT; PAM sequence: CTTGGCTT
caaaagcctggtgtcctcgt

SEQ ID NO: 11794 - DNA, 20 bp, Artificial Sequence
  Description of Artificial Sequence: Synthetic oligonucleotide
  Target: SCN10A; (+) strand; PAM type: NNNNGHTT; PAM sequence: ATTGGCTT
ttggcttccaaagtcatagt

SEQ ID NO: 11795 - DNA, 20 bp, Artificial Sequence
  Description of Artificial Sequence: Synthetic oligonucleotide
  Target: SCN10A; (+) strand; PAM type: NNNNGHTT; PAM sequence: GACTGTTT
tcctcccagacacaacggaa

SEQ ID NO: 11796 - DNA, 20 bp, Artificial Sequence
  Description of Artificial Sequence: Synthetic oligonucleotide
  Target: SCN10A; (+) strand; PAM type: NNNNGHTT; PAM sequence: TCCAGTTT
gacacaacggaagactgttt

SEQ ID NO: 11797 - DNA, 20 bp, Artificial Sequence
  Description of Artificial Sequence: Synthetic oligonucleotide
  Target: SCN10A; (+) strand; PAM type: NNNNGHTT; PAM sequence: TTTTGCTT
aacggaagactgttttccag

SEQ ID NO: 11798 - DNA, 20 bp, Artificial Sequence
  Description of Artificial Sequence: Synthetic oligonucleotide
  Target: SCN10A; (+) strand; PAM type: NNNNGHTT; PAM sequence: GAGAGCTT
cttgaagtagacactcccag

SEQ ID NO: 11799 - DNA, 20 bp, Artificial Sequence
  Description of Artificial Sequence: Synthetic oligonucleotide
  Target: SCN10A; (+) strand; PAM type: NNNNGHTT; PAM sequence: CACAGATT
acatctctattatgttaact

SEQ ID NO: 11800 - DNA, 20 bp, Artificial Sequence
  Description of Artificial Sequence: Synthetic oligonucleotide
  Target: SCN10A; (+) strand; PAM type: NNNNGHTT; PAM sequence: AATTGCTT
cttatcttgagtaatggaga

SEQ ID NO: 11801 - DNA, 20 bp, Artificial Sequence
  Description of Artificial Sequence: Synthetic oligonucleotide
  Target: SCN10A; (+) strand; PAM type: NNNNGHTT; PAM sequence: ACTGGCTT
aaaagcatcaactatgtggc

SEQ ID NO: 11802 - DNA, 20 bp, Artificial Sequence
  Description of Artificial Sequence: Synthetic oligonucleotide
  Target: SCN10A; (+) strand; PAM type: NNNNGHTT; PAM sequence: GAAGGCTT
caacaaggaagctgatagga

SEQ ID NO: 11803 - DNA, 20 bp, Artificial Sequence
  Description of Artificial Sequence: Synthetic oligonucleotide
  Target: SCN10A; (+) strand; PAM type: NNNNGHTT; PAM sequence: AAGGGTTT
tgaaccagcaaccctagggg

SEQ ID NO: 11804 - DNA, 20 bp, Artificial Sequence
  Description of Artificial Sequence: Synthetic oligonucleotide
  Target: SCN10A; (+) strand; PAM type: NNNNGHTT; PAM sequence: AAGAGATT
ttggtcaagacagtacaaga

SEQ ID NO: 11805 - DNA, 20 bp, Artificial Sequence
  Description of Artificial Sequence: Synthetic oligonucleotide
  Target: SCN10A; (+) strand; PAM type: NNNNGHTT; PAM sequence: GAAAGATT
caagaaagagattagctcag

SEQ ID NO: 11806 - DNA, 20 bp, Artificial Sequence
  Description of Artificial Sequence: Synthetic oligonucleotide
  Target: SCN10A; (+) strand; PAM type: NNNNGHTT; PAM sequence: GCTGGTTT
attagctcaggaaagattta

SEQ ID NO: 11807 - DNA, 20 bp, Artificial Sequence
  Description of Artificial Sequence: Synthetic oligonucleotide
  Target: SCN10A; (+) strand; PAM type: NNNNGHTT; PAM sequence: AGAAGTTT
aataaaagaaaatataatcc

SEQ ID NO: 11808 - DNA, 20 bp, Artificial Sequence
  Description of Artificial Sequence: Synthetic oligonucleotide
  Target: SCN10A; (+) strand; PAM type: NNNNGHTT; PAM sequence: TGACGATT
aatccagaagtttagagcct

SEQ ID NO: 11809 - DNA, 20 bp, Artificial Sequence
  Description of Artificial Sequence: Synthetic oligonucleotide
  Target: SCN10A; (+) strand; PAM type: NNNNGHTT; PAM sequence: TACTGCTT
cttgacgatttagggaactg

SEQ ID NO: 11810 - DNA, 20 bp, Artificial Sequence
  Description of Artificial Sequence: Synthetic oligonucleotide
  Target: SCN10A; (+) strand; PAM type: NNNNGHTT; PAM sequence: TCTAGATT
atttagggaactgtactgct

SEQ ID NO: 11811 - DNA, 20 bp, Artificial Sequence
  Description of Artificial Sequence: Synthetic oligonucleotide
  Target: SCN10A; (+) strand; PAM type: NNNNGHTT; PAM sequence: ATGGGATT
tagattccaggcagtgagca

SEQ ID NO: 11812 - DNA, 20 bp, Artificial Sequence
  Description of Artificial Sequence: Synthetic oligonucleotide
  Target: SCN10A; (+) strand; PAM type: NNNNGHTT; PAM sequence: CAAAGCTT
ttaaatgaaacaactcttag

SEQ ID NO: 11813 - DNA, 20 bp, Artificial Sequence
  Description of Artificial Sequence: Synthetic oligonucleotide
  Target: SCN10A; (+) strand; PAM type: NNNNGHTT; PAM sequence: CACTGTTT
gcttgtagtaatggtgtagc

SEQ ID NO: 11814 - DNA, 20 bp, Artificial Sequence
  Description of Artificial Sequence: Synthetic oligonucleotide
  Target: SCN10A; (+) strand; PAM type: NNNNGHTT; PAM sequence: CTAAGTTT
aatgagaggtctgaagccat

SEQ ID NO: 11815 - DNA, 20 bp, Artificial Sequence
  Description of Artificial Sequence: Synthetic oligonucleotide
  Target: SCN10A; (+) strand; PAM type: NNNNGHTT; PAM sequence: CACTGTTT
ccctgactgaaaaagccttt

SEQ ID NO: 11816 - DNA, 20 bp, Artificial Sequence
  Description of Artificial Sequence: Synthetic oligonucleotide
  Target: SCN10A; (+) strand; PAM type: NNNNGHTT; PAM sequence: CTTGGCTT
gtttaaaccttaaaacaaac

SEQ ID NO: 11817 - DNA, 20 bp, Artificial Sequence
  Description of Artificial Sequence: Synthetic oligonucleotide
  Target: SCN10A; (+) strand; PAM type: NNNNGHTT; PAM sequence: TCTGGCTT
tggagtcccacctagagctg

SEQ ID NO: 11818 - DNA, 20 bp, Artificial Sequence
  Description of Artificial Sequence: Synthetic oligonucleotide
  Target: SCN10A; (+) strand; PAM type: NNNNGHTT; PAM sequence: CTCAGTTT
acctttattggggtcagtta

SEQ ID NO: 11819 - DNA, 20 bp, Artificial Sequence
  Description of Artificial Sequence: Synthetic oligonucleotide
  Target: SCN10A; (+) strand; PAM type: NNNNGHTT; PAM sequence: TAGAGATT
tggggtcagttactcagttt

SEQ ID NO: 11820 - DNA, 20 bp, Artificial Sequence
  Description of Artificial Sequence: Synthetic oligonucleotide
  Target: SCN10A; (+) strand; PAM type: NNNNGHTT; PAM sequence: GGTAGCTT
tagagattgtctgtataata

SEQ ID NO: 11821 - DNA, 20 bp, Artificial Sequence
  Description of Artificial Sequence: Synthetic oligonucleotide
  Target: SCN10A; (+) strand; PAM type: NNNNGHTT; PAM sequence: CATTGATT
taataggtagctttattttt

SEQ ID NO: 11822 - DNA, 20 bp, Artificial Sequence
  Description of Artificial Sequence: Synthetic oligonucleotide
  Target: SCN10A; (+) strand; PAM type: NNNNGHTT; PAM sequence: TAAAGATT
aagttgtcttggaggaaggt

SEQ ID NO: 11823 - DNA, 20 bp, Artificial Sequence
  Description of Artificial Sequence: Synthetic oligonucleotide
  Target: SCN10A; (+) strand; PAM type: NNNNGHTT; PAM sequence: TTTGGCTT
gttaaagattttagctaact

SEQ ID NO: 11824 - DNA, 20 bp, Artificial Sequence
  Description of Artificial Sequence: Synthetic oligonucleotide
  Target: SCN10A; (+) strand; PAM type: NNNNGHTT; PAM sequence: CTTTGATT
agattttagctaacttttgg

SEQ ID NO: 11825 - DNA, 20 bp, Artificial Sequence
  Description of Artificial Sequence: Synthetic oligonucleotide
  Target: SCN10A; (+) strand; PAM type: NNNNGHTT; PAM sequence: TGGAGTTT
ttatttatttatttttgaga

SEQ ID NO: 11826 - DNA, 20 bp, Artificial Sequence
  Description of Artificial Sequence: Synthetic oligonucleotide
  Target: SCN10A; (+) strand; PAM type: NNNNGHTT; PAM sequence: CTGGGATT
tccctcagcctcccaagtag

SEQ ID NO: 11827 - DNA, 20 bp, Artificial Sequence
  Description of Artificial Sequence: Synthetic oligonucleotide
  Target: SCN10A; (+) strand; PAM type: NNNNGHTT; PAM sequence: CTGGGATT
tgcctgcgcctccaacagtg

SEQ ID NO: 11828 - DNA, 20 bp, Artificial Sequence
  Description of Artificial Sequence: Synthetic oligonucleotide
  Target: SCN10A; (+) strand; PAM type: NNNNGHTT; PAM sequence: TATTGTTT
actgcccctggccttctttt

SEQ ID NO: 11829 - DNA, 20 bp, Artificial Sequence
  Description of Artificial Sequence: Synthetic oligonucleotide
  Target: SCN10A; (+) strand; PAM type: NNNNGHTT; PAM sequence: CTGGGATT
gctcactgcaacctctgtct

SEQ ID NO: 11830 - DNA, 20 bp, Artificial Sequence
  Description of Artificial Sequence: Synthetic oligonucleotide
  Target: SCN10A; (+) strand; PAM type: NNNNGHTT; PAM sequence: CTGGGATT
tgcctcaccctcctgagtag

SEQ ID NO: 11831 - DNA, 20 bp, Artificial Sequence
  Description of Artificial Sequence: Synthetic oligonucleotide
  Target: SCN10A; (+) strand; PAM type: NNNNGHTT; PAM sequence: TGGGGTTT
ttatatatttttagtagaga

SEQ ID NO: 11832 - DNA, 20 bp, Artificial Sequence
  Description of Artificial Sequence: Synthetic oligonucleotide
  Target: SCN10A; (+) strand; PAM type: NNNNGHTT; PAM sequence: CTGGGATT
caccttggcctcccaaaatt

SEQ ID NO: 11833 - DNA, 20 bp, Artificial Sequence
  Description of Artificial Sequence: Synthetic oligonucleotide
  Target: SCN10A; (+) strand; PAM type: NNNNGHTT; PAM sequence: CTTGGCTT
gagccaccccacctggcccc

SEQ ID NO: 11834 - DNA, 20 bp, Artificial Sequence
  Description of Artificial Sequence: Synthetic oligonucleotide
  Target: SCN10A; (+) strand; PAM type: NNNNGHTT; PAM sequence: CTAGGTTT
aaaaatgcatcacgatcaag

SEQ ID NO: 11835 - DNA, 20 bp, Artificial Sequence
  Description of Artificial Sequence: Synthetic oligonucleotide
  Target: SCN10A; (+) strand; PAM type: NNNNGHTT; PAM sequence: AGTTGATT
ggtttgagctgggaatgtaa

SEQ ID NO: 11836 - DNA, 20 bp, Artificial Sequence
  Description of Artificial Sequence: Synthetic oligonucleotide
  Target: SCN10A; (+) strand; PAM type: NNNNGHTT; PAM sequence: AACAGATT
ttaatataattcaccacttt

SEQ ID NO: 11837 - DNA, 20 bp, Artificial Sequence
  Description of Artificial Sequence: Synthetic oligonucleotide
  Target: SCN10A; (+) strand; PAM type: NNNNGHTT; PAM sequence: ACATGATT
aacagattgaaggagaaaat

SEQ ID NO: 11838 - DNA, 20 bp, Artificial Sequence
  Description of Artificial Sequence: Synthetic oligonucleotide
  Target: SCN10A; (+) strand; PAM type: NNNNGHTT; PAM sequence: TAAAGATT
aagagaacttcctgaactga

SEQ ID NO: 11839 - DNA, 20 bp, Artificial Sequence
  Description of Artificial Sequence: Synthetic oligonucleotide
  Target: SCN10A; (+) strand; PAM type: NNNNGHTT; PAM sequence: AAAGGATT
ttagaggtggtgaaatattg

SEQ ID NO: 11840 - DNA, 20 bp, Artificial Sequence
  Description of Artificial Sequence: Synthetic oligonucleotide
  Target: SCN10A; (+) strand; PAM type: NNNNGHTT; PAM sequence: TAAGGATT
gtaaaaagaacctaatggca

SEQ ID NO: 11841 - DNA, 20 bp, Artificial Sequence
  Description of Artificial Sequence: Synthetic oligonucleotide
  Target: SCN10A; (+) strand; PAM type: NNNNGHTT; PAM sequence: ATGTGATT
ctcattgttattttcacatg

SEQ ID NO: 11842 - DNA, 20 bp, Artificial Sequence
  Description of Artificial Sequence: Synthetic oligonucleotide
  Target: SCN10A; (+) strand; PAM type: NNNNGHTT; PAM sequence: TAAAGATT
gatcagaagactgaattatg

SEQ ID NO: 11843 - DNA, 20 bp, Artificial Sequence
  Description of Artificial Sequence: Synthetic oligonucleotide
  Target: SCN10A; (+) strand; PAM type: NNNNGHTT; PAM sequence: AGCAGTTT
tccctaatgggaaaaacaat

SEQ ID NO: 11844 - DNA, 20 bp, Artificial Sequence
  Description of Artificial Sequence: Synthetic oligonucleotide
  Target: SCN10A; (+) strand; PAM type: NNNNGHTT; PAM sequence: GGTGGATT
gatattcttgaagtaaatta

SEQ ID NO: 11845 - DNA, 20 bp, Artificial Sequence
  Description of Artificial Sequence: Synthetic oligonucleotide
  Target: SCN10A; (+) strand; PAM type: NNNNGHTT; PAM sequence: ACTTGATT
tgaagtaaattaggtggatt

SEQ ID NO: 11846 - DNA, 20 bp, Artificial Sequence
  Description of Artificial Sequence: Synthetic oligonucleotide
  Target: SCN10A; (+) strand; PAM type: NNNNGHTT; PAM sequence: CAAGGCTT
gactaacagagcaaatggag

SEQ ID NO: 11847 - DNA, 20 bp, Artificial Sequence
  Description of Artificial Sequence: Synthetic oligonucleotide
  Target: SCN10A; (+) strand; PAM type: NNNNGHTT; PAM sequence: AGGTGTTT
ccttccttcaatcaatcaac

SEQ ID NO: 11848 - DNA, 20 bp, Artificial Sequence
  Description of Artificial Sequence: Synthetic oligonucleotide
  Target: SCN10A; (+) strand; PAM type: NNNNGHTT; PAM sequence: TCTGGTTT
taaaacggtagacaagaaac

SEQ ID NO: 11849 - DNA, 20 bp, Artificial Sequence
  Description of Artificial Sequence: Synthetic oligonucleotide
  Target: SCN10A; (+) strand; PAM type: NNNNGHTT; PAM sequence: CAGAGTTT
ggtgacaagtgcattgaaca

SEQ ID NO: 11850 - DNA, 20 bp, Artificial Sequence
  Description of Artificial Sequence: Synthetic oligonucleotide
  Target: SCN10A; (+) strand; PAM type: NNNNGHTT; PAM sequence: TCCTGATT
gagactggtgaactggcagg

SEQ ID NO: 11851 - DNA, 20 bp, Artificial Sequence
  Description of Artificial Sequence: Synthetic oligonucleotide
  Target: SCN10A; (+) strand; PAM type: NNNNGHTT; PAM sequence: TCTGGATT
ttgtacaccatcatgaggag

SEQ ID NO: 11852 - DNA, 20 bp, Artificial Sequence
  Description of Artificial Sequence: Synthetic oligonucleotide
  Target: SCN10A; (+) strand; PAM type: NNNNGHTT; PAM sequence: GTGGGATT
tgtgtgtgtgtgtgtgtgtt

SEQ ID NO: 11853 - DNA, 20 bp, Artificial Sequence
  Description of Artificial Sequence: Synthetic oligonucleotide
  Target: SCN10A; (+) strand; PAM type: NNNNGHTT; PAM sequence: GAAAGCTT
ttgtgggattgatggtatat

SEQ ID NO: 11854 - DNA, 20 bp, Artificial Sequence
  Description of Artificial Sequence: Synthetic oligonucleotide
  Target: SCN10A; (+) strand; PAM type: NNNNGHTT; PAM sequence: TCCAGTTT
aagctttctgttcaatctgc

SEQ ID NO: 11855 - DNA, 20 bp, Artificial Sequence
  Description of Artificial Sequence: Synthetic oligonucleotide
  Target: SCN10A; (+) strand; PAM type: NNNNGHTT; PAM sequence: CGGTGATT
ccaggaaactgaccagctgg

SEQ ID NO: 11856 - DNA, 20 bp, Artificial Sequence
  Description of Artificial Sequence: Synthetic oligonucleotide
  Target: SCN10A; (+) strand; PAM type: NNNNGHTT; PAM sequence: TGAGGTTT
atttgacttagactctccgg

SEQ ID NO: 11857 - DNA, 20 bp, Artificial Sequence
  Description of Artificial Sequence: Synthetic oligonucleotide
  Target: SCN10A; (+) strand; PAM type: NNNNGHTT; PAM sequence: AGGTGATT
cgcaaagaggcagagggaaa

SEQ ID NO: 11858 - DNA, 20 bp, Artificial Sequence
  Description of Artificial Sequence: Synthetic oligonucleotide
  Target: SCN10A; (+) strand; PAM type: NNNNGHTT; PAM sequence: TTGAGTTT
gaggcagagggaaaaggtga

SEQ ID NO: 11859 - DNA, 20 bp, Artificial Sequence
  Description of Artificial Sequence: Synthetic oligonucleotide
  Target: SCN10A; (+) strand; PAM type: NNNNGHTT; PAM sequence: GTTTGTTT
cagagggaaaaggtgattga

SEQ ID NO: 11860 - DNA, 20 bp, Artificial Sequence
  Description of Artificial Sequence: Synthetic oligonucleotide
  Target: SCN10A; (+) strand; PAM type: NNNNGHTT; PAM sequence: GGTTGTTT
aagtaaacttgcctattttt

SEQ ID NO: 11861 - DNA, 20 bp, Artificial Sequence
  Description of Artificial Sequence: Synthetic oligonucleotide
  Target: SCN10A; (+) strand; PAM type: NNNNGHTT; PAM sequence: CTAAGCTT
agcacatagaccttaaaaca

SEQ ID NO: 11862 - DNA, 20 bp, Artificial Sequence
  Description of Artificial Sequence: Synthetic oligonucleotide
  Target: SCN10A; (+) strand; PAM type: NNNNGHTT; PAM sequence: TTCTGCTT
tagaccttaaaacactaagc

SEQ ID NO: 11863 - DNA, 20 bp, Artificial Sequence
  Description of Artificial Sequence: Synthetic oligonucleotide
  Target: SCN10A; (+) strand; PAM type: NNNNGHTT; PAM sequence: GTTCGTTT
tccccaagtgtagcagaaat

SEQ ID NO: 11864 - DNA, 20 bp, Artificial Sequence
  Description of Artificial Sequence: Synthetic oligonucleotide
  Target: SCN10A; (+) strand; PAM type: NNNNGHTT; PAM sequence: CGCTGTTT
ttttttttgagacggagtcc

SEQ ID NO: 11865 - DNA, 20 bp, Artificial Sequence
  Description of Artificial Sequence: Synthetic oligonucleotide
  Target: SCN10A; (+) strand; PAM type: NNNNGHTT; PAM sequence: GCCGGATT
agtcccgctgtttagcccag

SEQ ID NO: 11866 - DNA, 20 bp, Artificial Sequence
  Description of Artificial Sequence: Synthetic oligonucleotide
  Target: SCN10A; (+) strand; PAM type: NNNNGHTT; PAM sequence: CGGGGTTT
ttttgtatttttagtagaga

SEQ ID NO: 11867 - DNA, 20 bp, Artificial Sequence
  Description of Artificial Sequence: Synthetic oligonucleotide
  Target: SCN10A; (+) strand; PAM type: NNNNGHTT; PAM sequence: CTGGGATT
tgcctcggcctcccaaagtg

SEQ ID NO: 11868 - DNA, 20 bp, Artificial Sequence
  Description of Artificial Sequence: Synthetic oligonucleotide
  Target: SCN10A; (+) strand; PAM type: NNNNGHTT; PAM sequence: TGACGATT
tgtgatatctcctgctctct

SEQ ID NO: 11869 - DNA, 20 bp, Artificial Sequence
  Description of Artificial Sequence: Synthetic oligonucleotide
  Target: SCN10A; (+) strand; PAM type: NNNNGHTT; PAM sequence: ATTAGCTT
ataggtaccttatattgacc

SEQ ID NO: 11870 - DNA, 20 bp, Artificial Sequence
  Description of Artificial Sequence: Synthetic oligonucleotide
  Target: SCN10A; (+) strand; PAM type: NNNNGHTT; PAM sequence: ATGTGATT
agaaatctgtccttctaaaa

SEQ ID NO: 11871 - DNA, 20 bp, Artificial Sequence
  Description of Artificial Sequence: Synthetic oligonucleotide
  Target: SCN10A; (+) strand; PAM type: NNNNGHTT; PAM sequence: GTAAGATT
tgtgatttaattctgacctt

SEQ ID NO: 11872 - DNA, 20 bp, Artificial Sequence
  Description of Artificial Sequence: Synthetic oligonucleotide
  Target: SCN10A; (+) strand; PAM type: NNNNGHTT; PAM sequence: ATCAGCTT
cctgggatggtgacagtacc

SEQ ID NO: 11873 - DNA, 20 bp, Artificial Sequence
  Description of Artificial Sequence: Synthetic oligonucleotide
  Target: SCN10A; (+) strand; PAM type: NNNNGHTT; PAM sequence: CAGCGTTT
cttaggcagatgccatcaac

SEQ ID NO: 11874 - DNA, 20 bp, Artificial Sequence
  Description of Artificial Sequence: Synthetic oligonucleotide
  Target: SCN10A; (+) strand; PAM type: NNNNGHTT; PAM sequence: ACATGCTT
tggcacagctgtgtctcagg

SEQ ID NO: 11875 - DNA, 20 bp, Artificial Sequence
  Description of Artificial Sequence: Synthetic oligonucleotide
  Target: SCN10A; (+) strand; PAM type: NNNNGHTT; PAM sequence: GAGTGTTT
catgctttatttggtcttta

SEQ ID NO: 11876 - DNA, 20 bp, Artificial Sequence
  Description of Artificial Sequence: Synthetic oligonucleotide
  Target: SCN10A; (+) strand; PAM type: NNNNGHTT; PAM sequence: ACTGGATT
tctttagagtgtttttaaaa

SEQ ID NO: 11877 - DNA, 20 bp, Artificial Sequence
  Description of Artificial Sequence: Synthetic oligonucleotide
  Target: SCN10A; (+) strand; PAM type: NNNNGHTT; PAM sequence: TCTGGATT
taaagacatttgcacaaaaa

SEQ ID NO: 11878 - DNA, 20 bp, Artificial Sequence
  Description of Artificial Sequence: Synthetic oligonucleotide
  Target: SCN10A; (+) strand; PAM type: NNNNGHTT; PAM sequence: TCTCGCTT
ctttctttcatctgtctttc

SEQ ID NO: 11879 - DNA, 20 bp, Artificial Sequence
  Description of Artificial Sequence: Synthetic oligonucleotide
  Target: SCN10A; (+) strand; PAM type: NNNNGHTT; PAM sequence: CGGGGTTT
tttttcattttttgtagaga

SEQ ID NO: 11880 - DNA, 20 bp, Artificial Sequence
  Description of Artificial Sequence: Synthetic oligonucleotide
  Target: SCN10A; (+) strand; PAM type: NNNNGHTT; PAM sequence: CTAGGATT
tgcctcggcctcccaaagta

SEQ ID NO: 11881 - DNA, 20 bp, Artificial Sequence
  Description of Artificial Sequence: Synthetic oligonucleotide
  Target: SCN10A; (+) strand; PAM type: NNNNGHTT; PAM sequence: CATTGATT
cacctggcctgagatggtca

SEQ ID NO: 11882 - DNA, 20 bp, Artificial Sequence
  Description of Artificial Sequence: Synthetic oligonucleotide
  Target: SCN10A; (+) strand; PAM type: NNNNGHTT; PAM sequence: CACTGCTT
catccctcccaggagttgtg

SEQ ID NO: 11883 - DNA, 20 bp, Artificial Sequence
  Description of Artificial Sequence: Synthetic oligonucleotide
  Target: SCN10A; (+) strand; PAM type: NNNNGHTT; PAM sequence: TTGAGTTT
atgtcactgcacatgggcat

SEQ ID NO: 11884 - DNA, 20 bp, Artificial Sequence
  Description of Artificial Sequence: Synthetic oligonucleotide
  Target: SCN10A; (+) strand; PAM type: NNNNGHTT; PAM sequence: GGAAGATT
caacacttgtcaggaccttg

SEQ ID NO: 11885 - DNA, 20 bp, Artificial Sequence
  Description of Artificial Sequence: Synthetic oligonucleotide
  Target: SCN10A; (+) strand; PAM type: NNNNGHTT; PAM sequence: CTTTGTTT
gaagattgttggatactccc

SEQ ID NO: 11886 - DNA, 20 bp, Artificial Sequence
  Description of Artificial Sequence: Synthetic oligonucleotide
  Target: SCN10A; (+) strand; PAM type: NNNNGHTT; PAM sequence: GAGAGATT
cagggctcccagttaatact

SEQ ID NO: 11887 - DNA, 20 bp, Artificial Sequence
  Description of Artificial Sequence: Synthetic oligonucleotide
  Target: SCN10A; (+) strand; PAM type: NNNNGHTT; PAM sequence: CCAAGCTT
tcccaagagtcagtgagatg

SEQ ID NO: 11888 - DNA, 20 bp, Artificial Sequence
  Description of Artificial Sequence: Synthetic oligonucleotide
  Target: SCN10A; (+) strand; PAM type: NNNNGHTT; PAM sequence: ACAGGTTT
ccgacactcctgggaatctg

SEQ ID NO: 11889 - DNA, 20 bp, Artificial Sequence
  Description of Artificial Sequence: Synthetic oligonucleotide
  Target: SCN10A; (+) strand; PAM type: NNNNGHTT; PAM sequence: CTGAGTTT
ctgtagagggcgtcctggag

SEQ ID NO: 11890 - DNA, 20 bp, Artificial Sequence
  Description of Artificial Sequence: Synthetic oligonucleotide
  Target: SCN10A; (+) strand; PAM type: NNNNGHTT; PAM sequence: AGGTGCTT
gagactaataggcaggttga

SEQ ID NO: 11891 - DNA, 20 bp, Artificial Sequence
  Description of Artificial Sequence: Synthetic oligonucleotide
  Target: SCN10A; (+) strand; PAM type: NNNNGHTT; PAM sequence: CTGTGATT
aggtgcttgagacattgggg

SEQ ID NO: 11892 - DNA, 20 bp, Artificial Sequence
  Description of Artificial Sequence: Synthetic oligonucleotide
  Target: SCN10A; (+) strand; PAM type: NNNNGHTT; PAM sequence: CCTGGATT
ggggctctggagtcagacaa

SEQ ID NO: 11893 - DNA, 20 bp, Artificial Sequence
  Description of Artificial Sequence: Synthetic oligonucleotide
  Target: SCN10A; (+) strand; PAM type: NNNNGHTT; PAM sequence: TGTGGCTT
ctggatttgagatccaggtc

SEQ ID NO: 11894 - DNA, 20 bp, Artificial Sequence
  Description of Artificial Sequence: Synthetic oligonucleotide
  Target: SCN10A; (+) strand; PAM type: NNNNGHTT; PAM sequence: ATTCGCTT
gagatccaggtctgtggctt

SEQ ID NO: 11895 - DNA, 20 bp, Artificial Sequence
  Description of Artificial Sequence: Synthetic oligonucleotide
  Target: SCN10A; (+) strand; PAM type: NNNNGHTT; PAM sequence: GCTTGCTT
tccaggtctgtggcttattc

SEQ ID NO: 11896 - DNA, 20 bp, Artificial Sequence
  Description of Artificial Sequence: Synthetic oligonucleotide
  Target: SCN10A; (+) strand; PAM type: NNNNGHTT; PAM sequence: GTGCGTTT
tgttgtgagcataaaatgag

SEQ ID NO: 11897 - DNA, 20 bp, Artificial Sequence
  Description of Artificial Sequence: Synthetic oligonucleotide
  Target: SCN10A; (+) strand; PAM type: NNNNGHTT; PAM sequence: CTGTGATT
tgctcagtaagtattagctg

SEQ ID NO: 11898 - DNA, 20 bp, Artificial Sequence
  Description of Artificial Sequence: Synthetic oligonucleotide
  Target: SCN10A; (+) strand; PAM type: NNNNGHTT; PAM sequence: CAGTGCTT
tatttgataagagacgagga

SEQ ID NO: 11899 - DNA, 20 bp, Artificial Sequence
  Description of Artificial Sequence: Synthetic oligonucleotide
  Target: SCN10A; (+) strand; PAM type: NNNNGHTT; PAM sequence: GGGAGTTT
tgtcttccctgaatctgggt

SEQ ID NO: 11900 - DNA, 20 bp, Artificial Sequence
  Description of Artificial Sequence: Synthetic oligonucleotide
  Target: SCN10A; (+) strand; PAM type: NNNNGHTT; PAM sequence: ACAGGCTT
gcggaagctccgcagcacag

SEQ ID NO: 11901 - DNA, 20 bp, Artificial Sequence
  Description of Artificial Sequence: Synthetic oligonucleotide
  Target: SCN10A; (+) strand; PAM type: NNNNGHTT; PAM sequence: CAATGATT
ataatagtatgggtcgaagg

SEQ ID NO: 11902 - DNA, 20 bp, Artificial Sequence
  Description of Artificial Sequence: Synthetic oligonucleotide
  Target: SCN10A; (+) strand; PAM type: NNNNGHTT; PAM sequence: ACAAGCTT
gtaaagacctaggagtggaa

SEQ ID NO: 11903 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
atttacaaaatagaaaatcc

SEQ ID NO: 11904 - DNA, 20 bp, Artificial Sequence
  Description of Artificial Sequence: Synthetic oligonucleotide
  Target: SCN10A; (+) strand; PAM type: NNNNGHTT; PAM sequence: TGAGGATT
ctatgttatctgtgggctcc

SEQ ID NO: 11905 - DNA, 20 bp, Artificial Sequence
  Description of Artificial Sequence: Synthetic oligonucleotide
  Target: SCN10A; (+) strand; PAM type: NNNNGHTT; PAM sequence: TGCAGTTT
ttctcaggggctgtgcatgc

SEQ ID NO: 11906 - DNA, 20 bp, Artificial Sequence
  Description of Artificial Sequence: Synthetic oligonucleotide
  Target: SCN10A; (+) strand; PAM type: NNNNGHTT; PAM sequence: CCTGGATT
gggttgtgggacatcacaga

SEQ ID NO: 11907 - DNA, 20 bp, Artificial Sequence
  Description of Artificial Sequence: Synthetic oligonucleotide
  Target: SCN10A; (+) strand; PAM type: NNNNGHTT; PAM sequence: CCTAGCTT
aaatcccagcccagacattt

SEQ ID NO: 11908 - DNA, 20 bp, Artificial Sequence
  Description of Artificial Sequence: Synthetic oligonucleotide
  Target: SCN10A; (+) strand; PAM type: NNNNGHTT; PAM sequence: GTAAGCTT
ccagacatttcctagcttat

SEQ ID NO: 11909 - DNA, 20 bp, Artificial Sequence
  Description of Artificial Sequence: Synthetic oligonucleotide
  Target: SCN10A; (+) strand; PAM type: NNNNGHTT; PAM sequence: CAATGATT
gtaacagtgactagtaagaa

SEQ ID NO: 11910 - DNA, 20 bp, Artificial Sequence
  Description of Artificial Sequence: Synthetic oligonucleotide
  Target: SCN10A; (+) strand; PAM type: NNNNGHTT; PAM sequence: CTAAGATT
agaacaatgattcattgcct

SEQ ID NO: 11911 - DNA, 20 bp, Artificial Sequence
  Description of Artificial Sequence: Synthetic oligonucleotide
  Target: SCN10A; (+) strand; PAM type: NNNNGHTT; PAM sequence: AGGTGCTT
ggaaagcaacgaccagggtc

SEQ ID NO: 11912 - DNA, 20 bp, Artificial Sequence
  Description of Artificial Sequence: Synthetic oligonucleotide
  Target: SCN10A; (+) strand; PAM type: NNNNGHTT; PAM sequence: GAGAGTTT
tatggagaagaaaacaggct

SEQ ID NO: 11913 - DNA, 20 bp, Artificial Sequence
  Description of Artificial Sequence: Synthetic oligonucleotide
  Target: SCN10A; (+) strand; PAM type: NNNNGHTT; PAM sequence: GACTGATT
gtgactttctcatgccacaa

SEQ ID NO: 11914 - DNA, 20 bp, Artificial Sequence
  Description of Artificial Sequence: Synthetic oligonucleotide
  Target: SCN10A; (+) strand; PAM type: NNNNGHTT; PAM sequence: TCTTGCTT
aggcaccaagcacatgactt

SEQ ID NO: 11915 - DNA, 20 bp, Artificial Sequence
  Description of Artificial Sequence: Synthetic oligonucleotide
  Target: SCN10A; (+) strand; PAM type: NNNNGHTT; PAM sequence: TCTTGCTT
tgggaaaggccttttctctc

SEQ ID NO: 11916 - DNA, 20 bp, Artificial Sequence
  Description of Artificial Sequence: Synthetic oligonucleotide
  Target: SCN10A; (+) strand; PAM type: NNNNGHTT; PAM sequence: TGCTGATT
tgctgccaaaacatgaggca

SEQ ID NO: 11917 - DNA, 20 bp, Artificial Sequence
  Description of Artificial Sequence: Synthetic oligonucleotide
  Target: SCN10A; (+) strand; PAM type: NNNNGHTT; PAM sequence: CCTGGATT
actgctgcccctttcacagc

SEQ ID NO: 11918 - DNA, 20 bp, Artificial Sequence
  Description of Artificial Sequence: Synthetic oligonucleotide
  Target: SCN10A; (+) strand; PAM type: NNNNGHTT; PAM sequence: AGTGGTTT
ccctggattatggcggaggg

SEQ ID NO: 11919 - DNA, 20 bp, Artificial Sequence
  Description of Artificial Sequence: Synthetic oligonucleotide
  Target: SCN10A; (+) strand; PAM type: NNNNGHTT; PAM sequence: TCCAGCTT
ggtgaatccagtaggtcacc

SEQ ID NO: 11920 - DNA, 20 bp, Artificial Sequence
  Description of Artificial Sequence: Synthetic oligonucleotide
  Target: SCN10A; (+) strand; PAM type: NNNNGHTT; PAM sequence: TCTAGCTT
aaggcaggatgctgaccctt

SEQ ID NO: 11921 - DNA, 20 bp, Artificial Sequence
  Description of Artificial Sequence: Synthetic oligonucleotide
  Target: SCN10A; (+) strand; PAM type: NNNNGHTT; PAM sequence: GTGTGTTT
cttctgcctatcatgtgtgc

SEQ ID NO: 11922 - DNA, 20 bp, Artificial Sequence
  Description of Artificial Sequence: Synthetic oligonucleotide
  Target: SCN10A; (+) strand; PAM type: NNNNGHTT; PAM sequence: GGTGGCTT
cacacacgcaagtcttgtga

SEQ ID NO: 11923 - DNA, 20 bp, Artificial Sequence
  Description of Artificial Sequence: Synthetic oligonucleotide
  Target: SCN10A; (+) strand; PAM type: NNNNGHTT; PAM sequence: GCGGGCTT
taattcaggggttaagaaaa

SEQ ID NO: 11924 - DNA, 20 bp, Artificial Sequence
  Description of Artificial Sequence: Synthetic oligonucleotide
  Target: SCN10A; (+) strand; PAM type: NNNNGHTT; PAM sequence: GGAAGATT
aactcaactctatgatcttg

SEQ ID NO: 11925 - DNA, 20 bp, Artificial Sequence
  Description of Artificial Sequence: Synthetic oligonucleotide
  Target: SCN10A; (+) strand; PAM type: NNNNGHTT; PAM sequence: TATGGATT
cagtatatagtgaaatccag

SEQ ID NO: 11926 - DNA, 20 bp, Artificial Sequence
  Description of Artificial Sequence: Synthetic oligonucleotide
  Target: SCN10A; (+) strand; PAM type: NNNNGHTT; PAM sequence: TGATGCTT
aaagaaaagttccgacttcc

SEQ ID NO: 11927 - DNA, 20 bp, Artificial Sequence
  Description of Artificial Sequence: Synthetic oligonucleotide
  Target: SCN10A; (+) strand; PAM type: NNNNGHTT; PAM sequence: CCTTGTTT
tgcttttgttacaacagcaa

SEQ ID NO: 11928 - DNA, 20 bp, Artificial Sequence
  Description of Artificial Sequence: Synthetic oligonucleotide
  Target: SCN10A; (+) strand; PAM type: NNNNGHTT; PAM sequence: CCATGTTT
ttacaacagcaaccttgttt

SEQ ID NO: 11929 - DNA, 20 bp, Artificial Sequence
  Description of Artificial Sequence: Synthetic oligonucleotide
  Target: SCN10A; (+) strand; PAM type: NNNNGHTT; PAM sequence: CAAAGATT
tggaaggaaacagacaagtc

SEQ ID NO: 11930 - DNA, 20 bp, Artificial Sequence
  Description of Artificial Sequence: Synthetic oligonucleotide
  Target: SCN10A; (+) strand; PAM type: NNNNGHTT; PAM sequence: CTATGTTT
agaaaattcaagtggttgtc

SEQ ID NO: 11931 - DNA, 20 bp, Artificial Sequence
  Description of Artificial Sequence: Synthetic oligonucleotide
  Target: SCN10A; (+) strand; PAM type: NNNNGHTT; PAM sequence: CTGTGCTT
ggctctcctggttcactttc

SEQ ID NO: 11932 - DNA, 20 bp, Artificial Sequence
  Description of Artificial Sequence: Synthetic oligonucleotide
  Target: SCN10A; (+) strand; PAM type: NNNNGHTT; PAM sequence: CATGGCTT
acgatgttgcctatctggag

SEQ ID NO: 11933 - DNA, 20 bp, Artificial Sequence
  Description of Artificial Sequence: Synthetic oligonucleotide
  Target: SCN10A; (+) strand; PAM type: NNNNGHTT; PAM sequence: TTGAGCTT
caagcccaaagagaattgtc

SEQ ID NO: 11934 - DNA, 20 bp, Artificial Sequence
  Description of Artificial Sequence: Synthetic oligonucleotide
  Target: SCN10A; (+) strand; PAM type: NNNNGHTT; PAM sequence: CCCAGCTT
tgtccttacttctcaatttg

SEQ ID NO: 11935 - DNA, 20 bp, Artificial Sequence
  Description of Artificial Sequence: Synthetic oligonucleotide
  Target: SCN10A; (+) strand; PAM type: NNNNGHTT; PAM sequence: CTTAGATT
ttacttctcaatttgcccag

SEQ ID NO: 11936 - DNA, 20 bp, Artificial Sequence
  Description of Artificial Sequence: Synthetic oligonucleotide
  Target: SCN10A; (+) strand; PAM type: NNNNGHTT; PAM sequence: CTATGCTT
tggctggaaaaaatacacaa

SEQ ID NO: 11937 - DNA, 20 bp, Artificial Sequence
  Description of Artificial Sequence: Synthetic oligonucleotide
  Target: SCN10A; (+) strand; PAM type: NNNNGHTT; PAM sequence: CTGTGTTT
tgccctgcccagaaatctgg

SEQ ID NO: 11938 - DNA, 20 bp, Artificial Sequence
  Description of Artificial Sequence: Synthetic oligonucleotide
  Target: SCN10A; (+) strand; PAM type: NNNNGHTT; PAM sequence: GACTGTTT
attccttcattcttccagat

SEQ ID NO: 11939 - DNA, 20 bp, Artificial Sequence
  Description of Artificial Sequence: Synthetic oligonucleotide
  Target: SCN10A; (+) strand; PAM type: NNNNGHTT; PAM sequence: ACATGCTT
ccattgccatgagcaggtaa

SEQ ID NO: 11940 - DNA, 20 bp, Artificial Sequence
  Description of Artificial Sequence: Synthetic oligonucleotide
  Target: SCN10A; (+) strand; PAM type: NNNNGHTT; PAM sequence: CGCGGCTT
taaacatgctttaattatct

SEQ ID NO: 11941 - DNA, 20 bp, Artificial Sequence
  Description of Artificial Sequence: Synthetic oligonucleotide
  Target: SCN10A; (+) strand; PAM type: NNNNGHTT; PAM sequence: TACTGCTT
gaccccatgctctctttcat

SEQ ID NO: 11942 - DNA, 20 bp, Artificial Sequence
  Description of Artificial Sequence: Synthetic oligonucleotide
  Target: SCN10A; (+) strand; PAM type: NNNNGHTT; PAM sequence: AAGAGTTT
ttgacagtaaaattccttgc

SEQ ID NO: 11943 - DNA, 20 bp, Artificial Sequence
  Description of Artificial Sequence: Synthetic oligonucleotide
  Target: SCN10A; (+) strand; PAM type: NNNNGHTT; PAM sequence: AACTGCTT
agcccctggaatctgacttt

SEQ ID NO: 11944 - DNA, 20 bp, Artificial Sequence
  Description of Artificial Sequence: Synthetic oligonucleotide
  Target: SCN10A; (+) strand; PAM type: NNNNGHTT; PAM sequence: AATTGATT
aactgcttccaaattcaaat

SEQ ID NO: 11945 - DNA, 20 bp, Artificial Sequence
  Description of Artificial Sequence: Synthetic oligonucleotide
  Target: SCN10A; (+) strand; PAM type: NNNNGHTT; PAM sequence: TCTTGCTT
gctctggggactgcatcatc

SEQ ID NO: 11946 - DNA, 20 bp, Artificial Sequence
  Description of Artificial Sequence: Synthetic oligonucleotide
  Target: SCN10A; (+) strand; PAM type: NNNNGHTT; PAM sequence: TTCTGTTT
tttctccacttcttttcact

SEQ ID NO: 11947 - DNA, 20 bp, Artificial Sequence
  Description of Artificial Sequence: Synthetic oligonucleotide
  Target: SCN10A; (+) strand; PAM type: NNNNGHTT; PAM sequence: TCCTGCTT
tttttgtctcccttttcctt

SEQ ID NO: 11948 - DNA, 20 bp, Artificial Sequence
  Description of Artificial Sequence: Synthetic oligonucleotide
  Target: SCN10A; (+) strand; PAM type: NNNNGHTT; PAM sequence: CTTAGCTT
aataactcaagcattctcac

SEQ ID NO: 11949 - DNA, 20 bp, Artificial Sequence
  Description of Artificial Sequence: Synthetic oligonucleotide
  Target: SCN10A; (+) strand; PAM type: NNNNGHTT; PAM sequence: CTGTGTTT
gcattctcaccttagcttct

SEQ ID NO: 11950 - DNA, 20 bp, Artificial Sequence
  Description of Artificial Sequence: Synthetic oligonucleotide
  Target: SCN10A; (+) strand; PAM type: NNNNGHTT; PAM sequence: CTAGGCTT
ttctgatcccttcctgaaca

SEQ ID NO: 11951 - DNA, 20 bp, Artificial Sequence
  Description of Artificial Sequence: Synthetic oligonucleotide
  Target: SCN10A; (+) strand; PAM type: NNNNGHTT; PAM sequence: CTTAGCTT
acctcgatggagggcaattt

SEQ ID NO: 11952 - DNA, 20 bp, Artificial Sequence
  Description of Artificial Sequence: Synthetic oligonucleotide
  Target: SCN10A; (+) strand; PAM type: NNNNGHTT; PAM sequence: TTAGGTTT
tggagggcaatttcttagct

SEQ ID NO: 11953 - DNA, 20 bp, Artificial Sequence
  Description of Artificial Sequence: Synthetic oligonucleotide
  Target: SCN10A; (+) strand; PAM type: NNNNGHTT; PAM sequence: CATTGTTT
gggcaaagaaagatgatgtc

SEQ ID NO: 11954 - DNA, 20 bp, Artificial Sequence
  Description of Artificial Sequence: Synthetic oligonucleotide
  Target: SCN10A; (+) strand; PAM type: NNNNGHTT; PAM sequence: GGCAGATT
tacattgtgaaaaagaatga

SEQ ID NO: 11955 - DNA, 20 bp, Artificial Sequence
  Description of Artificial Sequence: Synthetic oligonucleotide
  Target: SCN10A; (+) strand; PAM type: NNNNGHTT; PAM sequence: ATGTGCTT
tagtgtgtgtatgtgcatgc

SEQ ID NO: 11956 - DNA, 20 bp, Artificial Sequence
  Description of Artificial Sequence: Synthetic oligonucleotide
  Target: SCN10A; (+) strand; PAM type: NNNNGHTT; PAM sequence: CATTGCTT
gtgcttatatatgcatagaa

SEQ ID NO: 11957 - DNA, 20 bp, Artificial Sequence
  Description of Artificial Sequence: Synthetic oligonucleotide
  Target: SCN10A; (+) strand; PAM type: NNNNGHTT; PAM sequence: CAGTGTTT
tgtcattgcatacacacttg

SEQ ID NO: 11958 - DNA, 20 bp, Artificial Sequence
  Description of Artificial Sequence: Synthetic oligonucleotide
  Target: SCN10A; (+) strand; PAM type: NNNNGHTT; PAM sequence: TAGGGTTT
gcatacacacttgcagtgtt

SEQ ID NO: 11959 - DNA, 20 bp, Artificial Sequence
  Description of Artificial Sequence: Synthetic oligonucleotide
  Target: SCN10A; (+) strand; PAM type: NNNNGHTT; PAM sequence: ATCAGTTT
ttactatatgcacttgaaaa

SEQ ID NO: 11960 - DNA, 20 bp, Artificial Sequence
  Description of Artificial Sequence: Synthetic oligonucleotide
  Target: SCN10A; (+) strand; PAM type: NNNNGHTT; PAM sequence: CAGTGTTT
gtgcccccaaattttgctaa

SEQ ID NO: 11961 - DNA, 20 bp, Artificial Sequence
  Description of Artificial Sequence: Synthetic oligonucleotide
  Target: SCN10A; (+) strand; PAM type: NNNNGHTT; PAM sequence: TCAAGATT
atttaaaaatgtgtatgtag

SEQ ID NO: 11962 - DNA, 20 bp, Artificial Sequence
  Description of Artificial Sequence: Synthetic oligonucleotide
  Target: SCN10A; (+) strand; PAM type: NNNNGHTT; PAM sequence: ATTTGTTT
gatttatcagtagtattttt

SEQ ID NO: 11963 - DNA, 20 bp, Artificial Sequence
  Description of Artificial Sequence: Synthetic oligonucleotide
  Target: SCN10A; (+) strand; PAM type: NNNNGHTT; PAM sequence: TTAAGTTT
ttctttttttaaattatact

SEQ ID NO: 11964 - DNA, 20 bp, Artificial Sequence
  Description of Artificial Sequence: Synthetic oligonucleotide
  Target: SCN10A; (+) strand; PAM type: NNNNGHTT; PAM sequence: TGAAGCTT
atgcatacatgccttacata

SEQ ID NO: 11965 - DNA, 20 bp, Artificial Sequence
  Description of Artificial Sequence: Synthetic oligonucleotide
  Target: SCN10A; (+) strand; PAM type: NNNNGHTT; PAM sequence: CAAGGCTT
atatgaagcttttctcacta

SEQ ID NO: 11966 - DNA, 20 bp, Artificial Sequence
  Description of Artificial Sequence: Synthetic oligonucleotide
  Target: SCN10A; (+) strand; PAM type: NNNNGHTT; PAM sequence: CCATGTTT
aggcttggaaaataccttct

SEQ ID NO: 11967 - DNA, 20 bp, Artificial Sequence
  Description of Artificial Sequence: Synthetic oligonucleotide
  Target: SCN10A; (+) strand; PAM type: NNNNGHTT; PAM sequence: TGTAGTTT
ccatgtttttttctttcttt

SEQ ID NO: 11968 - DNA, 20 bp, Artificial Sequence
  Description of Artificial Sequence: Synthetic oligonucleotide
  Target: SCN10A; (+) strand; PAM type: NNNNGHTT; PAM sequence: TGTGGTTT
ggtaaagagtaagatattga

SEQ ID NO: 11969 - DNA, 20 bp, Artificial Sequence
  Description of Artificial Sequence: Synthetic oligonucleotide
  Target: SCN10A; (+) strand; PAM type: NNNNGHTT; PAM sequence: CTCTGATT
tgtggtttattttttcctgt

SEQ ID NO: 11970 - DNA, 20 bp, Artificial Sequence
  Description of Artificial Sequence: Synthetic oligonucleotide
  Target: SCN10A; (+) strand; PAM type: NNNNGHTT; PAM sequence: CCAAGATT
ttgaataatttttcattttc

SEQ ID NO: 11971 - DNA, 20 bp, Artificial Sequence
  Description of Artificial Sequence: Synthetic oligonucleotide
  Target: SCN10A; (+) strand; PAM type: NNNNGHTT; PAM sequence: ATGTGTTT
tgttattaccatttatgttc

SEQ ID NO: 11972 - DNA, 20 bp, Artificial Sequence
  Description of Artificial Sequence: Synthetic oligonucleotide
  Target: SCN10A; (+) strand; PAM type: NNNNGHTT; PAM sequence: TGCTGTTT
actatttattttcactgtca

SEQ ID NO: 11973 - DNA, 20 bp, Artificial Sequence
  Description of Artificial Sequence: Synthetic oligonucleotide
  Target: SCN10A; (+) strand; PAM type: NNNNGHTT; PAM sequence: ACTGGATT
tcatgctgttttaatcactg

SEQ ID NO: 11974 - DNA, 20 bp, Artificial Sequence
  Description of Artificial Sequence: Synthetic oligonucleotide
  Target: SCN10A; (+) strand; PAM type: NNNNGHTT; PAM sequence: CCCTGTTT
ctgggaccaaaatcaacaat

SEQ ID NO: 11975 - DNA, 20 bp, Artificial Sequence
  Description of Artificial Sequence: Synthetic oligonucleotide
  Target: SCN10A; (+) strand; PAM type: NNNNGHTT; PAM sequence: ACTTGATT
aacagccttgacattgttga

SEQ ID NO: 11976 - DNA, 20 bp, Artificial Sequence
  Description of Artificial Sequence: Synthetic oligonucleotide
  Target: SCN10A; (+) strand; PAM type: NNNNGHTT; PAM sequence: GATTGATT
gccttgacattgttgaactt

SEQ ID NO: 11977 - DNA, 20 bp, Artificial Sequence
  Description of Artificial Sequence: Synthetic oligonucleotide
  Target: SCN10A; (+) strand; PAM type: NNNNGHTT; PAM sequence: GCCAGCTT
gagactaaaagtatctactt

SEQ ID NO: 11978 - DNA, 20 bp, Artificial Sequence
  Description of Artificial Sequence: Synthetic oligonucleotide
  Target: SCN10A; (+) strand; PAM type: NNNNGHTT; PAM sequence: TTACGCTT
actttcctcccttcatcctg

SEQ ID NO: 11979 - DNA, 20 bp, Artificial Sequence
  Description of Artificial Sequence: Synthetic oligonucleotide
  Target: SCN10A; (+) strand; PAM type: NNNNGHTT; PAM sequence: TTTTGCTT
cttttactccattaatcctc

SEQ ID NO: 11980 - DNA, 20 bp, Artificial Sequence
  Description of Artificial Sequence: Synthetic oligonucleotide
  Target: SCN10A; (+) strand; PAM type: NNNNGHTT; PAM sequence: TCATGTTT
actaaagcccctggaccttt

SEQ ID NO: 11981 - DNA, 20 bp, Artificial Sequence
  Description of Artificial Sequence: Synthetic oligonucleotide
  Target: SCN10A; (+) strand; PAM type: NNNNGHTT; PAM sequence: TTCTGCTT
tcctctgctgggtccatctc

SEQ ID NO: 11982 - DNA, 20 bp, Artificial Sequence
  Description of Artificial Sequence: Synthetic oligonucleotide
  Target: SCN10A; (+) strand; PAM type: NNNNGHTT; PAM sequence: TTTAGTTT
ttctgcttaactattaaaca

SEQ ID NO: 11983 - DNA, 20 bp, Artificial Sequence
  Description of Artificial Sequence: Synthetic oligonucleotide
  Target: SCN10A; (+) strand; PAM type: NNNNGHTT; PAM sequence: AACTGCTT
aaaattaccacttacattca

SEQ ID NO: 11984 - DNA, 20 bp, Artificial Sequence
  Description of Artificial Sequence: Synthetic oligonucleotide
  Target: SCN10A; (+) strand; PAM type: NNNNGHTT; PAM sequence: CTTGGCTT
tcaagcactgccatcttgta

SEQ ID NO: 11985 - DNA, 20 bp, Artificial Sequence
  Description of Artificial Sequence: Synthetic oligonucleotide
  Target: SCN10A; (+) strand; PAM type: NNNNGHTT; PAM sequence: ACTGGTTT
ttgtacttggcttcctccta

SEQ ID NO: 11986 - DNA, 20 bp, Artificial Sequence
  Description of Artificial Sequence: Synthetic oligonucleotide
  Target: SCN10A; (+) strand; PAM type: NNNNGHTT; PAM sequence: AGGAGTTT
ccatatccttaatgcagtct

SEQ ID NO: 11987 - DNA, 20 bp, Artificial Sequence
  Description of Artificial Sequence: Synthetic oligonucleotide
  Target: SCN10A; (+) strand; PAM type: NNNNGHTT; PAM sequence: TTAGGCTT
ttctctaggttacagctaca

SEQ ID NO: 11988 - DNA, 20 bp, Artificial Sequence
  Description of Artificial Sequence: Synthetic oligonucleotide
  Target: SCN10A; (+) strand; PAM type: NNNNGHTT; PAM sequence: TTCTGCTT
ccttcaaatgttattctctc

SEQ ID NO: 11989 - DNA, 20 bp, Artificial Sequence
  Description of Artificial Sequence: Synthetic oligonucleotide
  Target: SCN10A; (+) strand; PAM type: NNNNGHTT; PAM sequence: CCCAGCTT
cagtaagctcactgctgtga

SEQ ID NO: 11990 - DNA, 20 bp, Artificial Sequence
  Description of Artificial Sequence: Synthetic oligonucleotide
  Target: SCN10A; (+) strand; PAM type: NNNNGHTT; PAM sequence: TCTGGCTT
tgtgacccagcttctggaat

SEQ ID NO: 11991 - DNA, 20 bp, Artificial Sequence
  Description of Artificial Sequence: Synthetic oligonucleotide
  Target: SCN10A; (+) strand; PAM type: NNNNGHTT; PAM sequence: CTCAGCTT
ggcttggacaacagtgaaat

SEQ ID NO: 11992 - DNA, 20 bp, Artificial Sequence
  Description of Artificial Sequence: Synthetic oligonucleotide
  Target: SCN10A; (+) strand; PAM type: NNNNGHTT; PAM sequence: ACATGCTT
atgccaagcatagaaggttc

SEQ ID NO: 11993 - DNA, 20 bp, Artificial Sequence
  Description of Artificial Sequence: Synthetic oligonucleotide
  Target: SCN10A; (+) strand; PAM type: NNNNGHTT; PAM sequence: GTTGGTTT
cagtgaattgtcaaactcct

SEQ ID NO: 11994 - DNA, 20 bp, Artificial Sequence
  Description of Artificial Sequence: Synthetic oligonucleotide
  Target: SCN10A; (+) strand; PAM type: NNNNGHTT; PAM sequence: TAAGGTTT
ttgacctcttttatttaacc

SEQ ID NO: 11995 - DNA, 20 bp, Artificial Sequence
  Description of Artificial Sequence: Synthetic oligonucleotide
  Target: SCN10A; (+) strand; PAM type: NNNNGHTT; PAM sequence: CTCAGATT
ttaacctaaggtttcctctc

SEQ ID NO: 11996 - DNA, 20 bp, Artificial Sequence
  Description of Artificial Sequence: Synthetic oligonucleotide
  Target: SCN10A; (+) strand; PAM type: NNNNGHTT; PAM sequence: CATTGTTT
tcagattttctttaaaacat

SEQ ID NO: 11997 - DNA, 20 bp, Artificial Sequence
  Description of Artificial Sequence: Synthetic oligonucleotide
  Target: SCN10A; (+) strand; PAM type: NNNNGHTT; PAM sequence: CATAGATT
aacagacacatctccgccct

SEQ ID NO: 11998 - DNA, 20 bp, Artificial Sequence
  Description of Artificial Sequence: Synthetic oligonucleotide
  Target: SCN10A; (+) strand; PAM type: NNNNGHTT; PAM sequence: TTTTGCTT
gccagtcgtggttctaagca

SEQ ID NO: 11999 - DNA, 20 bp, Artificial Sequence
  Description of Artificial Sequence: Synthetic oligonucleotide
  Target: SCN10A; (+) strand; PAM type: NNNNGHTT; PAM sequence: ATGTGTTT
tttgtcttacctacactggg

SEQ ID NO: 12000 - DNA, 20 bp, Artificial Sequence
  Description of Artificial Sequence: Synthetic oligonucleotide
  Target: SCN10A; (+) strand; PAM type: NNNNGHTT; PAM sequence: TTTTGCTT
ggatgtgtttgggacatgca

SEQ ID NO: 12001 - DNA, 20 bp, Artificial Sequence
  Description of Artificial Sequence: Synthetic oligonucleotide
  Target: SCN10A; (+) strand; PAM type: NNNNGHTT; PAM sequence: CTCAGCTT
ttgtgtctgcgaactttctc

SEQ ID NO: 12002 - DNA, 20 bp, Artificial Sequence
  Description of Artificial Sequence: Synthetic oligonucleotide
  Target: SCN10A; (+) strand; PAM type: NNNNGHTT; PAM sequence: AGCTGATT
ttctcctcagcttcttacat

SEQ ID NO: 12003 - DNA, 20 bp, Artificial Sequence
  Description of Artificial Sequence: Synthetic oligonucleotide
  Target: SCN10A; (+) strand; PAM type: NNNNGHTT; PAM sequence: TGTAGATT
tgtccccttccctgctagga

SEQ ID NO: 12004 - DNA, 20 bp, Artificial Sequence
  Description of Artificial Sequence: Synthetic oligonucleotide
  Target: SCN10A; (+) strand; PAM type: NNNNGHTT; PAM sequence: GCAAGCTT
aggatgtagattccatgagc

SEQ ID NO: 12005 - DNA, 20 bp, Artificial Sequence
  Description of Artificial Sequence: Synthetic oligonucleotide
  Target: SCN10A; (+) strand; PAM type: NNNNGHTT; PAM sequence: AAATGCTT
acacacaacaggggctcaac

SEQ ID NO: 12006 - DNA, 20 bp, Artificial Sequence
  Description of Artificial Sequence: Synthetic oligonucleotide
  Target: SCN10A; (+) strand; PAM type: NNNNGHTT; PAM sequence: GGAAGCTT
aatgaaagaagagagaagga

SEQ ID NO: 12007 - DNA, 20 bp, Artificial Sequence
  Description of Artificial Sequence: Synthetic oligonucleotide
  Target: SCN10A; (+) strand; PAM type: NNNNGHTT; PAM sequence: AACAGTTT
aagagagaaggaggaagctt

SEQ ID NO: 12008 - DNA, 20 bp, Artificial Sequence
  Description of Artificial Sequence: Synthetic oligonucleotide
  Target: SCN10A; (+) strand; PAM type: NNNNGHTT; PAM sequence: AACTGTTT
gagaataaatgaaaaaaaca

SEQ ID NO: 12009 - DNA, 20 bp, Artificial Sequence
  Description of Artificial Sequence: Synthetic oligonucleotide
  Target: SCN10A; (+) strand; PAM type: NNNNGHTT; PAM sequence: CAATGTTT
aaaaacaaactgtttgtatt

SEQ ID NO: 12010 - DNA, 20 bp, Artificial Sequence
  Description of Artificial Sequence: Synthetic oligonucleotide
  Target: SCN10A; (+) strand; PAM type: NNNNGHTT; PAM sequence: TGCTGTTT
aactgtttgtattcaatgtt

SEQ ID NO: 12011 - DNA, 20 bp, Artificial Sequence
  Description of Artificial Sequence: Synthetic oligonucleotide
  Target: SCN10A; (+) strand; PAM type: NNNNGHTT; PAM sequence: AGCAGCTT
aagaaagaaattgtgggaat

SEQ ID NO: 12012 - DNA, 20 bp, Artificial Sequence
  Description of Artificial Sequence: Synthetic oligonucleotide
  Target: SCN10A; (+) strand; PAM type: NNNNGHTT; PAM sequence: TTATGCTT
gtaacttagttgaattcaat

SEQ ID NO: 12013 - DNA, 20 bp, Artificial Sequence
  Description of Artificial Sequence: Synthetic oligonucleotide
  Target: SCN10A; (+) strand; PAM type: NNNNGHTT; PAM sequence: CTGAGTTT
ttcaatatctgagtctgtgt

SEQ ID NO: 12014 - DNA, 20 bp, Artificial Sequence
  Description of Artificial Sequence: Synthetic oligonucleotide
  Target: SCN10A; (+) strand; PAM type: NNNNGHTT; PAM sequence: TCTAGTTT
atgaagatggctcttctctc

SEQ ID NO: 12015 - DNA, 20 bp, Artificial Sequence
  Description of Artificial Sequence: Synthetic oligonucleotide
  Target: SCN10A; (+) strand; PAM type: NNNNGHTT; PAM sequence: GGCTGCTT
agccacagggctctctctga

SEQ ID NO: 12016 - DNA, 20 bp, Artificial Sequence
  Description of Artificial Sequence: Synthetic oligonucleotide
  Target: SCN10A; (+) strand; PAM type: NNNNGHTT; PAM sequence: CCCAGATT
ctaagctaaggttgcctttc

SEQ ID NO: 12017 - DNA, 20 bp, Artificial Sequence
  Description of Artificial Sequence: Synthetic oligonucleotide
  Target: SCN10A; (+) strand; PAM type: NNNNGHTT; PAM sequence: CTTTGTTT
ccagattttcttaaaaacgt

SEQ ID NO: 12018 - DNA, 20 bp, Artificial Sequence
  Description of Artificial Sequence: Synthetic oligonucleotide
  Target: SCN10A; (+) strand; PAM type: NNNNGHTT; PAM sequence: ATCAGTTT
tccttattttcttccttttt

SEQ ID NO: 12019 - DNA, 20 bp, Artificial Sequence
  Description of Artificial Sequence: Synthetic oligonucleotide
  Target: SCN10A; (+) strand; PAM type: NNNNGHTT; PAM sequence: TACAGTTT
attactggctagttctactc

SEQ ID NO: 12020 - DNA, 20 bp, Artificial Sequence
  Description of Artificial Sequence: Synthetic oligonucleotide
  Target: SCN10A; (+) strand; PAM type: NNNNGHTT; PAM sequence: TAAGGCTT
tgtgcatgtgaatctctctc

SEQ ID NO: 12021 - DNA, 20 bp, Artificial Sequence
  Description of Artificial Sequence: Synthetic oligonucleotide
  Target: SCN10A; (+) strand; PAM type: NNNNGHTT; PAM sequence: TCTGGCTT
tctctctaaggcttgccacc

SEQ ID NO: 12022 - DNA, 20 bp, Artificial Sequence
  Description of Artificial Sequence: Synthetic oligonucleotide
  Target: SCN10A; (+) strand; PAM type: NNNNGHTT; PAM sequence: CTCTGTTT
gaaagtagggcacacattgg

SEQ ID NO: 12023 - DNA, 20 bp, Artificial Sequence
  Description of Artificial Sequence: Synthetic oligonucleotide
  Target: SCN10A; (+) strand; PAM type: NNNNGHTT; PAM sequence: TTTGGTTT
tgaaatccctcaaacatttt

SEQ ID NO: 12024 - DNA, 20 bp, Artificial Sequence
  Description of Artificial Sequence: Synthetic oligonucleotide
  Target: SCN10A; (+) strand; PAM type: NNNNGHTT; PAM sequence: TTAGGATT
caccacttcttcccctcaaa

SEQ ID NO: 12025 - DNA, 20 bp, Artificial Sequence
  Description of Artificial Sequence: Synthetic oligonucleotide
  Target: SCN10A; (+) strand; PAM type: NNNNGHTT; PAM sequence: GTCAGTTT
ttacaactcctccagcctag

SEQ ID NO: 12026 - DNA, 20 bp, Artificial Sequence
  Description of Artificial Sequence: Synthetic oligonucleotide
  Target: SCN10A; (+) strand; PAM type: NNNNGHTT; PAM sequence: GCTGGATT
ataccctaaggcaaaaaaag

SEQ ID NO: 12027 - DNA, 20 bp, Artificial Sequence
  Description of Artificial Sequence: Synthetic oligonucleotide
  Target: SCN10A; (+) strand; PAM type: NNNNGHTT; PAM sequence: TTTGGCTT
gccactctcttcctctaccc

SEQ ID NO: 12028 - DNA, 20 bp, Artificial Sequence
  Description of Artificial Sequence: Synthetic oligonucleotide
  Target: SCN10A; (+) strand; PAM type: NNNNGHTT; PAM sequence: AGTGGATT
atacattgctggggagactg

SEQ ID NO: 12029 - DNA, 20 bp, Artificial Sequence
  Description of Artificial Sequence: Synthetic oligonucleotide
  Target: SCN10A; (+) strand; PAM type: NNNNGHTT; PAM sequence: ACTTGATT
gggagactgagtggattccc

SEQ ID NO: 12030 - DNA, 20 bp, Artificial Sequence
  Description of Artificial Sequence: Synthetic oligonucleotide
  Target: SCN10A; (+) strand; PAM type: NNNNGHTT; PAM sequence: GACTGATT
aacaaggacttagttaaatt

SEQ ID NO: 12031 - DNA, 20 bp, Artificial Sequence
  Description of Artificial Sequence: Synthetic oligonucleotide
  Target: SCN10A; (+) strand; PAM type: NNNNGHTT; PAM sequence: GTGGGCTT
ctaccaatattcagcataat

SEQ ID NO: 12032 - DNA, 20 bp, Artificial Sequence
  Description of Artificial Sequence: Synthetic oligonucleotide
  Target: SCN10A; (+) strand; PAM type: NNNNGHTT; PAM sequence: TCTAGTTT
tgccagatcacttttaaaaa

SEQ ID NO: 12033 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
atattttattcatcaaatta

SEQ ID NO: 12034 - DNA, 20 bp, Artificial Sequence
  Description of Artificial Sequence: Synthetic oligonucleotide
  Target: SCN10A; (+) strand; PAM type: NNNNGHTT; PAM sequence: GGACGCTT
gaattccagtacacagagat

SEQ ID NO: 12035 - DNA, 20 bp, Artificial Sequence
  Description of Artificial Sequence: Synthetic oligonucleotide
  Target: SCN10A; (+) strand; PAM type: NNNNGHTT; PAM sequence: CATTGCTT
gctttgacacgagttagaga

SEQ ID NO: 12036 - DNA, 20 bp, Artificial Sequence
  Description of Artificial Sequence: Synthetic oligonucleotide
  Target: SCN10A; (+) strand; PAM type: NNNNGHTT; PAM sequence: AGGTGATT
gttctgacaaatacatcatt

SEQ ID NO: 12037 - DNA, 20 bp, Artificial Sequence
  Description of Artificial Sequence: Synthetic oligonucleotide
  Target: SCN10A; (+) strand; PAM type: NNNNGHTT; PAM sequence: GAAAGTTT
aaacagttaataaacataaa

SEQ ID NO: 12038 - DNA, 20 bp, Artificial Sequence
  Description of Artificial Sequence: Synthetic oligonucleotide
  Target: SCN10A; (+) strand; PAM type: NNNNGHTT; PAM sequence: TAAAGCTT
ataaacataaagaaagttta

SEQ ID NO: 12039 - DNA, 20 bp, Artificial Sequence
  Description of Artificial Sequence: Synthetic oligonucleotide
  Target: SCN10A; (+) strand; PAM type: NNNNGHTT; PAM sequence: GGAGGCTT
ctttttacaaggggagataa

SEQ ID NO: 12040 - DNA, 20 bp, Artificial Sequence
  Description of Artificial Sequence: Synthetic oligonucleotide
  Target: SCN10A; (+) strand; PAM type: NNNNGHTT; PAM sequence: CTCTGTTT
ggatgcctttgactttaagg

SEQ ID NO: 12041 - DNA, 20 bp, Artificial Sequence
  Description of Artificial Sequence: Synthetic oligonucleotide
  Target: SCN10A; (+) strand; PAM type: NNNNGHTT; PAM sequence: TGGTGATT
ttgactttaaggctctgttt

SEQ ID NO: 12042 - DNA, 20 bp, Artificial Sequence
  Description of Artificial Sequence: Synthetic oligonucleotide
  Target: SCN10A; (+) strand; PAM type: NNNNGHTT; PAM sequence: CCAGGTTT
tccttaccctctggttctgg

SEQ ID NO: 12043 - DNA, 20 bp, Artificial Sequence
  Description of Artificial Sequence: Synthetic oligonucleotide
  Target: SCN10A; (+) strand; PAM type: NNNNGHTT; PAM sequence: CCTGGCTT
agacaagtcaggtattttcc

SEQ ID NO: 12044 - DNA, 20 bp, Artificial Sequence
  Description of Artificial Sequence: Synthetic oligonucleotide
  Target: SCN10A; (+) strand; PAM type: NNNNGHTT; PAM sequence: AACAGCTT
tcccttcagcctaggcatgt

SEQ ID NO: 12045 - DNA, 20 bp, Artificial Sequence
  Description of Artificial Sequence: Synthetic oligonucleotide
  Target: SCN10A; (+) strand; PAM type: NNNNGHTT; PAM sequence: ACTAGTTT
tgtaacagcttccccctgtt

SEQ ID NO: 12046 - DNA, 20 bp, Artificial Sequence
  Description of Artificial Sequence: Synthetic oligonucleotide
  Target: SCN10A; (+) strand; PAM type: NNNNGHTT; PAM sequence: ATCTGTTT
ttagcccatcggagtggtcc

SEQ ID NO: 12047 - DNA, 20 bp, Artificial Sequence
  Description of Artificial Sequence: Synthetic oligonucleotide
  Target: SCN10A; (+) strand; PAM type: NNNNGHTT; PAM sequence: CTGCGATT
ccctgacttgccattacact

SEQ ID NO: 12048 - DNA, 20 bp, Artificial Sequence
  Description of Artificial Sequence: Synthetic oligonucleotide
  Target: SCN10A; (+) strand; PAM type: NNNNGHTT; PAM sequence: CTGTGCTT
tgtgagtaaagcaaggaata

SEQ ID NO: 12049 - DNA, 20 bp, Artificial Sequence
  Description of Artificial Sequence: Synthetic oligonucleotide
  Target: SCN10A; (+) strand; PAM type: NNNNGHTT; PAM sequence: AAGAGTTT
gtgccatttgcccagcctag

SEQ ID NO: 12050 - DNA, 20 bp, Artificial Sequence
  Description of Artificial Sequence: Synthetic oligonucleotide
  Target: SCN10A; (+) strand; PAM type: NNNNGHTT; PAM sequence: TTCAGTTT
aagcaggaagagaagggtcc

SEQ ID NO: 12051 - DNA, 20 bp, Artificial Sequence
  Description of Artificial Sequence: Synthetic oligonucleotide
  Target: SCN10A; (+) strand; PAM type: NNNNGHTT; PAM sequence: ACCTGTTT
actgcagaataaaccaggaa

SEQ ID NO: 12052 - DNA, 20 bp, Artificial Sequence
  Description of Artificial Sequence: Synthetic oligonucleotide
  Target: SCN10A; (+) strand; PAM type: NNNNGHTT; PAM sequence: TCAGGCTT
atcccttccattggtgatac

SEQ ID NO: 12053 - DNA, 20 bp, Artificial Sequence
  Description of Artificial Sequence: Synthetic oligonucleotide
  Target: SCN10A; (+) strand; PAM type: NNNNGHTT; PAM sequence: CAAGGCTT
gatactcaggcttcttggct

SEQ ID NO: 12054 - DNA, 20 bp, Artificial Sequence
  Description of Artificial Sequence: Synthetic oligonucleotide
  Target: SCN10A; (+) strand; PAM type: NNNNGHTT; PAM sequence: GAGGGCTT
agggttgctgggttgaggaa

SEQ ID NO: 12055 - DNA, 20 bp, Artificial Sequence
  Description of Artificial Sequence: Synthetic oligonucleotide
  Target: SCN10A; (+) strand; PAM type: NNNNGHTT; PAM sequence: GATGGCTT
acccagcagcagagagcccc

SEQ ID NO: 12056 - DNA, 20 bp, Artificial Sequence
  Description of Artificial Sequence: Synthetic oligonucleotide
  Target: SCN10A; (+) strand; PAM type: NNNNGHTT; PAM sequence: CGGCGTTT
acacactgccatgactagcc

SEQ ID NO: 12057 - DNA, 20 bp, Artificial Sequence
  Description of Artificial Sequence: Synthetic oligonucleotide
  Target: SCN10A; (+) strand; PAM type: NNNNGHTT; PAM sequence: GAGAGATT
cgggaaagaccaggagagag

SEQ ID NO: 12058 - DNA, 20 bp, Artificial Sequence
  Description of Artificial Sequence: Synthetic oligonucleotide
  Target: SCN10A; (+) strand; PAM type: NNNNGHTT; PAM sequence: AGTTGATT
ccttgtcacctggatagttc

SEQ ID NO: 12059 - DNA, 20 bp, Artificial Sequence
  Description of Artificial Sequence: Synthetic oligonucleotide
  Target: SCN10A; (+) strand; PAM type: NNNNGHTT; PAM sequence: GAGAGTTT
gatcccatctgtatgaatgt

SEQ ID NO: 12060 - DNA, 20 bp, Artificial Sequence
  Description of Artificial Sequence: Synthetic oligonucleotide
  Target: SCN10A; (+) strand; PAM type: NNNNGHTT; PAM sequence: ATGAGTTT
gacaagagctgtacagtgca

SEQ ID NO: 12061 - DNA, 20 bp, Artificial Sequence
  Description of Artificial Sequence: Synthetic oligonucleotide
  Target: SCN10A; (+) strand; PAM type: NNNNGHTT; PAM sequence: CGAGGCTT
aatgagtttctaggatccct

SEQ ID NO: 12062 - DNA, 20 bp, Artificial Sequence
  Description of Artificial Sequence: Synthetic oligonucleotide
  Target: SCN10A; (+) strand; PAM type: NNNNGHTT; PAM sequence: TGTGGCTT
atcttccattgagggaactg

SEQ ID NO: 12063 - DNA, 20 bp, Artificial Sequence
  Description of Artificial Sequence: Synthetic oligonucleotide
  Target: SCN10A; (+) strand; PAM type: NNNNGHTT; PAM sequence: TACCGATT
ttcataccaaactctgatca

SEQ ID NO: 12064 - DNA, 20 bp, Artificial Sequence
  Description of Artificial Sequence: Synthetic oligonucleotide
  Target: SCN10A; (+) strand; PAM type: NNNNGHTT; PAM sequence: TGAAGTTT
atccccttatctcacagaac

SEQ ID NO: 12065 - DNA, 20 bp, Artificial Sequence
  Description of Artificial Sequence: Synthetic oligonucleotide
  Target: SCN10A; (+) strand; PAM type: NNNNGHTT; PAM sequence: TCCTGTTT
cttgataatttgaagcctga

SEQ ID NO: 12066 - DNA, 20 bp, Artificial Sequence
  Description of Artificial Sequence: Synthetic oligonucleotide
  Target: SCN10A; (+) strand; PAM type: NNNNGHTT; PAM sequence: TAAGGTTT
gccacgagttattttagaat

SEQ ID NO: 12067 - DNA, 20 bp, Artificial Sequence
  Description of Artificial Sequence: Synthetic oligonucleotide
  Target: SCN10A; (+) strand; PAM type: NNNNGHTT; PAM sequence: AATTGCTT
cttctgagtataagcattag

SEQ ID NO: 12068 - DNA, 20 bp, Artificial Sequence
  Description of Artificial Sequence: Synthetic oligonucleotide
  Target: SCN10A; (+) strand; PAM type: NNNNGHTT; PAM sequence: CTGTGATT
ctctaacgagaccaactggt

SEQ ID NO: 12069 - DNA, 20 bp, Artificial Sequence
  Description of Artificial Sequence: Synthetic oligonucleotide
  Target: SCN10A; (+) strand; PAM type: NNNNGHTT; PAM sequence: AATGGCTT
ttaatttctattggttataa

SEQ ID NO: 12070 - DNA, 20 bp, Artificial Sequence
  Description of Artificial Sequence: Synthetic oligonucleotide
  Target: SCN10A; (+) strand; PAM type: NNNNGHTT; PAM sequence: GGATGTTT
ctatccagccccataagagt

SEQ ID NO: 12071 - DNA, 20 bp, Artificial Sequence
  Description of Artificial Sequence: Synthetic oligonucleotide
  Target: SCN10A; (+) strand; PAM type: NNNNGHTT; PAM sequence: CCCTGATT
cataagagtggatgtttctt

SEQ ID NO: 12072 - DNA, 20 bp, Artificial Sequence
  Description of Artificial Sequence: Synthetic oligonucleotide
  Target: SCN10A; (+) strand; PAM type: NNNNGHTT; PAM sequence: CTGTGTTT
atacactatttaacacatag

SEQ ID NO: 12073 - DNA, 20 bp, Artificial Sequence
  Description of Artificial Sequence: Synthetic oligonucleotide
  Target: SCN10A; (+) strand; PAM type: NNNNGHTT; PAM sequence: CTGTGATT
cattgacatttccatggaag

SEQ ID NO: 12074 - DNA, 20 bp, Artificial Sequence
  Description of Artificial Sequence: Synthetic oligonucleotide
  Target: SCN10A; (+) strand; PAM type: NNNNGHTT; PAM sequence: CTGTGATT
aagctgtgattcatcctgtt

SEQ ID NO: 12075 - DNA, 20 bp, Artificial Sequence
  Description of Artificial Sequence: Synthetic oligonucleotide
  Target: SCN10A; (+) strand; PAM type: NNNNGHTT; PAM sequence: CTGTGTTT
cagtgtgcatgcaagtgtgt

SEQ ID NO: 12076 - DNA, 20 bp, Artificial Sequence
  Description of Artificial Sequence: Synthetic oligonucleotide
  Target: SCN10A; (+) strand; PAM type: NNNNGHTT; PAM sequence: TTCGGCTT
tgcaaaaaagtaaaatatcc

SEQ ID NO: 12077 - DNA, 20 bp, Artificial Sequence
  Description of Artificial Sequence: Synthetic oligonucleotide
  Target: SCN10A; (+) strand; PAM type: NNNNGHTT; PAM sequence: AAGAGATT
ccttcggcttagcacaggaa

SEQ ID NO: 12078 - DNA, 20 bp, Artificial Sequence
  Description of Artificial Sequence: Synthetic oligonucleotide
  Target: SCN10A; (+) strand; PAM type: NNNNGHTT; PAM sequence: GCTGGATT
ggtgctgaagccattcccag

SEQ ID NO: 12079 - DNA, 20 bp, Artificial Sequence
  Description of Artificial Sequence: Synthetic oligonucleotide
  Target: SCN10A; (+) strand; PAM type: NNNNGHTT; PAM sequence: GACAGCTT
cttttctgataacaacaggt

SEQ ID NO: 12080 - DNA, 20 bp, Artificial Sequence
  Description of Artificial Sequence: Synthetic oligonucleotide
  Target: SCN10A; (+) strand; PAM type: NNNNGHTT; PAM sequence: TTAAGATT
ctttgatgtccgcagacacc

SEQ ID NO: 12081 - DNA, 20 bp, Artificial Sequence
  Description of Artificial Sequence: Synthetic oligonucleotide
  Target: SCN10A; (+) strand; PAM type: NNNNGHTT; PAM sequence: ATGGGCTT
ttaagattggcatgttcagt

SEQ ID NO: 12082 - DNA, 20 bp, Artificial Sequence
  Description of Artificial Sequence: Synthetic oligonucleotide
  Target: SCN10A; (+) strand; PAM type: NNNNGHTT; PAM sequence: ATTTGATT
tcatcttggaatcaccaccc

SEQ ID NO: 12083 - DNA, 20 bp, Artificial Sequence
  Description of Artificial Sequence: Synthetic oligonucleotide
  Target: SCN10A; (+) strand; PAM type: NNNNGHTT; PAM sequence: CCTAGTTT
cccatctataattacacttt

SEQ ID NO: 12084 - DNA, 20 bp, Artificial Sequence
  Description of Artificial Sequence: Synthetic oligonucleotide
  Target: SCN10A; (+) strand; PAM type: NNNNGHTT; PAM sequence: GGGTGATT
tggttgtaaggatcagagcg

SEQ ID NO: 12085 - DNA, 20 bp, Artificial Sequence
  Description of Artificial Sequence: Synthetic oligonucleotide
  Target: SCN10A; (+) strand; PAM type: NNNNGHTT; PAM sequence: CTTGGCTT
ctgtggagccctctgacact

SEQ ID NO: 12086 - DNA, 20 bp, Artificial Sequence
  Description of Artificial Sequence: Synthetic oligonucleotide
  Target: SCN10A; (+) strand; PAM type: NNNNGHTT; PAM sequence: ATTTGCTT
cagcaggtgtagccaatagt

SEQ ID NO: 12087 - DNA, 20 bp, Artificial Sequence
  Description of Artificial Sequence: Synthetic oligonucleotide
  Target: SCN10A; (+) strand; PAM type: NNNNGHTT; PAM sequence: GTGGGATT
gggttaggaccagggtggtg

SEQ ID NO: 12088 - DNA, 20 bp, Artificial Sequence
  Description of Artificial Sequence: Synthetic oligonucleotide
  Target: SCN10A; (+) strand; PAM type: NNNNGHTT; PAM sequence: AGCTGCTT
aggtcagcacagctatcccg

SEQ ID NO: 12089 - DNA, 20 bp, Artificial Sequence
  Description of Artificial Sequence: Synthetic oligonucleotide
  Target: SCN10A; (+) strand; PAM type: NNNNGHTT; PAM sequence: GCCTGCTT
aaaaaaagtctcttttggct

SEQ ID NO: 12090 - DNA, 20 bp, Artificial Sequence
  Description of Artificial Sequence: Synthetic oligonucleotide
  Target: SCN10A; (+) strand; PAM type: NNNNGHTT; PAM sequence: CCTTGTTT
ggtctctagctgagaacact

SEQ ID NO: 12091 - DNA, 20 bp, Artificial Sequence
  Description of Artificial Sequence: Synthetic oligonucleotide
  Target: SCN10A; (+) strand; PAM type: NNNNGHTT; PAM sequence: TTCTGTTT
tagttccaccctctgcccca

SEQ ID NO: 12092 - DNA, 20 bp, Artificial Sequence
  Description of Artificial Sequence: Synthetic oligonucleotide
  Target: SCN10A; (+) strand; PAM type: NNNNGHTT; PAM sequence: TTTTGCTT
ccaccctctgccccattctg

SEQ ID NO: 12093 - DNA, 20 bp, Artificial Sequence
  Description of Artificial Sequence: Synthetic oligonucleotide
  Target: SCN10A; (+) strand; PAM type: NNNNGHTT; PAM sequence: ATTCGCTT
gccccattctgttttgcttc

SEQ ID NO: 12094 - DNA, 20 bp, Artificial Sequence
  Description of Artificial Sequence: Synthetic oligonucleotide
  Target: SCN10A; (+) strand; PAM type: NNNNGHTT; PAM sequence: CTTAGCTT
cacttgcacaagaatcctca

SEQ ID NO: 12095 - DNA, 20 bp, Artificial Sequence
  Description of Artificial Sequence: Synthetic oligonucleotide
  Target: SCN10A; (+) strand; PAM type: NNNNGHTT; PAM sequence: AGATGATT
ctaatatggtccctgaggca

SEQ ID NO: 12096 - DNA, 20 bp, Artificial Sequence
  Description of Artificial Sequence: Synthetic oligonucleotide
  Target: SCN10A; (+) strand; PAM type: NNNNGHTT; PAM sequence: CAAAGCTT
acagtctgcaaccttcttca

SEQ ID NO: 12097 - DNA, 20 bp, Artificial Sequence
  Description of Artificial Sequence: Synthetic oligonucleotide
  Target: SCN10A; (+) strand; PAM type: NNNNGHTT; PAM sequence: CTTTGCTT
gcctcctggaacttcttctc

SEQ ID NO: 12098 - DNA, 20 bp, Artificial Sequence
  Description of Artificial Sequence: Synthetic oligonucleotide
  Target: SCN10A; (+) strand; PAM type: NNNNGHTT; PAM sequence: GGAAGATT
gaccaggtagaaagatccca

SEQ ID NO: 12099 - DNA, 20 bp, Artificial Sequence
  Description of Artificial Sequence: Synthetic oligonucleotide
  Target: SCN10A; (+) strand; PAM type: NNNNGHTT; PAM sequence: TATAGATT
tacgagcacaaaaaagatca

SEQ ID NO: 12100 - DNA, 20 bp, Artificial Sequence
  Description of Artificial Sequence: Synthetic oligonucleotide
  Target: SCN10A; (+) strand; PAM type: NNNNGHTT; PAM sequence: AGAAGTTT
tagttaaaatccgggttgtc

SEQ ID NO: 12101 - DNA, 20 bp, Artificial Sequence
  Description of Artificial Sequence: Synthetic oligonucleotide
  Target: SCN10A; (+) strand; PAM type: NNNNGHTT; PAM sequence: CCCTGCTT
caagaacagagaaggtcatc

SEQ ID NO: 12102 - DNA, 20 bp, Artificial Sequence
  Description of Artificial Sequence: Synthetic oligonucleotide
  Target: SCN10A; (+) strand; PAM type: NNNNGHTT; PAM sequence: CAGAGTTT
ccagggctgcgagacaacca

SEQ ID NO: 12103 - DNA, 20 bp, Artificial Sequence
  Description of Artificial Sequence: Synthetic oligonucleotide
  Target: SCN10A; (+) strand; PAM type: NNNNGHTT; PAM sequence: GTCTGTTT
aggatgatcttggacacttg

SEQ ID NO: 12104 - DNA, 20 bp, Artificial Sequence
  Description of Artificial Sequence: Synthetic oligonucleotide
  Target: SCN10A; (+) strand; PAM type: NNNNGHTT; PAM sequence: ATTGGTTT
gacacttggtctgtttaggt

SEQ ID NO: 12105 - DNA, 20 bp, Artificial Sequence
  Description of Artificial Sequence: Synthetic oligonucleotide
  Target: SCN10A; (+) strand; PAM type: NNNNGHTT; PAM sequence: CACTGATT
ggtctcacattagccaagtt

SEQ ID NO: 12106 - DNA, 20 bp, Artificial Sequence
  Description of Artificial Sequence: Synthetic oligonucleotide
  Target: SCN10A; (+) strand; PAM type: NNNNGHTT; PAM sequence: AAGTGCTT
gtgttcttctctctcccttt

SEQ ID NO: 12107 - DNA, 20 bp, Artificial Sequence
  Description of Artificial Sequence: Synthetic oligonucleotide
  Target: SCN10A; (+) strand; PAM type: NNNNGHTT; PAM sequence: GCCAGATT
aagatggcctatgaaggaag

SEQ ID NO: 12108 - DNA, 20 bp, Artificial Sequence
  Description of Artificial Sequence: Synthetic oligonucleotide
  Target: SCN10A; (+) strand; PAM type: NNNNGHTT; PAM sequence: CCTCGTTT
tgatcaatgaaacagcaatg

SEQ ID NO: 12109 - DNA, 20 bp, Artificial Sequence
  Description of Artificial Sequence: Synthetic oligonucleotide
  Target: SCN10A; (+) strand; PAM type: NNNNGHTT; PAM sequence: TCCTGTTT
tttaaatttttttctttttc

SEQ ID NO: 12110 - DNA, 20 bp, Artificial Sequence
  Description of Artificial Sequence: Synthetic oligonucleotide
  Target: SCN10A; (+) strand; PAM type: NNNNGHTT; PAM sequence: CCAGGATT
tacatggaattcttttactc

SEQ ID NO: 12111 - DNA, 20 bp, Artificial Sequence
  Description of Artificial Sequence: Synthetic oligonucleotide
  Target: SCN10A; (+) strand; PAM type: NNNNGHTT; PAM sequence: CATGGATT
tccatgtgaacaacccatac

SEQ ID NO: 12112 - DNA, 20 bp, Artificial Sequence
  Description of Artificial Sequence: Synthetic oligonucleotide
  Target: SCN10A; (+) strand; PAM type: NNNNGHTT; PAM sequence: CTTCGATT
cagttccaagtctatctcca

SEQ ID NO: 12113 - DNA, 20 bp, Artificial Sequence
  Description of Artificial Sequence: Synthetic oligonucleotide
  Target: SCN10A; (+) strand; PAM type: NNNNGHTT; PAM sequence: TGAAGATT
aagtctatctccacttcgat

SEQ ID NO: 12114 - DNA, 20 bp, Artificial Sequence
  Description of Artificial Sequence: Synthetic oligonucleotide
  Target: SCN10A; (+) strand; PAM type: NNNNGHTT; PAM sequence: CCTGGCTT
cgattgaagattgcaagttc

SEQ ID NO: 12115 - DNA, 20 bp, Artificial Sequence
  Description of Artificial Sequence: Synthetic oligonucleotide
  Target: SCN10A; (+) strand; PAM type: NNNNGHTT; PAM sequence: CTTGGTTT
cccacatttaaagataggct

SEQ ID NO: 12116 - DNA, 20 bp, Artificial Sequence
  Description of Artificial Sequence: Synthetic oligonucleotide
  Target: SCN10A; (+) strand; PAM type: NNNNGHTT; PAM sequence: GTAGGTTT
ggctaggcaacccatttcct

SEQ ID NO: 12117 - DNA, 20 bp, Artificial Sequence
  Description of Artificial Sequence: Synthetic oligonucleotide
  Target: SCN10A; (+) strand; PAM type: NNNNGHTT; PAM sequence: CCTTGTTT
ttaattaactctgagggcag

SEQ ID NO: 12118 - DNA, 20 bp, Artificial Sequence
  Description of Artificial Sequence: Synthetic oligonucleotide
  Target: SCN10A; (+) strand; PAM type: NNNNGHTT; PAM sequence: TGAGGATT
atataaacagttcactgctc

SEQ ID NO: 12119 - DNA, 20 bp, Artificial Sequence
  Description of Artificial Sequence: Synthetic oligonucleotide
  Target: SCN10A; (+) strand; PAM type: NNNNGHTT; PAM sequence: TATTGTTT
aaactgcaaaggaaaattcc

SEQ ID NO: 12120 - DNA, 20 bp, Artificial Sequence
  Description of Artificial Sequence: Synthetic oligonucleotide
  Target: SCN10A; (+) strand; PAM type: NNNNGHTT; PAM sequence: TCTGGCTT
tgtgggcctttcctcaggac

SEQ ID NO: 12121 - DNA, 20 bp, Artificial Sequence
  Description of Artificial Sequence: Synthetic oligonucleotide
  Target: SCN10A; (+) strand; PAM type: NNNNGHTT; PAM sequence: CCAGGTTT
tctgcagccccacagaggac

SEQ ID NO: 12122 - DNA, 20 bp, Artificial Sequence
  Description of Artificial Sequence: Synthetic oligonucleotide
  Target: SCN10A; (+) strand; PAM type: NNNNGHTT; PAM sequence: TTTAGCTT
agccccacagaggacccagg

SEQ ID NO: 12123 - DNA, 20 bp, Artificial Sequence
  Description of Artificial Sequence: Synthetic oligonucleotide
  Target: SCN10A; (+) strand; PAM type: NNNNGHTT; PAM sequence: CTTGGTTT
cagaaggatgctgaggggct

SEQ ID NO: 12124 - DNA, 20 bp, Artificial Sequence
  Description of Artificial Sequence: Synthetic oligonucleotide
  Target: SCN10A; (+) strand; PAM type: NNNNGHTT; PAM sequence: TCCTGCTT
acctgatgttgaccaaatgc

SEQ ID NO: 12125 - DNA, 20 bp, Artificial Sequence
  Description of Artificial Sequence: Synthetic oligonucleotide
  Target: SCN10A; (+) strand; PAM type: NNNNGHTT; PAM sequence: GCTTGTTT
gatgttgaccaaatgctcct

SEQ ID NO: 12126 - DNA, 20 bp, Artificial Sequence
  Description of Artificial Sequence: Synthetic oligonucleotide
  Target: SCN10A; (+) strand; PAM type: NNNNGHTT; PAM sequence: GATAGTTT
cagtcctcagctccaactga

SEQ ID NO: 12127 - DNA, 20 bp, Artificial Sequence
  Description of Artificial Sequence: Synthetic oligonucleotide
  Target: SCN10A; (+) strand; PAM type: NNNNGHTT; PAM sequence: CTCTGCTT
ggcactgggggtgttgtgag

SEQ ID NO: 12128 - DNA, 20 bp, Artificial Sequence
  Description of Artificial Sequence: Synthetic oligonucleotide
  Target: SCN10A; (+) strand; PAM type: NNNNGHTT; PAM sequence: CTTAGCTT
gagctgaggggtcctcatcc

SEQ ID NO: 12129 - DNA, 20 bp, Artificial Sequence
  Description of Artificial Sequence: Synthetic oligonucleotide
  Target: SCN10A; (+) strand; PAM type: NNNNGHTT; PAM sequence: CTGTGTTT
tgcctcacaccgccacctca

SEQ ID NO: 12130 - DNA, 20 bp, Artificial Sequence
  Description of Artificial Sequence: Synthetic oligonucleotide
  Target: SCN10A; (+) strand; PAM type: NNNNGHTT; PAM sequence: ACTTGTTT
tatgaagcctctagtaaaga

SEQ ID NO: 12131 - DNA, 20 bp, Artificial Sequence
  Description of Artificial Sequence: Synthetic oligonucleotide
  Target: SCN10A; (+) strand; PAM type: NNNNGHTT; PAM sequence: AGCAGCTT
tgaatgagaaattgcaaact

SEQ ID NO: 12132 - DNA, 20 bp, Artificial Sequence
  Description of Artificial Sequence: Synthetic oligonucleotide
  Target: SCN10A; (+) strand; PAM type: NNNNGHTT; PAM sequence: GCTGGATT
tgcaaactagcagcttatag

SEQ ID NO: 12133 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
ggatttggcccacagaaata

SEQ ID NO: 12134 - DNA, 20 bp, Artificial Sequence
  Description of Artificial Sequence: Synthetic oligonucleotide
  Target: SCN10A; (+) strand; PAM type: NNNNGHTT; PAM sequence: CAATGTTT
cattttttggaataggtagc

SEQ ID NO: 12135 - DNA, 20 bp, Artificial Sequence
  Description of Artificial Sequence: Synthetic oligonucleotide
  Target: SCN10A; (+) strand; PAM type: NNNNGHTT; PAM sequence: GGGAGATT
ggtagccaatgtttacggtt

SEQ ID NO: 12136 - DNA, 20 bp, Artificial Sequence
  Description of Artificial Sequence: Synthetic oligonucleotide
  Target: SCN10A; (+) strand; PAM type: NNNNGHTT; PAM sequence: ATGTGTTT
gaaattgcaaagtctgatac

SEQ ID NO: 12137 - DNA, 20 bp, Artificial Sequence
  Description of Artificial Sequence: Synthetic oligonucleotide
  Target: SCN10A; (+) strand; PAM type: NNNNGHTT; PAM sequence: TGATGATT
ctatagaatggagttagctg

SEQ ID NO: 12138 - DNA, 20 bp, Artificial Sequence
  Description of Artificial Sequence: Synthetic oligonucleotide
  Target: SCN10A; (+) strand; PAM type: NNNNGHTT; PAM sequence: GGTAGATT
aagtattggttccttcctgg

SEQ ID NO: 12139 - DNA, 20 bp, Artificial Sequence
  Description of Artificial Sequence: Synthetic oligonucleotide
  Target: SCN10A; (+) strand; PAM type: NNNNGHTT; PAM sequence: ACTTGCTT
tggatctctactggactgca

SEQ ID NO: 12140 - DNA, 20 bp, Artificial Sequence
  Description of Artificial Sequence: Synthetic oligonucleotide
  Target: SCN10A; (+) strand; PAM type: NNNNGHTT; PAM sequence: CACTGTTT
gaagaagccttgcaaacttc

SEQ ID NO: 12141 - DNA, 20 bp, Artificial Sequence
  Description of Artificial Sequence: Synthetic oligonucleotide
  Target: SCN10A; (+) strand; PAM type: NNNNGHTT; PAM sequence: ACCTGTTT
atgagaacaggcccaggcta

SEQ ID NO: 12142 - DNA, 20 bp, Artificial Sequence
  Description of Artificial Sequence: Synthetic oligonucleotide
  Target: SCN10A; (+) strand; PAM type: NNNNGHTT; PAM sequence: TGTTGTTT
gaatcatgaattaaatacat

SEQ ID NO: 12143 - DNA, 20 bp, Artificial Sequence
  Description of Artificial Sequence: Synthetic oligonucleotide
  Target: SCN10A; (+) strand; PAM type: NNNNGHTT; PAM sequence: CCATGATT
gagctctgggttggcaaagg

SEQ ID NO: 12144 - DNA, 20 bp, Artificial Sequence
  Description of Artificial Sequence: Synthetic oligonucleotide
  Target: SCN10A; (+) strand; PAM type: NNNNGHTT; PAM sequence: TCGTGCTT
gagaaggaattgttgggcac

SEQ ID NO: 12145 - DNA, 20 bp, Artificial Sequence
  Description of Artificial Sequence: Synthetic oligonucleotide
  Target: SCN10A; (+) strand; PAM type: NNNNGHTT; PAM sequence: CCTCGCTT
acagtaaggggtcagaagtg

SEQ ID NO: 12146 - DNA, 20 bp, Artificial Sequence
  Description of Artificial Sequence: Synthetic oligonucleotide
  Target: SCN10A; (+) strand; PAM type: NNNNGHTT; PAM sequence: TCTAGATT
cagaggtagaatgacttgcc

SEQ ID NO: 12147 - DNA, 20 bp, Artificial Sequence
  Description of Artificial Sequence: Synthetic oligonucleotide
  Target: SCN10A; (+) strand; PAM type: NNNNGHTT; PAM sequence: TCACGTTT
ccctatggaagagactccac

SEQ ID NO: 12148 - DNA, 20 bp, Artificial Sequence
  Description of Artificial Sequence: Synthetic oligonucleotide
  Target: SCN10A; (+) strand; PAM type: NNNNGHTT; PAM sequence: GCCAGTTT
tggtgaggatggtcacatca

SEQ ID NO: 12149 - DNA, 20 bp, Artificial Sequence
  Description of Artificial Sequence: Synthetic oligonucleotide
  Target: SCN10A; (+) strand; PAM type: NNNNGHTT; PAM sequence: CGAAGCTT
gttccaagacctttctcatc

SEQ ID NO: 12150 - DNA, 20 bp, Artificial Sequence
  Description of Artificial Sequence: Synthetic oligonucleotide
  Target: SCN10A; (+) strand; PAM type: NNNNGHTT; PAM sequence: GGCAGCTT
ctttctgcatgcatctggga

SEQ ID NO: 12151 - DNA, 20 bp, Artificial Sequence
  Description of Artificial Sequence: Synthetic oligonucleotide
  Target: SCN10A; (+) strand; PAM type: NNNNGHTT; PAM sequence: GTGAGTTT
agacacagagaaacagagag

SEQ ID NO: 12152 - DNA, 20 bp, Artificial Sequence
  Description of Artificial Sequence: Synthetic oligonucleotide
  Target: SCN10A; (+) strand; PAM type: NNNNGHTT; PAM sequence: ACCTGCTT
ctggcagcaaagaaggatac

SEQ ID NO: 12153 - DNA, 20 bp, Artificial Sequence
  Description of Artificial Sequence: Synthetic oligonucleotide
  Target: SCN10A; (+) strand; PAM type: NNNNGHTT; PAM sequence: GCTTGTTT
cagcaaagaaggatacacct

SEQ ID NO: 12154 - DNA, 20 bp, Artificial Sequence
  Description of Artificial Sequence: Synthetic oligonucleotide
  Target: SCN10A; (+) strand; PAM type: NNNNGHTT; PAM sequence: GGATGATT
acacctgcttgtttaaggag

SEQ ID NO: 12155 - DNA, 20 bp, Artificial Sequence
  Description of Artificial Sequence: Synthetic oligonucleotide
  Target: SCN10A; (+) strand; PAM type: NNNNGHTT; PAM sequence: AGCAGCTT
aaaatcaacttctttgggag

SEQ ID NO: 12156 - DNA, 20 bp, Artificial Sequence
  Description of Artificial Sequence: Synthetic oligonucleotide
  Target: SCN10A; (+) strand; PAM type: NNNNGHTT; PAM sequence: CTAGGATT
gctctgaccagggaagcaat

SEQ ID NO: 12157 - DNA, 20 bp, Artificial Sequence
  Description of Artificial Sequence: Synthetic oligonucleotide
  Target: SCN10A; (+) strand; PAM type: NNNNGHTT; PAM sequence: GGTGGATT
ggagtatttgcagaaccgta

SEQ ID NO: 12158 - DNA, 20 bp, Artificial Sequence
  Description of Artificial Sequence: Synthetic oligonucleotide
  Target: SCN10A; (+) strand; PAM type: NNNNGHTT; PAM sequence: GAGAGTTT
gtgtccagtgggaattggca

SEQ ID NO: 12159 - DNA, 20 bp, Artificial Sequence
  Description of Artificial Sequence: Synthetic oligonucleotide
  Target: SCN10A; (+) strand; PAM type: NNNNGHTT; PAM sequence: GGGTGTTT
aaagacttccactctagaat

SEQ ID NO: 12160 - DNA, 20 bp, Artificial Sequence
  Description of Artificial Sequence: Synthetic oligonucleotide
  Target: SCN10A; (+) strand; PAM type: NNNNGHTT; PAM sequence: TTCTGTTT
ttccactctagaatgggtgt

SEQ ID NO: 12161 - DNA, 20 bp, Artificial Sequence
  Description of Artificial Sequence: Synthetic oligonucleotide
  Target: SCN10A; (+) strand; PAM type: NNNNGHTT; PAM sequence: GAAAGTTT
aagcatcaagtcccatttca

SEQ ID NO: 12162 - DNA, 20 bp, Artificial Sequence
  Description of Artificial Sequence: Synthetic oligonucleotide
  Target: SCN10A; (+) strand; PAM type: NNNNGHTT; PAM sequence: ATGAGCTT
gatcttagaggccccacaca

SEQ ID NO: 12163 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
aatgagctttgatggactac

SEQ ID NO: 12164 - DNA, 20 bp, Artificial Sequence
  Description of Artificial Sequence: Synthetic oligonucleotide
  Target: SCN10A; (+) strand; PAM type: NNNNGHTT; PAM sequence: ACAGGATT
tttcctctgggtgtctaaag

SEQ ID NO: 12165 - DNA, 20 bp, Artificial Sequence
  Description of Artificial Sequence: Synthetic oligonucleotide
  Target: SCN10A; (+) strand; PAM type: NNNNGHTT; PAM sequence: GACTGCTT
ggaaacagtgaagatactgg

SEQ ID NO: 12166 - DNA, 20 bp, Artificial Sequence
  Description of Artificial Sequence: Synthetic oligonucleotide
  Target: SCN10A; (+) strand; PAM type: NNNNGHTT; PAM sequence: CCAAGTTT
ttctcccttcctccccattt

SEQ ID NO: 12167 - DNA, 20 bp, Artificial Sequence
  Description of Artificial Sequence: Synthetic oligonucleotide
  Target: SCN10A; (+) strand; PAM type: NNNNGHTT; PAM sequence: TTTAGTTT
cccatttccaagtttaatcc

SEQ ID NO: 12168 - DNA, 20 bp, Artificial Sequence
  Description of Artificial Sequence: Synthetic oligonucleotide
  Target: SCN10A; (+) strand; PAM type: NNNNGHTT; PAM sequence: TATTGATT
gacatgcccctcctgttacg

SEQ ID NO: 12169 - DNA, 20 bp, Artificial Sequence
  Description of Artificial Sequence: Synthetic oligonucleotide
  Target: SCN10A; (+) strand; PAM type: NNNNGHTT; PAM sequence: ATAGGCTT
ctggcctaggagttgggaca

SEQ ID NO: 12170 - DNA, 20 bp, Artificial Sequence
  Description of Artificial Sequence: Synthetic oligonucleotide
  Target: SCN10A; (+) strand; PAM type: NNNNGHTT; PAM sequence: TTGGGTTT
ctcttactagtgaagaggcc

SEQ ID NO: 12171 - DNA, 20 bp, Artificial Sequence
  Description of Artificial Sequence: Synthetic oligonucleotide
  Target: SCN10A; (+) strand; PAM type: NNNNGHTT; PAM sequence: TTATGTTT
ctagtgaagaggccttgggt

SEQ ID NO: 12172 - DNA, 20 bp, Artificial Sequence
  Description of Artificial Sequence: Synthetic oligonucleotide
  Target: SCN10A; (+) strand; PAM type: NNNNGHTT; PAM sequence: AACTGTTT
tgctcacctgggatcacaga

SEQ ID NO: 12173 - DNA, 20 bp, Artificial Sequence
  Description of Artificial Sequence: Synthetic oligonucleotide
  Target: SCN10A; (+) strand; PAM type: NNNNGHTT; PAM sequence: CACTGATT
catctatagactgacactga

SEQ ID NO: 12174 - DNA, 20 bp, Artificial Sequence
  Description of Artificial Sequence: Synthetic oligonucleotide
  Target: SCN10A; (+) strand; PAM type: NNNNGHTT; PAM sequence: AGGAGTTT
gtggacggatcttcaaacac

SEQ ID NO: 12175 - DNA, 20 bp, Artificial Sequence
  Description of Artificial Sequence: Synthetic oligonucleotide
  Target: SCN10A; (+) strand; PAM type: NNNNGHTT; PAM sequence: CACTGATT
gaccaaccagtctcctcaga

SEQ ID NO: 12176 - DNA, 20 bp, Artificial Sequence
  Description of Artificial Sequence: Synthetic oligonucleotide
  Target: SCN10A; (+) strand; PAM type: NNNNGHTT; PAM sequence: CTCAGATT
tgtgacaggctaactgttat

SEQ ID NO: 12177 - DNA, 20 bp, Artificial Sequence
  Description of Artificial Sequence: Synthetic oligonucleotide
  Target: SCN10A; (+) strand; PAM type: NNNNGHTT; PAM sequence: AATAGTTT
tttttattttattttatttc

SEQ ID NO: 12178 - DNA, 20 bp, Artificial Sequence
  Description of Artificial Sequence: Synthetic oligonucleotide
  Target: SCN10A; (+) strand; PAM type: NNNNGHTT; PAM sequence: GGTGGTTT
tcaatagttttgagggaaca

SEQ ID NO: 12179 - DNA, 20 bp, Artificial Sequence
  Description of Artificial Sequence: Synthetic oligonucleotide
  Target: SCN10A; (+) strand; PAM type: NNNNGHTT; PAM sequence: AATAGTTT
aagttctttatttgtatttc

SEQ ID NO: 12180 - DNA, 20 bp, Artificial Sequence
  Description of Artificial Sequence: Synthetic oligonucleotide
  Target: SCN10A; (+) strand; PAM type: NNNNGHTT; PAM sequence: CGCTGATT
tgcacagaaaaattctttaa

SEQ ID NO: 12181 - DNA, 20 bp, Artificial Sequence
  Description of Artificial Sequence: Synthetic oligonucleotide
  Target: SCN10A; (+) strand; PAM type: NNNNGHTT; PAM sequence: CTGAGATT
aaattctttaacgctgattt

SEQ ID NO: 12182 - DNA, 20 bp, Artificial Sequence
  Description of Artificial Sequence: Synthetic oligonucleotide
  Target: SCN10A; (+) strand; PAM type: NNNNGHTT; PAM sequence: CACAGCTT
ttgttatgcctttgcatcct

SEQ ID NO: 12183 - DNA, 20 bp, Artificial Sequence
  Description of Artificial Sequence: Synthetic oligonucleotide
  Target: SCN10A; (+) strand; PAM type: NNNNGHTT; PAM sequence: TCCTGCTT
ttgcatcctcacagcttagc

SEQ ID NO: 12184 - DNA, 20 bp, Artificial Sequence
  Description of Artificial Sequence: Synthetic oligonucleotide
  Target: SCN10A; (+) strand; PAM type: NNNNGHTT; PAM sequence: TGATGCTT
tgcttgtaattaagaacaca

SEQ ID NO: 12185 - DNA, 20 bp, Artificial Sequence
  Description of Artificial Sequence: Synthetic oligonucleotide
  Target: SCN10A; (+) strand; PAM type: NNNNGHTT; PAM sequence: TCCAGCTT
aataatagtctccaactcca

SEQ ID NO: 12186 - DNA, 20 bp, Artificial Sequence
  Description of Artificial Sequence: Synthetic oligonucleotide
  Target: SCN10A; (+) strand; PAM type: NNNNGHTT; PAM sequence: AATGGCTT
tatgcaagtgtctttttaat

SEQ ID NO: 12187 - DNA, 20 bp, Artificial Sequence
  Description of Artificial Sequence: Synthetic oligonucleotide
  Target: SCN10A; (+) strand; PAM type: NNNNGHTT; PAM sequence: GTGGGATT
ctctgggtagatacccagta

SEQ ID NO: 12188 - DNA, 20 bp, Artificial Sequence
  Description of Artificial Sequence: Synthetic oligonucleotide
  Target: SCN10A; (+) strand; PAM type: NNNNGHTT; PAM sequence: TAACGTTT
agttctttaaggaatctcca

SEQ ID NO: 12189 - DNA, 20 bp, Artificial Sequence
  Description of Artificial Sequence: Synthetic oligonucleotide
  Target: SCN10A; (+) strand; PAM type: NNNNGHTT; PAM sequence: ACTAGTTT
acgttttccttagtggttgt

SEQ ID NO: 12190 - DNA, 20 bp, Artificial Sequence
  Description of Artificial Sequence: Synthetic oligonucleotide
  Target: SCN10A; (+) strand; PAM type: NNNNGHTT; PAM sequence: AATTGTTT
cattcccaccagcagtgtaa

SEQ ID NO: 12191 - DNA, 20 bp, Artificial Sequence
  Description of Artificial Sequence: Synthetic oligonucleotide
  Target: SCN10A; (+) strand; PAM type: NNNNGHTT; PAM sequence: TGTGGTTT
ggagtaaggtggtatctcat

SEQ ID NO: 12192 - DNA, 20 bp, Artificial Sequence
  Description of Artificial Sequence: Synthetic oligonucleotide
  Target: SCN10A; (+) strand; PAM type: NNNNGHTT; PAM sequence: ATGGGATT
tgtcctttgcccacttttgg

SEQ ID NO: 12193 - DNA, 20 bp, Artificial Sequence
  Description of Artificial Sequence: Synthetic oligonucleotide
  Target: SCN10A; (+) strand; PAM type: NNNNGHTT; PAM sequence: ATTTGTTT
gcccacttttggatgggatt

SEQ ID NO: 12194 - DNA, 20 bp, Artificial Sequence
  Description of Artificial Sequence: Synthetic oligonucleotide
  Target: SCN10A; (+) strand; PAM type: NNNNGHTT; PAM sequence: GTTTGTTT
acttttggatgggattattt

SEQ ID NO: 12195 - DNA, 20 bp, Artificial Sequence
  Description of Artificial Sequence: Synthetic oligonucleotide
  Target: SCN10A; (+) strand; PAM type: NNNNGHTT; PAM sequence: TGCTGATT
ggattatttgtttgttttct

SEQ ID NO: 12196 - DNA, 20 bp, Artificial Sequence
  Description of Artificial Sequence: Synthetic oligonucleotide
  Target: SCN10A; (+) strand; PAM type: NNNNGHTT; PAM sequence: TTGTGTTT
ttgttttcttgctgatttat

SEQ ID NO: 12197 - DNA, 20 bp, Artificial Sequence
  Description of Artificial Sequence: Synthetic oligonucleotide
  Target: SCN10A; (+) strand; PAM type: NNNNGHTT; PAM sequence: CAAAGATT
tttgctggaagcatagataa

SEQ ID NO: 12198 - DNA, 20 bp, Artificial Sequence
  Description of Artificial Sequence: Synthetic oligonucleotide
  Target: SCN10A; (+) strand; PAM type: NNNNGHTT; PAM sequence: GTCTGTTT
tttctctcatcctatgggtt

SEQ ID NO: 12199 - DNA, 20 bp, Artificial Sequence
  Description of Artificial Sequence: Synthetic oligonucleotide
  Target: SCN10A; (+) strand; PAM type: NNNNGHTT; PAM sequence: GGATGATT
tatgggttgtctgtttactt

SEQ ID NO: 12200 - DNA, 20 bp, Artificial Sequence
  Description of Artificial Sequence: Synthetic oligonucleotide
  Target: SCN10A; (+) strand; PAM type: NNNNGHTT; PAM sequence: AACAGCTT
gattatttctcttgctgtgc

SEQ ID NO: 12201 - DNA, 20 bp, Artificial Sequence
  Description of Artificial Sequence: Synthetic oligonucleotide
  Target: SCN10A; (+) strand; PAM type: NNNNGHTT; PAM sequence: TTTAGTTT
ctcttgctgtgcaacagctt

SEQ ID NO: 12202 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
attagatcccatctatttat

SEQ ID NO: 12203 - DNA, 20 bp, Artificial Sequence
  Description of Artificial Sequence: Synthetic oligonucleotide
  Target: SCN10A; (+) strand; PAM type: NNNNGHTT; PAM sequence: GTTGGATT
atctatttatttttgttttt

SEQ ID NO: 12204 - DNA, 20 bp, Artificial Sequence
  Description of Artificial Sequence: Synthetic oligonucleotide
  Target: SCN10A; (+) strand; PAM type: NNNNGHTT; PAM sequence: ATTTGCTT
tttatttttgtttttgttgg

SEQ ID NO: 12205 - DNA, 20 bp, Artificial Sequence
  Description of Artificial Sequence: Synthetic oligonucleotide
  Target: SCN10A; (+) strand; PAM type: NNNNGHTT; PAM sequence: GAACGTTT
tgctttgggtccttggtcag

SEQ ID NO: 12206 - DNA, 20 bp, Artificial Sequence
  Description of Artificial Sequence: Synthetic oligonucleotide
  Target: SCN10A; (+) strand; PAM type: NNNNGHTT; PAM sequence: AAGAGTTT
ttgcctaagccaatgtctag

SEQ ID NO: 12207 - DNA, 20 bp, Artificial Sequence
  Description of Artificial Sequence: Synthetic oligonucleotide
  Target: SCN10A; (+) strand; PAM type: NNNNGHTT; PAM sequence: CTTAGATT
aattttttataatttcaggt

SEQ ID NO: 12208 - DNA, 20 bp, Artificial Sequence
  Description of Artificial Sequence: Synthetic oligonucleotide
  Target: SCN10A; (+) strand; PAM type: NNNNGHTT; PAM sequence: AATTGATT
taagccttttatccatcttg

SEQ ID NO: 12209 - DNA, 20 bp, Artificial Sequence
  Description of Artificial Sequence: Synthetic oligonucleotide
  Target: SCN10A; (+) strand; PAM type: NNNNGHTT; PAM sequence: TGAAGATT
tttttgtataaggtgagaga

SEQ ID NO: 12210 - DNA, 20 bp, Artificial Sequence
  Description of Artificial Sequence: Synthetic oligonucleotide
  Target: SCN10A; (+) strand; PAM type: NNNNGHTT; PAM sequence: TTCAGTTT
tataaggtgagagatgaaga

SEQ ID NO: 12211 - DNA, 20 bp, Artificial Sequence
  Description of Artificial Sequence: Synthetic oligonucleotide
  Target: SCN10A; (+) strand; PAM type: NNNNGHTT; PAM sequence: TGTGGCTT
ttcagtttctttcttccaca

SEQ ID NO: 12212 - DNA, 20 bp, Artificial Sequence
  Description of Artificial Sequence: Synthetic oligonucleotide
  Target: SCN10A; (+) strand; PAM type: NNNNGHTT; PAM sequence: TTACGTTT
atagggtgtcctttccccac

SEQ ID NO: 12213 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
tgtcctttccccacttacgt

SEQ ID NO: 12214 - DNA, 20 bp, Artificial Sequence
  Description of Artificial Sequence: Synthetic oligonucleotide
  Target: SCN10A; (+) strand; PAM type: NNNNGHTT; PAM sequence: GTTTGCTT
ctttccccacttacgttttt

SEQ ID NO: 12215 - DNA, 20 bp, Artificial Sequence
  Description of Artificial Sequence: Synthetic oligonucleotide
  Target: SCN10A; (+) strand; PAM type: NNNNGHTT; PAM sequence: AGTTGCTT
tgtttgctttttcaaagatc

SEQ ID NO: 12216 - DNA, 20 bp, Artificial Sequence
  Description of Artificial Sequence: Synthetic oligonucleotide
  Target: SCN10A; (+) strand; PAM type: NNNNGHTT; PAM sequence: TTTGGCTT
agatcagttgcttgtaagta

SEQ ID NO: 12217 - DNA, 20 bp, Artificial Sequence
  Description of Artificial Sequence: Synthetic oligonucleotide
  Target: SCN10A; (+) strand; PAM type: NNNNGHTT; PAM sequence: ATGTGCTT
ctattcttttccattggtct

SEQ ID NO: 12218 - DNA, 20 bp, Artificial Sequence
  Description of Artificial Sequence: Synthetic oligonucleotide
  Target: SCN10A; (+) strand; PAM type: NNNNGHTT; PAM sequence: TGCTGTTT
ttatttttataccagtatca

SEQ ID NO: 12219 - DNA, 20 bp, Artificial Sequence
  Description of Artificial Sequence: Synthetic oligonucleotide
  Target: SCN10A; (+) strand; PAM type: NNNNGHTT; PAM sequence: TATAGTTT
gctatactatagccttgtag

SEQ ID NO: 12220 - DNA, 20 bp, Artificial Sequence
  Description of Artificial Sequence: Synthetic oligonucleotide
  Target: SCN10A; (+) strand; PAM type: NNNNGHTT; PAM sequence: TCCAGATT
aaatcagctaaggtgatgcc

SEQ ID NO: 12221 - DNA, 20 bp, Artificial Sequence
  Description of Artificial Sequence: Synthetic oligonucleotide
  Target: SCN10A; (+) strand; PAM type: NNNNGHTT; PAM sequence: TCTTGCTT
gatgcctccagatttgttat

SEQ ID NO: 12222 - DNA, 20 bp, Artificial Sequence
  Description of Artificial Sequence: Synthetic oligonucleotide
  Target: SCN10A; (+) strand; PAM type: NNNNGHTT; PAM sequence: TCTTGCTT
gatttgttattcttgcttag

SEQ ID NO: 12223 - DNA, 20 bp, Artificial Sequence
  Description of Artificial Sequence: Synthetic oligonucleotide
  Target: SCN10A; (+) strand; PAM type: NNNNGHTT; PAM sequence: TGTGGATT
gcttagtcttgctttggcta

SEQ ID NO: 12224 - DNA, 20 bp, Artificial Sequence
  Description of Artificial Sequence: Synthetic oligonucleotide
  Target: SCN10A; (+) strand; PAM type: NNNNGHTT; PAM sequence: TATTGCTT
gaaattgtattgaatctgta

SEQ ID NO: 12225 - DNA, 20 bp, Artificial Sequence
  Description of Artificial Sequence: Synthetic oligonucleotide
  Target: SCN10A; (+) strand; PAM type: NNNNGHTT; PAM sequence: TATTGATT
cagtaaggtcattttcacaa

SEQ ID NO: 12226 - DNA, 20 bp, Artificial Sequence
  Description of Artificial Sequence: Synthetic oligonucleotide
  Target: SCN10A; (+) strand; PAM type: NNNNGHTT; PAM sequence: ATTTGTTT
tgagcatgggatgtgttccc

SEQ ID NO: 12227 - DNA, 20 bp, Artificial Sequence
  Description of Artificial Sequence: Synthetic oligonucleotide
  Target: SCN10A; (+) strand; PAM type: NNNNGHTT; PAM sequence: CTGTGATT
ttcccatttgtttgtgtcat

SEQ ID NO: 12228 - DNA, 20 bp, Artificial Sequence
  Description of Artificial Sequence: Synthetic oligonucleotide
  Target: SCN10A; (+) strand; PAM type: NNNNGHTT; PAM sequence: CAGTGTTT
tcatctgtgatttattttag

SEQ ID NO: 12229 - DNA, 20 bp, Artificial Sequence
  Description of Artificial Sequence: Synthetic oligonucleotide
  Target: SCN10A; (+) strand; PAM type: NNNNGHTT; PAM sequence: TGTAGTTT
gatttattttagcagtgttt

SEQ ID NO: 12230 - DNA, 20 bp, Artificial Sequence
  Description of Artificial Sequence: Synthetic oligonucleotide
  Target: SCN10A; (+) strand; PAM type: NNNNGHTT; PAM sequence: CTAAGATT
ctttttggttaggtatattc

SEQ ID NO: 12231 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
taggtatattcctaagattt

SEQ ID NO: 12232 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
taagatttttttgtttttat

SEQ ID NO: 12233 - DNA, 20 bp, Artificial Sequence
  Description of Artificial Sequence: Synthetic oligonucleotide
  Target: SCN10A; (+) strand; PAM type: NNNNGHTT; PAM sequence: AAGGGATT
tttttttgcagctgttgtaa

SEQ ID NO: 12234 - DNA, 20 bp, Artificial Sequence
  Description of Artificial Sequence: Synthetic oligonucleotide
  Target: SCN10A; (+) strand; PAM type: NNNNGHTT; PAM sequence: TCTTGATT
tgttgtaaaagggattgagt

SEQ ID NO: 12235 - DNA, 20 bp, Artificial Sequence
  Description of Artificial Sequence: Synthetic oligonucleotide
  Target: SCN10A; (+) strand; PAM type: NNNNGHTT; PAM sequence: CTCAGCTT
attgagttcttgatttgttc

SEQ ID NO: 12236 - DNA, 20 bp, Artificial Sequence
  Description of Artificial Sequence: Synthetic oligonucleotide
  Target: SCN10A; (+) strand; PAM type: NNNNGHTT; PAM sequence: CTTGGTTT
gttcttgatttgttcctcag

SEQ ID NO: 12237 - DNA, 20 bp, Artificial Sequence
  Description of Artificial Sequence: Synthetic oligonucleotide
  Target: SCN10A; (+) strand; PAM type: NNNNGHTT; PAM sequence: TGCTGATT
ctggtggtgtacagtagtgc

SEQ ID NO: 12238 - DNA, 20 bp, Artificial Sequence
  Description of Artificial Sequence: Synthetic oligonucleotide
  Target: SCN10A; (+) strand; PAM type: NNNNGHTT; PAM sequence: CATTGTTT
tagtgctgctgatttgtata

SEQ ID NO: 12239 - DNA, 20 bp, Artificial Sequence
  Description of Artificial Sequence: Synthetic oligonucleotide
  Target: SCN10A; (+) strand; PAM type: NNNNGHTT; PAM sequence: AGGAGCTT
tgaattcatttattagatct

SEQ ID NO: 12240 - DNA, 20 bp, Artificial Sequence
  Description of Artificial Sequence: Synthetic oligonucleotide
  Target: SCN10A; (+) strand; PAM type: NNNNGHTT; PAM sequence: TAGGGTTT
gagctttttggatgagtctt

SEQ ID NO: 12241 - DNA, 20 bp, Artificial Sequence
  Description of Artificial Sequence: Synthetic oligonucleotide
  Target: SCN10A; (+) strand; PAM type: NNNNGHTT; PAM sequence: AACAGTTT
tcatatcattggtgaacagc

SEQ ID NO: 12242 - DNA, 20 bp, Artificial Sequence
  Description of Artificial Sequence: Synthetic oligonucleotide
  Target: SCN10A; (+) strand; PAM type: NNNNGHTT; PAM sequence: TACTGATT
caacagtttgacttcccctt

SEQ ID NO: 12243 - DNA, 20 bp, Artificial Sequence
  Description of Artificial Sequence: Synthetic oligonucleotide
  Target: SCN10A; (+) strand; PAM type: NNNNGHTT; PAM sequence: TTTGGATT
tttgacttcccctttactga

SEQ ID NO: 12244 - DNA, 20 bp, Artificial Sequence
  Description of Artificial Sequence: Synthetic oligonucleotide
  Target: SCN10A; (+) strand; PAM type: NNNNGHTT; PAM sequence: GTCTGATT
tccctttatttatttctctt

SEQ ID NO: 12245 - DNA, 20 bp, Artificial Sequence
  Description of Artificial Sequence: Synthetic oligonucleotide
  Target: SCN10A; (+) strand; PAM type: NNNNGHTT; PAM sequence: TCTTGTTT
ggtgaaagtgggcatccttg

SEQ ID NO: 12246 - DNA, 20 bp, Artificial Sequence
  Description of Artificial Sequence: Synthetic oligonucleotide
  Target: SCN10A; (+) strand; PAM type: NNNNGHTT; PAM sequence: GAATGCTT
cttgtttcagttctcagggg

SEQ ID NO: 12247 - DNA, 20 bp, Artificial Sequence
  Description of Artificial Sequence: Synthetic oligonucleotide
  Target: SCN10A; (+) strand; PAM type: NNNNGHTT; PAM sequence: CCCTGTTT
ggggaatgctttcaactttt

SEQ ID NO: 12248 - DNA, 20 bp, Artificial Sequence
  Description of Artificial Sequence: Synthetic oligonucleotide
  Target: SCN10A; (+) strand; PAM type: NNNNGHTT; PAM sequence: TGTGGATT
ctgtttggtataatgttggc

SEQ ID NO: 12249 - DNA, 20 bp, Artificial Sequence
  Description of Artificial Sequence: Synthetic oligonucleotide
  Target: SCN10A; (+) strand; PAM type: NNNNGHTT; PAM sequence: GATGGCTT
ttggctgtggatttgtcata

SEQ ID NO: 12250 - DNA, 20 bp, Artificial Sequence
  Description of Artificial Sequence: Synthetic oligonucleotide
  Target: SCN10A; (+) strand; PAM type: NNNNGHTT; PAM sequence: GAGGGTTT
ccttctatgccaatttggtt

SEQ ID NO: 12251 - DNA, 20 bp, Artificial Sequence
  Description of Artificial Sequence: Synthetic oligonucleotide
  Target: SCN10A; (+) strand; PAM type: NNNNGHTT; PAM sequence: GCTGGATT
ggttttaatcataatgggat

SEQ ID NO: 12252 - DNA, 20 bp, Artificial Sequence
  Description of Artificial Sequence: Synthetic oligonucleotide
  Target: SCN10A; (+) strand; PAM type: NNNNGHTT; PAM sequence: AAATGCTT
atgggatgctggattttgtc

SEQ ID NO: 12253 - DNA, 20 bp, Artificial Sequence
  Description of Artificial Sequence: Synthetic oligonucleotide
  Target: SCN10A; (+) strand; PAM type: NNNNGHTT; PAM sequence: ATATGATT
ctgcacctattgagatgatc

SEQ ID NO: 12254 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
tattgagatgatcatatgat

SEQ ID NO: 12255 - DNA, 20 bp, Artificial Sequence
  Description of Artificial Sequence: Synthetic oligonucleotide
  Target: SCN10A; (+) strand; PAM type: NNNNGHTT; PAM sequence: TTCTGTTT
catatgatttttgtttttaa

SEQ ID NO: 12256 - DNA, 20 bp, Artificial Sequence
  Description of Artificial Sequence: Synthetic oligonucleotide
  Target: SCN10A; (+) strand; PAM type: NNNNGHTT; PAM sequence: GTTGGATT
gtgttatcttttggatatgt

SEQ ID NO: 12257 - DNA, 20 bp, Artificial Sequence
  Description of Artificial Sequence: Synthetic oligonucleotide
  Target: SCN10A; (+) strand; PAM type: NNNNGHTT; PAM sequence: TGAGGATT
tcaattagctagcattttgt

SEQ ID NO: 12258 - DNA, 20 bp, Artificial Sequence
  Description of Artificial Sequence: Synthetic oligonucleotide
  Target: SCN10A; (+) strand; PAM type: NNNNGHTT; PAM sequence: TCTGGTTT
ttcttttttaaaagtccttt

SEQ ID NO: 12259 - DNA, 20 bp, Artificial Sequence
  Description of Artificial Sequence: Synthetic oligonucleotide
  Target: SCN10A; (+) strand; PAM type: NNNNGHTT; PAM sequence: ACTGGCTT
ggttttggtattagggtgat

SEQ ID NO: 12260 - DNA, 20 bp, Artificial Sequence
  Description of Artificial Sequence: Synthetic oligonucleotide
  Target: SCN10A; (+) strand; PAM type: NNNNGHTT; PAM sequence: AAATGATT
agggtgatactggcttcata

SEQ ID NO: 12261 - DNA, 20 bp, Artificial Sequence
  Description of Artificial Sequence: Synthetic oligonucleotide
  Target: SCN10A; (+) strand; PAM type: NNNNGHTT; PAM sequence: GGAGGATT
tggcttcataaaatgattta

SEQ ID NO: 12262 - DNA, 20 bp, Artificial Sequence
  Description of Artificial Sequence: Synthetic oligonucleotide
  Target: SCN10A; (+) strand; PAM type: NNNNGHTT; PAM sequence: AATAGTTT
cctctttctgcatcttttgg

SEQ ID NO: 12263 - DNA, 20 bp, Artificial Sequence
  Description of Artificial Sequence: Synthetic oligonucleotide
  Target: SCN10A; (+) strand; PAM type: NNNNGHTT; PAM sequence: TACTGTTT
ttccttggcaatttttgaat

SEQ ID NO: 12264 - DNA, 20 bp, Artificial Sequence
  Description of Artificial Sequence: Synthetic oligonucleotide
  Target: SCN10A; (+) strand; PAM type: NNNNGHTT; PAM sequence: GTCTGTTT
aatctcgctacttgttattg

SEQ ID NO: 12265 - DNA, 20 bp, Artificial Sequence
  Description of Artificial Sequence: Synthetic oligonucleotide
  Target: SCN10A; (+) strand; PAM type: NNNNGHTT; PAM sequence: TAGAGTTT
ctacttgttattggtctgtt

SEQ ID NO: 12266 - DNA, 20 bp, Artificial Sequence
  Description of Artificial Sequence: Synthetic oligonucleotide
  Target: SCN10A; (+) strand; PAM type: NNNNGHTT; PAM sequence: TTCTGATT
tgtttagagtttctattact

SEQ ID NO: 12267 - DNA, 20 bp, Artificial Sequence
  Description of Artificial Sequence: Synthetic oligonucleotide
  Target: SCN10A; (+) strand; PAM type: NNNNGHTT; PAM sequence: TCTAGTTT
tattcatctcctctaaattt

SEQ ID NO: 12268 - DNA, 20 bp, Artificial Sequence
  Description of Artificial Sequence: Synthetic oligonucleotide
  Target: SCN10A; (+) strand; PAM type: NNNNGHTT; PAM sequence: GAATGATT
aaggtgttcatagtagcctt

SEQ ID NO: 12269 - DNA, 20 bp, Artificial Sequence
  Description of Artificial Sequence: Synthetic oligonucleotide
  Target: SCN10A; (+) strand; PAM type: NNNNGHTT; PAM sequence: TTGAGCTT
atctcccattttatttctaa

SEQ ID NO: 12270 - DNA, 20 bp, Artificial Sequence
  Description of Artificial Sequence: Synthetic oligonucleotide
  Target: SCN10A; (+) strand; PAM type: NNNNGHTT; PAM sequence: ACCCGCTT
tttctatatctttttaaaga

SEQ ID NO: 12271 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
atctttttaaagaacccgct

SEQ ID NO: 12272 - DNA, 20 bp, Artificial Sequence
  Description of Artificial Sequence: Synthetic oligonucleotide
  Target: SCN10A; (+) strand; PAM type: NNNNGHTT; PAM sequence: TTCTGCTT
gatctttgttattccttttc

SEQ ID NO: 12273 - DNA, 20 bp, Artificial Sequence
  Description of Artificial Sequence: Synthetic oligonucleotide
  Target: SCN10A; (+) strand; PAM type: NNNNGHTT; PAM sequence: CTTGGTTT
ttgttattccttttcttctg

SEQ ID NO: 12274 - DNA, 20 bp, Artificial Sequence
  Description of Artificial Sequence: Synthetic oligonucleotide
  Target: SCN10A; (+) strand; PAM type: NNNNGHTT; PAM sequence: GTCTGTTT
ttttcttctgcttggtttgg

SEQ ID NO: 12275 - DNA, 20 bp, Artificial Sequence
  Description of Artificial Sequence: Synthetic oligonucleotide
  Target: SCN10A; (+) strand; PAM type: NNNNGHTT; PAM sequence: TCTTGTTT
ttggtttgggtctgttttgt

SEQ ID NO: 12276 - DNA, 20 bp, Artificial Sequence
  Description of Artificial Sequence: Synthetic oligonucleotide
  Target: SCN10A; (+) strand; PAM type: NNNNGHTT; PAM sequence: CTTAGATT
ctaattccttgaggtgtgac

SEQ ID NO: 12277 - DNA, 20 bp, Artificial Sequence
  Description of Artificial Sequence: Synthetic oligonucleotide
  Target: SCN10A; (+) strand; PAM type: NNNNGHTT; PAM sequence: ATGAGCTT
tgatgtaggtatttaatgct

SEQ ID NO: 12278 - DNA, 20 bp, Artificial Sequence
  Description of Artificial Sequence: Synthetic oligonucleotide
  Target: SCN10A; (+) strand; PAM type: NNNNGHTT; PAM sequence: CACTGCTT
gctatgagctttcctcttag

SEQ ID NO: 12279 - DNA, 20 bp, Artificial Sequence
  Description of Artificial Sequence: Synthetic oligonucleotide
  Target: SCN10A; (+) strand; PAM type: NNNNGHTT; PAM sequence: AGAGGTTT
cactgctttagctgtatccc

SEQ ID NO: 12280 - DNA, 20 bp, Artificial Sequence
  Description of Artificial Sequence: Synthetic oligonucleotide
  Target: SCN10A; (+) strand; PAM type: NNNNGHTT; PAM sequence: TCTTGATT
aaaaaatttttaaacttcca

SEQ ID NO: 12281 - DNA, 20 bp, Artificial Sequence
  Description of Artificial Sequence: Synthetic oligonucleotide
  Target: SCN10A; (+) strand; PAM type: NNNNGHTT; PAM sequence: AGCAGATT
tgacccaaagatcattcaag

SEQ ID NO: 12282 - DNA, 20 bp, Artificial Sequence
  Description of Artificial Sequence: Synthetic oligonucleotide
  Target: SCN10A; (+) strand; PAM type: NNNNGHTT; PAM sequence: GATTGTTT
ccaaagatcattcaagagca

SEQ ID NO: 12283 - DNA, 20 bp, Artificial Sequence
  Description of Artificial Sequence: Synthetic oligonucleotide
  Target: SCN10A; (+) strand; PAM type: NNNNGHTT; PAM sequence: TTTAGTTT
gatcattcaagagcagattg

SEQ ID NO: 12284 - DNA, 20 bp, Artificial Sequence
  Description of Artificial Sequence: Synthetic oligonucleotide
  Target: SCN10A; (+) strand; PAM type: NNNNGHTT; PAM sequence: TATAGTTT
gtttagttttcatgtatttg

SEQ ID NO: 12285 - DNA, 20 bp, Artificial Sequence
  Description of Artificial Sequence: Synthetic oligonucleotide
  Target: SCN10A; (+) strand; PAM type: NNNNGHTT; PAM sequence: GAGGGTTT
tcatgtatttgtatagtttt

SEQ ID NO: 12286 - DNA, 20 bp, Artificial Sequence
  Description of Artificial Sequence: Synthetic oligonucleotide
  Target: SCN10A; (+) strand; PAM type: NNNNGHTT; PAM sequence: CGAGGTTT
gtttcttttggagttaactc

SEQ ID NO: 12287 - DNA, 20 bp, Artificial Sequence
  Description of Artificial Sequence: Synthetic oligonucleotide
  Target: SCN10A; (+) strand; PAM type: NNNNGHTT; PAM sequence: TTGAGATT
tttctattttcttaaattta

SEQ ID NO: 12288 - DNA, 20 bp, Artificial Sequence
  Description of Artificial Sequence: Synthetic oligonucleotide
  Target: SCN10A; (+) strand; PAM type: NNNNGHTT; PAM sequence: AGTTGTTT
gaaaagaatgtatattctgc

SEQ ID NO: 12289 - DNA, 20 bp, Artificial Sequence
  Description of Artificial Sequence: Synthetic oligonucleotide
  Target: SCN10A; (+) strand; PAM type: NNNNGHTT; PAM sequence: GAATGTTT
tattctgcagttgtttggta

SEQ ID NO: 12290 - DNA, 20 bp, Artificial Sequence
  Description of Artificial Sequence: Synthetic oligonucleotide
  Target: SCN10A; (+) strand; PAM type: NNNNGHTT; PAM sequence: TACAGTTT
taagtccatttgttctaggt

SEQ ID NO: 12291 - DNA, 20 bp, Artificial Sequence
  Description of Artificial Sequence: Synthetic oligonucleotide
  Target: SCN10A; (+) strand; PAM type: NNNNGHTT; PAM sequence: CATTGTTT
tctaggttacagtttaagtt

SEQ ID NO: 12292 - DNA, 20 bp, Artificial Sequence
  Description of Artificial Sequence: Synthetic oligonucleotide
  Target: SCN10A; (+) strand; PAM type: NNNNGHTT; PAM sequence: AATTGTTT
catttcttaggtctagtagt

SEQ ID NO: 12293 - DNA, 20 bp, Artificial Sequence
  Description of Artificial Sequence: Synthetic oligonucleotide
  Target: SCN10A; (+) strand; PAM type: NNNNGHTT; PAM sequence: TTAGGATT
agtgttaggtgcatatgtat

SEQ ID NO: 12294 - DNA, 20 bp, Artificial Sequence
  Description of Artificial Sequence: Synthetic oligonucleotide
  Target: SCN10A; (+) strand; PAM type: NNNNGHTT; PAM sequence: TGTTGCTT
ctttgtctttttttaactgt

SEQ ID NO: 12295 - DNA, 20 bp, Artificial Sequence
  Description of Artificial Sequence: Synthetic oligonucleotide
  Target: SCN10A; (+) strand; PAM type: NNNNGHTT; PAM sequence: GTCTGTTT
ttaactgttgttgctttaag

SEQ ID NO: 12296 - DNA, 20 bp, Artificial Sequence
  Description of Artificial Sequence: Synthetic oligonucleotide
  Target: SCN10A; (+) strand; PAM type: NNNNGHTT; PAM sequence: TCCTGCTT
tctgatataagaatagctac

SEQ ID NO: 12297 - DNA, 20 bp, Artificial Sequence
  Description of Artificial Sequence: Synthetic oligonucleotide
  Target: SCN10A; (+) strand; PAM type: NNNNGHTT; PAM sequence: GCTTGCTT
atataagaatagctactcct

SEQ ID NO: 12298 - DNA, 20 bp, Artificial Sequence
  Description of Artificial Sequence: Synthetic oligonucleotide
  Target: SCN10A; (+) strand; PAM type: NNNNGHTT; PAM sequence: TTTGGTTT
aatagctactcctgcttgct

SEQ ID NO: 12299 - DNA, 20 bp, Artificial Sequence
  Description of Artificial Sequence: Synthetic oligonucleotide
  Target: SCN10A; (+) strand; PAM type: NNNNGHTT; PAM sequence: TTAAGTTT
tcttttcccatctctttacc

SEQ ID NO: 12300 - DNA, 20 bp, Artificial Sequence
  Description of Artificial Sequence: Synthetic oligonucleotide
  Target: SCN10A; (+) strand; PAM type: NNNNGHTT; PAM sequence: GGTGGATT
aagacagtagatacttggtt

SEQ ID NO: 12301 - DNA, 20 bp, Artificial Sequence
  Description of Artificial Sequence: Synthetic oligonucleotide
  Target: SCN10A; (+) strand; PAM type: NNNNGHTT; PAM sequence: TATTGTTT
aattcctttttttattgtgt

SEQ ID NO: 12302 - DNA, 20 bp, Artificial Sequence
  Description of Artificial Sequence: Synthetic oligonucleotide
  Target: SCN10A; (+) strand; PAM type: NNNNGHTT; PAM sequence: TTATGCTT
ttttataggtcctttgatat

SEQ ID NO: 12303 - DNA, 20 bp, Artificial Sequence
  Description of Artificial Sequence: Synthetic oligonucleotide
  Target: SCN10A; (+) strand; PAM type: NNNNGHTT; PAM sequence: TAAGGTTT
ggttctattttggtgtattt

SEQ ID NO: 12304 - DNA, 20 bp, Artificial Sequence
  Description of Artificial Sequence: Synthetic oligonucleotide
  Target: SCN10A; (+) strand; PAM type: NNNNGHTT; PAM sequence: TCAAGATT
gtgtattttaaggttttatt

SEQ ID NO: 12305 - DNA, 20 bp, Artificial Sequence
  Description of Artificial Sequence: Synthetic oligonucleotide
  Target: SCN10A; (+) strand; PAM type: NNNNGHTT; PAM sequence: GCTGGCTT
cttttagcatttcttgtagt

SEQ ID NO: 12306 - DNA, 20 bp, Artificial Sequence
  Description of Artificial Sequence: Synthetic oligonucleotide
  Target: SCN10A; (+) strand; PAM type: NNNNGHTT; PAM sequence: ATTTGTTT
tagtggaaaattctctcacc

SEQ ID NO: 12307 - DNA, 20 bp, Artificial Sequence
  Description of Artificial Sequence: Synthetic oligonucleotide
  Target: SCN10A; (+) strand; PAM type: NNNNGHTT; PAM sequence: TGAAGCTT
ctttatcttgtcttcactta

SEQ ID NO: 12308 - DNA, 20 bp, Artificial Sequence
  Description of Artificial Sequence: Synthetic oligonucleotide
  Target: SCN10A; (+) strand; PAM type: NNNNGHTT; PAM sequence: CTTAGTTT
tcttgtcttcacttatgaag

SEQ ID NO: 12309 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
atattcttggctggcaatta

SEQ ID NO: 12310 - DNA, 20 bp, Artificial Sequence
  Description of Artificial Sequence: Synthetic oligonucleotide
  Target: SCN10A; (+) strand; PAM type: NNNNGHTT; PAM sequence: TCTGGCTT
aagatgggaccctaatccct

SEQ ID NO: 12311 - DNA, 20 bp, Artificial Sequence
  Description of Artificial Sequence: Synthetic oligonucleotide
  Target: SCN10A; (+) strand; PAM type: NNNNGHTT; PAM sequence: CAAGGTTT
ccctaatcccttctggcttg

SEQ ID NO: 12312 - DNA, 20 bp, Artificial Sequence
  Description of Artificial Sequence: Synthetic oligonucleotide
  Target: SCN10A; (+) strand; PAM type: NNNNGHTT; PAM sequence: TGAGGCTT
cctttcctttataggttatc

SEQ ID NO: 12313 - DNA, 20 bp, Artificial Sequence
  Description of Artificial Sequence: Synthetic oligonucleotide
  Target: SCN10A; (+) strand; PAM type: NNNNGHTT; PAM sequence: TTAAGATT
aggcttttgtctcacagctc

SEQ ID NO: 12314 - DNA, 20 bp, Artificial Sequence
  Description of Artificial Sequence: Synthetic oligonucleotide
  Target: SCN10A; (+) strand; PAM type: NNNNGHTT; PAM sequence: TTGAGCTT
acacatttcagaggtattct

SEQ ID NO: 12315 - DNA, 20 bp, Artificial Sequence
  Description of Artificial Sequence: Synthetic oligonucleotide
  Target: SCN10A; (+) strand; PAM type: NNNNGHTT; PAM sequence: GGAAGTTT
tatatttctaacaaggccag

SEQ ID NO: 12316 - DNA, 20 bp, Artificial Sequence
  Description of Artificial Sequence: Synthetic oligonucleotide
  Target: SCN10A; (+) strand; PAM type: NNNNGHTT; PAM sequence: ATAAGTTT
ttcctcaattattccctcaa

SEQ ID NO: 12317 - DNA, 20 bp, Artificial Sequence
  Description of Artificial Sequence: Synthetic oligonucleotide
  Target: SCN10A; (+) strand; PAM type: NNNNGHTT; PAM sequence: TTTAGATT
tcaaataagttttccaaact

SEQ ID NO: 12318 - DNA, 20 bp, Artificial Sequence
  Description of Artificial Sequence: Synthetic oligonucleotide
  Target: SCN10A; (+) strand; PAM type: NNNNGHTT; PAM sequence: TTAGGTTT
cttgggaacacccattattc

SEQ ID NO: 12319 - DNA, 20 bp, Artificial Sequence
  Description of Artificial Sequence: Synthetic oligonucleotide
  Target: SCN10A; (+) strand; PAM type: NNNNGHTT; PAM sequence: GGTTGTTT
cacccattattcttaggttt

SEQ ID NO: 12320 - DNA, 20 bp, Artificial Sequence
  Description of Artificial Sequence: Synthetic oligonucleotide
  Target: SCN10A; (+) strand; PAM type: NNNNGHTT; PAM sequence: ACATGATT
ttcttaggtttggttgtttc

SEQ ID NO: 12321 - DNA, 20 bp, Artificial Sequence
  Description of Artificial Sequence: Synthetic oligonucleotide
  Target: SCN10A; (+) strand; PAM type: NNNNGHTT; PAM sequence: GGCCGATT
cacatgattccaaatttatt

SEQ ID NO: 12322 - DNA, 20 bp, Artificial Sequence
  Description of Artificial Sequence: Synthetic oligonucleotide
  Target: SCN10A; (+) strand; PAM type: NNNNGHTT; PAM sequence: CTTAGTTT
aattctttctttttgtgtgt

SEQ ID NO: 12323 - DNA, 20 bp, Artificial Sequence
  Description of Artificial Sequence: Synthetic oligonucleotide
  Target: SCN10A; (+) strand; PAM type: NNNNGHTT; PAM sequence: AAAAGCTT
tgtcttagtttgggtctatt

SEQ ID NO: 12324 - DNA, 20 bp, Artificial Sequence
  Description of Artificial Sequence: Synthetic oligonucleotide
  Target: SCN10A; (+) strand; PAM type: NNNNGHTT; PAM sequence: TTGTGATT
gagtcttccatttccagaag

SEQ ID NO: 12325 - DNA, 20 bp, Artificial Sequence
  Description of Artificial Sequence: Synthetic oligonucleotide
  Target: SCN10A; (+) strand; PAM type: NNNNGHTT; PAM sequence: GATTGTTT
cttccatttccagaagttgt

SEQ ID NO: 12326 - DNA, 20 bp, Artificial Sequence
  Description of Artificial Sequence: Synthetic oligonucleotide
  Target: SCN10A; (+) strand; PAM type: NNNNGHTT; PAM sequence: TGTTGTTT
agaattttccatccatatct

SEQ ID NO: 12327 - DNA, 20 bp, Artificial Sequence
  Description of Artificial Sequence: Synthetic oligonucleotide
  Target: SCN10A; (+) strand; PAM type: NNNNGHTT; PAM sequence: GTTGGTTT
tgttttaaaaatttctttaa

SEQ ID NO: 12328 - DNA, 20 bp, Artificial Sequence
  Description of Artificial Sequence: Synthetic oligonucleotide
  Target: SCN10A; (+) strand; PAM type: NNNNGHTT; PAM sequence: GATGGATT
tcttttttttttttttttga

SEQ ID NO: 12329 - DNA, 20 bp, Artificial Sequence
  Description of Artificial Sequence: Synthetic oligonucleotide
  Target: SCN10A; (+) strand; PAM type: NNNNGHTT; PAM sequence: CTGGGATT
tgcctcagtctcctgagtag

SEQ ID NO: 12330 - DNA, 20 bp, Artificial Sequence
  Description of Artificial Sequence: Synthetic oligonucleotide
  Target: SCN10A; (+) strand; PAM type: NNNNGHTT; PAM sequence: CGGGGTTT
tttgtattttttagtagaga

SEQ ID NO: 12331 - DNA, 20 bp, Artificial Sequence
  Description of Artificial Sequence: Synthetic oligonucleotide
  Target: SCN10A; (+) strand; PAM type: NNNNGHTT; PAM sequence: GTTGGCTT
tagagacggggtttctccat

SEQ ID NO: 12332 - DNA, 20 bp, Artificial Sequence
  Description of Artificial Sequence: Synthetic oligonucleotide
  Target: SCN10A; (+) strand; PAM type: NNNNGHTT; PAM sequence: CTGAGATT
caccttggcctcccaaagtg

SEQ ID NO: 12333 - DNA, 20 bp, Artificial Sequence
  Description of Artificial Sequence: Synthetic oligonucleotide
  Target: SCN10A; (+) strand; PAM type: NNNNGHTT; PAM sequence: CAGAGATT
gaattctttatctggcaatt

SEQ ID NO: 12334 - DNA, 20 bp, Artificial Sequence
  Description of Artificial Sequence: Synthetic oligonucleotide
  Target: SCN10A; (+) strand; PAM type: NNNNGHTT; PAM sequence: CTTAGTTT
tggcaattcagagatttctt

SEQ ID NO: 12335 - DNA, 20 bp, Artificial Sequence
  Description of Artificial Sequence: Synthetic oligonucleotide
  Target: SCN10A; (+) strand; PAM type: NNNNGHTT; PAM sequence: GCTAGTTT
tttggatccattgttgggga

SEQ ID NO: 12336 - DNA, 20 bp, Artificial Sequence
  Description of Artificial Sequence: Synthetic oligonucleotide
  Target: SCN10A; (+) strand; PAM type: NNNNGHTT; PAM sequence: AATTGCTT
ctcttttgtcatattaccag

SEQ ID NO: 12337 - DNA, 20 bp, Artificial Sequence
  Description of Artificial Sequence: Synthetic oligonucleotide
  Target: SCN10A; (+) strand; PAM type: NNNNGHTT; PAM sequence: TGCAGATT
ctggaactgaatggctgttg

SEQ ID NO: 12338 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
aatggctgttgtgcagattc

SEQ ID NO: 12339 - DNA, 20 bp, Artificial Sequence
  Description of Artificial Sequence: Synthetic oligonucleotide
  Target: SCN10A; (+) strand; PAM type: NNNNGHTT; PAM sequence: TGGGGCTT
tctccccaatcccctgggga

SEQ ID NO: 12340 - DNA, 20 bp, Artificial Sequence
  Description of Artificial Sequence: Synthetic oligonucleotide
  Target: SCN10A; (+) strand; PAM type: NNNNGHTT; PAM sequence: ATGTGATT
atgcctgcaagagtcctgtg

SEQ ID NO: 12341 - DNA, 20 bp, Artificial Sequence
  Description of Artificial Sequence: Synthetic oligonucleotide
  Target: SCN10A; (+) strand; PAM type: NNNNGHTT; PAM sequence: GATAGATT
tgtgagagtcctaggctgta

SEQ ID NO: 12342 - DNA, 20 bp, Artificial Sequence
  Description of Artificial Sequence: Synthetic oligonucleotide
  Target: SCN10A; (+) strand; PAM type: NNNNGHTT; PAM sequence: GCTGGCTT
gctgtagatagatttagtgt

SEQ ID NO: 12343 - DNA, 20 bp, Artificial Sequence
  Description of Artificial Sequence: Synthetic oligonucleotide
  Target: SCN10A; (+) strand; PAM type: NNNNGHTT; PAM sequence: TGTTGTTT
ttgcaggcagtgcaactggt

SEQ ID NO: 12344 - DNA, 20 bp, Artificial Sequence
  Description of Artificial Sequence: Synthetic oligonucleotide
  Target: SCN10A; (+) strand; PAM type: NNNNGHTT; PAM sequence: AGTTGCTT
atcaaagttattctgtcatg

SEQ ID NO: 12345 - DNA, 20 bp, Artificial Sequence
  Description of Artificial Sequence: Synthetic oligonucleotide
  Target: SCN10A; (+) strand; PAM type: NNNNGHTT; PAM sequence: AGCTGTTT
tgagttgctttaatggcctg

SEQ ID NO: 12346 - DNA, 20 bp, Artificial Sequence
  Description of Artificial Sequence: Synthetic oligonucleotide
  Target: SCN10A; (+) strand; PAM type: NNNNGHTT; PAM sequence: TGATGCTT
tttgacctccagccggtagg

SEQ ID NO: 12347 - DNA, 20 bp, Artificial Sequence
  Description of Artificial Sequence: Synthetic oligonucleotide
  Target: SCN10A; (+) strand; PAM type: NNNNGHTT; PAM sequence: TTTAGTTT
aagttggccagggtaaatat

SEQ ID NO: 12348 - DNA, 20 bp, Artificial Sequence
  Description of Artificial Sequence: Synthetic oligonucleotide
  Target: SCN10A; (+) strand; PAM type: NNNNGHTT; PAM sequence: TAAAGCTT
ttaggtgatgagcagggcca

SEQ ID NO: 12349 - DNA, 20 bp, Artificial Sequence
  Description of Artificial Sequence: Synthetic oligonucleotide
  Target: SCN10A; (+) strand; PAM type: NNNNGHTT; PAM sequence: GAGAGTTT
agcagggccataaagcttcc

SEQ ID NO: 12350 - DNA, 20 bp, Artificial Sequence
  Description of Artificial Sequence: Synthetic oligonucleotide
  Target: SCN10A; (+) strand; PAM type: NNNNGHTT; PAM sequence: CTGGGTTT
cataaagcttccgagagttt

SEQ ID NO: 12351 - DNA, 20 bp, Artificial Sequence
  Description of Artificial Sequence: Synthetic oligonucleotide
  Target: SCN10A; (+) strand; PAM type: NNNNGHTT; PAM sequence: TAGGGATT
agactcagacccttcttggg

SEQ ID NO: 12352 - DNA, 20 bp, Artificial Sequence
  Description of Artificial Sequence: Synthetic oligonucleotide
  Target: SCN10A; (+) strand; PAM type: NNNNGHTT; PAM sequence: GTGAGCTT
ctcagaccttgccccaggct

SEQ ID NO: 12353 - DNA, 20 bp, Artificial Sequence
  Description of Artificial Sequence: Synthetic oligonucleotide
  Target: SCN10A; (+) strand; PAM type: NNNNGHTT; PAM sequence: GTCTGCTT
tttggaccgcatccctcact

SEQ ID NO: 12354 - DNA, 20 bp, Artificial Sequence
  Description of Artificial Sequence: Synthetic oligonucleotide
  Target: SCN10A; (+) strand; PAM type: NNNNGHTT; PAM sequence: CCTGGATT
cttgcagttcccatttgccc

SEQ ID NO: 12355 - DNA, 20 bp, Artificial Sequence
  Description of Artificial Sequence: Synthetic oligonucleotide
  Target: SCN10A; (+) strand; PAM type: NNNNGHTT; PAM sequence: CCCTGATT
tctttcatcctgtgacccct

SEQ ID NO: 12356 - DNA, 20 bp, Artificial Sequence
  Description of Artificial Sequence: Synthetic oligonucleotide
  Target: SCN10A; (+) strand; PAM type: NNNNGHTT; PAM sequence: GATGGATT
gcctgtgagacatagtcagg

SEQ ID NO: 12357 - DNA, 20 bp, Artificial Sequence
  Description of Artificial Sequence: Synthetic oligonucleotide
  Target: SCN10A; (+) strand; PAM type: NNNNGHTT; PAM sequence: TGCTGTTT
gcctacaaggcacttccctt

SEQ ID NO: 12358 - DNA, 20 bp, Artificial Sequence
  Description of Artificial Sequence: Synthetic oligonucleotide
  Target: SCN10A; (+) strand; PAM type: NNNNGHTT; PAM sequence: TGTGGCTT
gtttctacttttatattttg

SEQ ID NO: 12359 - DNA, 20 bp, Artificial Sequence
  Description of Artificial Sequence: Synthetic oligonucleotide
  Target: SCN10A; (+) strand; PAM type: NNNNGHTT; PAM sequence: TCTGGATT
ggtaaattcttctcctgtga

SEQ ID NO: 12360 - DNA, 20 bp, Artificial Sequence
  Description of Artificial Sequence: Synthetic oligonucleotide
  Target: SCN10A; (+) strand; PAM type: NNNNGHTT; PAM sequence: TTCAGATT
cttctcctgtgatctggatt

SEQ ID NO: 12361 - DNA, 20 bp, Artificial Sequence
  Description of Artificial Sequence: Synthetic oligonucleotide
  Target: SCN10A; (+) strand; PAM type: NNNNGHTT; PAM sequence: GTATGTTT
tcagattacccagttgggat

SEQ ID NO: 12362 - DNA, 20 bp, Artificial Sequence
  Description of Artificial Sequence: Synthetic oligonucleotide
  Target: SCN10A; (+) strand; PAM type: NNNNGHTT; PAM sequence: GCAGGTTT
gttgggatgtatgtttggag

SEQ ID NO: 12363 - DNA, 20 bp, Artificial Sequence
  Description of Artificial Sequence: Synthetic oligonucleotide
  Target: SCN10A; (+) strand; PAM type: NNNNGHTT; PAM sequence: CACAGTTT
cccctcacactttgggagct

SEQ ID NO: 12364 - DNA, 20 bp, Artificial Sequence
  Description of Artificial Sequence: Synthetic oligonucleotide
  Target: SCN10A; (+) strand; PAM type: NNNNGHTT; PAM sequence: CAAGGCTT
cctcttgccagtatctttat

SEQ ID NO: 12365 - DNA, 20 bp, Artificial Sequence
  Description of Artificial Sequence: Synthetic oligonucleotide
  Target: SCN10A; (+) strand; PAM type: NNNNGHTT; PAM sequence: AGCAGCTT
tgtgtgtggctgggacagcc

SEQ ID NO: 12366 - DNA, 20 bp, Artificial Sequence
  Description of Artificial Sequence: Synthetic oligonucleotide
  Target: SCN10A; (+) strand; PAM type: NNNNGHTT; PAM sequence: CAAGGATT
gggcagtagcgggtgaagag

SEQ ID NO: 12367 - DNA, 20 bp, Artificial Sequence
  Description of Artificial Sequence: Synthetic oligonucleotide
  Target: SCN10A; (+) strand; PAM type: NNNNGHTT; PAM sequence: TCCTGTTT
cgggtgaagagcaaggattc

SEQ ID NO: 12368 - DNA, 20 bp, Artificial Sequence
  Description of Artificial Sequence: Synthetic oligonucleotide
  Target: SCN10A; (+) strand; PAM type: NNNNGHTT; PAM sequence: CCCAGTTT
tggaggctcatctaaaaact

SEQ ID NO: 12369 - DNA, 20 bp, Artificial Sequence
  Description of Artificial Sequence: Synthetic oligonucleotide
  Target: SCN10A; (+) strand; PAM type: NNNNGHTT; PAM sequence: AACTGCTT
gctatgctgcagagccccag

SEQ ID NO: 12370 - DNA, 20 bp, Artificial Sequence
  Description of Artificial Sequence: Synthetic oligonucleotide
  Target: SCN10A; (+) strand; PAM type: NNNNGHTT; PAM sequence: CAAGGTTT
atgctaagtatctctgaaag

SEQ ID NO: 12371 - DNA, 20 bp, Artificial Sequence
  Description of Artificial Sequence: Synthetic oligonucleotide
  Target: SCN10A; (+) strand; PAM type: NNNNGHTT; PAM sequence: AATTGCTT
gtgataagtagggctgaaag

SEQ ID NO: 12372 - DNA, 20 bp, Artificial Sequence
  Description of Artificial Sequence: Synthetic oligonucleotide
  Target: SCN10A; (+) strand; PAM type: NNNNGHTT; PAM sequence: GAAAGTTT
tagggctgaaagaattgctt

SEQ ID NO: 12373 - DNA, 20 bp, Artificial Sequence
  Description of Artificial Sequence: Synthetic oligonucleotide
  Target: SCN10A; (+) strand; PAM type: NNNNGHTT; PAM sequence: TTGAGCTT
aagttttttacaggaaccag

SEQ ID NO: 12374 - DNA, 20 bp, Artificial Sequence
  Description of Artificial Sequence: Synthetic oligonucleotide
  Target: SCN10A; (+) strand; PAM type: NNNNGHTT; PAM sequence: TGCTGCTT
aaccagttgagctttctaga

SEQ ID NO: 12375 - DNA, 20 bp, Artificial Sequence
  Description of Artificial Sequence: Synthetic oligonucleotide
  Target: SCN10A; (+) strand; PAM type: NNNNGHTT; PAM sequence: AACTGTTT
atgccatccattcaatgaga

SEQ ID NO: 12376 - DNA, 20 bp, Artificial Sequence
  Description of Artificial Sequence: Synthetic oligonucleotide
  Target: SCN10A; (+) strand; PAM type: NNNNGHTT; PAM sequence: AATGGATT
gaaactgtttctgctccaga

SEQ ID NO: 12377 - DNA, 20 bp, Artificial Sequence
  Description of Artificial Sequence: Synthetic oligonucleotide
  Target: SCN10A; (+) strand; PAM type: NNNNGHTT; PAM sequence: AAAAGTTT
actgaaaaatgcatataaag

SEQ ID NO: 12378 - DNA, 20 bp, Artificial Sequence
  Description of Artificial Sequence: Synthetic oligonucleotide
  Target: SCN10A; (+) strand; PAM type: NNNNGHTT; PAM sequence: TTAAGTTT
ctattcacttctgctcctcg

SEQ ID NO: 12379 - DNA, 20 bp, Artificial Sequence
  Description of Artificial Sequence: Synthetic oligonucleotide
  Target: SCN10A; (+) strand; PAM type: NNNNGHTT; PAM sequence: TCTGGTTT
gttaagtttccagaagataa

SEQ ID NO: 12380 - DNA, 20 bp, Artificial Sequence
  Description of Artificial Sequence: Synthetic oligonucleotide
  Target: SCN10A; (+) strand; PAM type: NNNNGHTT; PAM sequence: GGATGCTT
aggagcatcaggaatttgaa

SEQ ID NO: 12381 - DNA, 20 bp, Artificial Sequence
  Description of Artificial Sequence: Synthetic oligonucleotide
  Target: SCN10A; (+) strand; PAM type: NNNNGHTT; PAM sequence: GGCAGATT
cactttgggaggccgaggcg

SEQ ID NO: 12382 - DNA, 20 bp, Artificial Sequence
  Description of Artificial Sequence: Synthetic oligonucleotide
  Target: SCN10A; (+) strand; PAM type: NNNNGHTT; PAM sequence: CGGAGCTT
aatggcgtgaacccgggagg

SEQ ID NO: 12383 - DNA, 20 bp, Artificial Sequence
  Description of Artificial Sequence: Synthetic oligonucleotide
  Target: SCN10A; (+) strand; PAM type: NNNNGHTT; PAM sequence: TAAAGTTT
ctaataggcggacttgtaaa

SEQ ID NO: 12384 - DNA, 20 bp, Artificial Sequence
  Description of Artificial Sequence: Synthetic oligonucleotide
  Target: SCN10A; (+) strand; PAM type: NNNNGHTT; PAM sequence: AAAAGTTT
gaaatggataggaagtgata

SEQ ID NO: 12385 - DNA, 20 bp, Artificial Sequence
  Description of Artificial Sequence: Synthetic oligonucleotide
  Target: SCN10A; (+) strand; PAM type: NNNNGHTT; PAM sequence: TATTGTTT
gagaatcagactaggaggta

SEQ ID NO: 12386 - DNA, 20 bp, Artificial Sequence
  Description of Artificial Sequence: Synthetic oligonucleotide
  Target: SCN10A; (+) strand; PAM type: NNNNGHTT; PAM sequence: AGGAGTTT
caggaggatcacttgaaccc

SEQ ID NO: 12387 - DNA, 20 bp, Artificial Sequence
  Description of Artificial Sequence: Synthetic oligonucleotide
  Target: SCN10A; (+) strand; PAM type: NNNNGHTT; PAM sequence: CTGTGATT
cagaagatgaagtactctag

SEQ ID NO: 12388 - DNA, 20 bp, Artificial Sequence
  Description of Artificial Sequence: Synthetic oligonucleotide
  Target: SCN10A; (+) strand; PAM type: NNNNGHTT; PAM sequence: AAGAGTTT
caacaattaaacatctggag

SEQ ID NO: 12389 - DNA, 20 bp, Artificial Sequence
  Description of Artificial Sequence: Synthetic oligonucleotide
  Target: SCN10A; (+) strand; PAM type: NNNNGHTT; PAM sequence: CAGTGTTT
ctgcatgacacagctgtaaa

SEQ ID NO: 12390 - DNA, 20 bp, Artificial Sequence
  Description of Artificial Sequence: Synthetic oligonucleotide
  Target: SCN10A; (+) strand; PAM type: NNNNGHTT; PAM sequence: TGAAGATT
atattatctgatgatctaac

SEQ ID NO: 12391 - DNA, 20 bp, Artificial Sequence
  Description of Artificial Sequence: Synthetic oligonucleotide
  Target: SCN10A; (+) strand; PAM type: NNNNGHTT; PAM sequence: ATGAGTTT
gaagatgagggtgagaggaa

SEQ ID NO: 12392 - DNA, 20 bp, Artificial Sequence
  Description of Artificial Sequence: Synthetic oligonucleotide
  Target: SCN10A; (+) strand; PAM type: NNNNGHTT; PAM sequence: TTAAGTTT
atgagtttgtggatgtggcc

SEQ ID NO: 12393 - DNA, 20 bp, Artificial Sequence
  Description of Artificial Sequence: Synthetic oligonucleotide
  Target: SCN10A; (+) strand; PAM type: NNNNGHTT; PAM sequence: TGCTGTTT
agagatgagaaaaatgaaat

SEQ ID NO: 12394 - DNA, 20 bp, Artificial Sequence
  Description of Artificial Sequence: Synthetic oligonucleotide
  Target: SCN10A; (+) strand; PAM type: NNNNGHTT; PAM sequence: TCGTGTTT
cacatctgtgagaggagaaa

SEQ ID NO: 12395 - DNA, 20 bp, Artificial Sequence
  Description of Artificial Sequence: Synthetic oligonucleotide
  Target: SCN10A; (+) strand; PAM type: NNNNGHTT; PAM sequence: AGCTGCTT
gaatctatatctggttgcat

SEQ ID NO: 12396 - DNA, 20 bp, Artificial Sequence
  Description of Artificial Sequence: Synthetic oligonucleotide
  Target: SCN10A; (+) strand; PAM type: NNNNGHTT; PAM sequence: GTCAGCTT
gttgcatagctgcttgagct

SEQ ID NO: 12397 - DNA, 20 bp, Artificial Sequence
  Description of Artificial Sequence: Synthetic oligonucleotide
  Target: SCN10A; (+) strand; PAM type: NNNNGHTT; PAM sequence: GTTGGTTT
gctgtcagcttccatatctt

SEQ ID NO: 12398 - DNA, 20 bp, Artificial Sequence
  Description of Artificial Sequence: Synthetic oligonucleotide
  Target: SCN10A; (+) strand; PAM type: NNNNGHTT; PAM sequence: TTATGTTT
tggtttcccccccacactct

SEQ ID NO: 12399 - DNA, 20 bp, Artificial Sequence
  Description of Artificial Sequence: Synthetic oligonucleotide
  Target: SCN10A; (+) strand; PAM type: NNNNGHTT; PAM sequence: GGAAGCTT
ctcagaattataggttgttg

SEQ ID NO: 12400 - DNA, 20 bp, Artificial Sequence
  Description of Artificial Sequence: Synthetic oligonucleotide
  Target: SCN10A; (+) strand; PAM type: NNNNGHTT; PAM sequence: TCTGGTTT
gggaagctttgatggatatt

SEQ ID NO: 12401 - DNA, 20 bp, Artificial Sequence
  Description of Artificial Sequence: Synthetic oligonucleotide
  Target: SCN10A; (+) strand; PAM type: NNNNGHTT; PAM sequence: CAGTGCTT
tgctctctaaagactatttt

SEQ ID NO: 12402 - DNA, 20 bp, Artificial Sequence
  Description of Artificial Sequence: Synthetic oligonucleotide
  Target: SCN10A; (+) strand; PAM type: NNNNGHTT; PAM sequence: AAGTGCTT
agcccaatgtgttatttcct

SEQ ID NO: 12403 - DNA, 20 bp, Artificial Sequence
  Description of Artificial Sequence: Synthetic oligonucleotide
  Target: SCN10A; (+) strand; PAM type: NNNNGHTT; PAM sequence: GTCTGATT
gagccacttgcaccactgat

SEQ ID NO: 12404 - DNA, 20 bp, Artificial Sequence
  Description of Artificial Sequence: Synthetic oligonucleotide
  Target: SCN10A; (+) strand; PAM type: NNNNGHTT; PAM sequence: CAAAGATT
cgatattcaggctctgaaaa

SEQ ID NO: 12405 - DNA, 20 bp, Artificial Sequence
  Description of Artificial Sequence: Synthetic oligonucleotide
  Target: SCN10A; (+) strand; PAM type: NNNNGHTT; PAM sequence: ATCAGTTT
atgtacactaagtgaccaca

SEQ ID NO: 12406 - DNA, 20 bp, Artificial Sequence
  Description of Artificial Sequence: Synthetic oligonucleotide
  Target: SCN10A; (+) strand; PAM type: NNNNGHTT; PAM sequence: TGGAGTTT
ttccttgctgaccatgtggc

SEQ ID NO: 12407 - DNA, 20 bp, Artificial Sequence
  Description of Artificial Sequence: Synthetic oligonucleotide
  Target: SCN10A; (+) strand; PAM type: NNNNGHTT; PAM sequence: AAAAGTTT
acacctttcctcttttaaaa

SEQ ID NO: 12408 - DNA, 20 bp, Artificial Sequence
  Description of Artificial Sequence: Synthetic oligonucleotide
  Target: SCN10A; (+) strand; PAM type: NNNNGHTT; PAM sequence: ATCTGTTT
attgtggaactatcaccact

SEQ ID NO: 12409 - DNA, 20 bp, Artificial Sequence
  Description of Artificial Sequence: Synthetic oligonucleotide
  Target: SCN10A; (+) strand; PAM type: NNNNGHTT; PAM sequence: TTGCGTTT
atcatgcaacatttgttctt

SEQ ID NO: 12410 - DNA, 20 bp, Artificial Sequence
  Description of Artificial Sequence: Synthetic oligonucleotide
  Target: SCN10A; (+) strand; PAM type: NNNNGHTT; PAM sequence: CAATGCTT
ttgagttattttacttagca

SEQ ID NO: 12411 - DNA, 20 bp, Artificial Sequence
  Description of Artificial Sequence: Synthetic oligonucleotide
  Target: SCN10A; (+) strand; PAM type: NNNNGHTT; PAM sequence: AATTGTTT
tttaaaactgaatgatattc

SEQ ID NO: 12412 - DNA, 20 bp, Artificial Sequence
  Description of Artificial Sequence: Synthetic oligonucleotide
  Target: SCN10A; (+) strand; PAM type: NNNNGHTT; PAM sequence: GTCTGTTT
aagccaacataccttttaaa

SEQ ID NO: 12413 - DNA, 20 bp, Artificial Sequence
  Description of Artificial Sequence: Synthetic oligonucleotide
  Target: SCN10A; (+) strand; PAM type: NNNNGHTT; PAM sequence: ATTAGCTT
cagagagctcttcttttaaa

SEQ ID NO: 12414 - DNA, 20 bp, Artificial Sequence
  Description of Artificial Sequence: Synthetic oligonucleotide
  Target: SCN10A; (+) strand; PAM type: NNNNGHTT; PAM sequence: CATAGTTT
atgctgacaacttacttatt

SEQ ID NO: 12415 - DNA, 20 bp, Artificial Sequence
  Description of Artificial Sequence: Synthetic oligonucleotide
  Target: SCN10A; (+) strand; PAM type: NNNNGHTT; PAM sequence: AATTGTTT
tctaattaaggaattatacc

SEQ ID NO: 12416 - DNA, 20 bp, Artificial Sequence
  Description of Artificial Sequence: Synthetic oligonucleotide
  Target: SCN10A; (+) strand; PAM type: NNNNGHTT; PAM sequence: TCTTGTTT
ggaattataccaattgtttt

SEQ ID NO: 12417 - DNA, 20 bp, Artificial Sequence
  Description of Artificial Sequence: Synthetic oligonucleotide
  Target: SCN10A; (+) strand; PAM type: NNNNGHTT; PAM sequence: AATTGATT
tctccaaccacaatatttgt

SEQ ID NO: 12418 - DNA, 20 bp, Artificial Sequence
  Description of Artificial Sequence: Synthetic oligonucleotide
  Target: SCN10A; (+) strand; PAM type: NNNNGHTT; PAM sequence: ACTGGTTT
tatttgtaattgatttggaa

SEQ ID NO: 12419 - DNA, 20 bp, Artificial Sequence
  Description of Artificial Sequence: Synthetic oligonucleotide
  Target: SCN10A; (+) strand; PAM type: NNNNGHTT; PAM sequence: TTGTGCTT
tcttaccagcaggagtgcaa

SEQ ID NO: 12420 - DNA, 20 bp, Artificial Sequence
  Description of Artificial Sequence: Synthetic oligonucleotide
  Target: SCN10A; (+) strand; PAM type: NNNNGHTT; PAM sequence: TATAGTTT
atgaggatgaatgatgactc

SEQ ID NO: 12421 - DNA, 20 bp, Artificial Sequence
  Description of Artificial Sequence: Synthetic oligonucleotide
  Target: SCN10A; (+) strand; PAM type: NNNNGHTT; PAM sequence: TTGTGCTT
tatactgggaaagccttatt

SEQ ID NO: 12422 - DNA, 20 bp, Artificial Sequence
  Description of Artificial Sequence: Synthetic oligonucleotide
  Target: SCN10A; (+) strand; PAM type: NNNNGHTT; PAM sequence: ATTGGTTT
gcttgtagtagagatattca

SEQ ID NO: 12423 - DNA, 20 bp, Artificial Sequence
  Description of Artificial Sequence: Synthetic oligonucleotide
  Target: SCN10A; (+) strand; PAM type: NNNNGHTT; PAM sequence: GGAAGTTT
actttattggaaaataatat

SEQ ID NO: 12424 - DNA, 20 bp, Artificial Sequence
  Description of Artificial Sequence: Synthetic oligonucleotide
  Target: SCN10A; (+) strand; PAM type: NNNNGHTT; PAM sequence: GATAGCTT
gaaaataatatggaagtttt

SEQ ID NO: 12425 - DNA, 20 bp, Artificial Sequence
  Description of Artificial Sequence: Synthetic oligonucleotide
  Target: SCN10A; (+) strand; PAM type: NNNNGHTT; PAM sequence: TCTGGTTT
cattttcttatatatttttg

SEQ ID NO: 12426 - DNA, 20 bp, Artificial Sequence
  Description of Artificial Sequence: Synthetic oligonucleotide
  Target: SCN10A; (+) strand; PAM type: NNNNGHTT; PAM sequence: GGGAGATT
atatatttttgtctggtttt

SEQ ID NO: 12427 - DNA, 20 bp, Artificial Sequence
  Description of Artificial Sequence: Synthetic oligonucleotide
  Target: SCN10A; (+) strand; PAM type: NNNNGHTT; PAM sequence: AACAGATT
tatccacttgtctcatgaca

SEQ ID NO: 12428 - DNA, 20 bp, Artificial Sequence
  Description of Artificial Sequence: Synthetic oligonucleotide
  Target: SCN10A; (+) strand; PAM type: NNNNGHTT; PAM sequence: TCATGCTT
ttgtctcatgacaaacagat

SEQ ID NO: 12429 - DNA, 20 bp, Artificial Sequence
  Description of Artificial Sequence: Synthetic oligonucleotide
  Target: SCN10A; (+) strand; PAM type: NNNNGHTT; PAM sequence: GTAGGATT
ttgtgaccttatttcacatt

SEQ ID NO: 12430 - DNA, 20 bp, Artificial Sequence
  Description of Artificial Sequence: Synthetic oligonucleotide
  Target: SCN10A; (+) strand; PAM type: NNNNGHTT; PAM sequence: TTATGCTT
ttctatttttatcattattg

SEQ ID NO: 12431 - DNA, 20 bp, Artificial Sequence
  Description of Artificial Sequence: Synthetic oligonucleotide
  Target: SCN10A; (+) strand; PAM type: NNNNGHTT; PAM sequence: CTATGATT
cattagtcaagataaactgc

SEQ ID NO: 12432 - DNA, 20 bp, Artificial Sequence
  Description of Artificial Sequence: Synthetic oligonucleotide
  Target: SCN10A; (+) strand; PAM type: NNNNGHTT; PAM sequence: ATCAGTTT
tgttaaccattatgaatgaa

SEQ ID NO: 12433 - DNA, 20 bp, Artificial Sequence
  Description of Artificial Sequence: Synthetic oligonucleotide
  Target: SCN10A; (+) strand; PAM type: NNNNGHTT; PAM sequence: CACTGTTT
atcagtttttgaagcacata

SEQ ID NO: 12434 - DNA, 20 bp, Artificial Sequence
  Description of Artificial Sequence: Synthetic oligonucleotide
  Target: SCN10A; (+) strand; PAM type: NNNNGHTT; PAM sequence: GTTAGATT
tataataattaatcttacat

SEQ ID NO: 12435 - DNA, 20 bp, Artificial Sequence
  Description of Artificial Sequence: Synthetic oligonucleotide
  Target: SCN10A; (+) strand; PAM type: NNNNGHTT; PAM sequence: GACAGTTT
gagttggaacatcccaaagg

SEQ ID NO: 12436 - DNA, 20 bp, Artificial Sequence
  Description of Artificial Sequence: Synthetic oligonucleotide
  Target: SCN10A; (+) strand; PAM type: NNNNGHTT; PAM sequence: AGAAGATT
ccaaagggacagtttatgaa

SEQ ID NO: 12437 - DNA, 20 bp, Artificial Sequence
  Description of Artificial Sequence: Synthetic oligonucleotide
  Target: SCN10A; (+) strand; PAM type: NNNNGHTT; PAM sequence: GTTAGTTT
aaaaatagactaacaaacct

SEQ ID NO: 12438 - DNA, 20 bp, Artificial Sequence
  Description of Artificial Sequence: Synthetic oligonucleotide
  Target: SCN10A; (+) strand; PAM type: NNNNGHTT; PAM sequence: TACAGATT
gactaacaaacctgttagtt

SEQ ID NO: 12439 - DNA, 20 bp, Artificial Sequence
  Description of Artificial Sequence: Synthetic oligonucleotide
  Target: SCN10A; (+) strand; PAM type: NNNNGHTT; PAM sequence: CATAGCTT
aaaataaatatgctcactgt

SEQ ID NO: 12440 - DNA, 20 bp, Artificial Sequence
  Description of Artificial Sequence: Synthetic oligonucleotide
  Target: SCN10A; (+) strand; PAM type: NNNNGHTT; PAM sequence: ACAAGTTT
taagaatcataaaggaagaa

SEQ ID NO: 12441 - DNA, 20 bp, Artificial Sequence
  Description of Artificial Sequence: Synthetic oligonucleotide
  Target: SCN10A; (+) strand; PAM type: NNNNGHTT; PAM sequence: GACAGTTT
atagaaattaataatattaa

SEQ ID NO: 12442 - DNA, 20 bp, Artificial Sequence
  Description of Artificial Sequence: Synthetic oligonucleotide
  Target: SCN10A; (+) strand; PAM type: NNNNGHTT; PAM sequence: GAAGGCTT
tctgccatactgatgtgtgg

SEQ ID NO: 12443 - DNA, 20 bp, Artificial Sequence
  Description of Artificial Sequence: Synthetic oligonucleotide
  Target: SCN10A; (+) strand; PAM type: NNNNGHTT; PAM sequence: TGGCGATT
aaggcttcgtattgtaaatg

SEQ ID NO: 12444 - DNA, 20 bp, Artificial Sequence
  Description of Artificial Sequence: Synthetic oligonucleotide
  Target: SCN10A; (+) strand; PAM type: NNNNGHTT; PAM sequence: CAAAGTTT
caattcagtgcattaccaaa

SEQ ID NO: 12445 - DNA, 20 bp, Artificial Sequence
  Description of Artificial Sequence: Synthetic oligonucleotide
  Target: SCN10A; (+) strand; PAM type: NNNNGHTT; PAM sequence: ATGAGATT
tgttgactcaggatgtgaca

SEQ ID NO: 12446 - DNA, 20 bp, Artificial Sequence
  Description of Artificial Sequence: Synthetic oligonucleotide
  Target: SCN10A; (+) strand; PAM type: NNNNGHTT; PAM sequence: AACAGATT
acaatgagattactgggaga

SEQ ID NO: 12447 - DNA, 20 bp, Artificial Sequence
  Description of Artificial Sequence: Synthetic oligonucleotide
  Target: SCN10A; (+) strand; PAM type: NNNNGHTT; PAM sequence: AGGAGATT
cacatacaaaaataaattct

SEQ ID NO: 12448 - DNA, 20 bp, Artificial Sequence
  Description of Artificial Sequence: Synthetic oligonucleotide
  Target: SCN10A; (+) strand; PAM type: NNNNGHTT; PAM sequence: CCCCGTTT
gcagtgttaaacacccactt

SEQ ID NO: 12449 - DNA, 20 bp, Artificial Sequence
  Description of Artificial Sequence: Synthetic oligonucleotide
  Target: SCN10A; (+) strand; PAM type: NNNNGHTT; PAM sequence: AGTAGATT
acacccacttccccgtttgc

SEQ ID NO: 12450 - DNA, 20 bp, Artificial Sequence
  Description of Artificial Sequence: Synthetic oligonucleotide
  Target: SCN10A; (+) strand; PAM type: NNNNGHTT; PAM sequence: TTCAGCTT
acttccccgtttgcagtaga

SEQ ID NO: 12451 - DNA, 20 bp, Artificial Sequence
  Description of Artificial Sequence: Synthetic oligonucleotide
  Target: SCN10A; (+) strand; PAM type: NNNNGHTT; PAM sequence: AAAGGTTT
ccaaattgctataatttgtc

SEQ ID NO: 12452 - DNA, 20 bp, Artificial Sequence
  Description of Artificial Sequence: Synthetic oligonucleotide
  Target: SCN10A; (+) strand; PAM type: NNNNGHTT; PAM sequence: TTATGCTT
aaaggttttccagaatattg

SEQ ID NO: 12453 - DNA, 20 bp, Artificial Sequence
  Description of Artificial Sequence: Synthetic oligonucleotide
  Target: SCN10A; (+) strand; PAM type: NNNNGHTT; PAM sequence: CAATGATT
gggtcatcaaagagcccctt

SEQ ID NO: 12454 - DNA, 20 bp, Artificial Sequence
  Description of Artificial Sequence: Synthetic oligonucleotide
  Target: SCN10A; (+) strand; PAM type: NNNNGHTT; PAM sequence: TCTAGTTT
gcccaatctgaggaagaacc

SEQ ID NO: 12455 - DNA, 20 bp, Artificial Sequence
  Description of Artificial Sequence: Synthetic oligonucleotide
  Target: SCN10A; (+) strand; PAM type: NNNNGHTT; PAM sequence: AGGGGATT
agtttcttcccaagcaaaag

SEQ ID NO: 12456 - DNA, 20 bp, Artificial Sequence
  Description of Artificial Sequence: Synthetic oligonucleotide
  Target: SCN10A; (+) strand; PAM type: NNNNGHTT; PAM sequence: TAATGTTT
agcaggtaattgtgcaaagc

SEQ ID NO: 12457 - DNA, 20 bp, Artificial Sequence
  Description of Artificial Sequence: Synthetic oligonucleotide
  Target: SCN10A; (+) strand; PAM type: NNNNGHTT; PAM sequence: AAAAGATT
gaagggagggaagataagga

SEQ ID NO: 12458 - DNA, 20 bp, Artificial Sequence
  Description of Artificial Sequence: Synthetic oligonucleotide
  Target: SCN10A; (+) strand; PAM type: NNNNGHTT; PAM sequence: ATAAGATT
attgtgttaagaacatggca

SEQ ID NO: 12459 - DNA, 20 bp, Artificial Sequence
  Description of Artificial Sequence: Synthetic oligonucleotide
  Target: SCN10A; (+) strand; PAM type: NNNNGHTT; PAM sequence: ATTGGTTT
gttaagaacatggcaataag

SEQ ID NO: 12460 - DNA, 20 bp, Artificial Sequence
  Description of Artificial Sequence: Synthetic oligonucleotide
  Target: SCN10A; (+) strand; PAM type: NNNNGHTT; PAM sequence: TTCTGATT
aacatggcaataagattggt

SEQ ID NO: 12461 - DNA, 20 bp, Artificial Sequence
  Description of Artificial Sequence: Synthetic oligonucleotide
  Target: SCN10A; (+) strand; PAM type: NNNNGHTT; PAM sequence: TAATGCTT
attcctcactggctacaatt

SEQ ID NO: 12462 - DNA, 20 bp, Artificial Sequence
  Description of Artificial Sequence: Synthetic oligonucleotide
  Target: SCN10A; (+) strand; PAM type: NNNNGHTT; PAM sequence: GTCTGATT
catttcaaaaagaaaatcta

SEQ ID NO: 12463 - DNA, 20 bp, Artificial Sequence
  Description of Artificial Sequence: Synthetic oligonucleotide
  Target: SCN10A; (+) strand; PAM type: NNNNGHTT; PAM sequence: CCAGGATT
aatacctgtcacataaattc

SEQ ID NO: 12464 - DNA, 20 bp, Artificial Sequence
  Description of Artificial Sequence: Synthetic oligonucleotide
  Target: SCN10A; (+) strand; PAM type: NNNNGHTT; PAM sequence: GGTAGATT
cccaggattgtgaccatata

SEQ ID NO: 12465 - DNA, 20 bp, Artificial Sequence
  Description of Artificial Sequence: Synthetic oligonucleotide
  Target: SCN10A; (+) strand; PAM type: NNNNGHTT; PAM sequence: AATGGATT
taatacaaaatctcctaaag

SEQ ID NO: 12466 - DNA, 20 bp, Artificial Sequence
  Description of Artificial Sequence: Synthetic oligonucleotide
  Target: SCN10A; (+) strand; PAM type: NNNNGHTT; PAM sequence: AGACGATT
ggaaaggatccaactttgga

SEQ ID NO: 12467 - DNA, 20 bp, Artificial Sequence
  Description of Artificial Sequence: Synthetic oligonucleotide
  Target: SCN10A; (+) strand; PAM type: NNNNGHTT; PAM sequence: TGAGGATT
taatatgtggtggcaaaata

SEQ ID NO: 12468 - DNA, 20 bp, Artificial Sequence
  Description of Artificial Sequence: Synthetic oligonucleotide
  Target: SCN10A; (+) strand; PAM type: NNNNGHTT; PAM sequence: CTGGGATT
tttctataaaacagctgctg

SEQ ID NO: 12469 - DNA, 20 bp, Artificial Sequence
  Description of Artificial Sequence: Synthetic oligonucleotide
  Target: SCN10A; (+) strand; PAM type: NNNNGHTT; PAM sequence: TTTGGATT
tgcatatttttacaacagca

SEQ ID NO: 12470 - DNA, 20 bp, Artificial Sequence
  Description of Artificial Sequence: Synthetic oligonucleotide
  Target: SCN10A; (+) strand; PAM type: NNNNGHTT; PAM sequence: TACTGTTT
gcatttggatttattagatc

SEQ ID NO: 12471 - DNA, 20 bp, Artificial Sequence
  Description of Artificial Sequence: Synthetic oligonucleotide
  Target: SCN10A; (+) strand; PAM type: NNNNGHTT; PAM sequence: TATTGCTT
tgtttttctattttgtaatt

SEQ ID NO: 12472 - DNA, 20 bp, Artificial Sequence
  Description of Artificial Sequence: Synthetic oligonucleotide
  Target: SCN10A; (+) strand; PAM type: NNNNGHTT; PAM sequence: TCTAGTTT
ctttcatttgttatcctttt

SEQ ID NO: 12473 - DNA, 20 bp, Artificial Sequence
  Description of Artificial Sequence: Synthetic oligonucleotide
  Target: SCN10A; (+) strand; PAM type: NNNNGHTT; PAM sequence: TTCAGCTT
aggtctttaaataatttctt

SEQ ID NO: 12474 - DNA, 20 bp, Artificial Sequence
  Description of Artificial Sequence: Synthetic oligonucleotide
  Target: SCN10A; (+) strand; PAM type: NNNNGHTT; PAM sequence: CTATGCTT
cttttactgatataaatatt

SEQ ID NO: 12475 - DNA, 20 bp, Artificial Sequence
  Description of Artificial Sequence: Synthetic oligonucleotide
  Target: SCN10A; (+) strand; PAM type: NNNNGHTT; PAM sequence: TTCTGATT
ctttaactgcactctctagg

SEQ ID NO: 12476 - DNA, 20 bp, Artificial Sequence
  Description of Artificial Sequence: Synthetic oligonucleotide
  Target: SCN10A; (+) strand; PAM type: NNNNGHTT; PAM sequence: AACTGTTT
cactctctaggttctgatta

SEQ ID NO: 12477 - DNA, 20 bp, Artificial Sequence
  Description of Artificial Sequence: Synthetic oligonucleotide
  Target: SCN10A; (+) strand; PAM type: NNNNGHTT; PAM sequence: TTTAGTTT
ttccctcgaaattatataat

SEQ ID NO: 12478 - DNA, 20 bp, Artificial Sequence
  Description of Artificial Sequence: Synthetic oligonucleotide
  Target: SCN10A; (+) strand; PAM type: NNNNGHTT; PAM sequence: TATAGTTT
gaaattatataattttagtt

SEQ ID NO: 12479 - DNA, 20 bp, Artificial Sequence
  Description of Artificial Sequence: Synthetic oligonucleotide
  Target: SCN10A; (+) strand; PAM type: NNNNGHTT; PAM sequence: GAGAGATT
tttgtccaagaattctttaa

SEQ ID NO: 12480 - DNA, 20 bp, Artificial Sequence
  Description of Artificial Sequence: Synthetic oligonucleotide
  Target: SCN10A; (+) strand; PAM type: NNNNGHTT; PAM sequence: GAATGTTT
tctatttcattatgatcaga

SEQ ID NO: 12481 - DNA, 20 bp, Artificial Sequence
  Description of Artificial Sequence: Synthetic oligonucleotide
  Target: SCN10A; (+) strand; PAM type: NNNNGHTT; PAM sequence: TGGAGCTT
tctatattatttccactttc

SEQ ID NO: 12482 - DNA, 20 bp, Artificial Sequence
  Description of Artificial Sequence: Synthetic oligonucleotide
  Target: SCN10A; (+) strand; PAM type: NNNNGHTT; PAM sequence: TGAGGTTT
ttccactttctggagcttat

SEQ ID NO: 12483 - DNA, 20 bp, Artificial Sequence
  Description of Artificial Sequence: Synthetic oligonucleotide
  Target: SCN10A; (+) strand; PAM type: NNNNGHTT; PAM sequence: CATGGCTT
gagcttattgaggtttttgt

SEQ ID NO: 12484 - DNA, 20 bp, Artificial Sequence
  Description of Artificial Sequence: Synthetic oligonucleotide
  Target: SCN10A; (+) strand; PAM type: NNNNGHTT; PAM sequence: TTTGGTTT
gtttttgtcatggcttaata

SEQ ID NO: 12485 - DNA, 20 bp, Artificial Sequence
  Description of Artificial Sequence: Synthetic oligonucleotide
  Target: SCN10A; (+) strand; PAM type: NNNNGHTT; PAM sequence: ATATGTTT
atggcttaatatttggtttg

SEQ ID NO: 12486 - DNA, 20 bp, Artificial Sequence
  Description of Artificial Sequence: Synthetic oligonucleotide
  Target: SCN10A; (+) strand; PAM type: NNNNGHTT; PAM sequence: TTTGGTTT
ttaatatttggtttgatatg

SEQ ID NO: 12487 - DNA, 20 bp, Artificial Sequence
  Description of Artificial Sequence: Synthetic oligonucleotide
  Target: SCN10A; (+) strand; PAM type: NNNNGHTT; PAM sequence: GGTAGTTT
cattttctattgttagggaa

SEQ ID NO: 12488 - DNA, 20 bp, Artificial Sequence
  Description of Artificial Sequence: Synthetic oligonucleotide
  Target: SCN10A; (+) strand; PAM type: NNNNGHTT; PAM sequence: CAATGTTT
attgaaaatttctattccta

SEQ ID NO: 12489 - DNA, 20 bp, Artificial Sequence
  Description of Artificial Sequence: Synthetic oligonucleotide
  Target: SCN10A; (+) strand; PAM type: NNNNGHTT; PAM sequence: TTCTGATT
tatcctcctactctaataat

SEQ ID NO: 12490 - DNA, 20 bp, Artificial Sequence
  Description of Artificial Sequence: Synthetic oligonucleotide
  Target: SCN10A; (+) strand; PAM type: NNNNGHTT; PAM sequence: TATAGATT
catcttatttgttgcaaaga

SEQ ID NO: 12491 - DNA, 20 bp, Artificial Sequence
  Description of Artificial Sequence: Synthetic oligonucleotide
  Target: SCN10A; (+) strand; PAM type: NNNNGHTT; PAM sequence: TCATGCTT
tgtgcaatttttgtcctatt

SEQ ID NO: 12492 - DNA, 20 bp, Artificial Sequence
  Description of Artificial Sequence: Synthetic oligonucleotide
  Target: SCN10A; (+) strand; PAM type: NNNNGHTT; PAM sequence: CCGAGATT
tcctatttcatgctttttga

SEQ ID NO: 12493 - DNA, 20 bp, Artificial Sequence
  Description of Artificial Sequence: Synthetic oligonucleotide
  Target: SCN10A; (+) strand; PAM type: NNNNGHTT; PAM sequence: TCCTGCTT
tctgatattaaaatcatgga

SEQ ID NO: 12494 - DNA, 20 bp, Artificial Sequence
  Description of Artificial Sequence: Synthetic oligonucleotide
  Target: SCN10A; (+) strand; PAM type: NNNNGHTT; PAM sequence: CTTTGTTT
aaaatcatggatcctgcttt

SEQ ID NO: 12495 - DNA, 20 bp, Artificial Sequence
  Description of Artificial Sequence: Synthetic oligonucleotide
  Target: SCN10A; (+) strand; PAM type: NNNNGHTT; PAM sequence: CTTTGCTT
atcctgctttctttgtttgc

SEQ ID NO: 12496 - DNA, 20 bp, Artificial Sequence
  Description of Artificial Sequence: Synthetic oligonucleotide
  Target: SCN10A; (+) strand; PAM type: NNNNGHTT; PAM sequence: TATTGCTT
ttattcaacatagagttggg

SEQ ID NO: 12497 - DNA, 20 bp, Artificial Sequence
  Description of Artificial Sequence: Synthetic oligonucleotide
  Target: SCN10A; (+) strand; PAM type: NNNNGHTT; PAM sequence: GACAGATT
ccatttatatttagtgacat

SEQ ID NO: 12498 - DNA, 20 bp, Artificial Sequence
  Description of Artificial Sequence: Synthetic oligonucleotide
  Target: SCN10A; (+) strand; PAM type: NNNNGHTT; PAM sequence: ATTTGCTT
tatatttagtgacatgacag

SEQ ID NO: 12499 - DNA, 20 bp, Artificial Sequence
  Description of Artificial Sequence: Synthetic oligonucleotide
  Target: SCN10A; (+) strand; PAM type: NNNNGHTT; PAM sequence: CTTAGCTT
acatgacagatttgcttagt

SEQ ID NO: 12500 - DNA, 20 bp, Artificial Sequence
  Description of Artificial Sequence: Synthetic oligonucleotide
  Target: SCN10A; (+) strand; PAM type: NNNNGHTT; PAM sequence: GCTTGTTT
gacagatttgcttagtctta

SEQ ID NO: 12501 - DNA, 20 bp, Artificial Sequence
  Description of Artificial Sequence: Synthetic oligonucleotide
  Target: SCN10A; (+) strand; PAM type: NNNNGHTT; PAM sequence: TTTAGTTT
atattatttcatatgacgta

SEQ ID NO: 12502 - DNA, 20 bp, Artificial Sequence
  Description of Artificial Sequence: Synthetic oligonucleotide
  Target: SCN10A; (+) strand; PAM type: NNNNGHTT; PAM sequence: TGTGGTTT
taggttggtacaaaagtaat

SEQ ID NO: 12503 - DNA, 20 bp, Artificial Sequence
  Description of Artificial Sequence: Synthetic oligonucleotide
  Target: SCN10A; (+) strand; PAM type: NNNNGHTT; PAM sequence: TGCCGTTT
gtttttgcattgttgaaatt

SEQ ID NO: 12504 - DNA, 20 bp, Artificial Sequence
  Description of Artificial Sequence: Synthetic oligonucleotide
  Target: SCN10A; (+) strand; PAM type: NNNNGHTT; PAM sequence: TGCTGTTT
tttgctaatgacttattact

SEQ ID NO: 12505 - DNA, 20 bp, Artificial Sequence
  Description of Artificial Sequence: Synthetic oligonucleotide
  Target: SCN10A; (+) strand; PAM type: NNNNGHTT; PAM sequence: GAGCGATT
gttatacaaaaagcaaattc

SEQ ID NO: 12506 - DNA, 20 bp, Artificial Sequence
  Description of Artificial Sequence: Synthetic oligonucleotide
  Target: SCN10A; (+) strand; PAM type: NNNNGHTT; PAM sequence: CAGGGATT
catcaacaacgcatttggcc

SEQ ID NO: 12507 - DNA, 20 bp, Artificial Sequence
  Description of Artificial Sequence: Synthetic oligonucleotide
  Target: SCN10A; (+) strand; PAM type: NNNNGHTT; PAM sequence: AGAAGTTT
tacagtgcagtggtggttca

SEQ ID NO: 12508 - DNA, 20 bp, Artificial Sequence
  Description of Artificial Sequence: Synthetic oligonucleotide
  Target: SCN10A; (+) strand; PAM type: NNNNGHTT; PAM sequence: AAATGTTT
gtgcctcataagctaaggaa

SEQ ID NO: 12509 - DNA, 20 bp, Artificial Sequence
  Description of Artificial Sequence: Synthetic oligonucleotide
  Target: SCN10A; (+) strand; PAM type: NNNNGHTT; PAM sequence: ATCAGATT
caaaaatgaactatttctta

SEQ ID NO: 12510 - DNA, 20 bp, Artificial Sequence
  Description of Artificial Sequence: Synthetic oligonucleotide
  Target: SCN10A; (+) strand; PAM type: NNNNGHTT; PAM sequence: ACCAGCTT
ttacttgacaactggcaatg

SEQ ID NO: 12511 - DNA, 20 bp, Artificial Sequence
  Description of Artificial Sequence: Synthetic oligonucleotide
  Target: SCN10A; (+) strand; PAM type: NNNNGHTT; PAM sequence: CACTGCTT
gcaccaaaaaaagtcgtggt

SEQ ID NO: 12512 - DNA, 20 bp, Artificial Sequence
  Description of Artificial Sequence: Synthetic oligonucleotide
  Target: SCN10A; (+) strand; PAM type: NNNNGHTT; PAM sequence: TACAGCTT
ctgctgccggtctgatctac

SEQ ID NO: 12513 - DNA, 20 bp, Artificial Sequence
  Description of Artificial Sequence: Synthetic oligonucleotide
  Target: SCN10A; (+) strand; PAM type: NNNNGHTT; PAM sequence: TGAAGTTT
aagttgaatgaattgggcta

SEQ ID NO: 12514 - DNA, 20 bp, Artificial Sequence
  Description of Artificial Sequence: Synthetic oligonucleotide
  Target: SCN10A; (+) strand; PAM type: NNNNGHTT; PAM sequence: CATGGATT
gagttcattgaatcccaaag

SEQ ID NO: 12515 - DNA, 20 bp, Artificial Sequence
  Description of Artificial Sequence: Synthetic oligonucleotide
  Target: SCN10A; (+) strand; PAM type: NNNNGHTT; PAM sequence: TGTTGATT
atttctcattggcaaaaatg

SEQ ID NO: 12516 - DNA, 20 bp, Artificial Sequence
  Description of Artificial Sequence: Synthetic oligonucleotide
  Target: SCN10A; (+) strand; PAM type: NNNNGHTT; PAM sequence: CTTTGATT
gttgattgtaatggttccta

SEQ ID NO: 12517 - DNA, 20 bp, Artificial Sequence
  Description of Artificial Sequence: Synthetic oligonucleotide
  Target: SCN10A; (+) strand; PAM type: NNNNGHTT; PAM sequence: ATGTGTTT
tcctactttgattaataaag

SEQ ID NO: 12518 - DNA, 20 bp, Artificial Sequence
  Description of Artificial Sequence: Synthetic oligonucleotide
  Target: SCN10A; (+) strand; PAM type: NNNNGHTT; PAM sequence: TAATGATT
gatgtgtttgagcctagtta

SEQ ID NO: 12519 - DNA, 20 bp, Artificial Sequence
  Description of Artificial Sequence: Synthetic oligonucleotide
  Target: SCN10A; (+) strand; PAM type: NNNNGHTT; PAM sequence: ATTTGCTT
ttcattatttggcatctctt

SEQ ID NO: 12520 - DNA, 20 bp, Artificial Sequence
  Description of Artificial Sequence: Synthetic oligonucleotide
  Target: SCN10A; (+) strand; PAM type: NNNNGHTT; PAM sequence: TAGAGTTT
tgtacaattcttccagtatt

SEQ ID NO: 12521 - DNA, 20 bp, Artificial Sequence
  Description of Artificial Sequence: Synthetic oligonucleotide
  Target: SCN10A; (+) strand; PAM type: NNNNGHTT; PAM sequence: TATAGATT
catattatttgttacaaata

SEQ ID NO: 12522 - DNA, 20 bp, Artificial Sequence
  Description of Artificial Sequence: Synthetic oligonucleotide
  Target: SCN10A; (+) strand; PAM type: NNNNGHTT; PAM sequence: AAGAGTTT
tacaaatatatagattacta

SEQ ID NO: 12523 - DNA, 20 bp, Artificial Sequence
  Description of Artificial Sequence: Synthetic oligonucleotide
  Target: SCN10A; (+) strand; PAM type: NNNNGHTT; PAM sequence: TGGTGATT
caaaatctctcatttccatt

SEQ ID NO: 12524 - DNA, 20 bp, Artificial Sequence
  Description of Artificial Sequence: Synthetic oligonucleotide
  Target: SCN10A; (+) strand; PAM type: NNNNGHTT; PAM sequence: CTCTGTTT
catttggtgattcctttcct

SEQ ID NO: 12525 - DNA, 20 bp, Artificial Sequence
  Description of Artificial Sequence: Synthetic oligonucleotide
  Target: SCN10A; (+) strand; PAM type: NNNNGHTT; PAM sequence: TTGTGCTT
ctgtatttaataatatcttt

SEQ ID NO: 12526 - DNA, 20 bp, Artificial Sequence
  Description of Artificial Sequence: Synthetic oligonucleotide
  Target: SCN10A; (+) strand; PAM type: NNNNGHTT; PAM sequence: TTCTGCTT
gctcacatgttctttcctct

SEQ ID NO: 12527 - DNA, 20 bp, Artificial Sequence
  Description of Artificial Sequence: Synthetic oligonucleotide
  Target: SCN10A; (+) strand; PAM type: NNNNGHTT; PAM sequence: TGGGGCTT
gtcaacacttgcagggcctc

SEQ ID NO: 12528 - DNA, 20 bp, Artificial Sequence
  Description of Artificial Sequence: Synthetic oligonucleotide
  Target: SCN10A; (+) strand; PAM type: NNNNGHTT; PAM sequence: CGTGGTTT
ttatccccctctggaggcac

SEQ ID NO: 12529 - DNA, 20 bp, Artificial Sequence
  Description of Artificial Sequence: Synthetic oligonucleotide
  Target: SCN10A; (+) strand; PAM type: NNNNGHTT; PAM sequence: AAGTGATT
ttaacaaaccctgatctgct

SEQ ID NO: 12530 - DNA, 20 bp, Artificial Sequence
  Description of Artificial Sequence: Synthetic oligonucleotide
  Target: SCN10A; (+) strand; PAM type: NNNNGHTT; PAM sequence: AAGTGTTT
ccacccacttttggtcttcc

SEQ ID NO: 12531 - DNA, 20 bp, Artificial Sequence
  Description of Artificial Sequence: Synthetic oligonucleotide
  Target: SCN10A; (+) strand; PAM type: NNNNGHTT; PAM sequence: CTGTGTTT
gttttgacatcatttgtcct

SEQ ID NO: 12532 - DNA, 20 bp, Artificial Sequence
  Description of Artificial Sequence: Synthetic oligonucleotide
  Target: SCN10A; (+) strand; PAM type: NNNNGHTT; PAM sequence: AAATGTTT
aaataactcattttgcaaaa

SEQ ID NO: 12533 - DNA, 20 bp, Artificial Sequence
  Description of Artificial Sequence: Synthetic oligonucleotide
  Target: SCN10A; (+) strand; PAM type: NNNNGHTT; PAM sequence: TCATGATT
caacaatattaaatataatt

SEQ ID NO: 12534 - DNA, 20 bp, Artificial Sequence
  Description of Artificial Sequence: Synthetic oligonucleotide
  Target: SCN10A; (+) strand; PAM type: NNNNGHTT; PAM sequence: TTGTGATT
ttaaatataatttcatgatt

SEQ ID NO: 12535 - DNA, 20 bp, Artificial Sequence
  Description of Artificial Sequence: Synthetic oligonucleotide
  Target: SCN10A; (+) strand; PAM type: NNNNGHTT; PAM sequence: TTCTGATT
ttctctacttagtaaccatc

SEQ ID NO: 12536 - DNA, 20 bp, Artificial Sequence
  Description of Artificial Sequence: Synthetic oligonucleotide
  Target: SCN10A; (+) strand; PAM type: NNNNGHTT; PAM sequence: TTGGGTTT
tcatttattttaaaaaatta

SEQ ID NO: 12537 - DNA, 20 bp, Artificial Sequence
  Description of Artificial Sequence: Synthetic oligonucleotide
  Target: SCN10A; (+) strand; PAM type: NNNNGHTT; PAM sequence: AAATGTTT
taaattaattattttaaaac

SEQ ID NO: 12538 - DNA, 20 bp, Artificial Sequence
  Description of Artificial Sequence: Synthetic oligonucleotide
  Target: SCN10A; (+) strand; PAM type: NNNNGHTT; PAM sequence: GGTGGCTT
taacaaaataccatagactg

SEQ ID NO: 12539 - DNA, 20 bp, Artificial Sequence
  Description of Artificial Sequence: Synthetic oligonucleotide
  Target: SCN10A; (+) strand; PAM type: NNNNGHTT; PAM sequence: CTGAGATT
acaaatctggaggttgaagc

SEQ ID NO: 12540 - DNA, 20 bp, Artificial Sequence
  Description of Artificial Sequence: Synthetic oligonucleotide
  Target: SCN10A; (+) strand; PAM type: NNNNGHTT; PAM sequence: TCTAGCTT
ggtctgggaaagactctctt

SEQ ID NO: 12541 - DNA, 20 bp, Artificial Sequence
  Description of Artificial Sequence: Synthetic oligonucleotide
  Target: SCN10A; (+) strand; PAM type: NNNNGHTT; PAM sequence: GGGGGTTT
atctccaacatagcaacatg

SEQ ID NO: 12542 - DNA, 20 bp, Artificial Sequence
  Description of Artificial Sequence: Synthetic oligonucleotide
  Target: SCN10A; (+) strand; PAM type: NNNNGHTT; PAM sequence: GTTTGTTT
ccaacatagcaacatggggg

SEQ ID NO: 12543 - DNA, 20 bp, Artificial Sequence
  Description of Artificial Sequence: Synthetic oligonucleotide
  Target: SCN10A; (+) strand; PAM type: NNNNGHTT; PAM sequence: AGCAGCTT
ggggacaaaattcactccat

SEQ ID NO: 12544 - DNA, 20 bp, Artificial Sequence
  Description of Artificial Sequence: Synthetic oligonucleotide
  Target: SCN10A; (+) strand; PAM type: NNNNGHTT; PAM sequence: TGATGCTT
tttttcttgccttactttat

SEQ ID NO: 12545 - DNA, 20 bp, Artificial Sequence
  Description of Artificial Sequence: Synthetic oligonucleotide
  Target: SCN10A; (+) strand; PAM type: NNNNGHTT; PAM sequence: AATAGTTT
aagtatgcattcctaaacaa

SEQ ID NO: 12546 - DNA, 20 bp, Artificial Sequence
  Description of Artificial Sequence: Synthetic oligonucleotide
  Target: SCN10A; (+) strand; PAM type: NNNNGHTT; PAM sequence: TTTAGTTT
tgcattcctaaacaaaatag

SEQ ID NO: 12547 - DNA, 20 bp, Artificial Sequence
  Description of Artificial Sequence: Synthetic oligonucleotide
  Target: SCN10A; (+) strand; PAM type: NNNNGHTT; PAM sequence: TTTTGCTT
tcctaaacaaaatagtttag

SEQ ID NO: 12548 - DNA, 20 bp, Artificial Sequence
  Description of Artificial Sequence: Synthetic oligonucleotide
  Target: SCN10A; (+) strand; PAM type: NNNNGHTT; PAM sequence: GCTTGATT
aaacaaaatagtttagtttt

SEQ ID NO: 12549 - DNA, 20 bp, Artificial Sequence
  Description of Artificial Sequence: Synthetic oligonucleotide
  Target: SCN10A; (+) strand; PAM type: NNNNGHTT; PAM sequence: CCTTGTTT
tcaaactttatataaatgaa

SEQ ID NO: 12550 - DNA, 20 bp, Artificial Sequence
  Description of Artificial Sequence: Synthetic oligonucleotide
  Target: SCN10A; (+) strand; PAM type: NNNNGHTT; PAM sequence: TTTGGCTT
tgtttatgtaatcctttgca

SEQ ID NO: 12551 - DNA, 20 bp, Artificial Sequence
  Description of Artificial Sequence: Synthetic oligonucleotide
  Target: SCN10A; (+) strand; PAM type: NNNNGHTT; PAM sequence: TAAAGTTT
tccttattgttgtgcagcac

SEQ ID NO: 12552 - DNA, 20 bp, Artificial Sequence
  Description of Artificial Sequence: Synthetic oligonucleotide
  Target: SCN10A; (+) strand; PAM type: NNNNGHTT; PAM sequence: GTAAGTTT
gtttattaatttttattgct

SEQ ID NO: 12553 - DNA, 20 bp, Artificial Sequence
  Description of Artificial Sequence: Synthetic oligonucleotide
  Target: SCN10A; (+) strand; PAM type: NNNNGHTT; PAM sequence: CAAAGTTT
acagaaatagttaatgtact

SEQ ID NO: 12554 - DNA, 20 bp, Artificial Sequence
  Description of Artificial Sequence: Synthetic oligonucleotide
  Target: SCN10A; (+) strand; PAM type: NNNNGHTT; PAM sequence: AGTGGTTT
tcaaagtttatggacatttg

SEQ ID NO: 12555 - DNA, 20 bp, Artificial Sequence
  Description of Artificial Sequence: Synthetic oligonucleotide
  Target: SCN10A; (+) strand; PAM type: NNNNGHTT; PAM sequence: TCCGGTTT
ttatggacatttgagtggtt

SEQ ID NO: 12556 - DNA, 20 bp, Artificial Sequence
  Description of Artificial Sequence: Synthetic oligonucleotide
  Target: SCN10A; (+) strand; PAM type: NNNNGHTT; PAM sequence: TGGGGTTT
catttgagtggtttccggtt

SEQ ID NO: 12557 - DNA, 20 bp, Artificial Sequence
  Description of Artificial Sequence: Synthetic oligonucleotide
  Target: SCN10A; (+) strand; PAM type: NNNNGHTT; PAM sequence: GTATGCTT
aatagaagaatacagcatat

SEQ ID NO: 12558 - DNA, 20 bp, Artificial Sequence
  Description of Artificial Sequence: Synthetic oligonucleotide
  Target: SCN10A; (+) strand; PAM type: NNNNGHTT; PAM sequence: CCTTGCTT
cacctttactagataatacc

SEQ ID NO: 12559 - DNA, 20 bp, Artificial Sequence
  Description of Artificial Sequence: Synthetic oligonucleotide
  Target: SCN10A; (+) strand; PAM type: NNNNGHTT; PAM sequence: GTGAGTTT
tacactcccaccagcagtgt

SEQ ID NO: 12560 - DNA, 20 bp, Artificial Sequence
  Description of Artificial Sequence: Synthetic oligonucleotide
  Target: SCN10A; (+) strand; PAM type: NNNNGHTT; PAM sequence: GTGTGATT
gaacatgtaataaaatctca

SEQ ID NO: 12561 - DNA, 20 bp, Artificial Sequence
  Description of Artificial Sequence: Synthetic oligonucleotide
  Target: SCN10A; (+) strand; PAM type: NNNNGHTT; PAM sequence: CTTTGATT
tgtgattttaatttgcaact

SEQ ID NO: 12562 - DNA, 20 bp, Artificial Sequence
  Description of Artificial Sequence: Synthetic oligonucleotide
  Target: SCN10A; (+) strand; PAM type: NNNNGHTT; PAM sequence: ATATGTTT
aaaaggttaagaatactttc

SEQ ID NO: 12563 - DNA, 20 bp, Artificial Sequence
  Description of Artificial Sequence: Synthetic oligonucleotide
  Target: SCN10A; (+) strand; PAM type: NNNNGHTT; PAM sequence: TTTGGATT
ctttcatatgtttatggcca

SEQ ID NO: 12564 - DNA, 20 bp, Artificial Sequence
  Description of Artificial Sequence: Synthetic oligonucleotide
  Target: SCN10A; (+) strand; PAM type: NNNNGHTT; PAM sequence: AATTGATT
ggttgttctgacatttttct

SEQ ID NO: 12565 - DNA, 20 bp, Artificial Sequence
  Description of Artificial Sequence: Synthetic oligonucleotide
  Target: SCN10A; (+) strand; PAM type: NNNNGHTT; PAM sequence: ACTTGCTT
tcattactctgaatataagc

SEQ ID NO: 12566 - DNA, 20 bp, Artificial Sequence
  Description of Artificial Sequence: Synthetic oligonucleotide
  Target: SCN10A; (+) strand; PAM type: NNNNGHTT; PAM sequence: ATCAGTTT
attatagtatactaaaatgt

SEQ ID NO: 12567 - DNA, 20 bp, Artificial Sequence
  Description of Artificial Sequence: Synthetic oligonucleotide
  Target: SCN10A; (+) strand; PAM type: NNNNGHTT; PAM sequence: TAGTGCTT
tcagttttttcctgtatagt

SEQ ID NO: 12568 - DNA, 20 bp, Artificial Sequence
  Description of Artificial Sequence: Synthetic oligonucleotide
  Target: SCN10A; (+) strand; PAM type: NNNNGHTT; PAM sequence: TAAAGTTT
gcttcttgtgtcatatgtaa

SEQ ID NO: 12569 - DNA, 20 bp, Artificial Sequence
  Description of Artificial Sequence: Synthetic oligonucleotide
  Target: SCN10A; (+) strand; PAM type: NNNNGHTT; PAM sequence: CTTTGTTT
gaggtcataaagatattcct

SEQ ID NO: 12570 - DNA, 20 bp, Artificial Sequence
  Description of Artificial Sequence: Synthetic oligonucleotide
  Target: SCN10A; (+) strand; PAM type: NNNNGHTT; PAM sequence: AAAAGCTT
ctctttgttttttcctttca

SEQ ID NO: 12571 - DNA, 20 bp, Artificial Sequence
  Description of Artificial Sequence: Synthetic oligonucleotide
  Target: SCN10A; (+) strand; PAM type: NNNNGHTT; PAM sequence: GTCGGCTT
agcttatccaccacgatcaa

SEQ ID NO: 12572 - DNA, 20 bp, Artificial Sequence
  Description of Artificial Sequence: Synthetic oligonucleotide
  Target: SCN10A; (+) strand; PAM type: NNNNGHTT; PAM sequence: ACGTGATT
cagaaccaatgacaaaaacc

SEQ ID NO: 12573 - DNA, 20 bp, Artificial Sequence
  Description of Artificial Sequence: Synthetic oligonucleotide
  Target: SCN10A; (+) strand; PAM type: NNNNGHTT; PAM sequence: CTCTGTTT
aaaagaggaagtcaaattgt

SEQ ID NO: 12574 - DNA, 20 bp, Artificial Sequence
  Description of Artificial Sequence: Synthetic oligonucleotide
  Target: SCN10A; (+) strand; PAM type: NNNNGHTT; PAM sequence: TATAGATT
ccatactgcccaaagtaatt

SEQ ID NO: 12575 - DNA, 20 bp, Artificial Sequence
  Description of Artificial Sequence: Synthetic oligonucleotide
  Target: SCN10A; (+) strand; PAM type: NNNNGHTT; PAM sequence: AAAGGATT
gacaaaagcaagcaatgggg

SEQ ID NO: 12576 - DNA, 20 bp, Artificial Sequence
  Description of Artificial Sequence: Synthetic oligonucleotide
  Target: SCN10A; (+) strand; PAM type: NNNNGHTT; PAM sequence: GATAGATT
ttacacaaaaattaactcaa

SEQ ID NO: 12577 - DNA, 20 bp, Artificial Sequence
  Description of Artificial Sequence: Synthetic oligonucleotide
  Target: SCN10A; (+) strand; PAM type: NNNNGHTT; PAM sequence: AAAGGCTT
ttcaggacataggcatgggc

SEQ ID NO: 12578 - DNA, 20 bp, Artificial Sequence
  Description of Artificial Sequence: Synthetic oligonucleotide
  Target: SCN10A; (+) strand; PAM type: NNNNGHTT; PAM sequence: AAGAGCTT
aatggaatccaattaaacta

SEQ ID NO: 12579 - DNA, 20 bp, Artificial Sequence
  Description of Artificial Sequence: Synthetic oligonucleotide
  Target: SCN10A; (+) strand; PAM type: NNNNGHTT; PAM sequence: GAATGCTT
gagaggatgtggagagatag

SEQ ID NO: 12580 - DNA, 20 bp, Artificial Sequence
  Description of Artificial Sequence: Synthetic oligonucleotide
  Target: SCN10A; (+) strand; PAM type: NNNNGHTT; PAM sequence: TGGTGATT
aaccattgtggaagacagtg

SEQ ID NO: 12581 - DNA, 20 bp, Artificial Sequence
  Description of Artificial Sequence: Synthetic oligonucleotide
  Target: SCN10A; (+) strand; PAM type: NNNNGHTT; PAM sequence: AAAGGATT
ccattactgggtatataccc

SEQ ID NO: 12582 - DNA, 20 bp, Artificial Sequence
  Description of Artificial Sequence: Synthetic oligonucleotide
  Target: SCN10A; (+) strand; PAM type: NNNNGHTT; PAM sequence: GTATGTTT
ctataaagatacaagcatgc

SEQ ID NO: 12583 - DNA, 20 bp, Artificial Sequence
  Description of Artificial Sequence: Synthetic oligonucleotide
  Target: SCN10A; (+) strand; PAM type: NNNNGHTT; PAM sequence: AAGGGCTT
acttaaagtaaaatttaaaa

SEQ ID NO: 12584 - DNA, 20 bp, Artificial Sequence
  Description of Artificial Sequence: Synthetic oligonucleotide
  Target: SCN10A; (+) strand; PAM type: NNNNGHTT; PAM sequence: AATTGATT
tgaggtgttgatccacctag

SEQ ID NO: 12585 - DNA, 20 bp, Artificial Sequence
  Description of Artificial Sequence: Synthetic oligonucleotide
  Target: SCN10A; (+) strand; PAM type: NNNNGHTT; PAM sequence: GGATGTTT
cttgtgtgtggtgcaaagtt

SEQ ID NO: 12586 - DNA, 20 bp, Artificial Sequence
  Description of Artificial Sequence: Synthetic oligonucleotide
  Target: SCN10A; (+) strand; PAM type: NNNNGHTT; PAM sequence: TGTAGTTT
gtgcaaagttggatgtttaa

SEQ ID NO: 12587 - DNA, 20 bp, Artificial Sequence
  Description of Artificial Sequence: Synthetic oligonucleotide
  Target: SCN10A; (+) strand; PAM type: NNNNGHTT; PAM sequence: GTGAGATT
tgtttaatgtagtttttcca

SEQ ID NO: 12588 - DNA, 20 bp, Artificial Sequence
  Description of Artificial Sequence: Synthetic oligonucleotide
  Target: SCN10A; (+) strand; PAM type: NNNNGHTT; PAM sequence: AGATGTTT
gtgccaccttttcacacatt

SEQ ID NO: 12589 - DNA, 20 bp, Artificial Sequence
  Description of Artificial Sequence: Synthetic oligonucleotide
  Target: SCN10A; (+) strand; PAM type: NNNNGHTT; PAM sequence: GTCTGTTT
agatgtttacatatgtgttg

SEQ ID NO: 12590 - DNA, 20 bp, Artificial Sequence
  Description of Artificial Sequence: Synthetic oligonucleotide
  Target: SCN10A; (+) strand; PAM type: NNNNGHTT; PAM sequence: CACTGCTT
ccaatcttacaccaatggca

SEQ ID NO: 12591 - DNA, 20 bp, Artificial Sequence
  Description of Artificial Sequence: Synthetic oligonucleotide
  Target: SCN10A; (+) strand; PAM type: NNNNGHTT; PAM sequence: TAGAGCTT
caatggcacactgcttcaat

SEQ ID NO: 12592 - DNA, 20 bp, Artificial Sequence
  Description of Artificial Sequence: Synthetic oligonucleotide
  Target: SCN10A; (+) strand; PAM type: NNNNGHTT; PAM sequence: AAAAGTTT
ccactttgtatttcttcctc

SEQ ID NO: 12593 - DNA, 20 bp, Artificial Sequence
  Description of Artificial Sequence: Synthetic oligonucleotide
  Target: SCN10A; (+) strand; PAM type: NNNNGHTT; PAM sequence: TAAAGTTT
aacttttgaggaagaaaatt

SEQ ID NO: 12594 - DNA, 20 bp, Artificial Sequence
  Description of Artificial Sequence: Synthetic oligonucleotide
  Target: SCN10A; (+) strand; PAM type: NNNNGHTT; PAM sequence: TAAAGTTT
gaggaagaaaatttaaagtt

SEQ ID NO: 12595 - DNA, 20 bp, Artificial Sequence
  Description of Artificial Sequence: Synthetic oligonucleotide
  Target: SCN10A; (+) strand; PAM type: NNNNGHTT; PAM sequence: TATTGATT
ccaaaagaagcctgttgaaa

SEQ ID NO: 12596 - DNA, 20 bp, Artificial Sequence
  Description of Artificial Sequence: Synthetic oligonucleotide
  Target: SCN10A; (+) strand; PAM type: NNNNGHTT; PAM sequence: CACTGATT
aatctgagaacatgtctccc

SEQ ID NO: 12597 - DNA, 20 bp, Artificial Sequence
  Description of Artificial Sequence: Synthetic oligonucleotide
  Target: SCN10A; (+) strand; PAM type: NNNNGHTT; PAM sequence: TTTGGTTT
agaacatgtctccccactga

SEQ ID NO: 12598 - DNA, 20 bp, Artificial Sequence
  Description of Artificial Sequence: Synthetic oligonucleotide
  Target: SCN10A; (+) strand; PAM type: NNNNGHTT; PAM sequence: TTCTGTTT
tggtatttttaaaaactatt

SEQ ID NO: 12599 - DNA, 20 bp, Artificial Sequence
  Description of Artificial Sequence: Synthetic oligonucleotide
  Target: SCN10A; (+) strand; PAM type: NNNNGHTT; PAM sequence: AATTGATT
tgttgctagtgtctatacac

SEQ ID NO: 12600 - DNA, 20 bp, Artificial Sequence
  Description of Artificial Sequence: Synthetic oligonucleotide
  Target: SCN10A; (+) strand; PAM type: NNNNGHTT; PAM sequence: TACTGTTT
tatactcttttattaattct

SEQ ID NO: 12601 - DNA, 20 bp, Artificial Sequence
  Description of Artificial Sequence: Synthetic oligonucleotide
  Target: SCN10A; (+) strand; PAM type: NNNNGHTT; PAM sequence: CTTTGCTT
tcttcttgcacttttttttt

SEQ ID NO: 12602 - DNA, 20 bp, Artificial Sequence
  Description of Artificial Sequence: Synthetic oligonucleotide
  Target: SCN10A; (+) strand; PAM type: NNNNGHTT; PAM sequence: TTTGGTTT
aactgagaagaacagacatc

SEQ ID NO: 12603 - DNA, 20 bp, Artificial Sequence
  Description of Artificial Sequence: Synthetic oligonucleotide
  Target: SCN10A; (+) strand; PAM type: NNNNGHTT; PAM sequence: GAAAGCTT
ttttcttttgatctcaaagg

SEQ ID NO: 12604 - DNA, 20 bp, Artificial Sequence
  Description of Artificial Sequence: Synthetic oligonucleotide
  Target: SCN10A; (+) strand; PAM type: NNNNGHTT; PAM sequence: TGACGCTT
tccatgttcacaattaagta

SEQ ID NO: 12605 - DNA, 20 bp, Artificial Sequence
  Description of Artificial Sequence: Synthetic oligonucleotide
  Target: SCN10A; (+) strand; PAM type: NNNNGHTT; PAM sequence: GCCGGTTT
ggggtacatgtgcagaacgt

SEQ ID NO: 12606 - DNA, 20 bp, Artificial Sequence
  Description of Artificial Sequence: Synthetic oligonucleotide
  Target: SCN10A; (+) strand; PAM type: NNNNGHTT; PAM sequence: GGTGGTTT
cataggtgtacccgtgccat

SEQ ID NO: 12607 - DNA, 20 bp, Artificial Sequence
  Description of Artificial Sequence: Synthetic oligonucleotide
  Target: SCN10A; (+) strand; PAM type: NNNNGHTT; PAM sequence: CGGTGTTT
cacttatgagtgagaacata

SEQ ID NO: 12608 - DNA, 20 bp, Artificial Sequence
  Description of Artificial Sequence: Synthetic oligonucleotide
  Target: SCN10A; (+) strand; PAM type: NNNNGHTT; PAM sequence: TTTGGTTT
atgagtgagaacatacggtg

SEQ ID NO: 12609 - DNA, 20 bp, Artificial Sequence
  Description of Artificial Sequence: Synthetic oligonucleotide
  Target: SCN10A; (+) strand; PAM type: NNNNGHTT; PAM sequence: GTTAGTTT
gtttggttttctgttcttgt

SEQ ID NO: 12610 - DNA, 20 bp, Artificial Sequence
  Description of Artificial Sequence: Synthetic oligonucleotide
  Target: SCN10A; (+) strand; PAM type: NNNNGHTT; PAM sequence: GATGGTTT
tgtgttagtttgctgagaat

SEQ ID NO: 12611 - DNA, 20 bp, Artificial Sequence
  Description of Artificial Sequence: Synthetic oligonucleotide
  Target: SCN10A; (+) strand; PAM type: NNNNGHTT; PAM sequence: TCCAGCTT
gtttgctgagaatgatggtt

SEQ ID NO: 12612 - DNA, 20 bp, Artificial Sequence
  Description of Artificial Sequence: Synthetic oligonucleotide
  Target: SCN10A; (+) strand; PAM type: NNNNGHTT; PAM sequence: AAATGATT
aatggaaattaaactttatc

SEQ ID NO: 12613 - DNA, 20 bp, Artificial Sequence
  Description of Artificial Sequence: Synthetic oligonucleotide
  Target: SCN10A; (+) strand; PAM type: NNNNGHTT; PAM sequence: TTATGATT
tgttgtggcatgcattactg

SEQ ID NO: 12614 - DNA, 20 bp, Artificial Sequence
  Description of Artificial Sequence: Synthetic oligonucleotide
  Target: SCN10A; (+) strand; PAM type: NNNNGHTT; PAM sequence: GAATGTTT
ctcccagatgtgtggatatg

SEQ ID NO: 12615 - DNA, 20 bp, Artificial Sequence
  Description of Artificial Sequence: Synthetic oligonucleotide
  Target: SCN10A; (+) strand; PAM type: NNNNGHTT; PAM sequence: CCCAGATT
tggaatgtttttggaaaact

SEQ ID NO: 12616 - DNA, 20 bp, Artificial Sequence
  Description of Artificial Sequence: Synthetic oligonucleotide
  Target: SCN10A; (+) strand; PAM type: NNNNGHTT; PAM sequence: AGGGGTTT
ctcccagattctgaaactat

SEQ ID NO: 12617 - DNA, 20 bp, Artificial Sequence
  Description of Artificial Sequence: Synthetic oligonucleotide
  Target: SCN10A; (+) strand; PAM type: NNNNGHTT; PAM sequence: AACAGCTT
atatgaagcatgataactta

SEQ ID NO: 12618 - DNA, 20 bp, Artificial Sequence
  Description of Artificial Sequence: Synthetic oligonucleotide
  Target: SCN10A; (+) strand; PAM type: NNNNGHTT; PAM sequence: CTCAGTTT
ccatttgttcttagttctgt

SEQ ID NO: 12619 - DNA, 20 bp, Artificial Sequence
  Description of Artificial Sequence: Synthetic oligonucleotide
  Target: SCN10A; (+) strand; PAM type: NNNNGHTT; PAM sequence: GTATGTTT
tctttgaaactgaaaatcat

SEQ ID NO: 12620 - DNA, 20 bp, Artificial Sequence
  Description of Artificial Sequence: Synthetic oligonucleotide
  Target: SCN10A; (+) strand; PAM type: NNNNGHTT; PAM sequence: ATGAGATT
attacaaagacatatagaca

SEQ ID NO: 12621 - DNA, 20 bp, Artificial Sequence
  Description of Artificial Sequence: Synthetic oligonucleotide
  Target: SCN10A; (+) strand; PAM type: NNNNGHTT; PAM sequence: GAATGATT
tctaggatcaccttgatgct

SEQ ID NO: 12622 - DNA, 20 bp, Artificial Sequence
  Description of Artificial Sequence: Synthetic oligonucleotide
  Target: SCN10A; (+) strand; PAM type: NNNNGHTT; PAM sequence: ATTAGCTT
attcataaatcttagccaat

SEQ ID NO: 12623 - DNA, 20 bp, Artificial Sequence
  Description of Artificial Sequence: Synthetic oligonucleotide
  Target: SCN10A; (+) strand; PAM type: NNNNGHTT; PAM sequence: ATCTGTTT
ctgcagagatgtgaactctt

SEQ ID NO: 12624 - DNA, 20 bp, Artificial Sequence
  Description of Artificial Sequence: Synthetic oligonucleotide
  Target: SCN10A; (+) strand; PAM type: NNNNGHTT; PAM sequence: ATTAGTTT
aggtacaaactttcatggga

SEQ ID NO: 12625 - DNA, 20 bp, Artificial Sequence
  Description of Artificial Sequence: Synthetic oligonucleotide
  Target: SCN10A; (+) strand; PAM type: NNNNGHTT; PAM sequence: ATCAGATT
ctttcatgggaattagtttc

SEQ ID NO: 12626 - DNA, 20 bp, Artificial Sequence
  Description of Artificial Sequence: Synthetic oligonucleotide
  Target: SCN10A; (+) strand; PAM type: NNNNGHTT; PAM sequence: GATTGTTT
catgggaattagtttcatca

SEQ ID NO: 12627 - DNA, 20 bp, Artificial Sequence
  Description of Artificial Sequence: Synthetic oligonucleotide
  Target: SCN10A; (+) strand; PAM type: NNNNGHTT; PAM sequence: GTAGGATT
gctcaggaagaaaaccccaa

SEQ ID NO: 12628 - DNA, 20 bp, Artificial Sequence
  Description of Artificial Sequence: Synthetic oligonucleotide
  Target: SCN10A; (+) strand; PAM type: NNNNGHTT; PAM sequence: AAGGGATT
ttgacagcagactatgggca

SEQ ID NO: 12629 - DNA, 20 bp, Artificial Sequence
  Description of Artificial Sequence: Synthetic oligonucleotide
  Target: SCN10A; (+) strand; PAM type: NNNNGHTT; PAM sequence: CAGTGCTT
aggaatagctgggctcccaa

SEQ ID NO: 12630 - DNA, 20 bp, Artificial Sequence
  Description of Artificial Sequence: Synthetic oligonucleotide
  Target: SCN10A; (+) strand; PAM type: NNNNGHTT; PAM sequence: TTTAGTTT
gcagaagtatttaaatgtat

SEQ ID NO: 12631 - DNA, 20 bp, Artificial Sequence
  Description of Artificial Sequence: Synthetic oligonucleotide
  Target: SCN10A; (+) strand; PAM type: NNNNGHTT; PAM sequence: TCTAGTTT
tctgtaaatgccttgatgtg

SEQ ID NO: 12632 - DNA, 20 bp, Artificial Sequence
  Description of Artificial Sequence: Synthetic oligonucleotide
  Target: SCN10A; (+) strand; PAM type: NNNNGHTT; PAM sequence: CAAGGATT
catggggggaaatgttaatc

SEQ ID NO: 12633 - DNA, 20 bp, Artificial Sequence
  Description of Artificial Sequence: Synthetic oligonucleotide
  Target: SCN10A; (+) strand; PAM type: NNNNGHTT; PAM sequence: ATGTGATT
tatgaaaacattcatagcaa

SEQ ID NO: 12634 - DNA, 20 bp, Artificial Sequence
  Description of Artificial Sequence: Synthetic oligonucleotide
  Target: SCN10A; (+) strand; PAM type: NNNNGHTT; PAM sequence: ATGAGATT
gggctggagttaccaaattt

SEQ ID NO: 12635 - DNA, 20 bp, Artificial Sequence
  Description of Artificial Sequence: Synthetic oligonucleotide
  Target: SCN10A; (+) strand; PAM type: NNNNGHTT; PAM sequence: AACAGCTT
tgtgaggaagagaccccctc

SEQ ID NO: 12636 - DNA, 20 bp, Artificial Sequence
  Description of Artificial Sequence: Synthetic oligonucleotide
  Target: SCN10A; (+) strand; PAM type: NNNNGHTT; PAM sequence: AGGGGATT
ctggtcacttggttcttttt

SEQ ID NO: 12637 - DNA, 20 bp, Artificial Sequence
  Description of Artificial Sequence: Synthetic oligonucleotide
  Target: SCN10A; (+) strand; PAM type: NNNNGHTT; PAM sequence: AGCTGTTT
aggggattttatttctaatt

SEQ ID NO: 12638 - DNA, 20 bp, Artificial Sequence
  Description of Artificial Sequence: Synthetic oligonucleotide
  Target: SCN10A; (+) strand; PAM type: NNNNGHTT; PAM sequence: AGGAGTTT
ttcaaccagaatccataaag

SEQ ID NO: 12639 - DNA, 20 bp, Artificial Sequence
  Description of Artificial Sequence: Synthetic oligonucleotide
  Target: SCN10A; (+) strand; PAM type: NNNNGHTT; PAM sequence: GTATGTTT
gaatccataaagaggagttt

SEQ ID NO: 12640 - DNA, 20 bp, Artificial Sequence
  Description of Artificial Sequence: Synthetic oligonucleotide
  Target: SCN10A; (+) strand; PAM type: NNNNGHTT; PAM sequence: TTGTGATT
ataaagaggagtttgtatgt

SEQ ID NO: 12641 - DNA, 20 bp, Artificial Sequence
  Description of Artificial Sequence: Synthetic oligonucleotide
  Target: SCN10A; (+) strand; PAM type: NNNNGHTT; PAM sequence: CCCTGATT
acacattgagagaataatta

SEQ ID NO: 12642 - DNA, 20 bp, Artificial Sequence
  Description of Artificial Sequence: Synthetic oligonucleotide
  Target: SCN10A; (+) strand; PAM type: NNNNGHTT; PAM sequence: GTCAGTTT
tttacttaatgcctctgtgt

SEQ ID NO: 12643 - DNA, 20 bp, Artificial Sequence
  Description of Artificial Sequence: Synthetic oligonucleotide
  Target: SCN10A; (+) strand; PAM type: NNNNGHTT; PAM sequence: AGAGGCTT
gggatggtaatctctacttc

SEQ ID NO: 12644 - DNA, 20 bp, Artificial Sequence
  Description of Artificial Sequence: Synthetic oligonucleotide
  Target: SCN10A; (+) strand; PAM type: NNNNGHTT; PAM sequence: TCAAGATT
cttctgtagaatctgaaaat

SEQ ID NO: 12645 - DNA, 20 bp, Artificial Sequence
  Description of Artificial Sequence: Synthetic oligonucleotide
  Target: SCN10A; (+) strand; PAM type: NNNNGHTT; PAM sequence: TGCAGCTT
aatgcaacttcatcaagctg

SEQ ID NO: 12646 - DNA, 20 bp, Artificial Sequence
  Description of Artificial Sequence: Synthetic oligonucleotide
  Target: SCN10A; (+) strand; PAM type: NNNNGHTT; PAM sequence: ACTAGTTT
aaccaaagtatcttttttct

SEQ ID NO: 12647 - DNA, 20 bp, Artificial Sequence
  Description of Artificial Sequence: Synthetic oligonucleotide
  Target: SCN10A; (+) strand; PAM type: NNNNGHTT; PAM sequence: TTTGGCTT
aagtatcttttttctactag

SEQ ID NO: 12648 - DNA, 20 bp, Artificial Sequence
  Description of Artificial Sequence: Synthetic oligonucleotide
  Target: SCN10A; (+) strand; PAM type: NNNNGHTT; PAM sequence: AGCAGCTT
gccttgcaaaatcccctgaa

SEQ ID NO: 12649 - DNA, 20 bp, Artificial Sequence
  Description of Artificial Sequence: Synthetic oligonucleotide
  Target: SCN10A; (+) strand; PAM type: NNNNGHTT; PAM sequence: ATCAGATT
cagtcttgtatggcatgaac

SEQ ID NO: 12650 - DNA, 20 bp, Artificial Sequence
  Description of Artificial Sequence: Synthetic oligonucleotide
  Target: SCN10A; (+) strand; PAM type: NNNNGHTT; PAM sequence: AGTAGTTT
attgacattttaaacctgct

SEQ ID NO: 12651 - DNA, 20 bp, Artificial Sequence
  Description of Artificial Sequence: Synthetic oligonucleotide
  Target: SCN10A; (+) strand; PAM type: NNNNGHTT; PAM sequence: GTCTGTTT
tgtgtgctcttcccatcatg

SEQ ID NO: 12652 - DNA, 20 bp, Artificial Sequence
  Description of Artificial Sequence: Synthetic oligonucleotide
  Target: SCN10A; (+) strand; PAM type: NNNNGHTT; PAM sequence: GAAGGCTT
gcctatctcatctgcccaaa

SEQ ID NO: 12653 - DNA, 20 bp, Artificial Sequence
  Description of Artificial Sequence: Synthetic oligonucleotide
  Target: SCN10A; (+) strand; PAM type: NNNNGHTT; PAM sequence: GGATGTTT
caaacctcccctcataaaga

SEQ ID NO: 12654 - DNA, 20 bp, Artificial Sequence
  Description of Artificial Sequence: Synthetic oligonucleotide
  Target: SCN10A; (+) strand; PAM type: NNNNGHTT; PAM sequence: TCTAGATT
gttgtgcatccacaggtgtg

SEQ ID NO: 12655 - DNA, 20 bp, Artificial Sequence
  Description of Artificial Sequence: Synthetic oligonucleotide
  Target: SCN10A; (+) strand; PAM type: NNNNGHTT; PAM sequence: GACTGCTT
acacttcttctgtgtcttgg

SEQ ID NO: 12656 - DNA, 20 bp, Artificial Sequence
  Description of Artificial Sequence: Synthetic oligonucleotide
  Target: SCN10A; (+) strand; PAM type: NNNNGHTT; PAM sequence: TTGGGATT
ctaatgacctcattgtactt

SEQ ID NO: 12657 - DNA, 20 bp, Artificial Sequence
  Description of Artificial Sequence: Synthetic oligonucleotide
  Target: SCN10A; (+) strand; PAM type: NNNNGHTT; PAM sequence: ACAAGATT
aagtggacctccaatgagaa

SEQ ID NO: 12658 - DNA, 20 bp, Artificial Sequence
  Description of Artificial Sequence: Synthetic oligonucleotide
  Target: SCN10A; (+) strand; PAM type: NNNNGHTT; PAM sequence: CCATGTTT
aaacaagattccttatacaa

SEQ ID NO: 12659 - DNA, 20 bp, Artificial Sequence
  Description of Artificial Sequence: Synthetic oligonucleotide
  Target: SCN10A; (+) strand; PAM type: NNNNGHTT; PAM sequence: TCAGGCTT
taaacatgagaggcattatc

SEQ ID NO: 12660 - DNA, 20 bp, Artificial Sequence
  Description of Artificial Sequence: Synthetic oligonucleotide
  Target: SCN10A; (+) strand; PAM type: NNNNGHTT; PAM sequence: CCTTGTTT
tcttctgacaagagaaccat

SEQ ID NO: 12661 - DNA, 20 bp, Artificial Sequence
  Description of Artificial Sequence: Synthetic oligonucleotide
  Target: SCN10A; (+) strand; PAM type: NNNNGHTT; PAM sequence: TAATGTTT
agagaaccatccttgttttg

SEQ ID NO: 12662 - DNA, 20 bp, Artificial Sequence
  Description of Artificial Sequence: Synthetic oligonucleotide
  Target: SCN10A; (+) strand; PAM type: NNNNGHTT; PAM sequence: CCTGGTTT
ctctgtctcttaaatcctct

SEQ ID NO: 12663 - DNA, 20 bp, Artificial Sequence
  Description of Artificial Sequence: Synthetic oligonucleotide
  Target: SCN10A; (+) strand; PAM type: NNNNGHTT; PAM sequence: TGAGGATT
cctctcctggtttctccctc

SEQ ID NO: 12664 - DNA, 20 bp, Artificial Sequence
  Description of Artificial Sequence: Synthetic oligonucleotide
  Target: SCN10A; (+) strand; PAM type: NNNNGHTT; PAM sequence: GGCTGATT
ctgctagccatatttgagat

SEQ ID NO: 12665 - DNA, 20 bp, Artificial Sequence
  Description of Artificial Sequence: Synthetic oligonucleotide
  Target: SCN10A; (+) strand; PAM type: NNNNGHTT; PAM sequence: TCTTGTTT
gataattgtcatgaagaagc

SEQ ID NO: 12666 - DNA, 20 bp, Artificial Sequence
  Description of Artificial Sequence: Synthetic oligonucleotide
  Target: SCN10A; (+) strand; PAM type: NNNNGHTT; PAM sequence: TACTGATT
gaagaagctcttgtttaaac

SEQ ID NO: 12667 - DNA, 20 bp, Artificial Sequence
  Description of Artificial Sequence: Synthetic oligonucleotide
  Target: SCN10A; (+) strand; PAM type: NNNNGHTT; PAM sequence: TTTTGATT
aaactactgattctcaaact

SEQ ID NO: 12668 - DNA, 20 bp, Artificial Sequence
  Description of Artificial Sequence: Synthetic oligonucleotide
  Target: SCN10A; (+) strand; PAM type: NNNNGHTT; PAM sequence: CAGGGATT
attctcaaactttttgattt

SEQ ID NO: 12669 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
tattgaggaccccaaataac

SEQ ID NO: 12670 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
ttttgtttatgttgatacct

SEQ ID NO: 12671 - DNA, 20 bp, Artificial Sequence
  Description of Artificial Sequence: Synthetic oligonucleotide
  Target: SCN10A; (+) strand; PAM type: NNNNGHTT; PAM sequence: ATATGCTT
agaaattaatatatatgtat

SEQ ID NO: 12672 - DNA, 20 bp, Artificial Sequence
  Description of Artificial Sequence: Synthetic oligonucleotide
  Target: SCN10A; (+) strand; PAM type: NNNNGHTT; PAM sequence: AGTAGCTT
aatatacaggcacacattcc

SEQ ID NO: 12673 - DNA, 20 bp, Artificial Sequence
  Description of Artificial Sequence: Synthetic oligonucleotide
  Target: SCN10A; (+) strand; PAM type: NNNNGHTT; PAM sequence: AATAGTTT
acatccaagtattgttatac

SEQ ID NO: 12674 - DNA, 20 bp, Artificial Sequence
  Description of Artificial Sequence: Synthetic oligonucleotide
  Target: SCN10A; (+) strand; PAM type: NNNNGHTT; PAM sequence: AACAGTTT
tcattttataaacccactaa

SEQ ID NO: 12675 - DNA, 20 bp, Artificial Sequence
  Description of Artificial Sequence: Synthetic oligonucleotide
  Target: SCN10A; (+) strand; PAM type: NNNNGHTT; PAM sequence: ACTGGCTT
caagatcatagttgaggacc

SEQ ID NO: 12676 - DNA, 20 bp, Artificial Sequence
  Description of Artificial Sequence: Synthetic oligonucleotide
  Target: SCN10A; (+) strand; PAM type: NNNNGHTT; PAM sequence: TCCTGCTT
ggaccactggcttaaattca

SEQ ID NO: 12677 - DNA, 20 bp, Artificial Sequence
  Description of Artificial Sequence: Synthetic oligonucleotide
  Target: SCN10A; (+) strand; PAM type: NNNNGHTT; PAM sequence: ATCTGCTT
ctgaaagctctgcagcagtt

SEQ ID NO: 12678 - DNA, 20 bp, Artificial Sequence
  Description of Artificial Sequence: Synthetic oligonucleotide
  Target: SCN10A; (+) strand; PAM type: NNNNGHTT; PAM sequence: GTGGGTTT
agttatctgcttttgaagat

SEQ ID NO: 12679 - DNA, 20 bp, Artificial Sequence
  Description of Artificial Sequence: Synthetic oligonucleotide
  Target: SCN10A; (+) strand; PAM type: NNNNGHTT; PAM sequence: GTTAGTTT
cttttgaagatgtgggttta

SEQ ID NO: 12680 - DNA, 20 bp, Artificial Sequence
  Description of Artificial Sequence: Synthetic oligonucleotide
  Target: SCN10A; (+) strand; PAM type: NNNNGHTT; PAM sequence: GCAGGCTT
tagaacttgggcagctggtt

SEQ ID NO: 12681 - DNA, 20 bp, Artificial Sequence
  Description of Artificial Sequence: Synthetic oligonucleotide
  Target: SCN10A; (+) strand; PAM type: NNNNGHTT; PAM sequence: CGAGGCTT
ctttcaagtccagctggggc

SEQ ID NO: 12682 - DNA, 20 bp, Artificial Sequence
  Description of Artificial Sequence: Synthetic oligonucleotide
  Target: SCN10A; (+) strand; PAM type: NNNNGHTT; PAM sequence: CTATGCTT
cttcttggtccttctgctcc

SEQ ID NO: 12683 - DNA, 20 bp, Artificial Sequence
  Description of Artificial Sequence: Synthetic oligonucleotide
  Target: SCN10A; (+) strand; PAM type: NNNNGHTT; PAM sequence: TCTGGCTT
ttctgctccctatgcttctc

SEQ ID NO: 12684 - DNA, 20 bp, Artificial Sequence
  Description of Artificial Sequence: Synthetic oligonucleotide
  Target: SCN10A; (+) strand; PAM type: NNNNGHTT; PAM sequence: CCCTGCTT
tctctctggctttctttgtt

SEQ ID NO: 12685 - DNA, 20 bp, Artificial Sequence
  Description of Artificial Sequence: Synthetic oligonucleotide
  Target: SCN10A; (+) strand; PAM type: NNNNGHTT; PAM sequence: ATTTGCTT
ttgttccctgcttggcagca

SEQ ID NO: 12686 - DNA, 20 bp, Artificial Sequence
  Description of Artificial Sequence: Synthetic oligonucleotide
  Target: SCN10A; (+) strand; PAM type: NNNNGHTT; PAM sequence: GTTAGTTT
ggagtaaagcgacggaagtt

SEQ ID NO: 12687 - DNA, 20 bp, Artificial Sequence
  Description of Artificial Sequence: Synthetic oligonucleotide
  Target: SCN10A; (+) strand; PAM type: NNNNGHTT; PAM sequence: GACAGCTT
ggacataaccacagagaggt

SEQ ID NO: 12688 - DNA, 20 bp, Artificial Sequence
  Description of Artificial Sequence: Synthetic oligonucleotide
  Target: SCN10A; (+) strand; PAM type: NNNNGHTT; PAM sequence: TCTTGATT
tgtccctctcatctgtccca

SEQ ID NO: 12689 - DNA, 20 bp, Artificial Sequence
  Description of Artificial Sequence: Synthetic oligonucleotide
  Target: SCN10A; (+) strand; PAM type: NNNNGHTT; PAM sequence: GGCTGTTT
cctgcaaggcattcagggga

SEQ ID NO: 12690 - DNA, 20 bp, Artificial Sequence
  Description of Artificial Sequence: Synthetic oligonucleotide
  Target: SCN10A; (+) strand; PAM type: NNNNGHTT; PAM sequence: ATGTGCTT
gggttatgtctttgctcccc

SEQ ID NO: 12691 - DNA, 20 bp, Artificial Sequence
  Description of Artificial Sequence: Synthetic oligonucleotide
  Target: SCN10A; (+) strand; PAM type: NNNNGHTT; PAM sequence: CATTGCTT
ctccccatgtgcttctatgt

SEQ ID NO: 12692 - DNA, 20 bp, Artificial Sequence
  Description of Artificial Sequence: Synthetic oligonucleotide
  Target: SCN10A; (+) strand; PAM type: NNNNGHTT; PAM sequence: ACCAGATT
tgtaccatcctaccaccacc

SEQ ID NO: 12693 - DNA, 20 bp, Artificial Sequence
  Description of Artificial Sequence: Synthetic oligonucleotide
  Target: SCN10A; (+) strand; PAM type: NNNNGHTT; PAM sequence: TTTGGTTT
ctcccatattcatcaaagac

SEQ ID NO: 12694 - DNA, 20 bp, Artificial Sequence
  Description of Artificial Sequence: Synthetic oligonucleotide
  Target: SCN10A; (+) strand; PAM type: NNNNGHTT; PAM sequence: ACCTGTTT
gacattgtcaacatttctcc

SEQ ID NO: 12695 - DNA, 20 bp, Artificial Sequence
  Description of Artificial Sequence: Synthetic oligonucleotide
  Target: SCN10A; (+) strand; PAM type: NNNNGHTT; PAM sequence: TCCAGATT
cctccaagttactggagaac

SEQ ID NO: 12696 - DNA, 20 bp, Artificial Sequence
  Description of Artificial Sequence: Synthetic oligonucleotide
  Target: SCN10A; (+) strand; PAM type: NNNNGHTT; PAM sequence: ACCAGATT
gctgaacacttttccccata

SEQ ID NO: 12697 - DNA, 20 bp, Artificial Sequence
  Description of Artificial Sequence: Synthetic oligonucleotide
  Target: SCN10A; (+) strand; PAM type: NNNNGHTT; PAM sequence: AGCAGTTT
atcatatggtatccctagtc

SEQ ID NO: 12698 - DNA, 20 bp, Artificial Sequence
  Description of Artificial Sequence: Synthetic oligonucleotide
  Target: SCN10A; (+) strand; PAM type: NNNNGHTT; PAM sequence: TGAGGTTT
gtcagcagtttcttctagtc

SEQ ID NO: 12699 - DNA, 20 bp, Artificial Sequence
  Description of Artificial Sequence: Synthetic oligonucleotide
  Target: SCN10A; (+) strand; PAM type: NNNNGHTT; PAM sequence: CTCTGCTT
tctaaggaccattcctttcc

SEQ ID NO: 12700 - DNA, 20 bp, Artificial Sequence
  Description of Artificial Sequence: Synthetic oligonucleotide
  Target: SCN10A; (+) strand; PAM type: NNNNGHTT; PAM sequence: AGATGCTT
tctttcctatcagcatttaa

SEQ ID NO: 12701 - DNA, 20 bp, Artificial Sequence
  Description of Artificial Sequence: Synthetic oligonucleotide
  Target: SCN10A; (+) strand; PAM type: NNNNGHTT; PAM sequence: ATTGGCTT
cctcctctctcctgttctct

SEQ ID NO: 12702 - DNA, 20 bp, Artificial Sequence
  Description of Artificial Sequence: Synthetic oligonucleotide
  Target: SCN10A; (+) strand; PAM type: NNNNGHTT; PAM sequence: CACTGTTT
ataaaggacttacttctact

SEQ ID NO: 12703 - DNA, 20 bp, Artificial Sequence
  Description of Artificial Sequence: Synthetic oligonucleotide
  Target: SCN10A; (+) strand; PAM type: NNNNGHTT; PAM sequence: TGAAGCTT
tccagtcacttttcagtctt

SEQ ID NO: 12704 - DNA, 20 bp, Artificial Sequence
  Description of Artificial Sequence: Synthetic oligonucleotide
  Target: SCN10A; (+) strand; PAM type: NNNNGHTT; PAM sequence: CTTGGATT
tcacttttcagtctttgaag

SEQ ID NO: 12705 - DNA, 20 bp, Artificial Sequence
  Description of Artificial Sequence: Synthetic oligonucleotide
  Target: SCN10A; (+) strand; PAM type: NNNNGHTT; PAM sequence: AAATGCTT
tttgccctcctatctcacta

SEQ ID NO: 12706 - DNA, 20 bp, Artificial Sequence
  Description of Artificial Sequence: Synthetic oligonucleotide
  Target: SCN10A; (+) strand; PAM type: NNNNGHTT; PAM sequence: AAGAGATT
atgcttccttgcagggatac

SEQ ID NO: 12707 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
cccttctcagttcttgtctt

SEQ ID NO: 12708 - DNA, 20 bp, Artificial Sequence
  Description of Artificial Sequence: Synthetic oligonucleotide
  Target: SCN10A; (+) strand; PAM type: NNNNGHTT; PAM sequence: GCTAGTTT
ggcacatgtcaccacactcg

SEQ ID NO: 12709 - DNA, 20 bp, Artificial Sequence
  Description of Artificial Sequence: Synthetic oligonucleotide
  Target: SCN10A; (+) strand; PAM type: NNNNGHTT; PAM sequence: GGCTGTTT
cttatcttgatggtcctatt

SEQ ID NO: 12710 - DNA, 20 bp, Artificial Sequence
  Description of Artificial Sequence: Synthetic oligonucleotide
  Target: SCN10A; (+) strand; PAM type: NNNNGHTT; PAM sequence: CTTGGTTT
tttggctaccatgacactct

SEQ ID NO: 12711 - DNA, 20 bp, Artificial Sequence
  Description of Artificial Sequence: Synthetic oligonucleotide
  Target: SCN10A; (+) strand; PAM type: NNNNGHTT; PAM sequence: CTCAGCTT
tccttctcagtctctccttt

SEQ ID NO: 12712 - DNA, 20 bp, Artificial Sequence
  Description of Artificial Sequence: Synthetic oligonucleotide
  Target: SCN10A; (+) strand; PAM type: NNNNGHTT; PAM sequence: ACATGATT
cctttctcagcttttcccat

SEQ ID NO: 12713 - DNA, 20 bp, Artificial Sequence
  Description of Artificial Sequence: Synthetic oligonucleotide
  Target: SCN10A; (+) strand; PAM type: NNNNGHTT; PAM sequence: TTTTGTTT
gtgaataatggcactctatc

SEQ ID NO: 12714 - DNA, 20 bp, Artificial Sequence
  Description of Artificial Sequence: Synthetic oligonucleotide
  Target: SCN10A; (+) strand; PAM type: NNNNGHTT; PAM sequence: CTGAGATT
ttcaacagcgctagcattta

SEQ ID NO: 12715 - DNA, 20 bp, Artificial Sequence
  Description of Artificial Sequence: Synthetic oligonucleotide
  Target: SCN10A; (+) strand; PAM type: NNNNGHTT; PAM sequence: TCTGGATT
gattccactgtatttcagac

SEQ ID NO: 12716 - DNA, 20 bp, Artificial Sequence
  Description of Artificial Sequence: Synthetic oligonucleotide
  Target: SCN10A; (+) strand; PAM type: NNNNGHTT; PAM sequence: GTATGTTT
agaacggtacttaaactcag

SEQ ID NO: 12717 - DNA, 20 bp, Artificial Sequence
  Description of Artificial Sequence: Synthetic oligonucleotide
  Target: SCN10A; (+) strand; PAM type: NNNNGHTT; PAM sequence: GCCTGTTT
actgccattagccccaaata

SEQ ID NO: 12718 - DNA, 20 bp, Artificial Sequence
  Description of Artificial Sequence: Synthetic oligonucleotide
  Target: SCN10A; (+) strand; PAM type: NNNNGHTT; PAM sequence: TGTTGCTT
tacaatcaaacatctagtgc

SEQ ID NO: 12719 - DNA, 20 bp, Artificial Sequence
  Description of Artificial Sequence: Synthetic oligonucleotide
  Target: SCN10A; (+) strand; PAM type: NNNNGHTT; PAM sequence: TTTTGATT
cactggcctcgtatgtgtca

SEQ ID NO: 12720 - DNA, 20 bp, Artificial Sequence
  Description of Artificial Sequence: Synthetic oligonucleotide
  Target: SCN10A; (+) strand; PAM type: NNNNGHTT; PAM sequence: ATAAGTTT
tccccagccacactactttt

SEQ ID NO: 12721 - DNA, 20 bp, Artificial Sequence
  Description of Artificial Sequence: Synthetic oligonucleotide
  Target: SCN10A; (+) strand; PAM type: NNNNGHTT; PAM sequence: TAAGGCTT
tgacccattcttttttatgt

SEQ ID NO: 12722 - DNA, 20 bp, Artificial Sequence
  Description of Artificial Sequence: Synthetic oligonucleotide
  Target: SCN10A; (+) strand; PAM type: NNNNGHTT; PAM sequence: CTTGGCTT
tcctctcttattcttgtact

SEQ ID NO: 12723 - DNA, 20 bp, Artificial Sequence
  Description of Artificial Sequence: Synthetic oligonucleotide
  Target: SCN10A; (+) strand; PAM type: NNNNGHTT; PAM sequence: TTAGGATT
tgacctatatgaagtctatg

SEQ ID NO: 12724 - DNA, 20 bp, Artificial Sequence
  Description of Artificial Sequence: Synthetic oligonucleotide
  Target: SCN10A; (+) strand; PAM type: NNNNGHTT; PAM sequence: TCCTGTTT
tatgaagtctatgttaggat

SEQ ID NO: 12725 - DNA, 20 bp, Artificial Sequence
  Description of Artificial Sequence: Synthetic oligonucleotide
  Target: SCN10A; (+) strand; PAM type: NNNNGHTT; PAM sequence: ATCTGATT
tctgcactttctctataaac

SEQ ID NO: 12726 - DNA, 20 bp, Artificial Sequence
  Description of Artificial Sequence: Synthetic oligonucleotide
  Target: SCN10A; (+) strand; PAM type: NNNNGHTT; PAM sequence: TTCTGTTT
ataaacatctgatttgtaat

SEQ ID NO: 12727 - DNA, 20 bp, Artificial Sequence
  Description of Artificial Sequence: Synthetic oligonucleotide
  Target: SCN10A; (+) strand; PAM type: NNNNGHTT; PAM sequence: TATTGTTT
gtaatttctgtttgcctttc

SEQ ID NO: 12728 - DNA, 20 bp, Artificial Sequence
  Description of Artificial Sequence: Synthetic oligonucleotide
  Target: SCN10A; (+) strand; PAM type: NNNNGHTT; PAM sequence: CATTGATT
ctcacatctattttgttcag

SEQ ID NO: 12729 - DNA, 20 bp, Artificial Sequence
  Description of Artificial Sequence: Synthetic oligonucleotide
  Target: SCN10A; (+) strand; PAM type: NNNNGHTT; PAM sequence: AAGAGATT
aataggaatataaggaacca

SEQ ID NO: 12730 - DNA, 20 bp, Artificial Sequence
  Description of Artificial Sequence: Synthetic oligonucleotide
  Target: SCN10A; (+) strand; PAM type: NNNNGHTT; PAM sequence: CAGTGCTT
caagcagatggtggcagagg

SEQ ID NO: 12731 - DNA, 20 bp, Artificial Sequence
  Description of Artificial Sequence: Synthetic oligonucleotide
  Target: SCN10A; (+) strand; PAM type: NNNNGHTT; PAM sequence: TCCTGCTT
aaatacccctatgatggaga

SEQ ID NO: 12732 - DNA, 20 bp, Artificial Sequence
  Description of Artificial Sequence: Synthetic oligonucleotide
  Target: SCN10A; (+) strand; PAM type: NNNNGHTT; PAM sequence: CACTGCTT
caatacctctgtgatataga

SEQ ID NO: 12733 - DNA, 20 bp, Artificial Sequence
  Description of Artificial Sequence: Synthetic oligonucleotide
  Target: SCN10A; (+) strand; PAM type: NNNNGHTT; PAM sequence: GAGAGCTT
gtcctccattactttcttct

SEQ ID NO: 12734 - DNA, 20 bp, Artificial Sequence
  Description of Artificial Sequence: Synthetic oligonucleotide
  Target: SCN10A; (+) strand; PAM type: NNNNGHTT; PAM sequence: ATCTGTTT
ctcctgcctatttgtagttg

SEQ ID NO: 12735 - DNA, 20 bp, Artificial Sequence
  Description of Artificial Sequence: Synthetic oligonucleotide
  Target: SCN10A; (+) strand; PAM type: NNNNGHTT; PAM sequence: TTCTGATT
ctatgtgttgtgtgcccaaa

SEQ ID NO: 12736 - DNA, 20 bp, Artificial Sequence
  Description of Artificial Sequence: Synthetic oligonucleotide
  Target: SCN10A; (+) strand; PAM type: NNNNGHTT; PAM sequence: CAAAGATT
aattcttcccttctgagaaa

SEQ ID NO: 12737 - DNA, 20 bp, Artificial Sequence
  Description of Artificial Sequence: Synthetic oligonucleotide
  Target: SCN10A; (+) strand; PAM type: NNNNGHTT; PAM sequence: TATAGTTT
tctaggggagaagagatact

SEQ ID NO: 12738 - DNA, 20 bp, Artificial Sequence
  Description of Artificial Sequence: Synthetic oligonucleotide
  Target: SCN10A; (+) strand; PAM type: NNNNGHTT; PAM sequence: AGTTGTTT
aaatttgaatcccaggactc

SEQ ID NO: 12739 - DNA, 20 bp, Artificial Sequence
  Description of Artificial Sequence: Synthetic oligonucleotide
  Target: SCN10A; (+) strand; PAM type: NNNNGHTT; PAM sequence: TGAGGATT
gtgacactggaatgcaatgt

SEQ ID NO: 12740 - DNA, 20 bp, Artificial Sequence
  Description of Artificial Sequence: Synthetic oligonucleotide
  Target: SCN10A; (+) strand; PAM type: NNNNGHTT; PAM sequence: TGGAGCTT
agaattccaggtcctggagc

SEQ ID NO: 12741 - DNA, 20 bp, Artificial Sequence
  Description of Artificial Sequence: Synthetic oligonucleotide
  Target: SCN10A; (+) strand; PAM type: NNNNGHTT; PAM sequence: AATTGTTT
atccctccagctaaggacaa

SEQ ID NO: 12742 - DNA, 20 bp, Artificial Sequence
  Description of Artificial Sequence: Synthetic oligonucleotide
  Target: SCN10A; (+) strand; PAM type: NNNNGHTT; PAM sequence: CCTTGATT
atagctctggacttgggatc

SEQ ID NO: 12743 - DNA, 20 bp, Artificial Sequence
  Description of Artificial Sequence: Synthetic oligonucleotide
  Target: SCN10A; (+) strand; PAM type: NNNNGHTT; PAM sequence: AGTAGTTT
gagaaaactattggggtgca

SEQ ID NO: 12744 - DNA, 20 bp, Artificial Sequence
  Description of Artificial Sequence: Synthetic oligonucleotide
  Target: SCN10A; (+) strand; PAM type: NNNNGHTT; PAM sequence: AATTGTTT
tatgggcaaactgggctcag

SEQ ID NO: 12745 - DNA, 20 bp, Artificial Sequence
  Description of Artificial Sequence: Synthetic oligonucleotide
  Target: SCN10A; (+) strand; PAM type: NNNNGHTT; PAM sequence: TAGGGTTT
tcactgaggggtaaggatac

SEQ ID NO: 12746 - DNA, 20 bp, Artificial Sequence
  Description of Artificial Sequence: Synthetic oligonucleotide
  Target: SCN10A; (+) strand; PAM type: NNNNGHTT; PAM sequence: CTGGGATT
cttattggttgacggttgtc

SEQ ID NO: 12747 - DNA, 20 bp, Artificial Sequence
  Description of Artificial Sequence: Synthetic oligonucleotide
  Target: SCN10A; (+) strand; PAM type: NNNNGHTT; PAM sequence: ATAGGATT
ccatatcaaatgtatgtgtt

SEQ ID NO: 12748 - DNA, 20 bp, Artificial Sequence
  Description of Artificial Sequence: Synthetic oligonucleotide
  Target: SCN10A; (+) strand; PAM type: NNNNGHTT; PAM sequence: CTTGGATT
tctgggcctgatactcactt

SEQ ID NO: 12749 - DNA, 20 bp, Artificial Sequence
  Description of Artificial Sequence: Synthetic oligonucleotide
  Target: SCN10A; (+) strand; PAM type: NNNNGHTT; PAM sequence: TCTAGTTT
acaatccaagaaatatctat

SEQ ID NO: 12750 - DNA, 20 bp, Artificial Sequence
  Description of Artificial Sequence: Synthetic oligonucleotide
  Target: SCN10A; (+) strand; PAM type: NNNNGHTT; PAM sequence: CCTGGCTT
agtttagctccaagctcggc

SEQ ID NO: 12751 - DNA, 20 bp, Artificial Sequence
  Description of Artificial Sequence: Synthetic oligonucleotide
  Target: SCN10A; (+) strand; PAM type: NNNNGHTT; PAM sequence: ATGAGTTT
ctggctttcaaacagtctgc

SEQ ID NO: 12752 - DNA, 20 bp, Artificial Sequence
  Description of Artificial Sequence: Synthetic oligonucleotide
  Target: SCN10A; (+) strand; PAM type: NNNNGHTT; PAM sequence: TTAAGTTT
gtttttgcaggtatattccc

SEQ ID NO: 12753 - DNA, 20 bp, Artificial Sequence
  Description of Artificial Sequence: Synthetic oligonucleotide
  Target: SCN10A; (+) strand; PAM type: NNNNGHTT; PAM sequence: TGGGGTTT
gctaatcttcatatttttga

SEQ ID NO: 12754 - DNA, 20 bp, Artificial Sequence
  Description of Artificial Sequence: Synthetic oligonucleotide
  Target: SCN10A; (-) strand; PAM type: NRG; PAM sequence: TAG
atagtccgtatgcctggcca

SEQ ID NO: 12755 - DNA, 20 bp, Artificial Sequence
  Description of Artificial Sequence: Synthetic oligonucleotide
  Target: SCN10A; (-) strand; PAM type: NRG; PAM sequence: TGG
acaaaaatagtccgtatgcc

SEQ ID NO: 12756 - DNA, 20 bp, Artificial Sequence
  Description of Artificial Sequence: Synthetic oligonucleotide
  Target: SCN10A; (-) strand; PAM type: NRG; PAM sequence: TAG
atagggcacatttacaaaaa

SEQ ID NO: 12757 - DNA, 20 bp, Artificial Sequence
  Description of Artificial Sequence: Synthetic oligonucleotide
  Target: SCN10A; (-) strand; PAM type: NRG; PAM sequence: GGG
ggtacaaatacaagtacata

SEQ ID NO: 12758 - DNA, 20 bp, Artificial Sequence
  Description of Artificial Sequence: Synthetic oligonucleotide
  Target: SCN10A; (-) strand; PAM type: NRG; PAM sequence: AGG
gggtacaaatacaagtacat

SEQ ID NO: 12759 - DNA, 20 bp, Artificial Sequence
  Description of Artificial Sequence: Synthetic oligonucleotide
  Target: SCN10A; (-) strand; PAM type: NRG; PAM sequence: TAG
agggtacaaatacaagtaca

SEQ ID NO: 12760 - DNA, 20 bp, Artificial Sequence
  Description of Artificial Sequence: Synthetic oligonucleotide
  Target: SCN10A; (-) strand; PAM type: NRG; PAM sequence: AAG
taccaaaagggtacaaatac

SEQ ID NO: 12761 - DNA, 20 bp, Artificial Sequence
  Description of Artificial Sequence: Synthetic oligonucleotide
  Target: SCN10A; (-) strand; PAM type: NRG; PAM sequence: GGG
aaaacctaaggttaccaaaa

SEQ ID NO: 12762 - DNA, 20 bp, Artificial Sequence
  Description of Artificial Sequence: Synthetic oligonucleotide
  Target: SCN10A; (-) strand; PAM type: NRG; PAM sequence: AGG
caaaacctaaggttaccaaa

SEQ ID NO: 12763 - DNA, 20 bp, Artificial Sequence
  Description of Artificial Sequence: Synthetic oligonucleotide
  Target: SCN10A; (-) strand; PAM type: NRG; PAM sequence: AAG
acaaaacctaaggttaccaa

SEQ ID NO: 12764 - DNA, 20 bp, Artificial Sequence
  Description of Artificial Sequence: Synthetic oligonucleotide
  Target: SCN10A; (-) strand; PAM type: NRG; PAM sequence: AGG
agaaagccacacaaaaccta

SEQ ID NO: 12765 - DNA, 20 bp, Artificial Sequence
  Description of Artificial Sequence: Synthetic oligonucleotide
  Target: SCN10A; (-) strand; PAM type: NRG; PAM sequence: AAG
cagaaagccacacaaaacct

SEQ ID NO: 12766 - DNA, 20 bp, Artificial Sequence
  Description of Artificial Sequence: Synthetic oligonucleotide
  Target: SCN10A; (-) strand; PAM type: NRG; PAM sequence: AAG
aaataaattctgtttacaga

SEQ ID NO: 12767 - DNA, 20 bp, Artificial Sequence
  Description of Artificial Sequence: Synthetic oligonucleotide
  Target: SCN10A; (-) strand; PAM type: NRG; PAM sequence: CAG
attcaaataaattctgttta

SEQ ID NO: 12768 - DNA, 20 bp, Artificial Sequence
  Description of Artificial Sequence: Synthetic oligonucleotide
  Target: SCN10A; (-) strand; PAM type: NRG; PAM sequence: AAG
tgggaaaaagagtgtcagtc

SEQ ID NO: 12769 - DNA, 20 bp, Artificial Sequence
  Description of Artificial Sequence: Synthetic oligonucleotide
  Target: SCN10A; (-) strand; PAM type: NRG; PAM sequence: CAG
gactctgggaaaaagagtgt

SEQ ID NO: 12770 - DNA, 20 bp, Artificial Sequence
  Description of Artificial Sequence: Synthetic oligonucleotide
  Target: SCN10A; (-) strand; PAM type: NRG; PAM sequence: GAG
taaatggactctgggaaaaa

SEQ ID NO: 12771 - DNA, 20 bp, Artificial Sequence
  Description of Artificial Sequence: Synthetic oligonucleotide
  Target: SCN10A; (-) strand; PAM type: NRG; PAM sequence: AAG
tttaaatggactctgggaaa

SEQ ID NO: 12772 - DNA, 20 bp, Artificial Sequence
  Description of Artificial Sequence: Synthetic oligonucleotide
  Target: SCN10A; (-) strand; PAM type: NRG; PAM sequence: GGG
attaaatttaaatggactct

SEQ ID NO: 12773 - DNA, 20 bp, Artificial Sequence
  Description of Artificial Sequence: Synthetic oligonucleotide
  Target: SCN10A; (-) strand; PAM type: NRG; PAM sequence: TGG
cattaaatttaaatggactc

SEQ ID NO: 12774 - DNA, 20 bp, Artificial Sequence
  Description of Artificial Sequence: Synthetic oligonucleotide
  Target: SCN10A; (-) strand; PAM type: NRG; PAM sequence: TGG
taaattacattaaatttaaa

SEQ ID NO: 12775 - DNA, 20 bp, Artificial Sequence
  Description of Artificial Sequence: Synthetic oligonucleotide
  Target: SCN10A; (-) strand; PAM type: NRG; PAM sequence: TAG
atagaaaagacagagtaaag

SEQ ID NO: 12776 - DNA, 20 bp, Artificial Sequence
  Description of Artificial Sequence: Synthetic oligonucleotide
  Target: SCN10A; (-) strand; PAM type: NRG; PAM sequence: AAG
caaatagaaaagacagagta

SEQ ID NO: 12777 - DNA, 20 bp, Artificial Sequence
  Description of Artificial Sequence: Synthetic oligonucleotide
  Target: SCN10A; (-) strand; PAM type: NRG; PAM sequence: GAG
agaaacaaatagaaaagaca

SEQ ID NO: 12778 - DNA, 20 bp, Artificial Sequence
  Description of Artificial Sequence: Synthetic oligonucleotide
  Target: SCN10A; (-) strand; PAM type: NRG; PAM sequence: CAG
aaagaaacaaatagaaaaga

SEQ ID NO: 12779 - DNA, 20 bp, Artificial Sequence
  Description of Artificial Sequence: Synthetic oligonucleotide
  Target: SCN10A; (-) strand; PAM type: NRG; PAM sequence: AAG
aataaaagaaacaaatagaa

SEQ ID NO: 12780 - DNA, 20 bp, Artificial Sequence
  Description of Artificial Sequence: Synthetic oligonucleotide
  Target: SCN10A; (-) strand; PAM type: NRG; PAM sequence: TAG
tacagaataaaagaaacaaa

SEQ ID NO: 12781 - DNA, 20 bp, Artificial Sequence
  Description of Artificial Sequence: Synthetic oligonucleotide
  Target: SCN10A; (-) strand; PAM type: NRG; PAM sequence: AAG
tatagagacatacagaataa

SEQ ID NO: 12782 - DNA, 20 bp, Artificial Sequence
  Description of Artificial Sequence: Synthetic oligonucleotide
  Target: SCN10A; (-) strand; PAM type: NRG; PAM sequence: CAG
acccgggatatagagacata

SEQ ID NO: 12783 - DNA, 20 bp, Artificial Sequence
  Description of Artificial Sequence: Synthetic oligonucleotide
  Target: SCN10A; (-) strand; PAM type: NRG; PAM sequence: GAG
ttaaaaaaacccgggatata

SEQ ID NO: 12784 - DNA, 20 bp, Artificial Sequence
  Description of Artificial Sequence: Synthetic oligonucleotide
  Target: SCN10A; (-) strand; PAM type: NRG; PAM sequence: TAG
aattaaaaaaacccgggata

SEQ ID NO: 12785 - DNA, 20 bp, Artificial Sequence
  Description of Artificial Sequence: Synthetic oligonucleotide
  Target: SCN10A; (-) strand; PAM type: NRG; PAM sequence: GGG
aataataattaaaaaaaccc

SEQ ID NO: 12786 - DNA, 20 bp, Artificial Sequence
  Description of Artificial Sequence: Synthetic oligonucleotide
  Target: SCN10A; (-) strand; PAM type: NRG; PAM sequence: CGG
taataataattaaaaaaacc

SEQ ID NO: 12787 - DNA, 20 bp, Artificial Sequence
  Description of Artificial Sequence: Synthetic oligonucleotide
  Target: SCN10A; (-) strand; PAM type: NRG; PAM sequence: AAG
ctcatgtatcctaaaactta

SEQ ID NO: 12788 - DNA, 20 bp, Artificial Sequence
  Description of Artificial Sequence: Synthetic oligonucleotide
  Target: SCN10A; (-) strand; PAM type: NRG; PAM sequence: TGG
atgggtgcagcacaccaaca

SEQ ID NO: 12789 - DNA, 20 bp, Artificial Sequence
  Description of Artificial Sequence: Synthetic oligonucleotide
  Target: SCN10A; (-) strand; PAM type: NRG; PAM sequence: CAG
aaatgacaagttaatgggtg

SEQ ID NO: 12790 - DNA, 20 bp, Artificial Sequence
  Description of Artificial Sequence: Synthetic oligonucleotide
  Target: SCN10A; (-) strand; PAM type: NRG; PAM sequence: GGG
aatgtaaatgacaagttaat

SEQ ID NO: 12791 - DNA, 20 bp, Artificial Sequence
  Description of Artificial Sequence: Synthetic oligonucleotide
  Target: SCN10A; (-) strand; PAM type: NRG; PAM sequence: TGG
taatgtaaatgacaagttaa

SEQ ID NO: 12792 - DNA, 20 bp, Artificial Sequence
  Description of Artificial Sequence: Synthetic oligonucleotide
  Target: SCN10A; (-) strand; PAM type: NRG; PAM sequence: AAG
atatacctaatgtaaatgac

SEQ ID NO: 12793 - DNA, 20 bp, Artificial Sequence
  Description of Artificial Sequence: Synthetic oligonucleotide
  Target: SCN10A; (-) strand; PAM type: NRG; PAM sequence: GAG
ggggggagggatagcattag

SEQ ID NO: 12794 - DNA, 20 bp, Artificial Sequence
  Description of Artificial Sequence: Synthetic oligonucleotide
  Target: SCN10A; (-) strand; PAM type: NRG; PAM sequence: AGG
gaggggggagggatagcatt

SEQ ID NO: 12795 - DNA, 20 bp, Artificial Sequence
  Description of Artificial Sequence: Synthetic oligonucleotide
  Target: SCN10A; (-) strand; PAM type: NRG; PAM sequence: TAG
ggaggggggagggatagcat

SEQ ID NO: 12796 - DNA, 20 bp, Artificial Sequence
  Description of Artificial Sequence: Synthetic oligonucleotide
  Target: SCN10A; (-) strand; PAM type: NRG; PAM sequence: TAG
gtggagggaggggggaggga

SEQ ID NO: 12797 - DNA, 20 bp, Artificial Sequence
  Description of Artificial Sequence: Synthetic oligonucleotide
  Target: SCN10A; (-) strand; PAM type: NRG; PAM sequence: GGG
tggggtggagggagggggga

SEQ ID NO: 12798 - DNA, 20 bp, Artificial Sequence
  Description of Artificial Sequence: Synthetic oligonucleotide
  Target: SCN10A; (-) strand; PAM type: NRG; PAM sequence: AGG
gtggggtggagggagggggg

SEQ ID NO: 12799 - DNA, 20 bp, Artificial Sequence
  Description of Artificial Sequence: Synthetic oligonucleotide
  Target: SCN10A; (-) strand; PAM type: NRG; PAM sequence: GAG
tgtggggtggagggaggggg

SEQ ID NO: 12800 - DNA, 20 bp, Artificial Sequence
  Description of Artificial Sequence: Synthetic oligonucleotide
  Target: SCN10A; (-) strand; PAM type: NRG; PAM sequence: GGG
gttgtggggtggagggaggg

SEQ ID NO: 12801 - DNA, 20 bp, Artificial Sequence
  Description of Artificial Sequence: Synthetic oligonucleotide
  Target: SCN10A; (-) strand; PAM type: NRG; PAM sequence: GGG
agttgtggggtggagggagg

SEQ ID NO: 12802 - DNA, 20 bp, Artificial Sequence
  Description of Artificial Sequence: Synthetic oligonucleotide
  Target: SCN10A; (-) strand; PAM type: NRG; PAM sequence: GGG
cagttgtggggtggagggag

SEQ ID NO: 12803 - DNA, 20 bp, Artificial Sequence
  Description of Artificial Sequence: Synthetic oligonucleotide
  Target: SCN10A; (-) strand; PAM type: NRG; PAM sequence: GGG
acagttgtggggtggaggga

SEQ ID NO: 12804 - DNA, 20 bp, Artificial Sequence
  Description of Artificial Sequence: Synthetic oligonucleotide
  Target: SCN10A; (-) strand; PAM type: NRG; PAM sequence: AGG
gacagttgtggggtggaggg

SEQ ID NO: 12805 - DNA, 20 bp, Artificial Sequence
  Description of Artificial Sequence: Synthetic oligonucleotide
  Target: SCN10A; (-) strand; PAM type: NRG; PAM sequence: GAG
ggacagttgtggggtggagg

SEQ ID NO: 12806 - DNA, 20 bp, Artificial Sequence
  Description of Artificial Sequence: Synthetic oligonucleotide
  Target: SCN10A; (-) strand; PAM type: NRG; PAM sequence: GGG
ggggacagttgtggggtgga

SEQ ID NO: 12807 - DNA, 20 bp, Artificial Sequence
  Description of Artificial Sequence: Synthetic oligonucleotide
  Target: SCN10A; (-) strand; PAM type: NRG; PAM sequence: AGG
cggggacagttgtggggtgg

SEQ ID NO: 12808 - DNA, 20 bp, Artificial Sequence
  Description of Artificial Sequence: Synthetic oligonucleotide
  Target: SCN10A; (-) strand; PAM type: NRG; PAM sequence: GAG
ccggggacagttgtggggtg

SEQ ID NO: 12809 - DNA, 20 bp, Artificial Sequence
  Description of Artificial Sequence: Synthetic oligonucleotide
  Target: SCN10A; (-) strand; PAM type: NRG; PAM sequence: TGG
caccggggacagttgtgggg

SEQ ID NO: 12810 - DNA, 20 bp, Artificial Sequence
  Description of Artificial Sequence: Synthetic oligonucleotide
  Target: SCN10A; (-) strand; PAM type: NRG; PAM sequence: GGG
acacaccggggacagttgtg

SEQ ID NO: 12811 - DNA, 20 bp, Artificial Sequence
  Description of Artificial Sequence: Synthetic oligonucleotide
  Target: SCN10A; (-) strand; PAM type: NRG; PAM sequence: GGG
cacacaccggggacagttgt

SEQ ID NO: 12812 - DNA, 20 bp, Artificial Sequence
  Description of Artificial Sequence: Synthetic oligonucleotide
  Target: SCN10A; (-) strand; PAM type: NRG; PAM sequence: TGG
tcacacaccggggacagttg

SEQ ID NO: 12813 - DNA, 20 bp, Artificial Sequence
  Description of Artificial Sequence: Synthetic oligonucleotide
  Target: SCN10A; (-) strand; PAM type: NRG; PAM sequence: CAG
ggaacatcacacaccgggga

SEQ ID NO: 12814 - DNA, 20 bp, Artificial Sequence
  Description of Artificial Sequence: Synthetic oligonucleotide
  Target: SCN10A; (-) strand; PAM type: NRG; PAM sequence: GGG
aaggggaacatcacacaccg

SEQ ID NO: 12815 - DNA, 20 bp, Artificial Sequence
  Description of Artificial Sequence: Synthetic oligonucleotide
  Target: SCN10A; (-) strand; PAM type: NRG; PAM sequence: GGG
gaaggggaacatcacacacc

SEQ ID NO: 12816 - DNA, 20 bp, Artificial Sequence
  Description of Artificial Sequence: Synthetic oligonucleotide
  Target: SCN10A; (-) strand; PAM type: NRG; PAM sequence: CGG
ggaaggggaacatcacacac

SEQ ID NO: 12817 - DNA, 20 bp, Artificial Sequence
  Description of Artificial Sequence: Synthetic oligonucleotide
  Target: SCN10A; (-) strand; PAM type: NRG; PAM sequence: GGG
gaacacatggacacaggaag

SEQ ID NO: 12818 - DNA, 20 bp, Artificial Sequence
  Description of Artificial Sequence: Synthetic oligonucleotide
  Target: SCN10A; (-) strand; PAM type: NRG; PAM sequence: GGG
agaacacatggacacaggaa

SEQ ID NO: 12819 - DNA, 20 bp, Artificial Sequence
  Description of Artificial Sequence: Synthetic oligonucleotide
  Target: SCN10A; (-) strand; PAM type: NRG; PAM sequence: AGG
aagaacacatggacacagga

SEQ ID NO: 12820 - DNA, 20 bp, Artificial Sequence
  Description of Artificial Sequence: Synthetic oligonucleotide
  Target: SCN10A; (-) strand; PAM type: NRG; PAM sequence: AAG
taagaacacatggacacagg

SEQ ID NO: 12821 - DNA, 20 bp, Artificial Sequence
  Description of Artificial Sequence: Synthetic oligonucleotide
  Target: SCN10A; (-) strand; PAM type: NRG; PAM sequence: AGG
caataagaacacatggacac

SEQ ID NO: 12822 - DNA, 20 bp, Artificial Sequence
  Description of Artificial Sequence: Synthetic oligonucleotide
  Target: SCN10A; (-) strand; PAM type: NRG; PAM sequence: CAG
acaataagaacacatggaca

SEQ ID NO: 12823 - DNA, 20 bp, Artificial Sequence
  Description of Artificial Sequence: Synthetic oligonucleotide
  Target: SCN10A; (-) strand; PAM type: NRG; PAM sequence: TGG
aattgaacaataagaacaca

SEQ ID NO: 12824 - DNA, 20 bp, Artificial Sequence
  Description of Artificial Sequence: Synthetic oligonucleotide
  Target: SCN10A; (-) strand; PAM type: NRG; PAM sequence: AAG
ataggtgggaattgaacaat

SEQ ID NO: 12825 - DNA, 20 bp, Artificial Sequence
  Description of Artificial Sequence: Synthetic oligonucleotide
  Target: SCN10A; (-) strand; PAM type: NRG; PAM sequence: GGG
gcatgttctcactcataggt

SEQ ID NO: 12826 - DNA, 20 bp, Artificial Sequence
  Description of Artificial Sequence: Synthetic oligonucleotide
  Target: SCN10A; (-) strand; PAM type: NRG; PAM sequence: TGG
cgcatgttctcactcatagg

SEQ ID NO: 12827 - DNA, 20 bp, Artificial Sequence
  Description of Artificial Sequence: Synthetic oligonucleotide
  Target: SCN10A; (-) strand; PAM type: NRG; PAM sequence: AGG
caccgcatgttctcactcat

SEQ ID NO: 12828 - DNA, 20 bp, Artificial Sequence
  Description of Artificial Sequence: Synthetic oligonucleotide
  Target: SCN10A; (-) strand; PAM type: NRG; PAM sequence: TAG
acaccgcatgttctcactca

SEQ ID NO: 12829 - DNA, 20 bp, Artificial Sequence
  Description of Artificial Sequence: Synthetic oligonucleotide
  Target: SCN10A; (-) strand; PAM type: NRG; PAM sequence: AGG
attctcagcaaactatcgca

SEQ ID NO: 12830 - DNA, 20 bp, Artificial Sequence
  Description of Artificial Sequence: Synthetic oligonucleotide
  Target: SCN10A; (-) strand; PAM type: NRG; PAM sequence: AAG
cattctcagcaaactatcgc

SEQ ID NO: 12831 - DNA, 20 bp, Artificial Sequence
  Description of Artificial Sequence: Synthetic oligonucleotide
  Target: SCN10A; (-) strand; PAM type: NRG; PAM sequence: CAG
aagctggaaaccatcattct

SEQ ID NO: 12832 - DNA, 20 bp, Artificial Sequence
  Description of Artificial Sequence: Synthetic oligonucleotide
  Target: SCN10A; (-) strand; PAM type: NRG; PAM sequence: TGG
tgcagggacatggatgaagc

SEQ ID NO: 12833 - DNA, 20 bp, Artificial Sequence
  Description of Artificial Sequence: Synthetic oligonucleotide
  Target: SCN10A; (-) strand; PAM type: NRG; PAM sequence: AAG
cctttgcagggacatggatg

SEQ ID NO: 12834 - DNA, 20 bp, Artificial Sequence
  Description of Artificial Sequence: Synthetic oligonucleotide
  Target: SCN10A; (-) strand; PAM type: NRG; PAM sequence: TGG
tcatgtcctttgcagggaca

SEQ ID NO: 12835 - DNA, 20 bp, Artificial Sequence
  Description of Artificial Sequence: Synthetic oligonucleotide
  Target: SCN10A; (-) strand; PAM type: NRG; PAM sequence: GGG
atgagttcatgtcctttgca

SEQ ID NO: 12836 - DNA, 20 bp, Artificial Sequence
  Description of Artificial Sequence: Synthetic oligonucleotide
  Target: SCN10A; (-) strand; PAM type: NRG; PAM sequence: AGG
gatgagttcatgtcctttgc

SEQ ID NO: 12837 - DNA, 20 bp, Artificial Sequence
  Description of Artificial Sequence: Synthetic oligonucleotide
  Target: SCN10A; (-) strand; PAM type: NRG; PAM sequence: CAG
tgatgagttcatgtcctttg

SEQ ID NO: 12838 - DNA, 20 bp, Artificial Sequence
  Description of Artificial Sequence: Synthetic oligonucleotide
  Target: SCN10A; (-) strand; PAM type: NRG; PAM sequence: GAG
atgcagccataaaaaatgat

SEQ ID NO: 12839 - DNA, 20 bp, Artificial Sequence
  Description of Artificial Sequence: Synthetic oligonucleotide
  Target: SCN10A; (-) strand; PAM type: NRG; PAM sequence: CAG
atacaccatggaatactatg

SEQ ID NO: 12840 - DNA, 20 bp, Artificial Sequence
  Description of Artificial Sequence: Synthetic oligonucleotide
  Target: SCN10A; (-) strand; PAM type: NRG; PAM sequence: TGG
aatgtggcacatatacacca

SEQ ID NO: 12841 - DNA, 20 bp, Artificial Sequence
  Description of Artificial Sequence: Synthetic oligonucleotide
  Target: SCN10A; (-) strand; PAM type: NRG; PAM sequence: TGG
tagactggattaagaaaatg

SEQ ID NO: 12842 - DNA, 20 bp, Artificial Sequence
  Description of Artificial Sequence: Synthetic oligonucleotide
  Target: SCN10A; (-) strand; PAM type: NRG; PAM sequence: AAG
caacagtgatagactggatt

SEQ ID NO: 12843 - DNA, 20 bp, Artificial Sequence
  Description of Artificial Sequence: Synthetic oligonucleotide
  Target: SCN10A; (-) strand; PAM type: NRG; PAM sequence: TGG
aatgtccaacagtgatagac

SEQ ID NO: 12844 - DNA, 20 bp, Artificial Sequence
  Description of Artificial Sequence: Synthetic oligonucleotide
  Target: SCN10A; (-) strand; PAM type: NRG; PAM sequence: TAG
acccaaatgtccaacagtga

SEQ ID NO: 12845 - DNA, 20 bp, Artificial Sequence
  Description of Artificial Sequence: Synthetic oligonucleotide
  Target: SCN10A; (-) strand; PAM type: NRG; PAM sequence: CAG
gaaccaacccaaatgtccaa

SEQ ID NO: 12846 - DNA, 20 bp, Artificial Sequence
  Description of Artificial Sequence: Synthetic oligonucleotide
  Target: SCN10A; (-) strand; PAM type: NRG; PAM sequence: TGG
tattcacaatagcaaagact

SEQ ID NO: 12847 - DNA, 20 bp, Artificial Sequence
  Description of Artificial Sequence: Synthetic oligonucleotide
  Target: SCN10A; (-) strand; PAM type: NRG; PAM sequence: AAG
tggcactattcacaatagca

SEQ ID NO: 12848 - DNA, 20 bp, Artificial Sequence
  Description of Artificial Sequence: Synthetic oligonucleotide
  Target: SCN10A; (-) strand; PAM type: NRG; PAM sequence: TAG
tattgtggcactattcacaa

SEQ ID NO: 12849 - DNA, 20 bp, Artificial Sequence
  Description of Artificial Sequence: Synthetic oligonucleotide
  Target: SCN10A; (-) strand; PAM type: NRG; PAM sequence: TGG
atgcacacgtatgtttattg

SEQ ID NO: 12850 - DNA, 20 bp, Artificial Sequence
  Description of Artificial Sequence: Synthetic oligonucleotide
  Target: SCN10A; (-) strand; PAM type: NRG; PAM sequence: AAG
ttataaatcatactgctata

SEQ ID NO: 12851 - DNA, 20 bp, Artificial Sequence
  Description of Artificial Sequence: Synthetic oligonucleotide
  Target: SCN10A; (-) strand; PAM type: NRG; PAM sequence: AGG
attactgggtatatacccaa

SEQ ID NO: 12852 - DNA, 20 bp, Artificial Sequence
  Description of Artificial Sequence: Synthetic oligonucleotide
  Target: SCN10A; (-) strand; PAM type: NRG; PAM sequence: AAG
cattactgggtatataccca

SEQ ID NO: 12853 - DNA, 20 bp, Artificial Sequence
  Description of Artificial Sequence: Synthetic oligonucleotide
  Target: SCN10A; (-) strand; PAM type: NRG; PAM sequence: GGG
gacccagccatcccattact

SEQ ID NO: 12854 - DNA, 20 bp, Artificial Sequence
  Description of Artificial Sequence: Synthetic oligonucleotide
  Target: SCN10A; (-) strand; PAM type: NRG; PAM sequence: TGG
tgacccagccatcccattac

SEQ ID NO: 12855 - DNA, 20 bp, Artificial Sequence
  Description of Artificial Sequence: Synthetic oligonucleotide
  Target: SCN10A; (-) strand; PAM type: NRG; PAM sequence: CAG
accagaaataccatttgacc

SEQ ID NO: 12856 - DNA, 20 bp, Artificial Sequence
  Description of Artificial Sequence: Synthetic oligonucleotide
  Target: SCN10A; (-) strand; PAM type: NRG; PAM sequence: CAG
attcctcagggatctagaac

SEQ ID NO: 12857 - DNA, 20 bp, Artificial Sequence
  Description of Artificial Sequence: Synthetic oligonucleotide
  Target: SCN10A; (-) strand; PAM type: NRG; PAM sequence: TAG
gtggcaattcctcagggatc

SEQ ID NO: 12858 - DNA, 20 bp, Artificial Sequence
  Description of Artificial Sequence: Synthetic oligonucleotide
  Target: SCN10A; (-) strand; PAM type: NRG; PAM sequence: GGG
gtcggtgtggcaattcctca

SEQ ID NO: 12859 - DNA, 20 bp, Artificial Sequence
  Description of Artificial Sequence: Synthetic oligonucleotide
  Target: SCN10A; (-) strand; PAM type: NRG; PAM sequence: AGG
agtcggtgtggcaattcctc

SEQ ID NO: 12860 - DNA, 20 bp, Artificial Sequence
  Description of Artificial Sequence: Synthetic oligonucleotide
  Target: SCN10A; (-) strand; PAM type: NRG; PAM sequence: CAG
aagtcggtgtggcaattcct

SEQ ID NO: 12861 - DNA, 20 bp, Artificial Sequence
  Description of Artificial Sequence: Synthetic oligonucleotide
  Target: SCN10A; (-) strand; PAM type: NRG; PAM sequence: TGG
aatcattgtggaagtcggtg

SEQ ID NO: 12862 - DNA, 20 bp, Artificial Sequence
  Description of Artificial Sequence: Synthetic oligonucleotide
  Target: SCN10A; (-) strand; PAM type: NRG; PAM sequence: CGG
agttcaatcattgtggaagt

SEQ ID NO: 12863 - DNA, 20 bp, Artificial Sequence
  Description of Artificial Sequence: Synthetic oligonucleotide
  Target: SCN10A; (-) strand; PAM type: NRG; PAM sequence: AAG
aactagttcaatcattgtgg

SEQ ID NO: 12864 - DNA, 20 bp, Artificial Sequence
  Description of Artificial Sequence: Synthetic oligonucleotide
  Target: SCN10A; (-) strand; PAM type: NRG; PAM sequence: TGG
gtaaactagttcaatcattg

SEQ ID NO: 12865 - DNA, 20 bp, Artificial Sequence
  Description of Artificial Sequence: Synthetic oligonucleotide
  Target: SCN10A; (-) strand; PAM type: NRG; PAM sequence: TAG
ctgttggtgggtctgtaaac

SEQ ID NO: 12866 - DNA, 20 bp, Artificial Sequence
  Description of Artificial Sequence: Synthetic oligonucleotide
  Target: SCN10A; (-) strand; PAM type: NRG; PAM sequence: GGG
aacacttttacactgttggt

SEQ ID NO: 12867 - DNA, 20 bp, Artificial Sequence
  Description of Artificial Sequence: Synthetic oligonucleotide
  Target: SCN10A; (-) strand; PAM type: NRG; PAM sequence: TGG
gaacacttttacactgttgg

SEQ ID NO: 12868 - DNA, 20 bp, Artificial Sequence
  Description of Artificial Sequence: Synthetic oligonucleotide
  Target: SCN10A; (-) strand; PAM type: NRG; PAM sequence: TGG
taggaacacttttacactgt

SEQ ID NO: 12869 - DNA, 20 bp, Artificial Sequence
  Description of Artificial Sequence: Synthetic oligonucleotide
  Target: SCN10A; (-) strand; PAM type: NRG; PAM sequence: AGG
tggagaggatgtggagaaat

SEQ ID NO: 12870 - DNA, 20 bp, Artificial Sequence
  Description of Artificial Sequence: Synthetic oligonucleotide
  Target: SCN10A; (-) strand; PAM type: NRG; PAM sequence: TAG
ctggagaggatgtggagaaa

SEQ ID NO: 12871 - DNA, 20 bp, Artificial Sequence
  Description of Artificial Sequence: Synthetic oligonucleotide
  Target: SCN10A; (-) strand; PAM type: NRG; PAM sequence: GAG
caggtgctggagaggatgtg

SEQ ID NO: 12872 - DNA, 20 bp, Artificial Sequence
  Description of Artificial Sequence: Synthetic oligonucleotide
  Target: SCN10A; (-) strand; PAM type: NRG; PAM sequence: TGG
aacaggtgctggagaggatg

SEQ ID NO: 12873 - DNA, 20 bp, Artificial Sequence
  Description of Artificial Sequence: Synthetic oligonucleotide
  Target: SCN10A; (-) strand; PAM type: NRG; PAM sequence: AGG
ggaaacaacaggtgctggag

SEQ ID NO: 12874 - DNA, 20 bp, Artificial Sequence
  Description of Artificial Sequence: Synthetic oligonucleotide
  Target: SCN10A; (-) strand; PAM type: NRG; PAM sequence: GAG
aggaaacaacaggtgctgga

SEQ ID NO: 12875 - DNA, 20 bp, Artificial Sequence
  Description of Artificial Sequence: Synthetic oligonucleotide
  Target: SCN10A; (-) strand; PAM type: NRG; PAM sequence: GAG
tcaggaaacaacaggtgctg

SEQ ID NO: 12876 - DNA, 20 bp, Artificial Sequence
  Description of Artificial Sequence: Synthetic oligonucleotide
  Target: SCN10A; (-) strand; PAM type: NRG; PAM sequence: TGG
agtcaggaaacaacaggtgc

SEQ ID NO: 12877 - DNA, 20 bp, Artificial Sequence
  Description of Artificial Sequence: Synthetic oligonucleotide
  Target: SCN10A; (-) strand; PAM type: NRG; PAM sequence: AGG
ttaaaaagtcaggaaacaac

SEQ ID NO: 12878 - DNA, 20 bp, Artificial Sequence
  Description of Artificial Sequence: Synthetic oligonucleotide
  Target: SCN10A; (-) strand; PAM type: NRG; PAM sequence: CAG
attaaaaagtcaggaaacaa

SEQ ID NO: 12879 - DNA, 20 bp, Artificial Sequence
  Description of Artificial Sequence: Synthetic oligonucleotide
  Target: SCN10A; (-) strand; PAM type: NRG; PAM sequence: AGG
atggcgatcattaaaaagtc

SEQ ID NO: 12880 - DNA, 20 bp, Artificial Sequence
  Description of Artificial Sequence: Synthetic oligonucleotide
  Target: SCN10A; (-) strand; PAM type: NRG; PAM sequence: CAG
aatggcgatcattaaaaagt

SEQ ID NO: 12881 - DNA, 20 bp, Artificial Sequence
  Description of Artificial Sequence: Synthetic oligonucleotide
  Target: SCN10A; (-) strand; PAM type: NRG; PAM sequence: AAG
ttagaatggcgatcattaaa

SEQ ID NO: 12882 - DNA, 20 bp, Artificial Sequence
  Description of Artificial Sequence: Synthetic oligonucleotide
  Target: SCN10A; (-) strand; PAM type: NRG; PAM sequence: TGG
ccatctcacaccagttagaa

SEQ ID NO: 12883 - DNA, 20 bp, Artificial Sequence
  Description of Artificial Sequence: Synthetic oligonucleotide
  Target: SCN10A; (-) strand; PAM type: NRG; PAM sequence: TAG
agataccatctcacaccagt

SEQ ID NO: 12884 - DNA, 20 bp, Artificial Sequence
  Description of Artificial Sequence: Synthetic oligonucleotide
  Target: SCN10A; (-) strand; PAM type: NRG; PAM sequence: CAG
aatgagataccatctcacac

SEQ ID NO: 12885 - DNA, 20 bp, Artificial Sequence
  Description of Artificial Sequence: Synthetic oligonucleotide
  Target: SCN10A; (-) strand; PAM type: NRG; PAM sequence: GAG
atgcaaatcaaaaccacaat

SEQ ID NO: 12886 - DNA, 20 bp, Artificial Sequence
  Description of Artificial Sequence: Synthetic oligonucleotide
  Target: SCN10A; (-) strand; PAM type: NRG; PAM sequence: GAG
ctcatcatcactggccatca

SEQ ID NO: 12887 - DNA, 20 bp, Artificial Sequence
  Description of Artificial Sequence: Synthetic oligonucleotide
  Target: SCN10A; (-) strand; PAM type: NRG; PAM sequence: CAG
tgctcatcatcactggccat

SEQ ID NO: 12888 - DNA, 20 bp, Artificial Sequence
  Description of Artificial Sequence: Synthetic oligonucleotide
  Target: SCN10A; (-) strand; PAM type: NRG; PAM sequence: TGG
gaaaaaatgctcatcatcac

SEQ ID NO: 12889 - DNA, 20 bp, Artificial Sequence
  Description of Artificial Sequence: Synthetic oligonucleotide
  Target: SCN10A; (-) strand; PAM type: NRG; PAM sequence: CAG
ctcaaaagaagacatttatg

SEQ ID NO: 12890 - DNA, 20 bp, Artificial Sequence
  Description of Artificial Sequence: Synthetic oligonucleotide
  Target: SCN10A; (-) strand; PAM type: NRG; PAM sequence: AAG
gaacagacacttctcaaaag

SEQ ID NO: 12891 - DNA, 20 bp, Artificial Sequence
  Description of Artificial Sequence: Synthetic oligonucleotide
  Target: SCN10A; (-) strand; PAM type: NRG; PAM sequence: AAG
tatgaacagacacttctcaa

SEQ ID NO: 12892 - DNA, 20 bp, Artificial Sequence
  Description of Artificial Sequence: Synthetic oligonucleotide
  Target: SCN10A; (-) strand; PAM type: NRG; PAM sequence: CAG
aagtgggcgaaggatatgaa

SEQ ID NO: 12893 - DNA, 20 bp, Artificial Sequence
  Description of Artificial Sequence: Synthetic oligonucleotide
  Target: SCN10A; (-) strand; PAM type: NRG; PAM sequence: AGG
tcccatcaaaaagtgggcga

SEQ ID NO: 12894 - DNA, 20 bp, Artificial Sequence
  Description of Artificial Sequence: Synthetic oligonucleotide
  Target: SCN10A; (-) strand; PAM type: NRG; PAM sequence: AAG
atcccatcaaaaagtgggcg

SEQ ID NO: 12895 - DNA, 20 bp, Artificial Sequence
  Description of Artificial Sequence: Synthetic oligonucleotide
  Target: SCN10A; (-) strand; PAM type: NRG; PAM sequence: GGG
aaaaaatcccatcaaaaagt

SEQ ID NO: 12896 - DNA, 20 bp, Artificial Sequence
  Description of Artificial Sequence: Synthetic oligonucleotide
  Target: SCN10A; (-) strand; PAM type: NRG; PAM sequence: TGG
aaaaaaatcccatcaaaaag

SEQ ID NO: 12897 - DNA, 20 bp, Artificial Sequence
  Description of Artificial Sequence: Synthetic oligonucleotide
  Target: SCN10A; (-) strand; PAM type: NRG; PAM sequence: AAG
aggaaaaaaatcccatcaaa

SEQ ID NO: 12898 - DNA, 20 bp, Artificial Sequence
  Description of Artificial Sequence: Synthetic oligonucleotide
  Target: SCN10A; (-) strand; PAM type: NRG; PAM sequence: AGG
tgaactcaaacaaatttaca

SEQ ID NO: 12899 - DNA, 20 bp, Artificial Sequence
  Description of Artificial Sequence: Synthetic oligonucleotide
  Target: SCN10A; (-) strand; PAM type: NRG; PAM sequence: AAG
atgaactcaaacaaatttac

SEQ ID NO: 12900 - DNA, 20 bp, Artificial Sequence
  Description of Artificial Sequence: Synthetic oligonucleotide
  Target: SCN10A; (-) strand; PAM type: NRG; PAM sequence: CAG
tctgacgaagggctaatatc

SEQ ID NO: 12901 - DNA, 20 bp, Artificial Sequence
  Description of Artificial Sequence: Synthetic oligonucleotide
  Target: SCN10A; (-) strand; PAM type: NRG; PAM sequence: GGG
caacctactcatctgacgaa

SEQ ID NO: 12902 - DNA, 20 bp, Artificial Sequence
  Description of Artificial Sequence: Synthetic oligonucleotide
  Target: SCN10A; (-) strand; PAM type: NRG; PAM sequence: AGG
gcaacctactcatctgacga

SEQ ID NO: 12903 - DNA, 20 bp, Artificial Sequence
  Description of Artificial Sequence: Synthetic oligonucleotide
  Target: SCN10A; (-) strand; PAM type: NRG; PAM sequence: AAG
tgcaacctactcatctgacg

SEQ ID NO: 12904 - DNA, 20 bp, Artificial Sequence
  Description of Artificial Sequence: Synthetic oligonucleotide
  Target: SCN10A; (-) strand; PAM type: NRG; PAM sequence: GAG
aacagaaacctacaggatgg

SEQ ID NO: 12905 - DNA, 20 bp, Artificial Sequence
  Description of Artificial Sequence: Synthetic oligonucleotide
  Target: SCN10A; (-) strand; PAM type: NRG; PAM sequence: GGG
tgaacagaaacctacaggat

SEQ ID NO: 12906 - DNA, 20 bp, Artificial Sequence
  Description of Artificial Sequence: Synthetic oligonucleotide
  Target: SCN10A; (-) strand; PAM type: NRG; PAM sequence: TGG
gtgaacagaaacctacagga

SEQ ID NO: 12907 - DNA, 20 bp, Artificial Sequence
  Description of Artificial Sequence: Synthetic oligonucleotide
  Target: SCN10A; (-) strand; PAM type: NRG; PAM sequence: AGG
cagagtgaacagaaacctac

SEQ ID NO: 12908 - DNA, 20 bp, Artificial Sequence
  Description of Artificial Sequence: Synthetic oligonucleotide
  Target: SCN10A; (-) strand; PAM type: NRG; PAM sequence: CAG
tcagagtgaacagaaaccta

SEQ ID NO: 12909 - DNA, 20 bp, Artificial Sequence
  Description of Artificial Sequence: Synthetic oligonucleotide
  Target: SCN10A; (-) strand; PAM type: NRG; PAM sequence: CAG
gaaaccaccatcagagtgaa

SEQ ID NO: 12910 - DNA, 20 bp, Artificial Sequence
  Description of Artificial Sequence: Synthetic oligonucleotide
  Target: SCN10A; (-) strand; PAM type: NRG; PAM sequence: GAG
agcaaaagaaaccaccatca

SEQ ID NO: 12911 - DNA, 20 bp, Artificial Sequence
  Description of Artificial Sequence: Synthetic oligonucleotide
  Target: SCN10A; (-) strand; PAM type: NRG; PAM sequence: CAG
gcagcaaaagaaaccaccat

SEQ ID NO: 12912 - DNA, 20 bp, Artificial Sequence
  Description of Artificial Sequence: Synthetic oligonucleotide
  Target: SCN10A; (-) strand; PAM type: NRG; PAM sequence: AAG
aaagagcttctgagcagcaa

SEQ ID NO: 12913 - DNA, 20 bp, Artificial Sequence
  Description of Artificial Sequence: Synthetic oligonucleotide
  Target: SCN10A; (-) strand; PAM type: NRG; PAM sequence: CAG
taaactaaagagcttctgag

SEQ ID NO: 12914 - DNA, 20 bp, Artificial Sequence
  Description of Artificial Sequence: Synthetic oligonucleotide
  Target: SCN10A; (-) strand; PAM type: NRG; PAM sequence: GAG
cattaaactaaagagcttct

SEQ ID NO: 12915 - DNA, 20 bp, Artificial Sequence
  Description of Artificial Sequence: Synthetic oligonucleotide
  Target: SCN10A; (-) strand; PAM type: NRG; PAM sequence: GAG
tgggatctcattaaactaaa

SEQ ID NO: 12916 - DNA, 20 bp, Artificial Sequence
  Description of Artificial Sequence: Synthetic oligonucleotide
  Target: SCN10A; (-) strand; PAM type: NRG; PAM sequence: AAG
aatgggatctcattaaacta

SEQ ID NO: 12917 - DNA, 20 bp, Artificial Sequence
  Description of Artificial Sequence: Synthetic oligonucleotide
  Target: SCN10A; (-) strand; PAM type: NRG; PAM sequence: GGG
aaaagtcaaaattgacaaat

SEQ ID NO: 12918 - DNA, 20 bp, Artificial Sequence
  Description of Artificial Sequence: Synthetic oligonucleotide
  Target: SCN10A; (-) strand; PAM type: NRG; PAM sequence: TGG
caaaagtcaaaattgacaaa

SEQ ID NO: 12919 - DNA, 20 bp, Artificial Sequence
  Description of Artificial Sequence: Synthetic oligonucleotide
  Target: SCN10A; (-) strand; PAM type: NRG; PAM sequence: AAG
accaaaagcaatggcaacaa

SEQ ID NO: 12920 - DNA, 20 bp, Artificial Sequence
  Description of Artificial Sequence: Synthetic oligonucleotide
  Target: SCN10A; (-) strand; PAM type: NRG; PAM sequence: TGG
gtctaaaacaccaaaagcaa

SEQ ID NO: 12921 - DNA, 20 bp, Artificial Sequence
  Description of Artificial Sequence: Synthetic oligonucleotide
  Target: SCN10A; (-) strand; PAM type: NRG; PAM sequence: AAG
cttcatgtctaaaacaccaa

SEQ ID NO: 12922 - DNA, 20 bp, Artificial Sequence
  Description of Artificial Sequence: Synthetic oligonucleotide
  Target: SCN10A; (-) strand; PAM type: NRG; PAM sequence: AGG
tcaggacataggcatgggca

SEQ ID NO: 12923 - DNA, 20 bp, Artificial Sequence
  Description of Artificial Sequence: Synthetic oligonucleotide
  Target: SCN10A; (-) strand; PAM type: NRG; PAM sequence: AAG
ttcaggacataggcatgggc

SEQ ID NO: 12924 - DNA, 20 bp, Artificial Sequence
  Description of Artificial Sequence: Synthetic oligonucleotide
  Target: SCN10A; (-) strand; PAM type: NRG; PAM sequence: GGG
accattcaggacataggcat

SEQ ID NO: 12925 - DNA, 20 bp, Artificial Sequence
  Description of Artificial Sequence: Synthetic oligonucleotide
  Target: SCN10A; (-) strand; PAM type: NRG; PAM sequence: TGG
taccattcaggacataggca

SEQ ID NO: 12926 - DNA, 20 bp, Artificial Sequence
  Description of Artificial Sequence: Synthetic oligonucleotide
  Target: SCN10A; (-) strand; PAM type: NRG; PAM sequence: AGG
ggcaataccattcaggacat

SEQ ID NO: 12927 - DNA, 20 bp, Artificial Sequence
  Description of Artificial Sequence: Synthetic oligonucleotide
  Target: SCN10A; (-) strand; PAM type: NRG; PAM sequence: TAG
aggcaataccattcaggaca

SEQ ID NO: 12928 - DNA, 20 bp, Artificial Sequence
  Description of Artificial Sequence: Synthetic oligonucleotide
  Target: SCN10A; (-) strand; PAM type: NRG; PAM sequence: AGG
gaacctaggcaataccattc

SEQ ID NO: 12929 - DNA, 20 bp, Artificial Sequence
  Description of Artificial Sequence: Synthetic oligonucleotide
  Target: SCN10A; (-) strand; PAM type: NRG; PAM sequence: CAG
agaacctaggcaataccatt

SEQ ID NO: 12930 - DNA, 20 bp, Artificial Sequence
  Description of Artificial Sequence: Synthetic oligonucleotide
  Target: SCN10A; (-) strand; PAM type: NRG; PAM sequence: AGG
aaaaccctagaagagaacct

SEQ ID NO: 12931 - DNA, 20 bp, Artificial Sequence
  Description of Artificial Sequence: Synthetic oligonucleotide
  Target: SCN10A; (-) strand; PAM type: NRG; PAM sequence: TAG
aaaaaccctagaagagaacc

SEQ ID NO: 12932 - DNA, 20 bp, Artificial Sequence
  Description of Artificial Sequence: Synthetic oligonucleotide
  Target: SCN10A; (-) strand; PAM type: NRG; PAM sequence: GAG
aaaccataaaaaccctagaa

SEQ ID NO: 12933 - DNA, 20 bp, Artificial Sequence
  Description of Artificial Sequence: Synthetic oligonucleotide
  Target: SCN10A; (-) strand; PAM type: NRG; PAM sequence: AAG
taaaaccataaaaaccctag

SEQ ID NO: 12934 - DNA, 20 bp, Artificial Sequence
  Description of Artificial Sequence: Synthetic oligonucleotide
  Target: SCN10A; (-) strand; PAM type: NRG; PAM sequence: TAG
acctaaaaccataaaaaccc

SEQ ID NO: 12935 - DNA, 20 bp, Artificial Sequence
  Description of Artificial Sequence: Synthetic oligonucleotide
  Target: SCN10A; (-) strand; PAM type: NRG; PAM sequence: TAG
tggattaaagacttaaatgt

SEQ ID NO: 12936 - DNA, 20 bp, Artificial Sequence
  Description of Artificial Sequence: Synthetic oligonucleotide
  Target: SCN10A; (-) strand; PAM type: NRG; PAM sequence: AAG
aattaattcaagatggatta

SEQ ID NO: 12937 - DNA, 20 bp, Artificial Sequence
  Description of Artificial Sequence: Synthetic oligonucleotide
  Target: SCN10A; (-) strand; PAM type: NRG; PAM sequence: TGG
atacaaaaattaattcaaga

SEQ ID NO: 12938 - DNA, 20 bp, Artificial Sequence
  Description of Artificial Sequence: Synthetic oligonucleotide
  Target: SCN10A; (-) strand; PAM type: NRG; PAM sequence: AAG
ccttatacaaaaattaattc

SEQ ID NO: 12939 - DNA, 20 bp, Artificial Sequence
  Description of Artificial Sequence: Synthetic oligonucleotide
  Target: SCN10A; (-) strand; PAM type: NRG; PAM sequence: TGG
catatggagaaagctgaaac

SEQ ID NO: 12940 - DNA, 20 bp, Artificial Sequence
  Description of Artificial Sequence: Synthetic oligonucleotide
  Target: SCN10A; (-) strand; PAM type: NRG; PAM sequence: AAG
actggctagccatatggaga

SEQ ID NO: 12941 - DNA, 20 bp, Artificial Sequence
  Description of Artificial Sequence: Synthetic oligonucleotide
  Target: SCN10A; (-) strand; PAM type: NRG; PAM sequence: GAG
gaaaactggctagccatatg

SEQ ID NO: 12942 - DNA, 20 bp, Artificial Sequence
  Description of Artificial Sequence: Synthetic oligonucleotide
  Target: SCN10A; (-) strand; PAM type: NRG; PAM sequence: TGG
gggaaaactggctagccata

SEQ ID NO: 12943 - DNA, 20 bp, Artificial Sequence
  Description of Artificial Sequence: Synthetic oligonucleotide
  Target: SCN10A; (-) strand; PAM type: NRG; PAM sequence: TAG
atggtgctgggaaaactggc

SEQ ID NO: 12944 - DNA, 20 bp, Artificial Sequence
  Description of Artificial Sequence: Synthetic oligonucleotide
  Target: SCN10A; (-) strand; PAM type: NRG; PAM sequence: TGG
ataaatggtgctgggaaaac

SEQ ID NO: 12945 - DNA, 20 bp, Artificial Sequence
  Description of Artificial Sequence: Synthetic oligonucleotide
  Target: SCN10A; (-) strand; PAM type: NRG; PAM sequence: GGG
cctatttaataaatggtgct

SEQ ID NO: 12946 - DNA, 20 bp, Artificial Sequence
  Description of Artificial Sequence: Synthetic oligonucleotide
  Target: SCN10A; (-) strand; PAM type: NRG; PAM sequence: TGG
ccctatttaataaatggtgc

SEQ ID NO: 12947 - DNA, 20 bp, Artificial Sequence
  Description of Artificial Sequence: Synthetic oligonucleotide
  Target: SCN10A; (-) strand; PAM type: NRG; PAM sequence: TGG
aggattccctatttaataaa

SEQ ID NO: 12948 - DNA, 20 bp, Artificial Sequence
  Description of Artificial Sequence: Synthetic oligonucleotide
  Target: SCN10A; (-) strand; PAM type: NRG; PAM sequence: AGG
caaaaacaagaaatggggaa

SEQ ID NO: 12949 - DNA, 20 bp, Artificial Sequence
  Description of Artificial Sequence: Synthetic oligonucleotide
  Target: SCN10A; (-) strand; PAM type: NRG; PAM sequence: AAG
acaaaaacaagaaatgggga

SEQ ID NO: 12950 - DNA, 20 bp, Artificial Sequence
  Description of Artificial Sequence: Synthetic oligonucleotide
  Target: SCN10A; (-) strand; PAM type: NRG; PAM sequence: GGG
cctgacaaaaacaagaaatg

SEQ ID NO: 12951 - DNA, 20 bp, Artificial Sequence
  Description of Artificial Sequence: Synthetic oligonucleotide
  Target: SCN10A; (-) strand; PAM type: NRG; PAM sequence: GGG
acctgacaaaaacaagaaat

SEQ ID NO: 12952 - DNA, 20 bp, Artificial Sequence
  Description of Artificial Sequence: Synthetic oligonucleotide
  Target: SCN10A; (-) strand; PAM type: NRG; PAM sequence: TGG
aacctgacaaaaacaagaaa

SEQ ID NO: 12953 - DNA, 20 bp, Artificial Sequence
  Description of Artificial Sequence: Synthetic oligonucleotide
  Target: SCN10A; (-) strand; PAM type: NRG; PAM sequence: AAG
ttgacaaacctgacaaaaac

SEQ ID NO: 12954 - DNA, 20 bp, Artificial Sequence
  Description of Artificial Sequence: Synthetic oligonucleotide
  Target: SCN10A; (-) strand; PAM type: NRG; PAM sequence: CAG
atggaacagaacagagccct

SEQ ID NO: 12955 - DNA, 20 bp, Artificial Sequence
  Description of Artificial Sequence: Synthetic oligonucleotide
  Target: SCN10A; (-) strand; PAM type: NRG; PAM sequence: GAG
tagaccaatggaacagaaca

SEQ ID NO: 12956 - DNA, 20 bp, Artificial Sequence
  Description of Artificial Sequence: Synthetic oligonucleotide
  Target: SCN10A; (-) strand; PAM type: NRG; PAM sequence: CAG
tatagaccaatggaacagaa

SEQ ID NO: 12957 - DNA, 20 bp, Artificial Sequence
  Description of Artificial Sequence: Synthetic oligonucleotide
  Target: SCN10A; (-) strand; PAM type: NRG; PAM sequence: CAG
agagatatagaccaatggaa

SEQ ID NO: 12958 - DNA, 20 bp, Artificial Sequence
  Description of Artificial Sequence: Synthetic oligonucleotide
  Target: SCN10A; (-) strand; PAM type: NRG; PAM sequence: TGG
aaaacagagatatagaccaa

SEQ ID NO: 12959 - DNA, 20 bp, Artificial Sequence
  Description of Artificial Sequence: Synthetic oligonucleotide
  Target: SCN10A; (-) strand; PAM type: NRG; PAM sequence: TAG
ctggtaccaaaacagagata

SEQ ID NO: 12960 - DNA, 20 bp, Artificial Sequence
  Description of Artificial Sequence: Synthetic oligonucleotide
  Target: SCN10A; (-) strand; PAM type: NRG; PAM sequence: GAG
atggtactggtaccaaaaca

SEQ ID NO: 12961 - DNA, 20 bp, Artificial Sequence
  Description of Artificial Sequence: Synthetic oligonucleotide
  Target: SCN10A; (-) strand; PAM type: NRG; PAM sequence: CAG
gcatggtactggtaccaaaa

SEQ ID NO: 12962 - DNA, 20 bp, Artificial Sequence
  Description of Artificial Sequence: Synthetic oligonucleotide
  Target: SCN10A; (-) strand; PAM type: NRG; PAM sequence: TGG
taaccaaaacagcatggtac

SEQ ID NO: 12963 - DNA, 20 bp, Artificial Sequence
  Description of Artificial Sequence: Synthetic oligonucleotide
  Target: SCN10A; (-) strand; PAM type: NRG; PAM sequence: TGG
ctacagtaaccaaaacagca

SEQ ID NO: 12964 - DNA, 20 bp, Artificial Sequence
  Description of Artificial Sequence: Synthetic oligonucleotide
  Target: SCN10A; (-) strand; PAM type: NRG; PAM sequence: CAG
caaggctacagtaaccaaaa

SEQ ID NO: 12965 - DNA, 20 bp, Artificial Sequence
  Description of Artificial Sequence: Synthetic oligonucleotide
  Target: SCN10A; (-) strand; PAM type: NRG; PAM sequence: CAG
caaactatattacaaggcta

SEQ ID NO: 12966 - DNA, 20 bp, Artificial Sequence
  Description of Artificial Sequence: Synthetic oligonucleotide
  Target: SCN10A; (-) strand; PAM type: NRG; PAM sequence: AGG
tgacttcaaactatattaca

SEQ ID NO: 12967 - DNA, 20 bp, Artificial Sequence
  Description of Artificial Sequence: Synthetic oligonucleotide
  Target: SCN10A; (-) strand; PAM type: NRG; PAM sequence: AAG
ctgacttcaaactatattac

SEQ ID NO: 12968 - DNA, 20 bp, Artificial Sequence
  Description of Artificial Sequence: Synthetic oligonucleotide
  Target: SCN10A; (-) strand; PAM type: NRG; PAM sequence: AGG
ttggtgtataacaaagctgg

SEQ ID NO: 12969 - DNA, 20 bp, Artificial Sequence
  Description of Artificial Sequence: Synthetic oligonucleotide
  Target: SCN10A; (-) strand; PAM type: NRG; PAM sequence: GAG
attggtgtataacaaagctg

SEQ ID NO: 12970 - DNA, 20 bp, Artificial Sequence
  Description of Artificial Sequence: Synthetic oligonucleotide
  Target: SCN10A; (-) strand; PAM type: NRG; PAM sequence: TGG
ttattggtgtataacaaagc

SEQ ID NO: 12971 - DNA, 20 bp, Artificial Sequence
  Description of Artificial Sequence: Synthetic oligonucleotide
  Target: SCN10A; (-) strand; PAM type: NRG; PAM sequence: AAG
tctgttattggtgtataaca

SEQ ID NO: 12972 - DNA, 20 bp, Artificial Sequence
  Description of Artificial Sequence: Synthetic oligonucleotide
  Target: SCN10A; (-) strand; PAM type: NRG; PAM sequence: TGG
gctctctgtttgtctgttat

SEQ ID NO: 12973 - DNA, 20 bp, Artificial Sequence
  Description of Artificial Sequence: Synthetic oligonucleotide
  Target: SCN10A; (-) strand; PAM type: NRG; PAM sequence: TGG
atgggagttcactcatgatt

SEQ ID NO: 12974 - DNA, 20 bp, Artificial Sequence
  Description of Artificial Sequence: Synthetic oligonucleotide
  Target: SCN10A; (-) strand; PAM type: NRG; PAM sequence: GAG
tttgaagcaattgtgaatgg

SEQ ID NO: 12975 - DNA, 20 bp, Artificial Sequence
  Description of Artificial Sequence: Synthetic oligonucleotide
  Target: SCN10A; (-) strand; PAM type: NRG; PAM sequence: GGG
tctttgaagcaattgtgaat

SEQ ID NO: 12976 - DNA, 20 bp, Artificial Sequence
  Description of Artificial Sequence: Synthetic oligonucleotide
  Target: SCN10A; (-) strand; PAM type: NRG; PAM sequence: TGG
ctctttgaagcaattgtgaa

SEQ ID NO: 12977 - DNA, 20 bp, Artificial Sequence
  Description of Artificial Sequence: Synthetic oligonucleotide
  Target: SCN10A; (-) strand; PAM type: NRG; PAM sequence: AAG
taggtattttattctctttg

SEQ ID NO: 12978 - DNA, 20 bp, Artificial Sequence
  Description of Artificial Sequence: Synthetic oligonucleotide
  Target: SCN10A; (-) strand; PAM type: NRG; PAM sequence: AGG
cccttgtaagttgcattcct

SEQ ID NO: 12979 - DNA, 20 bp, Artificial Sequence
  Description of Artificial Sequence: Synthetic oligonucleotide
  Target: SCN10A; (-) strand; PAM type: NRG; PAM sequence: TAG
tcccttgtaagttgcattcc

SEQ ID NO: 12980 - DNA, 20 bp, Artificial Sequence
  Description of Artificial Sequence: Synthetic oligonucleotide
  Target: SCN10A; (-) strand; PAM type: NRG; PAM sequence: AAG
aggtccttcacatcccttgt

SEQ ID NO: 12981 - DNA, 20 bp, Artificial Sequence
  Description of Artificial Sequence: Synthetic oligonucleotide
  Target: SCN10A; (-) strand; PAM type: NRG; PAM sequence: AGG
gtttgtagttctccttgaag

SEQ ID NO: 12982 - DNA, 20 bp, Artificial Sequence
  Description of Artificial Sequence: Synthetic oligonucleotide
  Target: SCN10A; (-) strand; PAM type: NRG; PAM sequence: GAG
ggtttgtagttctccttgaa

SEQ ID NO: 12983 - DNA, 20 bp, Artificial Sequence
  Description of Artificial Sequence: Synthetic oligonucleotide
  Target: SCN10A; (-) strand; PAM type: NRG; PAM sequence: AAG
gtggtttgtagttctccttg

SEQ ID NO: 12984 - DNA, 20 bp, Artificial Sequence
  Description of Artificial Sequence: Synthetic oligonucleotide
  Target: SCN10A; (-) strand; PAM type: NRG; PAM sequence: TAG
tttcactgagcagtggtttg

SEQ ID NO: 12985 - DNA, 20 bp, Artificial Sequence
  Description of Artificial Sequence: Synthetic oligonucleotide
  Target: SCN10A; (-) strand; PAM type: NRG; PAM sequence: TGG
tcttttatttcactgagcag

SEQ ID NO: 12986 - DNA, 20 bp, Artificial Sequence
  Description of Artificial Sequence: Synthetic oligonucleotide
  Target: SCN10A; (-) strand; PAM type: NRG; PAM sequence: CAG
tcctcttttatttcactgag

SEQ ID NO: 12987 - DNA, 20 bp, Artificial Sequence
  Description of Artificial Sequence: Synthetic oligonucleotide
  Target: SCN10A; (-) strand; PAM type: NRG; PAM sequence: GAG
gtatcctcttttatttcact

SEQ ID NO: 12988 - DNA, 20 bp, Artificial Sequence
  Description of Artificial Sequence: Synthetic oligonucleotide
  Target: SCN10A; (-) strand; PAM type: NRG; PAM sequence: GAG
tcttcctacccatgagcatg

SEQ ID NO: 12989 - DNA, 20 bp, Artificial Sequence
  Description of Artificial Sequence: Synthetic oligonucleotide
  Target: SCN10A; (-) strand; PAM type: NRG; PAM sequence: TGG
attcttcctacccatgagca

SEQ ID NO: 12990 - DNA, 20 bp, Artificial Sequence
  Description of Artificial Sequence: Synthetic oligonucleotide
  Target: SCN10A; (-) strand; PAM type: NRG; PAM sequence: GAG
tattgattcttcctacccat

SEQ ID NO: 12991 - DNA, 20 bp, Artificial Sequence
  Description of Artificial Sequence: Synthetic oligonucleotide
  Target: SCN10A; (-) strand; PAM type: NRG; PAM sequence: AAG
tgggcagtatggccattttc

SEQ ID NO: 12992 - DNA, 20 bp, Artificial Sequence
  Description of Artificial Sequence: Synthetic oligonucleotide
  Target: SCN10A; (-) strand; PAM type: NRG; PAM sequence: TGG
ataaattaccttgggcagta

SEQ ID NO: 12993 - DNA, 20 bp, Artificial Sequence
  Description of Artificial Sequence: Synthetic oligonucleotide
  Target: SCN10A; (-) strand; PAM type: NRG; PAM sequence: CAG
aatctataaattaccttggg

SEQ ID NO: 12994 - DNA, 20 bp, Artificial Sequence
  Description of Artificial Sequence: Synthetic oligonucleotide
  Target: SCN10A; (-) strand; PAM type: NRG; PAM sequence: GGG
ttgaatctataaattacctt

SEQ ID NO: 12995 - DNA, 20 bp, Artificial Sequence
  Description of Artificial Sequence: Synthetic oligonucleotide
  Target: SCN10A; (-) strand; PAM type: NRG; PAM sequence: TGG
attgaatctataaattacct

SEQ ID NO: 12996 - DNA, 20 bp, Artificial Sequence
  Description of Artificial Sequence: Synthetic oligonucleotide
  Target: SCN10A; (-) strand; PAM type: NRG; PAM sequence: TGG
cattggtagcttgatgggga

SEQ ID NO: 12997 - DNA, 20 bp, Artificial Sequence
  Description of Artificial Sequence: Synthetic oligonucleotide
  Target: SCN10A; (-) strand; PAM type: NRG; PAM sequence: GGG
aagtcattggtagcttgatg

SEQ ID NO: 12998 - DNA, 20 bp, Artificial Sequence
  Description of Artificial Sequence: Synthetic oligonucleotide
  Target: SCN10A; (-) strand; PAM type: NRG; PAM sequence: GGG
aaagtcattggtagcttgat

SEQ ID NO: 12999 - DNA, 20 bp, Artificial Sequence
  Description of Artificial Sequence: Synthetic oligonucleotide
  Target: SCN10A; (-) strand; PAM type: NRG; PAM sequence: TGG
gaaagtcattggtagcttga

SEQ ID NO: 13000 - DNA, 20 bp, Artificial Sequence
  Description of Artificial Sequence: Synthetic oligonucleotide
  Target: SCN10A; (-) strand; PAM type: NRG; PAM sequence: TAG
tctgagaagaaagtcattgg

SEQ ID NO: 13001 - DNA, 20 bp, Artificial Sequence
  Description of Artificial Sequence: Synthetic oligonucleotide
  Target: SCN10A; (-) strand; PAM type: NRG; PAM sequence: TGG
aattctgagaagaaagtcat

SEQ ID NO: 13002 - DNA, 20 bp, Artificial Sequence
  Description of Artificial Sequence: Synthetic oligonucleotide
  Target: SCN10A; (-) strand; PAM type: NRG; PAM sequence: AAG
tttttccaattctgagaaga

SEQ ID NO: 13003 - DNA, 20 bp, Artificial Sequence
  Description of Artificial Sequence: Synthetic oligonucleotide
  Target: SCN10A; (-) strand; PAM type: NRG; PAM sequence: AAG
tagttttttccaattctgag

SEQ ID NO: 13004 - DNA, 20 bp, Artificial Sequence
  Description of Artificial Sequence: Synthetic oligonucleotide
  Target: SCN10A; (-) strand; PAM type: NRG; PAM sequence: GAG
aagtagttttttccaattct

SEQ ID NO: 13005 - DNA, 20 bp, Artificial Sequence
  Description of Artificial Sequence: Synthetic oligonucleotide
  Target: SCN10A; (-) strand; PAM type: NRG; PAM sequence: TAG
gttccgtatgaactttaaag

SEQ ID NO: 13006 - DNA, 20 bp, Artificial Sequence
  Description of Artificial Sequence: Synthetic oligonucleotide
  Target: SCN10A; (-) strand; PAM type: NRG; PAM sequence: AAG
ttggttccgtatgaacttta

SEQ ID NO: 13007 - DNA, 20 bp, Artificial Sequence
  Description of Artificial Sequence: Synthetic oligonucleotide
  Target: SCN10A; (-) strand; PAM type: NRG; PAM sequence: TGG
tggcaatgtgggctcttttt

SEQ ID NO: 13008 - DNA, 20 bp, Artificial Sequence
  Description of Artificial Sequence: Synthetic oligonucleotide
  Target: SCN10A; (-) strand; PAM type: NRG; PAM sequence: GGG
taggattgacttggcaatgt

SEQ ID NO: 13009 - DNA, 20 bp, Artificial Sequence
  Description of Artificial Sequence: Synthetic oligonucleotide
  Target: SCN10A; (-) strand; PAM type: NRG; PAM sequence: TGG
ttaggattgacttggcaatg

SEQ ID NO: 13010 - DNA, 20 bp, Artificial Sequence
  Description of Artificial Sequence: Synthetic oligonucleotide
  Target: SCN10A; (-) strand; PAM type: NRG; PAM sequence: TGG
aaacaggattaggattgact

SEQ ID NO: 13011 - DNA, 20 bp, Artificial Sequence
  Description of Artificial Sequence: Synthetic oligonucleotide
  Target: SCN10A; (-) strand; PAM type: NRG; PAM sequence: AGG
gttaaaaaaaaaacaggatt

SEQ ID NO: 13012 - DNA, 20 bp, Artificial Sequence
  Description of Artificial Sequence: Synthetic oligonucleotide
  Target: SCN10A; (-) strand; PAM type: NRG; PAM sequence: TAG
ggttaaaaaaaaaacaggat

SEQ ID NO: 13013 - DNA, 20 bp, Artificial Sequence
  Description of Artificial Sequence: Synthetic oligonucleotide
  Target: SCN10A; (-) strand; PAM type: NRG; PAM sequence: AGG
agtaaggttaaaaaaaaaac

SEQ ID NO: 13014 - DNA, 20 bp, Artificial Sequence
  Description of Artificial Sequence: Synthetic oligonucleotide
  Target: SCN10A; (-) strand; PAM type: NRG; PAM sequence: CAG
aagtaaggttaaaaaaaaaa

SEQ ID NO: 13015 - DNA, 20 bp, Artificial Sequence
  Description of Artificial Sequence: Synthetic oligonucleotide
  Target: SCN10A; (-) strand; PAM type: NRG; PAM sequence: AGG
attagccaatcaaaaaagta

SEQ ID NO: 13016 - DNA, 20 bp, Artificial Sequence
  Description of Artificial Sequence: Synthetic oligonucleotide
  Target: SCN10A; (-) strand; PAM type: NRG; PAM sequence: AAG
aattagccaatcaaaaaagt

SEQ ID NO: 13017 - DNA, 20 bp, Artificial Sequence
  Description of Artificial Sequence: Synthetic oligonucleotide
  Target: SCN10A; (-) strand; PAM type: NRG; PAM sequence: AAG
aaacaattagccaatcaaaa

SEQ ID NO: 13018 - DNA, 20 bp, Artificial Sequence
  Description of Artificial Sequence: Synthetic oligonucleotide
  Target: SCN10A; (-) strand; PAM type: NRG; PAM sequence: TAG
gaactatgctaagaaacaat

SEQ ID NO: 13019 - DNA, 20 bp, Artificial Sequence
  Description of Artificial Sequence: Synthetic oligonucleotide
  Target: SCN10A; (-) strand; PAM type: NRG; PAM sequence: AAG
ggacaagggggaactatgct

SEQ ID NO: 13020 - DNA, 20 bp, Artificial Sequence
  Description of Artificial Sequence: Synthetic oligonucleotide
  Target: SCN10A; (-) strand; PAM type: NRG; PAM sequence: GGG
atttccaaagtaggacaagg

SEQ ID NO: 13021 - DNA, 20 bp, Artificial Sequence
  Description of Artificial Sequence: Synthetic oligonucleotide
  Target: SCN10A; (-) strand; PAM type: NRG; PAM sequence: GGG
catttccaaagtaggacaag

SEQ ID NO: 13022 - DNA, 20 bp, Artificial Sequence
  Description of Artificial Sequence: Synthetic oligonucleotide
  Target: SCN10A; (-) strand; PAM type: NRG; PAM sequence: GGG
tcatttccaaagtaggacaa

SEQ ID NO: 13023 - DNA, 20 bp, Artificial Sequence
  Description of Artificial Sequence: Synthetic oligonucleotide
  Target: SCN10A; (-) strand; PAM type: NRG; PAM sequence: AGG
atcatttccaaagtaggaca

SEQ ID NO: 13024 - DNA, 20 bp, Artificial Sequence
  Description of Artificial Sequence: Synthetic oligonucleotide
  Target: SCN10A; (-) strand; PAM type: NRG; PAM sequence: AAG
tatcatttccaaagtaggac

SEQ ID NO: 13025 - DNA, 20 bp, Artificial Sequence
  Description of Artificial Sequence: Synthetic oligonucleotide
  Target: SCN10A; (-) strand; PAM type: NRG; PAM sequence: AGG
gagtatatcatttccaaagt

SEQ ID NO: 13026 - DNA, 20 bp, Artificial Sequence
  Description of Artificial Sequence: Synthetic oligonucleotide
  Target: SCN10A; (-) strand; PAM type: NRG; PAM sequence: TAG
agagtatatcatttccaaag

SEQ ID NO: 13027 - DNA, 20 bp, Artificial Sequence
  Description of Artificial Sequence: Synthetic oligonucleotide
  Target: SCN10A; (-) strand; PAM type: NRG; PAM sequence: AAG
aatagagtatatcatttcca

SEQ ID NO: 13028 - DNA, 20 bp, Artificial Sequence
  Description of Artificial Sequence: Synthetic oligonucleotide
  Target: SCN10A; (-) strand; PAM type: NRG; PAM sequence: GAG
ccagtaacaaatcagaaata

SEQ ID NO: 13029 - DNA, 20 bp, Artificial Sequence
  Description of Artificial Sequence: Synthetic oligonucleotide
  Target: SCN10A; (-) strand; PAM type: NRG; PAM sequence: TAG
tgccagtaacaaatcagaaa

SEQ ID NO: 13030 - DNA, 20 bp, Artificial Sequence
  Description of Artificial Sequence: Synthetic oligonucleotide
  Target: SCN10A; (-) strand; PAM type: NRG; PAM sequence: CAG
tagggttgccagtaacaaat

SEQ ID NO: 13031 - DNA, 20 bp, Artificial Sequence
  Description of Artificial Sequence: Synthetic oligonucleotide
  Target: SCN10A; (-) strand; PAM type: NRG; PAM sequence: CAG
gacttaattattagggttgc

SEQ ID NO: 13032 - DNA, 20 bp, Artificial Sequence
  Description of Artificial Sequence: Synthetic oligonucleotide
  Target: SCN10A; (-) strand; PAM type: NRG; PAM sequence: GGG
aatgaatgacttaattatta

SEQ ID NO: 13033 - DNA, 20 bp, Artificial Sequence
  Description of Artificial Sequence: Synthetic oligonucleotide
  Target: SCN10A; (-) strand; PAM type: NRG; PAM sequence: AGG
gaatgaatgacttaattatt

SEQ ID NO: 13034 - DNA, 20 bp, Artificial Sequence
  Description of Artificial Sequence: Synthetic oligonucleotide
  Target: SCN10A; (-) strand; PAM type: NRG; PAM sequence: TAG
agaatgaatgacttaattat

SEQ ID NO: 13035 - DNA, 20 bp, Artificial Sequence
  Description of Artificial Sequence: Synthetic oligonucleotide
  Target: SCN10A; (-) strand; PAM type: NRG; PAM sequence: AAG
atcattagactgtgtaactt

SEQ ID NO: 13036 - DNA, 20 bp, Artificial Sequence
  Description of Artificial Sequence: Synthetic oligonucleotide
  Target: SCN10A; (-) strand; PAM type: NRG; PAM sequence: TAG
gtaaaggtttttattatcat

SEQ ID NO: 13037 - DNA, 20 bp, Artificial Sequence
  Description of Artificial Sequence: Synthetic oligonucleotide
  Target: SCN10A; (-) strand; PAM type: NRG; PAM sequence: AGG
taaaaagtaaaaaaaagtaa

SEQ ID NO: 13038 - DNA, 20 bp, Artificial Sequence
  Description of Artificial Sequence: Synthetic oligonucleotide
  Target: SCN10A; (-) strand; PAM type: NRG; PAM sequence: AAG
ctaaaaagtaaaaaaaagta

SEQ ID NO: 13039 - DNA, 20 bp, Artificial Sequence
  Description of Artificial Sequence: Synthetic oligonucleotide
  Target: SCN10A; (-) strand; PAM type: NRG; PAM sequence: AAG
taatgctaaaaagtaaaaaa

SEQ ID NO: 13040 - DNA, 20 bp, Artificial Sequence
  Description of Artificial Sequence: Synthetic oligonucleotide
  Target: SCN10A; (-) strand; PAM type: NRG; PAM sequence: AAG
gtatttctcctaatgctaaa

SEQ ID NO: 13041 - DNA, 20 bp, Artificial Sequence
  Description of Artificial Sequence: Synthetic oligonucleotide
  Target: SCN10A; (-) strand; PAM type: NRG; PAM sequence: AGG
atcaacccgtcatctacatt

SEQ ID NO: 13042 - DNA, 20 bp, Artificial Sequence
  Description of Artificial Sequence: Synthetic oligonucleotide
  Target: SCN10A; (-) strand; PAM type: NRG; PAM sequence: TAG
catcaacccgtcatctacat

SEQ ID NO: 13043 - DNA, 20 bp, Artificial Sequence
  Description of Artificial Sequence: Synthetic oligonucleotide
  Target: SCN10A; (-) strand; PAM type: NRG; PAM sequence: TGG
taggtatacatgtgccatgt

SEQ ID NO: 13044 - DNA, 20 bp, Artificial Sequence
  Description of Artificial Sequence: Synthetic oligonucleotide
  Target: SCN10A; (-) strand; PAM type: NRG; PAM sequence: AGG
aatgtacatgtttgttatat

SEQ ID NO: 13045 - DNA, 20 bp, Artificial Sequence
  Description of Artificial Sequence: Synthetic oligonucleotide
  Target: SCN10A; (-) strand; PAM type: NRG; PAM sequence: TAG
caatgtacatgtttgttata

SEQ ID NO: 13046 - DNA, 20 bp, Artificial Sequence
  Description of Artificial Sequence: Synthetic oligonucleotide
  Target: SCN10A; (-) strand; PAM type: NRG; PAM sequence: GGG
aaattatactttaaattcta

SEQ ID NO: 13047 - DNA, 20 bp, Artificial Sequence
  Description of Artificial Sequence: Synthetic oligonucleotide
  Target: SCN10A; (-) strand; PAM type: NRG; PAM sequence: AGG
aaaattatactttaaattct

SEQ ID NO: 13048 - DNA, 20 bp, Artificial Sequence
  Description of Artificial Sequence: Synthetic oligonucleotide
  Target: SCN10A; (-) strand; PAM type: NRG; PAM sequence: TAG
taaaattatactttaaattc

SEQ ID NO: 13049 - DNA, 20 bp, Artificial Sequence
  Description of Artificial Sequence: Synthetic oligonucleotide
  Target: SCN10A; (-) strand; PAM type: NRG; PAM sequence: AAG
aggtttacaaataaattaaa

SEQ ID NO: 13050 - DNA, 20 bp, Artificial Sequence
  Description of Artificial Sequence: Synthetic oligonucleotide
  Target: SCN10A; (-) strand; PAM type: NRG; PAM sequence: AGG
tggagctgaacacaggctga

SEQ ID NO: 13051 - DNA, 20 bp, Artificial Sequence
  Description of Artificial Sequence: Synthetic oligonucleotide
  Target: SCN10A; (-) strand; PAM type: NRG; PAM sequence: AAG
ctggagctgaacacaggctg

SEQ ID NO: 13052 - DNA, 20 bp, Artificial Sequence
  Description of Artificial Sequence: Synthetic oligonucleotide
  Target: SCN10A; (-) strand; PAM type: NRG; PAM sequence: AGG
ttcagtctggagctgaacac

SEQ ID NO: 13053 - DNA, 20 bp, Artificial Sequence
  Description of Artificial Sequence: Synthetic oligonucleotide
  Target: SCN10A; (-) strand; PAM type: NRG; PAM sequence: CAG
cttcagtctggagctgaaca

SEQ ID NO: 13054 - DNA, 20 bp, Artificial Sequence
  Description of Artificial Sequence: Synthetic oligonucleotide
  Target: SCN10A; (-) strand; PAM type: NRG; PAM sequence: GAG
taagacagatcttcagtctg

SEQ ID NO: 13055 - DNA, 20 bp, Artificial Sequence
  Description of Artificial Sequence: Synthetic oligonucleotide
  Target: SCN10A; (-) strand; PAM type: NRG; PAM sequence: TGG
gataagacagatcttcagtc

SEQ ID NO: 13056 - DNA, 20 bp, Artificial Sequence
  Description of Artificial Sequence: Synthetic oligonucleotide
  Target: SCN10A; (-) strand; PAM type: NRG; PAM sequence: CAG
tgcaagataagacagatctt

SEQ ID NO: 13057 - DNA, 20 bp, Artificial Sequence
  Description of Artificial Sequence: Synthetic oligonucleotide
  Target: SCN10A; (-) strand; PAM type: NRG; PAM sequence: CAG
gttagggatgcaagataaga

SEQ ID NO: 13058 - DNA, 20 bp, Artificial Sequence
  Description of Artificial Sequence: Synthetic oligonucleotide
  Target: SCN10A; (-) strand; PAM type: NRG; PAM sequence: AAG
aagtgttagggatgcaagat

SEQ ID NO: 13059 - DNA, 20 bp, Artificial Sequence
  Description of Artificial Sequence: Synthetic oligonucleotide
  Target: SCN10A; (-) strand; PAM type: NRG; PAM sequence: AAG
ttcctaagtgttagggatgc

SEQ ID NO: 13060 - DNA, 20 bp, Artificial Sequence
  Description of Artificial Sequence: Synthetic oligonucleotide
  Target: SCN10A; (-) strand; PAM type: NRG; PAM sequence: GGG
agtcactttcctaagtgtta

SEQ ID NO: 13061 - DNA, 20 bp, Artificial Sequence
  Description of Artificial Sequence: Synthetic oligonucleotide
  Target: SCN10A; (-) strand; PAM type: NRG; PAM sequence: AGG
aagtcactttcctaagtgtt

SEQ ID NO: 13062 - DNA, 20 bp, Artificial Sequence
  Description of Artificial Sequence: Synthetic oligonucleotide
  Target: SCN10A; (-) strand; PAM type: NRG; PAM sequence: TAG
gaagtcactttcctaagtgt

SEQ ID NO: 13063 - DNA, 20 bp, Artificial Sequence
  Description of Artificial Sequence: Synthetic oligonucleotide
  Target: SCN10A; (-) strand; PAM type: NRG; PAM sequence: AAG
aaaagtgaagtcactttcct

SEQ ID NO: 13064 - DNA, 20 bp, Artificial Sequence
  Description of Artificial Sequence: Synthetic oligonucleotide
  Target: SCN10A; (-) strand; PAM type: NRG; PAM sequence: AAG
atttgcttaagacaaaagtg

SEQ ID NO: 13065 - DNA, 20 bp, Artificial Sequence
  Description of Artificial Sequence: Synthetic oligonucleotide
  Target: SCN10A; (-) strand; PAM type: NRG; PAM sequence: AAG
ggagcatttgcttaagacaa

SEQ ID NO: 13066 - DNA, 20 bp, Artificial Sequence
  Description of Artificial Sequence: Synthetic oligonucleotide
  Target: SCN10A; (-) strand; PAM type: NRG; PAM sequence: AAG
gtgtgctggagcatttgctt

SEQ ID NO: 13067 - DNA, 20 bp, Artificial Sequence
  Description of Artificial Sequence: Synthetic oligonucleotide
  Target: SCN10A; (-) strand; PAM type: NRG; PAM sequence: GAG
ggcagagccctggtgtgctg

SEQ ID NO: 13068 - DNA, 20 bp, Artificial Sequence
  Description of Artificial Sequence: Synthetic oligonucleotide
  Target: SCN10A; (-) strand; PAM type: NRG; PAM sequence: TGG
tcggcagagccctggtgtgc

SEQ ID NO: 13069 - DNA, 20 bp, Artificial Sequence
  Description of Artificial Sequence: Synthetic oligonucleotide
  Target: SCN10A; (-) strand; PAM type: NRG; PAM sequence: TGG
agtaggtatcggcagagccc

SEQ ID NO: 13070 - DNA, 20 bp, Artificial Sequence
  Description of Artificial Sequence: Synthetic oligonucleotide
  Target: SCN10A; (-) strand; PAM type: NRG; PAM sequence: GAG
cagaatagtaggtatcggca

SEQ ID NO: 13071 - DNA, 20 bp, Artificial Sequence
  Description of Artificial Sequence: Synthetic oligonucleotide
  Target: SCN10A; (-) strand; PAM type: NRG; PAM sequence: CAG
cacagaatagtaggtatcgg

SEQ ID NO: 13072 - DNA, 20 bp, Artificial Sequence
  Description of Artificial Sequence: Synthetic oligonucleotide
  Target: SCN10A; (-) strand; PAM type: NRG; PAM sequence: CGG
taacacagaatagtaggtat

SEQ ID NO: 13073 - DNA, 20 bp, Artificial Sequence
  Description of Artificial Sequence: Synthetic oligonucleotide
  Target: SCN10A; (-) strand; PAM type: NRG; PAM sequence: AGG
tccacttaacacagaatagt

SEQ ID NO: 13074 - DNA, 20 bp, Artificial Sequence
  Description of Artificial Sequence: Synthetic oligonucleotide
  Target: SCN10A; (-) strand; PAM type: NRG; PAM sequence: TAG
atccacttaacacagaatag

SEQ ID NO: 13075 - DNA, 20 bp, Artificial Sequence
  Description of Artificial Sequence: Synthetic oligonucleotide
  Target: SCN10A; (-) strand; PAM type: NRG; PAM sequence: TAG
aacatccacttaacacagaa

SEQ ID NO: 13076 - DNA, 20 bp, Artificial Sequence
  Description of Artificial Sequence: Synthetic oligonucleotide
  Target: SCN10A; (-) strand; PAM type: NRG; PAM sequence: CAG
ttcagaacatccacttaaca

SEQ ID NO: 13077 - DNA, 20 bp, Artificial Sequence
  Description of Artificial Sequence: Synthetic oligonucleotide
  Target: SCN10A; (-) strand; PAM type: NRG; PAM sequence: CAG
cacagatggcaaataacatt

SEQ ID NO: 13078 - DNA, 20 bp, Artificial Sequence
  Description of Artificial Sequence: Synthetic oligonucleotide
  Target: SCN10A; (-) strand; PAM type: NRG; PAM sequence: TGG
gcataacacatagacacaga

SEQ ID NO: 13079 - DNA, 20 bp, Artificial Sequence
  Description of Artificial Sequence: Synthetic oligonucleotide
  Target: SCN10A; (-) strand; PAM type: NRG; PAM sequence: CAG
aactgcataacacatagaca

SEQ ID NO: 13080 - DNA, 20 bp, Artificial Sequence
  Description of Artificial Sequence: Synthetic oligonucleotide
  Target: SCN10A; (-) strand; PAM type: NRG; PAM sequence: TAG
ccattaaactgcataacaca

SEQ ID NO: 13081 - DNA, 20 bp, Artificial Sequence
  Description of Artificial Sequence: Synthetic oligonucleotide
  Target: SCN10A; (-) strand; PAM type: NRG; PAM sequence: AAG
tggaacctgcaagttctcaa

SEQ ID NO: 13082 - DNA, 20 bp, Artificial Sequence
  Description of Artificial Sequence: Synthetic oligonucleotide
  Target: SCN10A; (-) strand; PAM type: NRG; PAM sequence: AAG
tacaaatatctggaacctgc

SEQ ID NO: 13083 - DNA, 20 bp, Artificial Sequence
  Description of Artificial Sequence: Synthetic oligonucleotide
  Target: SCN10A; (-) strand; PAM type: NRG; PAM sequence: TGG
atgctgactgtacaaatatc

SEQ ID NO: 13084 - DNA, 20 bp, Artificial Sequence
  Description of Artificial Sequence: Synthetic oligonucleotide
  Target: SCN10A; (-) strand; PAM type: NRG; PAM sequence: AGG
actgaagggagataagagac

SEQ ID NO: 13085 - DNA, 20 bp, Artificial Sequence
  Description of Artificial Sequence: Synthetic oligonucleotide
  Target: SCN10A; (-) strand; PAM type: NRG; PAM sequence: CAG
cactgaagggagataagaga

SEQ ID NO: 13086 - DNA, 20 bp, Artificial Sequence
  Description of Artificial Sequence: Synthetic oligonucleotide
  Target: SCN10A; (-) strand; PAM type: NRG; PAM sequence: GAG
ttagcactgaagggagataa

SEQ ID NO: 13087 - DNA, 20 bp, Artificial Sequence
  Description of Artificial Sequence: Synthetic oligonucleotide
  Target: SCN10A; (-) strand; PAM type: NRG; PAM sequence: AAG
ccttagcactgaagggagat

SEQ ID NO: 13088 - DNA, 20 bp, Artificial Sequence
  Description of Artificial Sequence: Synthetic oligonucleotide
  Target: SCN10A; (-) strand; PAM type: NRG; PAM sequence: GAG
ggataccttagcactgaagg

SEQ ID NO: 13089 - DNA, 20 bp, Artificial Sequence
  Description of Artificial Sequence: Synthetic oligonucleotide
  Target: SCN10A; (-) strand; PAM type: NRG; PAM sequence: GGG
gaggataccttagcactgaa

SEQ ID NO: 13090 - DNA, 20 bp, Artificial Sequence
  Description of Artificial Sequence: Synthetic oligonucleotide
  Target: SCN10A; (-) strand; PAM type: NRG; PAM sequence: AGG
tgaggataccttagcactga

SEQ ID NO: 13091 - DNA, 20 bp, Artificial Sequence
  Description of Artificial Sequence: Synthetic oligonucleotide
  Target: SCN10A; (-) strand; PAM type: NRG; PAM sequence: AAG
gtgaggataccttagcactg

SEQ ID NO: 13092 - DNA, 20 bp, Artificial Sequence
  Description of Artificial Sequence: Synthetic oligonucleotide
  Target: SCN10A; (-) strand; PAM type: NRG; PAM sequence: TAG
cccagaatgtgaggatacct

SEQ ID NO: 13093 - DNA, 20 bp, Artificial Sequence
  Description of Artificial Sequence: Synthetic oligonucleotide
  Target: SCN10A; (-) strand; PAM type: NRG; PAM sequence: AGG
tctctctggcccagaatgtg

SEQ ID NO: 13094 - DNA, 20 bp, Artificial Sequence
  Description of Artificial Sequence: Synthetic oligonucleotide
  Target: SCN10A; (-) strand; PAM type: NRG; PAM sequence: GAG
atctctctggcccagaatgt

SEQ ID NO: 13095 - DNA, 20 bp, Artificial Sequence
  Description of Artificial Sequence: Synthetic oligonucleotide
  Target: SCN10A; (-) strand; PAM type: NRG; PAM sequence: CAG
aaactagaatctctctggcc

SEQ ID NO: 13096 - DNA, 20 bp, Artificial Sequence
  Description of Artificial Sequence: Synthetic oligonucleotide
  Target: SCN10A; (-) strand; PAM type: NRG; PAM sequence: TGG
aggtaaaactagaatctctc

SEQ ID NO: 13097 - DNA, 20 bp, Artificial Sequence
  Description of Artificial Sequence: Synthetic oligonucleotide
  Target: SCN10A; (-) strand; PAM type: NRG; PAM sequence: TAG
ccacccacaagaggtaaaac

SEQ ID NO: 13098 - DNA, 20 bp, Artificial Sequence
  Description of Artificial Sequence: Synthetic oligonucleotide
  Target: SCN10A; (-) strand; PAM type: NRG; PAM sequence: AGG
ttctcaaccccacccacaag

SEQ ID NO: 13099 - DNA, 20 bp, Artificial Sequence
  Description of Artificial Sequence: Synthetic oligonucleotide
  Target: SCN10A; (-) strand; PAM type: NRG; PAM sequence: GAG
cttctcaaccccacccacaa

SEQ ID NO: 13100 - DNA, 20 bp, Artificial Sequence
  Description of Artificial Sequence: Synthetic oligonucleotide
  Target: SCN10A; (-) strand; PAM type: NRG; PAM sequence: AAG
accttctcaaccccacccac

SEQ ID NO: 13101 - DNA, 20 bp, Artificial Sequence
  Description of Artificial Sequence: Synthetic oligonucleotide
  Target: SCN10A; (-) strand; PAM type: NRG; PAM sequence: GAG
gggagccaacctgagaacca

SEQ ID NO: 13102 - DNA, 20 bp, Artificial Sequence
  Description of Artificial Sequence: Synthetic oligonucleotide
  Target: SCN10A; (-) strand; PAM type: NRG; PAM sequence: CAG
atgggagccaacctgagaac

SEQ ID NO: 13103 - DNA, 20 bp, Artificial Sequence
  Description of Artificial Sequence: Synthetic oligonucleotide
  Target: SCN10A; (-) strand; PAM type: NRG; PAM sequence: GAG
atttccatgggagccaacct

SEQ ID NO: 13104 - DNA, 20 bp, Artificial Sequence
  Description of Artificial Sequence: Synthetic oligonucleotide
  Target: SCN10A; (-) strand; PAM type: NRG; PAM sequence: GAG
tagaaactagatttccatgg

SEQ ID NO: 13105 - DNA, 20 bp, Artificial Sequence
  Description of Artificial Sequence: Synthetic oligonucleotide
  Target: SCN10A; (-) strand; PAM type: NRG; PAM sequence: GGG
ggtagaaactagatttccat

SEQ ID NO: 13106 - DNA, 20 bp, Artificial Sequence
  Description of Artificial Sequence: Synthetic oligonucleotide
  Target: SCN10A; (-) strand; PAM type: NRG; PAM sequence: TGG
aggtagaaactagatttcca

SEQ ID NO: 13107 - DNA, 20 bp, Artificial Sequence
  Description of Artificial Sequence: Synthetic oligonucleotide
  Target: SCN10A; (-) strand; PAM type: NRG; PAM sequence: TAG
tacaattacaaggtagaaac

SEQ ID NO: 13108 - DNA, 20 bp, Artificial Sequence
  Description of Artificial Sequence: Synthetic oligonucleotide
  Target: SCN10A; (-) strand; PAM type: NRG; PAM sequence: TAG
ctggtggtacaattacaagg

SEQ ID NO: 13109 - DNA, 20 bp, Artificial Sequence
  Description of Artificial Sequence: Synthetic oligonucleotide
  Target: SCN10A; (-) strand; PAM type: NRG; PAM sequence: AGG
cacctggtggtacaattaca

SEQ ID NO: 13110 - DNA, 20 bp, Artificial Sequence
  Description of Artificial Sequence: Synthetic oligonucleotide
  Target: SCN10A; (-) strand; PAM type: NRG; PAM sequence: AAG
tcacctggtggtacaattac

SEQ ID NO: 13111 - DNA, 20 bp, Artificial Sequence
  Description of Artificial Sequence: Synthetic oligonucleotide
  Target: SCN10A; (-) strand; PAM type: NRG; PAM sequence: TGG
cagtttccaagttcacctgg

SEQ ID NO: 13112 - DNA, 20 bp, Artificial Sequence
  Description of Artificial Sequence: Synthetic oligonucleotide
  Target: SCN10A; (-) strand; PAM type: NRG; PAM sequence: TGG
agccagtttccaagttcacc

SEQ ID NO: 13113 - DNA, 20 bp, Artificial Sequence
  Description of Artificial Sequence: Synthetic oligonucleotide
  Target: SCN10A; (-) strand; PAM type: NRG; PAM sequence: AAG
tttcactagagccagtttcc

SEQ ID NO: 13114 - DNA, 20 bp, Artificial Sequence
  Description of Artificial Sequence: Synthetic oligonucleotide
  Target: SCN10A; (-) strand; PAM type: NRG; PAM sequence: CAG
tttgaaaatttcactagagc

SEQ ID NO: 13115 - DNA, 20 bp, Artificial Sequence
  Description of Artificial Sequence: Synthetic oligonucleotide
  Target: SCN10A; (-) strand; PAM type: NRG; PAM sequence: GAG
atcttttgaaaatttcacta

SEQ ID NO: 13116 - DNA, 20 bp, Artificial Sequence
  Description of Artificial Sequence: Synthetic oligonucleotide
  Target: SCN10A; (-) strand; PAM type: NRG; PAM sequence: TAG
ttatcttttgaaaatttcac

SEQ ID NO: 13117 - DNA, 20 bp, Artificial Sequence
  Description of Artificial Sequence: Synthetic oligonucleotide
  Target: SCN10A; (-) strand; PAM type: NRG; PAM sequence: AAG
ttggaaatgtatccaaatgc

SEQ ID NO: 13118 - DNA, 20 bp, Artificial Sequence
  Description of Artificial Sequence: Synthetic oligonucleotide
  Target: SCN10A; (-) strand; PAM type: NRG; PAM sequence: TGG
cttgcatgacacggagtttt

SEQ ID NO: 13119 - DNA, 20 bp, Artificial Sequence
  Description of Artificial Sequence: Synthetic oligonucleotide
  Target: SCN10A; (-) strand; PAM type: NRG; PAM sequence: GAG
tacacatcttgcatgacacg

SEQ ID NO: 13120 - DNA, 20 bp, Artificial Sequence
  Description of Artificial Sequence: Synthetic oligonucleotide
  Target: SCN10A; (-) strand; PAM type: NRG; PAM sequence: CGG
tatacacatcttgcatgaca

SEQ ID NO: 13121 - DNA, 20 bp, Artificial Sequence
  Description of Artificial Sequence: Synthetic oligonucleotide
  Target: SCN10A; (-) strand; PAM type: NRG; PAM sequence: GGG
taatgggaaacattggaaaa

SEQ ID NO: 13122 - DNA, 20 bp, Artificial Sequence
  Description of Artificial Sequence: Synthetic oligonucleotide
  Target: SCN10A; (-) strand; PAM type: NRG; PAM sequence: AGG
gtaatgggaaacattggaaa

SEQ ID NO: 13123 - DNA, 20 bp, Artificial Sequence
  Description of Artificial Sequence: Synthetic oligonucleotide
  Target: SCN10A; (-) strand; PAM type: NRG; PAM sequence: AAG
tgtaatgggaaacattggaa

SEQ ID NO: 13124 - DNA, 20 bp, Artificial Sequence
  Description of Artificial Sequence: Synthetic oligonucleotide
  Target: SCN10A; (-) strand; PAM type: NRG; PAM sequence: TGG
taaattgtaatgggaaacat

SEQ ID NO: 13125 - DNA, 20 bp, Artificial Sequence
  Description of Artificial Sequence: Synthetic oligonucleotide
  Target: SCN10A; (-) strand; PAM type: NRG; PAM sequence: GGG
tgcatttcctaaattgtaat

SEQ ID NO: 13126 - DNA, 20 bp, Artificial Sequence
  Description of Artificial Sequence: Synthetic oligonucleotide
  Target: SCN10A; (-) strand; PAM type: NRG; PAM sequence: TGG
atgcatttcctaaattgtaa

SEQ ID NO: 13127 - DNA, 20 bp, Artificial Sequence
  Description of Artificial Sequence: Synthetic oligonucleotide
  Target: SCN10A; (-) strand; PAM type: NRG; PAM sequence: GGG
taatttgttacagcatccca

SEQ ID NO: 13128 - DNA, 20 bp, Artificial Sequence
  Description of Artificial Sequence: Synthetic oligonucleotide
  Target: SCN10A; (-) strand; PAM type: NRG; PAM sequence: AGG
gtaatttgttacagcatccc

SEQ ID NO: 13129 - DNA, 20 bp, Artificial Sequence
  Description of Artificial Sequence: Synthetic oligonucleotide
  Target: SCN10A; (-) strand; PAM type: NRG; PAM sequence: CAG
ggtaatttgttacagcatcc

SEQ ID NO: 13130 - DNA, 20 bp, Artificial Sequence
  Description of Artificial Sequence: Synthetic oligonucleotide
  Target: SCN10A; (-) strand; PAM type: NRG; PAM sequence: CAG
tagtttctggtaatttgtta

SEQ ID NO: 13131 - DNA, 20 bp, Artificial Sequence
  Description of Artificial Sequence: Synthetic oligonucleotide
  Target: SCN10A; (-) strand; PAM type: NRG; PAM sequence: TGG
attgtcatctacctagtttc

SEQ ID NO: 13132 - DNA, 20 bp, Artificial Sequence
  Description of Artificial Sequence: Synthetic oligonucleotide
  Target: SCN10A; (-) strand; PAM type: NRG; PAM sequence: TAG
ttctattattgtcatctacc

SEQ ID NO: 13133 - DNA, 20 bp, Artificial Sequence
  Description of Artificial Sequence: Synthetic oligonucleotide
  Target: SCN10A; (-) strand; PAM type: NRG; PAM sequence: GAG
atctagcctcagaagtgtaa

SEQ ID NO: 13134 - DNA, 20 bp, Artificial Sequence
  Description of Artificial Sequence: Synthetic oligonucleotide
  Target: SCN10A; (-) strand; PAM type: NRG; PAM sequence: AAG
acatctagcctcagaagtgt

SEQ ID NO: 13135 - DNA, 20 bp, Artificial Sequence
  Description of Artificial Sequence: Synthetic oligonucleotide
  Target: SCN10A; (-) strand; PAM type: NRG; PAM sequence: AAG
ttttagacatctagcctcag

SEQ ID NO: 13136 - DNA, 20 bp, Artificial Sequence
  Description of Artificial Sequence: Synthetic oligonucleotide
  Target: SCN10A; (-) strand; PAM type: NRG; PAM sequence: CAG
tgattttagacatctagcct

SEQ ID NO: 13137 - DNA, 20 bp, Artificial Sequence
  Description of Artificial Sequence: Synthetic oligonucleotide
  Target: SCN10A; (-) strand; PAM type: NRG; PAM sequence: TAG
ataccttgattttagacatc

SEQ ID NO: 13138 - DNA, 20 bp, Artificial Sequence
  Description of Artificial Sequence: Synthetic oligonucleotide
  Target: SCN10A; (-) strand; PAM type: NRG; PAM sequence: TAG
ctctgccaataccttgattt

SEQ ID NO: 13139 - DNA, 20 bp, Artificial Sequence
  Description of Artificial Sequence: Synthetic oligonucleotide
  Target: SCN10A; (-) strand; PAM type: NRG; PAM sequence: TGG
tgcgggcttcagagggaaca

SEQ ID NO: 13140 - DNA, 20 bp, Artificial Sequence
  Description of Artificial Sequence: Synthetic oligonucleotide
  Target: SCN10A; (-) strand; PAM type: NRG; PAM sequence: GGG
tctcacctgcgggcttcaga

SEQ ID NO: 13141 - DNA, 20 bp, Artificial Sequence
  Description of Artificial Sequence: Synthetic oligonucleotide
  Target: SCN10A; (-) strand; PAM type: NRG; PAM sequence: AGG
ttctcacctgcgggcttcag

SEQ ID NO: 13142 - DNA, 20 bp, Artificial Sequence
  Description of Artificial Sequence: Synthetic oligonucleotide
  Target: SCN10A; (-) strand; PAM type: NRG; PAM sequence: GAG
gttctcacctgcgggcttca

SEQ ID NO: 13143 - DNA, 20 bp, Artificial Sequence
  Description of Artificial Sequence: Synthetic oligonucleotide
  Target: SCN10A; (-) strand; PAM type: NRG; PAM sequence: CAG
cggttctcacctgcgggctt

SEQ ID NO: 13144 - DNA, 20 bp, Artificial Sequence
  Description of Artificial Sequence: Synthetic oligonucleotide
  Target: SCN10A; (-) strand; PAM type: NRG; PAM sequence: GGG
aggcaacggttctcacctgc

SEQ ID NO: 13145 - DNA, 20 bp, Artificial Sequence
  Description of Artificial Sequence: Synthetic oligonucleotide
  Target: SCN10A; (-) strand; PAM type: NRG; PAM sequence: CGG
aaggcaacggttctcacctg

SEQ ID NO: 13146 - DNA, 20 bp, Artificial Sequence
  Description of Artificial Sequence: Synthetic oligonucleotide
  Target: SCN10A; (-) strand; PAM type: NRG; PAM sequence: CGG
ggaggagacatggaaggcaa

SEQ ID NO: 13147 - DNA, 20 bp, Artificial Sequence
  Description of Artificial Sequence: Synthetic oligonucleotide
  Target: SCN10A; (-) strand; PAM type: NRG; PAM sequence: AGG
aagctaggaggagacatgga

SEQ ID NO: 13148 - DNA, 20 bp, Artificial Sequence
  Description of Artificial Sequence: Synthetic oligonucleotide
  Target: SCN10A; (-) strand; PAM type: NRG; PAM sequence: AAG
gaagctaggaggagacatgg

SEQ ID NO: 13149 - DNA, 20 bp, Artificial Sequence
  Description of Artificial Sequence: Synthetic oligonucleotide
  Target: SCN10A; (-) strand; PAM type: NRG; PAM sequence: TGG
gctgaagctaggaggagaca

SEQ ID NO: 13150 - DNA, 20 bp, Artificial Sequence
  Description of Artificial Sequence: Synthetic oligonucleotide
  Target: SCN10A; (-) strand; PAM type: NRG; PAM sequence: GAG
aagattgctgaagctaggag

SEQ ID NO: 13151 - DNA, 20 bp, Artificial Sequence
  Description of Artificial Sequence: Synthetic oligonucleotide
  Target: SCN10A; (-) strand; PAM type: NRG; PAM sequence: AGG
caaagattgctgaagctagg

SEQ ID NO: 13152 - DNA, 20 bp, Artificial Sequence
  Description of Artificial Sequence: Synthetic oligonucleotide
  Target: SCN10A; (-) strand; PAM type: NRG; PAM sequence: GAG
gcaaagattgctgaagctag

SEQ ID NO: 13153 - DNA, 20 bp, Artificial Sequence
  Description of Artificial Sequence: Synthetic oligonucleotide
  Target: SCN10A; (-) strand; PAM type: NRG; PAM sequence: AGG
tggcaaagattgctgaagct

SEQ ID NO: 13154 - DNA, 20 bp, Artificial Sequence
  Description of Artificial Sequence: Synthetic oligonucleotide
  Target: SCN10A; (-) strand; PAM type: NRG; PAM sequence: TAG
atggcaaagattgctgaagc

SEQ ID NO: 13155 - DNA, 20 bp, Artificial Sequence
  Description of Artificial Sequence: Synthetic oligonucleotide
  Target: SCN10A; (-) strand; PAM type: NRG; PAM sequence: AAG
aggaatggcaaagattgctg

SEQ ID NO: 13156 - DNA, 20 bp, Artificial Sequence
  Description of Artificial Sequence: Synthetic oligonucleotide
  Target: SCN10A; (-) strand; PAM type: NRG; PAM sequence: AAG
gtgcaggccaaggaatggca

SEQ ID NO: 13157 - DNA, 20 bp, Artificial Sequence
  Description of Artificial Sequence: Synthetic oligonucleotide
  Target: SCN10A; (-) strand; PAM type: NRG; PAM sequence: TGG
tacatgtgcaggccaaggaa

SEQ ID NO: 13158 - DNA, 20 bp, Artificial Sequence
  Description of Artificial Sequence: Synthetic oligonucleotide
  Target: SCN10A; (-) strand; PAM type: NRG; PAM sequence: AGG
agagatacatgtgcaggcca

SEQ ID NO: 13159 - DNA, 20 bp, Artificial Sequence
  Description of Artificial Sequence: Synthetic oligonucleotide
  Target: SCN10A; (-) strand; PAM type: NRG; PAM sequence: AAG
gagagatacatgtgcaggcc

SEQ ID NO: 13160 - DNA, 20 bp, Artificial Sequence
  Description of Artificial Sequence: Synthetic oligonucleotide
  Target: SCN10A; (-) strand; PAM type: NRG; PAM sequence: AGG
aatcggagagatacatgtgc

SEQ ID NO: 13161 - DNA, 20 bp, Artificial Sequence
  Description of Artificial Sequence: Synthetic oligonucleotide
  Target: SCN10A; (-) strand; PAM type: NRG; PAM sequence: CAG
aaatcggagagatacatgtg

SEQ ID NO: 13162 - DNA, 20 bp, Artificial Sequence
  Description of Artificial Sequence: Synthetic oligonucleotide
  Target: SCN10A; (-) strand; PAM type: NRG; PAM sequence: GAG
agacacaggaagaaatcgga

SEQ ID NO: 13163 - DNA, 20 bp, Artificial Sequence
  Description of Artificial Sequence: Synthetic oligonucleotide
  Target: SCN10A; (-) strand; PAM type: NRG; PAM sequence: GAG
ggagacacaggaagaaatcg

SEQ ID NO: 13164 - DNA, 20 bp, Artificial Sequence
  Description of Artificial Sequence: Synthetic oligonucleotide
  Target: SCN10A; (-) strand; PAM type: NRG; PAM sequence: CGG
atggagacacaggaagaaat

SEQ ID NO: 13165 - DNA, 20 bp, Artificial Sequence
  Description of Artificial Sequence: Synthetic oligonucleotide
  Target: SCN10A; (-) strand; PAM type: NRG; PAM sequence: AAG
cagctgtatggagacacagg

SEQ ID NO: 13166 - DNA, 20 bp, Artificial Sequence
  Description of Artificial Sequence: Synthetic oligonucleotide
  Target: SCN10A; (-) strand; PAM type: NRG; PAM sequence: AGG
agacagctgtatggagacac

SEQ ID NO: 13167 - DNA, 20 bp, Artificial Sequence
  Description of Artificial Sequence: Synthetic oligonucleotide
  Target: SCN10A; (-) strand; PAM type: NRG; PAM sequence: CAG
aagacagctgtatggagaca

SEQ ID NO: 13168 - DNA, 20 bp, Artificial Sequence
  Description of Artificial Sequence: Synthetic oligonucleotide
  Target: SCN10A; (-) strand; PAM type: NRG; PAM sequence: GAG
aaagaaaagacagctgtatg

SEQ ID NO: 13169 - DNA, 20 bp, Artificial Sequence
  Description of Artificial Sequence: Synthetic oligonucleotide
  Target: SCN10A; (-) strand; PAM type: NRG; PAM sequence: TGG
acaaagaaaagacagctgta

SEQ ID NO: 13170 - DNA, 20 bp, Artificial Sequence
  Description of Artificial Sequence: Synthetic oligonucleotide
  Target: SCN10A; (-) strand; PAM type: NRG; PAM sequence: CAG
aaacacacacaaagaaaaga

SEQ ID NO: 13171 - DNA, 20 bp, Artificial Sequence
  Description of Artificial Sequence: Synthetic oligonucleotide
  Target: SCN10A; (-) strand; PAM type: NRG; PAM sequence: AAG
aaaaaaacacacacaaagaa

SEQ ID NO: 13172 - DNA, 20 bp, Artificial Sequence
  Description of Artificial Sequence: Synthetic oligonucleotide
  Target: SCN10A; (-) strand; PAM type: NRG; PAM sequence: AAG
tgcagaaaaaaacacacaca

SEQ ID NO: 13173 - DNA, 20 bp, Artificial Sequence
  Description of Artificial Sequence: Synthetic oligonucleotide
  Target: SCN10A; (-) strand; PAM type: NRG; PAM sequence: CAG
gagaataccatgggaagatg

SEQ ID NO: 13174 - DNA, 20 bp, Artificial Sequence
  Description of Artificial Sequence: Synthetic oligonucleotide
  Target: SCN10A; (-) strand; PAM type: NRG; PAM sequence: AAG
agagaggagaataccatggg

SEQ ID NO: 13175 - DNA, 20 bp, Artificial Sequence
  Description of Artificial Sequence: Synthetic oligonucleotide
  Target: SCN10A; (-) strand; PAM type: NRG; PAM sequence: GGG
cacagagaggagaataccat

SEQ ID NO: 13176 - DNA, 20 bp, Artificial Sequence
  Description of Artificial Sequence: Synthetic oligonucleotide
  Target: SCN10A; (-) strand; PAM type: NRG; PAM sequence: TGG
acacagagaggagaatacca

SEQ ID NO: 13177 - DNA, 20 bp, Artificial Sequence
  Description of Artificial Sequence: Synthetic oligonucleotide
  Target: SCN10A; (-) strand; PAM type: NRG; PAM sequence: GAG
gaacagagacacacagagag

SEQ ID NO: 13178 - DNA, 20 bp, Artificial Sequence
  Description of Artificial Sequence: Synthetic oligonucleotide
  Target: SCN10A; (-) strand; PAM type: NRG; PAM sequence: AGG
ttgaacagagacacacagag

SEQ ID NO: 13179 - DNA, 20 bp, Artificial Sequence
  Description of Artificial Sequence: Synthetic oligonucleotide
  Target: SCN10A; (-) strand; PAM type: NRG; PAM sequence: GAG
tttgaacagagacacacaga

SEQ ID NO: 13180 - DNA, 20 bp, Artificial Sequence
  Description of Artificial Sequence: Synthetic oligonucleotide
  Target: SCN10A; (-) strand; PAM type: NRG; PAM sequence: GAG
aatttgaacagagacacaca

SEQ ID NO: 13181 - DNA, 20 bp, Artificial Sequence
  Description of Artificial Sequence: Synthetic oligonucleotide
  Target: SCN10A; (-) strand; PAM type: NRG; PAM sequence: CAG
ggaatttgaacagagacaca

SEQ ID NO: 13182 - DNA, 20 bp, Artificial Sequence
  Description of Artificial Sequence: Synthetic oligonucleotide
  Target: SCN10A; (-) strand; PAM type: NRG; PAM sequence: GAG
atatgaggggaatttgaaca

SEQ ID NO: 13183 - DNA, 20 bp, Artificial Sequence
  Description of Artificial Sequence: Synthetic oligonucleotide
  Target: SCN10A; (-) strand; PAM type: NRG; PAM sequence: CAG
aaatatgaggggaatttgaa

SEQ ID NO: 13184 - DNA, 20 bp, Artificial Sequence
  Description of Artificial Sequence: Synthetic oligonucleotide
  Target: SCN10A; (-) strand; PAM type: NRG; PAM sequence: GGG
tggtgttgctaaaatatgag

SEQ ID NO: 13185 - DNA, 20 bp, Artificial Sequence
  Description of Artificial Sequence: Synthetic oligonucleotide
  Target: SCN10A; (-) strand; PAM type: NRG; PAM sequence: GGG
ctggtgttgctaaaatatga

SEQ ID NO: 13186 - DNA, 20 bp, Artificial Sequence
  Description of Artificial Sequence: Synthetic oligonucleotide
  Target: SCN10A; (-) strand; PAM type: NRG; PAM sequence: AGG
actggtgttgctaaaatatg

SEQ ID NO: 13187 - DNA, 20 bp, Artificial Sequence
  Description of Artificial Sequence: Synthetic oligonucleotide
  Target: SCN10A; (-) strand; PAM type: NRG; PAM sequence: GAG
gactggtgttgctaaaatat

SEQ ID NO: 13188 - DNA, 20 bp, Artificial Sequence
  Description of Artificial Sequence: Synthetic oligonucleotide
  Target: SCN10A; (-) strand; PAM type: NRG; PAM sequence: TGG
gtgagccctaatccaatgac

SEQ ID NO: 13189 - DNA, 20 bp, Artificial Sequence
  Description of Artificial Sequence: Synthetic oligonucleotide
  Target: SCN10A; (-) strand; PAM type: NRG; PAM sequence: GAG
aaacaaattcagatgaaggt

SEQ ID NO: 13190 - DNA, 20 bp, Artificial Sequence
  Description of Artificial Sequence: Synthetic oligonucleotide
  Target: SCN10A; (-) strand; PAM type: NRG; PAM sequence: AGG
atgtaaacaaattcagatga

SEQ ID NO: 13191 - DNA, 20 bp, Artificial Sequence
  Description of Artificial Sequence: Synthetic oligonucleotide
  Target: SCN10A; (-) strand; PAM type: NRG; PAM sequence: AAG
gatgtaaacaaattcagatg

SEQ ID NO: 13192 - DNA, 20 bp, Artificial Sequence
  Description of Artificial Sequence: Synthetic oligonucleotide
  Target: SCN10A; (-) strand; PAM type: NRG; PAM sequence: CAG
tttgcagatgtaaacaaatt

SEQ ID NO: 13193 - DNA, 20 bp, Artificial Sequence
  Description of Artificial Sequence: Synthetic oligonucleotide
  Target: SCN10A; (-) strand; PAM type: NRG; PAM sequence: CAG
atttgacattaaggtttttg

SEQ ID NO: 13194 - DNA, 20 bp, Artificial Sequence
  Description of Artificial Sequence: Synthetic oligonucleotide
  Target: SCN10A; (-) strand; PAM type: NRG; PAM sequence: AGG
tgtgaccttatttgacatta

SEQ ID NO: 13195 - DNA, 20 bp, Artificial Sequence
  Description of Artificial Sequence: Synthetic oligonucleotide
  Target: SCN10A; (-) strand; PAM type: NRG; PAM sequence: AAG
ttgtgaccttatttgacatt

SEQ ID NO: 13196 - DNA, 20 bp, Artificial Sequence
  Description of Artificial Sequence: Synthetic oligonucleotide
  Target: SCN10A; (-) strand; PAM type: NRG; PAM sequence: TAG
tatgttgaagttctaaccaa

SEQ ID NO: 13197 - DNA, 20 bp, Artificial Sequence
  Description of Artificial Sequence: Synthetic oligonucleotide
  Target: SCN10A; (-) strand; PAM type: NRG; PAM sequence: AAG
ttccctaaaagggtatgttg

SEQ ID NO: 13198 - DNA, 20 bp, Artificial Sequence
  Description of Artificial Sequence: Synthetic oligonucleotide
  Target: SCN10A; (-) strand; PAM type: NRG; PAM sequence: GGG
ttgaataatgttccctaaaa

SEQ ID NO: 13199 - DNA, 20 bp, Artificial Sequence
  Description of Artificial Sequence: Synthetic oligonucleotide
  Target: SCN10A; (-) strand; PAM type: NRG; PAM sequence: AGG
gttgaataatgttccctaaa

SEQ ID NO: 13200 - DNA, 20 bp, Artificial Sequence
  Description of Artificial Sequence: Synthetic oligonucleotide
  Target: SCN10A; (-) strand; PAM type: NRG; PAM sequence: AAG
ggttgaataatgttccctaa

SEQ ID NO: 13201 - DNA, 20 bp, Artificial Sequence
  Description of Artificial Sequence: Synthetic oligonucleotide
  Target: SCN10A; (-) strand; PAM type: NRG; PAM sequence: GGG
tttatgttgaattatgcttt

SEQ ID NO: 13202 - DNA, 20 bp, Artificial Sequence
  Description of Artificial Sequence: Synthetic oligonucleotide
  Target: SCN10A; (-) strand; PAM type: NRG; PAM sequence: TGG
ctttatgttgaattatgctt

SEQ ID NO: 13203 - DNA, 20 bp, Artificial Sequence
  Description of Artificial Sequence: Synthetic oligonucleotide
  Target: SCN10A; (-) strand; PAM type: NRG; PAM sequence: AGG
gaattatgctccctaaacat

SEQ ID NO: 13204 - DNA, 20 bp, Artificial Sequence
  Description of Artificial Sequence: Synthetic oligonucleotide
  Target: SCN10A; (-) strand; PAM type: NRG; PAM sequence: TAG
tgaattatgctccctaaaca

SEQ ID NO: 13205 - DNA, 20 bp, Artificial Sequence
  Description of Artificial Sequence: Synthetic oligonucleotide
  Target: SCN10A; (-) strand; PAM type: NRG; PAM sequence: GAG
ctcaaaagtatttttacttt

SEQ ID NO: 13206 - DNA, 20 bp, Artificial Sequence
  Description of Artificial Sequence: Synthetic oligonucleotide
  Target: SCN10A; (-) strand; PAM type: NRG; PAM sequence: AAG
gcagatgatactattctcaa

SEQ ID NO: 13207 - DNA, 20 bp, Artificial Sequence
  Description of Artificial Sequence: Synthetic oligonucleotide
  Target: SCN10A; (-) strand; PAM type: NRG; PAM sequence: CAG
tcagactggttctattaaag

SEQ ID NO: 13208 - DNA, 20 bp, Artificial Sequence
  Description of Artificial Sequence: Synthetic oligonucleotide
  Target: SCN10A; (-) strand; PAM type: NRG; PAM sequence: AAG
ccatcagactggttctatta

SEQ ID NO: 13209 - DNA, 20 bp, Artificial Sequence
  Description of Artificial Sequence: Synthetic oligonucleotide
  Target: SCN10A; (-) strand; PAM type: NRG; PAM sequence: TGG
agtgtgccaaaccatcagac

SEQ ID NO: 13210 - DNA, 20 bp, Artificial Sequence
  Description of Artificial Sequence: Synthetic oligonucleotide
  Target: SCN10A; (-) strand; PAM type: NRG; PAM sequence: CAG
aattaagtgtgccaaaccat

SEQ ID NO: 13211 - DNA, 20 bp, Artificial Sequence
  Description of Artificial Sequence: Synthetic oligonucleotide
  Target: SCN10A; (-) strand; PAM type: NRG; PAM sequence: AAG
caatgatatgtgaaagaatt

SEQ ID NO: 13212 - DNA, 20 bp, Artificial Sequence
  Description of Artificial Sequence: Synthetic oligonucleotide
  Target: SCN10A; (-) strand; PAM type: NRG; PAM sequence: AAG
atttttacaatgatatgtga

SEQ ID NO: 13213 - DNA, 20 bp, Artificial Sequence
  Description of Artificial Sequence: Synthetic oligonucleotide
  Target: SCN10A; (-) strand; PAM type: NRG; PAM sequence: AGG
tggacagagagtttgggcac

SEQ ID NO: 13214 - DNA, 20 bp, Artificial Sequence
  Description of Artificial Sequence: Synthetic oligonucleotide
  Target: SCN10A; (-) strand; PAM type: NRG; PAM sequence: CAG
gtggacagagagtttgggca

SEQ ID NO: 13215 - DNA, 20 bp, Artificial Sequence
  Description of Artificial Sequence: Synthetic oligonucleotide
  Target: SCN10A; (-) strand; PAM type: NRG; PAM sequence: GGG
gctaagtggacagagagttt

SEQ ID NO: 13216 - DNA, 20 bp, Artificial Sequence
  Description of Artificial Sequence: Synthetic oligonucleotide
  Target: SCN10A; (-) strand; PAM type: NRG; PAM sequence: TGG
agctaagtggacagagagtt

SEQ ID NO: 13217 - DNA, 20 bp, Artificial Sequence
  Description of Artificial Sequence: Synthetic oligonucleotide
  Target: SCN10A; (-) strand; PAM type: NRG; PAM sequence: GAG
aagacagctaagtggacaga

SEQ ID NO: 13218 - DNA, 20 bp, Artificial Sequence
  Description of Artificial Sequence: Synthetic oligonucleotide
  Target: SCN10A; (-) strand; PAM type: NRG; PAM sequence: GAG
ataagacagctaagtggaca

SEQ ID NO: 13219 - DNA, 20 bp, Artificial Sequence
  Description of Artificial Sequence: Synthetic oligonucleotide
  Target: SCN10A; (-) strand; PAM type: NRG; PAM sequence: CAG
ttataagacagctaagtgga

SEQ ID NO: 13220 - DNA, 20 bp, Artificial Sequence
  Description of Artificial Sequence: Synthetic oligonucleotide
  Target: SCN10A; (-) strand; PAM type: NRG; PAM sequence: TGG
gtgtttataagacagctaag

SEQ ID NO: 13221 - DNA, 20 bp, Artificial Sequence
  Description of Artificial Sequence: Synthetic oligonucleotide
  Target: SCN10A; (-) strand; PAM type: NRG; PAM sequence: AAG
caagtgtttataagacagct

SEQ ID NO: 13222 - DNA, 20 bp, Artificial Sequence
  Description of Artificial Sequence: Synthetic oligonucleotide
  Target: SCN10A; (-) strand; PAM type: NRG; PAM sequence: CAG
tagcccaagtgtttataaga

SEQ ID NO: 13223 - DNA, 20 bp, Artificial Sequence
  Description of Artificial Sequence: Synthetic oligonucleotide
  Target: SCN10A; (-) strand; PAM type: NRG; PAM sequence: AAG
atactagcccaagtgtttat

SEQ ID NO: 13224 - DNA, 20 bp, Artificial Sequence
  Description of Artificial Sequence: Synthetic oligonucleotide
  Target: SCN10A; (-) strand; PAM type: NRG; PAM sequence: AAG
gccatctgagatactagccc

SEQ ID NO: 13225 - DNA, 20 bp, Artificial Sequence
  Description of Artificial Sequence: Synthetic oligonucleotide
  Target: SCN10A; (-) strand; PAM type: NRG; PAM sequence: TAG
gaaaaagccatctgagatac

SEQ ID NO: 13226 - DNA, 20 bp, Artificial Sequence
  Description of Artificial Sequence: Synthetic oligonucleotide
  Target: SCN10A; (-) strand; PAM type: NRG; PAM sequence: GAG
ggatgatgaaaaagccatct

SEQ ID NO: 13227 - DNA, 20 bp, Artificial Sequence
  Description of Artificial Sequence: Synthetic oligonucleotide
  Target: SCN10A; (-) strand; PAM type: NRG; PAM sequence: AAG
atcccatgtggatgatgaaa

SEQ ID NO: 13228 - DNA, 20 bp, Artificial Sequence
  Description of Artificial Sequence: Synthetic oligonucleotide
  Target: SCN10A; (-) strand; PAM type: NRG; PAM sequence: TGG
ttcaacgtctaaatcccatg

SEQ ID NO: 13229 - DNA, 20 bp, Artificial Sequence
  Description of Artificial Sequence: Synthetic oligonucleotide
  Target: SCN10A; (-) strand; PAM type: NRG; PAM sequence: CAG
gagcacagatactgactgtg

SEQ ID NO: 13230 - DNA, 20 bp, Artificial Sequence
  Description of Artificial Sequence: Synthetic oligonucleotide
  Target: SCN10A; (-) strand; PAM type: NRG; PAM sequence: CAG
taccactgaacccgggagca

SEQ ID NO: 13231 - DNA, 20 bp, Artificial Sequence
  Description of Artificial Sequence: Synthetic oligonucleotide
  Target: SCN10A; (-) strand; PAM type: NRG; PAM sequence: GAG
tctcgtaccactgaacccgg

SEQ ID NO: 13232 - DNA, 20 bp, Artificial Sequence
  Description of Artificial Sequence: Synthetic oligonucleotide
  Target: SCN10A; (-) strand; PAM type: NRG; PAM sequence: GGG
tctctcgtaccactgaaccc

SEQ ID NO: 13233 - DNA, 20 bp, Artificial Sequence
  Description of Artificial Sequence: Synthetic oligonucleotide
  Target: SCN10A; (-) strand; PAM type: NRG; PAM sequence: CGG
ctctctcgtaccactgaacc

SEQ ID NO: 13234 - DNA, 20 bp, Artificial Sequence
  Description of Artificial Sequence: Synthetic oligonucleotide
  Target: SCN10A; (-) strand; PAM type: NRG; PAM sequence: GAG
cctgatttattctaaaagat

SEQ ID NO: 13235 - DNA, 20 bp, Artificial Sequence
  Description of Artificial Sequence: Synthetic oligonucleotide
  Target: SCN10A; (-) strand; PAM type: NRG; PAM sequence: AAG
gaatgcctgatttattctaa

SEQ ID NO: 13236 - DNA, 20 bp, Artificial Sequence
  Description of Artificial Sequence: Synthetic oligonucleotide
  Target: SCN10A; (-) strand; PAM type: NRG; PAM sequence: CAG
ggtaccaagccatctcaaat

SEQ ID NO: 13237 - DNA, 20 bp, Artificial Sequence
  Description of Artificial Sequence: Synthetic oligonucleotide
  Target: SCN10A; (-) strand; PAM type: NRG; PAM sequence: AAG
gatgggatagcagaggtacc

SEQ ID NO: 13238 - DNA, 20 bp, Artificial Sequence
  Description of Artificial Sequence: Synthetic oligonucleotide
  Target: SCN10A; (-) strand; PAM type: NRG; PAM sequence: AGG
agatgatgatgggatagcag

SEQ ID NO: 13239 - DNA, 20 bp, Artificial Sequence
  Description of Artificial Sequence: Synthetic oligonucleotide
  Target: SCN10A; (-) strand; PAM type: NRG; PAM sequence: GAG
aagatgatgatgggatagca

SEQ ID NO: 13240 - DNA, 20 bp, Artificial Sequence
  Description of Artificial Sequence: Synthetic oligonucleotide
  Target: SCN10A; (-) strand; PAM type: NRG; PAM sequence: CAG
ataagatgatgatgggatag

SEQ ID NO: 13241 - DNA, 20 bp, Artificial Sequence
  Description of Artificial Sequence: Synthetic oligonucleotide
  Target: SCN10A; (-) strand; PAM type: NRG; PAM sequence: TAG
ttaataagatgatgatggga

SEQ ID NO: 13242 - DNA, 20 bp, Artificial Sequence
  Description of Artificial Sequence: Synthetic oligonucleotide
  Target: SCN10A; (-) strand; PAM type: NRG; PAM sequence: GGG
caggttaataagatgatgat

SEQ ID NO: 13243 - DNA, 20 bp, Artificial Sequence
  Description of Artificial Sequence: Synthetic oligonucleotide
  Target: SCN10A; (-) strand; PAM type: NRG; PAM sequence: TGG
gcaggttaataagatgatga

SEQ ID NO: 13244 - DNA, 20 bp, Artificial Sequence
  Description of Artificial Sequence: Synthetic oligonucleotide
  Target: SCN10A; (-) strand; PAM type: NRG; PAM sequence: AAG
atccacagatgcaggttaat

SEQ ID NO: 13245 - DNA, 20 bp, Artificial Sequence
  Description of Artificial Sequence: Synthetic oligonucleotide
  Target: SCN10A; (-) strand; PAM type: NRG; PAM sequence: AGG
ttggcagcatccacagatgc

SEQ ID NO: 13246 - DNA, 20 bp, Artificial Sequence
  Description of Artificial Sequence: Synthetic oligonucleotide
  Target: SCN10A; (-) strand; PAM type: NRG; PAM sequence: CAG
gttggcagcatccacagatg

SEQ ID NO: 13247 - DNA, 20 bp, Artificial Sequence
  Description of Artificial Sequence: Synthetic oligonucleotide
  Target: SCN10A; (-) strand; PAM type: NRG; PAM sequence: CAG
ctgggagttggcagcatcca

SEQ ID NO: 13248 - DNA, 20 bp, Artificial Sequence
  Description of Artificial Sequence: Synthetic oligonucleotide
  Target: SCN10A; (-) strand; PAM type: NRG; PAM sequence: CAG
agatgcttactgggagttgg

SEQ ID NO: 13249 - DNA, 20 bp, Artificial Sequence
  Description of Artificial Sequence: Synthetic oligonucleotide
  Target: SCN10A; (-) strand; PAM type: NRG; PAM sequence: TGG
tcaagatgcttactgggagt

SEQ ID NO: 13250 - DNA, 20 bp, Artificial Sequence
  Description of Artificial Sequence: Synthetic oligonucleotide
  Target: SCN10A; (-) strand; PAM type: NRG; PAM sequence: GAG
gctctcaagatgcttactgg

SEQ ID NO: 13251 - DNA, 20 bp, Artificial Sequence
  Description of Artificial Sequence: Synthetic oligonucleotide
  Target: SCN10A; (-) strand; PAM type: NRG; PAM sequence: GGG
aggctctcaagatgcttact

SEQ ID NO: 13252 - DNA, 20 bp, Artificial Sequence
  Description of Artificial Sequence: Synthetic oligonucleotide
  Target: SCN10A; (-) strand; PAM type: NRG; PAM sequence: TGG
gaggctctcaagatgcttac

SEQ ID NO: 13253 - DNA, 20 bp, Artificial Sequence
  Description of Artificial Sequence: Synthetic oligonucleotide
  Target: SCN10A; (-) strand; PAM type: NRG; PAM sequence: AAG
aagaagtcaaagaggctctc

SEQ ID NO: 13254 - DNA, 20 bp, Artificial Sequence
  Description of Artificial Sequence: Synthetic oligonucleotide
  Target: SCN10A; (-) strand; PAM type: NRG; PAM sequence: AGG
tagcccataagaagtcaaag

SEQ ID NO: 13255 - DNA, 20 bp, Artificial Sequence
  Description of Artificial Sequence: Synthetic oligonucleotide
  Target: SCN10A; (-) strand; PAM type: NRG; PAM sequence: GAG
ttagcccataagaagtcaaa

SEQ ID NO: 13256 - DNA, 20 bp, Artificial Sequence
  Description of Artificial Sequence: Synthetic oligonucleotide
  Target: SCN10A; (-) strand; PAM type: NRG; PAM sequence: AAG
tattagcccataagaagtca

SEQ ID NO: 13257 - DNA, 20 bp, Artificial Sequence
  Description of Artificial Sequence: Synthetic oligonucleotide
  Target: SCN10A; (-) strand; PAM type: NRG; PAM sequence: AAG
tgtcactattagcccataag

SEQ ID NO: 13258 - DNA, 20 bp, Artificial Sequence
  Description of Artificial Sequence: Synthetic oligonucleotide
  Target: SCN10A; (-) strand; PAM type: NRG; PAM sequence: AAG
ttctgtcactattagcccat

SEQ ID NO: 13259 - DNA, 20 bp, Artificial Sequence
  Description of Artificial Sequence: Synthetic oligonucleotide
  Target: SCN10A; (-) strand; PAM type: NRG; PAM sequence: TAG
tctcccttttctgtcactat

SEQ ID NO: 13260 - DNA, 20 bp, Artificial Sequence
  Description of Artificial Sequence: Synthetic oligonucleotide
  Target: SCN10A; (-) strand; PAM type: NRG; PAM sequence: AGG
tcaagaatacagatttgccg

SEQ ID NO: 13261 - DNA, 20 bp, Artificial Sequence
  Description of Artificial Sequence: Synthetic oligonucleotide
  Target: SCN10A; (-) strand; PAM type: NRG; PAM sequence: GAG
ctcaagaatacagatttgcc

SEQ ID NO: 13262 - DNA, 20 bp, Artificial Sequence
  Description of Artificial Sequence: Synthetic oligonucleotide
  Target: SCN10A; (-) strand; PAM type: NRG; PAM sequence: CAG
tctcacatgcctcaagaata

SEQ ID NO: 13263 - DNA, 20 bp, Artificial Sequence
  Description of Artificial Sequence: Synthetic oligonucleotide
  Target: SCN10A; (-) strand; PAM type: NRG; PAM sequence: AAG
tgatacatctcacatgcctc

SEQ ID NO: 13264 - DNA, 20 bp, Artificial Sequence
  Description of Artificial Sequence: Synthetic oligonucleotide
  Target: SCN10A; (-) strand; PAM type: NRG; PAM sequence: TGG
tgtataattacaaagcacag

SEQ ID NO: 13265 - DNA, 20 bp, Artificial Sequence
  Description of Artificial Sequence: Synthetic oligonucleotide
  Target: SCN10A; (-) strand; PAM type: NRG; PAM sequence: CAG
atttgtataattacaaagca

SEQ ID NO: 13266 - DNA, 20 bp, Artificial Sequence
  Description of Artificial Sequence: Synthetic oligonucleotide
  Target: SCN10A; (-) strand; PAM type: NRG; PAM sequence: AAG
tttccatttgtataattaca

SEQ ID NO: 13267 - DNA, 20 bp, Artificial Sequence
  Description of Artificial Sequence: Synthetic oligonucleotide
  Target: SCN10A; (-) strand; PAM type: NRG; PAM sequence: AAG
tatatatttgatcatttcat

SEQ ID NO: 13268 - DNA, 20 bp, Artificial Sequence
  Description of Artificial Sequence: Synthetic oligonucleotide
  Target: SCN10A; (-) strand; PAM type: NRG; PAM sequence: TAG
atcacaaagattcaaatata

SEQ ID NO: 13269 - DNA, 20 bp, Artificial Sequence
  Description of Artificial Sequence: Synthetic oligonucleotide
  Target: SCN10A; (-) strand; PAM type: NRG; PAM sequence: AAG
cattcccagccacaatcaca

SEQ ID NO: 13270 - DNA, 20 bp, Artificial Sequence
  Description of Artificial Sequence: Synthetic oligonucleotide
  Target: SCN10A; (-) strand; PAM type: NRG; PAM sequence: CAG
attaactcttggcccattcc

SEQ ID NO: 13271 - DNA, 20 bp, Artificial Sequence
  Description of Artificial Sequence: Synthetic oligonucleotide
  Target: SCN10A; (-) strand; PAM type: NRG; PAM sequence: TGG
catgatcttccattaactct

SEQ ID NO: 13272 - DNA, 20 bp, Artificial Sequence
  Description of Artificial Sequence: Synthetic oligonucleotide
  Target: SCN10A; (-) strand; PAM type: NRG; PAM sequence: CAG
ggacatagggattgtaatga

SEQ ID NO: 13273 - DNA, 20 bp, Artificial Sequence
  Description of Artificial Sequence: Synthetic oligonucleotide
  Target: SCN10A; (-) strand; PAM type: NRG; PAM sequence: GGG
ctataacaacataggacata

SEQ ID NO: 13274 - DNA, 20 bp, Artificial Sequence
  Description of Artificial Sequence: Synthetic oligonucleotide
  Target: SCN10A; (-) strand; PAM type: NRG; PAM sequence: AGG
cctataacaacataggacat

SEQ ID NO: 13275 - DNA, 20 bp, Artificial Sequence
  Description of Artificial Sequence: Synthetic oligonucleotide
  Target: SCN10A; (-) strand; PAM type: NRG; PAM sequence: TAG
ccctataacaacataggaca

SEQ ID NO: 13276 - DNA, 20 bp, Artificial Sequence
  Description of Artificial Sequence: Synthetic oligonucleotide
  Target: SCN10A; (-) strand; PAM type: NRG; PAM sequence: AGG
aagactccctataacaacat

SEQ ID NO: 13277 - DNA, 20 bp, Artificial Sequence
  Description of Artificial Sequence: Synthetic oligonucleotide
  Target: SCN10A; (-) strand; PAM type: NRG; PAM sequence: TAG
aaagactccctataacaaca

SEQ ID NO: 13278 - DNA, 20 bp, Artificial Sequence
  Description of Artificial Sequence: Synthetic oligonucleotide
  Target: SCN10A; (-) strand; PAM type: NRG; PAM sequence: AAG
ttttgagatgaagaaaagca

SEQ ID NO: 13279 - DNA, 20 bp, Artificial Sequence
  Description of Artificial Sequence: Synthetic oligonucleotide
  Target: SCN10A; (-) strand; PAM type: NRG; PAM sequence: AAG
gcagattttgagatgaagaa

SEQ ID NO: 13280 - DNA, 20 bp, Artificial Sequence
  Description of Artificial Sequence: Synthetic oligonucleotide
  Target: SCN10A; (-) strand; PAM type: NRG; PAM sequence: AAG
atgttgcagattttgagatg

SEQ ID NO: 13281 - DNA, 20 bp, Artificial Sequence
  Description of Artificial Sequence: Synthetic oligonucleotide
  Target: SCN10A; (-) strand; PAM type: NRG; PAM sequence: GAG
aaaggcatgttgcagatttt

SEQ ID NO: 13282 - DNA, 20 bp, Artificial Sequence
  Description of Artificial Sequence: Synthetic oligonucleotide
  Target: SCN10A; (-) strand; PAM type: NRG; PAM sequence: CAG
tttaggccaaaggcatgttg

SEQ ID NO: 13283 - DNA, 20 bp, Artificial Sequence
  Description of Artificial Sequence: Synthetic oligonucleotide
  Target: SCN10A; (-) strand; PAM type: NRG; PAM sequence: AGG
gaggagtttatttaggccaa

SEQ ID NO: 13284 - DNA, 20 bp, Artificial Sequence
  Description of Artificial Sequence: Synthetic oligonucleotide
  Target: SCN10A; (-) strand; PAM type: NRG; PAM sequence: AAG
agaggagtttatttaggcca

SEQ ID NO: 13285 - DNA, 20 bp, Artificial Sequence
  Description of Artificial Sequence: Synthetic oligonucleotide
  Target: SCN10A; (-) strand; PAM type: NRG; PAM sequence: AGG
attgtcagaggagtttattt

SEQ ID NO: 13286 - DNA, 20 bp, Artificial Sequence
  Description of Artificial Sequence: Synthetic oligonucleotide
  Target: SCN10A; (-) strand; PAM type: NRG; PAM sequence: TAG
aattgtcagaggagtttatt

SEQ ID NO: 13287 - DNA, 20 bp, Artificial Sequence
  Description of Artificial Sequence: Synthetic oligonucleotide
  Target: SCN10A; (-) strand; PAM type: NRG; PAM sequence: GAG
tggagtaagaattgtcagag

SEQ ID NO: 13288 - DNA, 20 bp, Artificial Sequence
  Description of Artificial Sequence: Synthetic oligonucleotide
  Target: SCN10A; (-) strand; PAM type: NRG; PAM sequence: AGG
aatggagtaagaattgtcag

SEQ ID NO: 13289 - DNA, 20 bp, Artificial Sequence
  Description of Artificial Sequence: Synthetic oligonucleotide
  Target: SCN10A; (-) strand; PAM type: NRG; PAM sequence: GAG
gaatggagtaagaattgtca

SEQ ID NO: 13290 - DNA, 20 bp, Artificial Sequence
  Description of Artificial Sequence: Synthetic oligonucleotide
  Target: SCN10A; (-) strand; PAM type: NRG; PAM sequence: CAG
ctgaatggagtaagaattgt

SEQ ID NO: 13291 - DNA, 20 bp, Artificial Sequence
  Description of Artificial Sequence: Synthetic oligonucleotide
  Target: SCN10A; (-) strand; PAM type: NRG; PAM sequence: AAG
ttgtatgaactgaatggagt

SEQ ID NO: 13292 - DNA, 20 bp, Artificial Sequence
  Description of Artificial Sequence: Synthetic oligonucleotide
  Target: SCN10A; (-) strand; PAM type: NRG; PAM sequence: GAG
ttaattgtatgaactgaatg

SEQ ID NO: 13293 - DNA, 20 bp, Artificial Sequence
  Description of Artificial Sequence: Synthetic oligonucleotide
  Target: SCN10A; (-) strand; PAM type: NRG; PAM sequence: TGG
gattaattgtatgaactgaa

SEQ ID NO: 13294 - DNA, 20 bp, Artificial Sequence
  Description of Artificial Sequence: Synthetic oligonucleotide
  Target: SCN10A; (-) strand; PAM type: NRG; PAM sequence: AAG
aataggaattaagcccccaa

SEQ ID NO: 13295 - DNA, 20 bp, Artificial Sequence
  Description of Artificial Sequence: Synthetic oligonucleotide
  Target: SCN10A; (-) strand; PAM type: NRG; PAM sequence: AAG
caagagataaaataggaatt

SEQ ID NO: 13296 - DNA, 20 bp, Artificial Sequence
  Description of Artificial Sequence: Synthetic oligonucleotide
  Target: SCN10A; (-) strand; PAM type: NRG; PAM sequence: AGG
ccaagaacaagagataaaat

SEQ ID NO: 13297 - DNA, 20 bp, Artificial Sequence
  Description of Artificial Sequence: Synthetic oligonucleotide
  Target: SCN10A; (-) strand; PAM type: NRG; PAM sequence: TAG
tccaagaacaagagataaaa

SEQ ID NO: 13298 - DNA, 20 bp, Artificial Sequence
  Description of Artificial Sequence: Synthetic oligonucleotide
  Target: SCN10A; (-) strand; PAM type: NRG; PAM sequence: GAG
gggcactgctccaagaacaa

SEQ ID NO: 13299 - DNA, 20 bp, Artificial Sequence
  Description of Artificial Sequence: Synthetic oligonucleotide
  Target: SCN10A; (-) strand; PAM type: NRG; PAM sequence: AAG
atgggcactgctccaagaac

SEQ ID NO: 13300 - DNA, 20 bp, Artificial Sequence
  Description of Artificial Sequence: Synthetic oligonucleotide
  Target: SCN10A; (-) strand; PAM type: NRG; PAM sequence: AAG
tatatgatgggcactgctcc

SEQ ID NO: 13301 - DNA, 20 bp, Artificial Sequence
  Description of Artificial Sequence: Synthetic oligonucleotide
  Target: SCN10A; (-) strand; PAM type: NRG; PAM sequence: GGG
ttaattacgtactatatgat

SEQ ID NO: 13302 - DNA, 20 bp, Artificial Sequence
  Description of Artificial Sequence: Synthetic oligonucleotide
  Target: SCN10A; (-) strand; PAM type: NRG; PAM sequence: TGG
attaattacgtactatatga

SEQ ID NO: 13303 - DNA, 20 bp, Artificial Sequence
  Description of Artificial Sequence: Synthetic oligonucleotide
  Target: SCN10A; (-) strand; PAM type: NRG; PAM sequence: TAG
tagataaaaggtatggccag

SEQ ID NO: 13304 - DNA, 20 bp, Artificial Sequence
  Description of Artificial Sequence: Synthetic oligonucleotide
  Target: SCN10A; (-) strand; PAM type: NRG; PAM sequence: CAG
cagtagataaaaggtatggc

SEQ ID NO: 13305 - DNA, 20 bp, Artificial Sequence
  Description of Artificial Sequence: Synthetic oligonucleotide
  Target: SCN10A; (-) strand; PAM type: NRG; PAM sequence: TGG
gatccagtagataaaaggta

SEQ ID NO: 13306 - DNA, 20 bp, Artificial Sequence
  Description of Artificial Sequence: Synthetic oligonucleotide
  Target: SCN10A; (-) strand; PAM type: NRG; PAM sequence: AGG
atgatgatccagtagataaa

SEQ ID NO: 13307 - DNA, 20 bp, Artificial Sequence
  Description of Artificial Sequence: Synthetic oligonucleotide
  Target: SCN10A; (-) strand; PAM type: NRG; PAM sequence: AAG
aatgatgatccagtagataa

SEQ ID NO: 13308 - DNA, 20 bp, Artificial Sequence
  Description of Artificial Sequence: Synthetic oligonucleotide
  Target: SCN10A; (-) strand; PAM type: NRG; PAM sequence: TAG
tcatgagaatgatgatccag

SEQ ID NO: 13309 - DNA, 20 bp, Artificial Sequence
  Description of Artificial Sequence: Synthetic oligonucleotide
  Target: SCN10A; (-) strand; PAM type: NRG; PAM sequence: CAG
taatcatgagaatgatgatc

SEQ ID NO: 13310 - DNA, 20 bp, Artificial Sequence
  Description of Artificial Sequence: Synthetic oligonucleotide
  Target: SCN10A; (-) strand; PAM type: NRG; PAM sequence: GAG
agaagaaaaagtataatcat

SEQ ID NO: 13311 - DNA, 20 bp, Artificial Sequence
  Description of Artificial Sequence: Synthetic oligonucleotide
  Target: SCN10A; (-) strand; PAM type: NRG; PAM sequence: AAG
gttaatataatcagaagaaa

SEQ ID NO: 13312 - DNA, 20 bp, Artificial Sequence
  Description of Artificial Sequence: Synthetic oligonucleotide
  Target: SCN10A; (-) strand; PAM type: NRG; PAM sequence: AAG
tccatagttaatataatcag

SEQ ID NO: 13313 - DNA, 20 bp, Artificial Sequence
  Description of Artificial Sequence: Synthetic oligonucleotide
  Target: SCN10A; (-) strand; PAM type: NRG; PAM sequence: CAG
aactccatagttaatataat

SEQ ID NO: 13314 - DNA, 20 bp, Artificial Sequence
  Description of Artificial Sequence: Synthetic oligonucleotide
  Target: SCN10A; (-) strand; PAM type: NRG; PAM sequence: TAG
acctggcgtccagaactcca

SEQ ID NO: 13315 - DNA, 20 bp, Artificial Sequence
  Description of Artificial Sequence: Synthetic oligonucleotide
  Target: SCN10A; (-) strand; PAM type: NRG; PAM sequence: CAG
tttttacattacctggcgtc

SEQ ID NO: 13316 - DNA, 20 bp, Artificial Sequence
  Description of Artificial Sequence: Synthetic oligonucleotide
  Target: SCN10A; (-) strand; PAM type: NRG; PAM sequence: TGG
aggagagtttttacattacc

SEQ ID NO: 13317 - DNA, 20 bp, Artificial Sequence
  Description of Artificial Sequence: Synthetic oligonucleotide
  Target: SCN10A; (-) strand; PAM type: NRG; PAM sequence: GAG
taatcagacattaaggagga

SEQ ID NO: 13318 - DNA, 20 bp, Artificial Sequence
  Description of Artificial Sequence: Synthetic oligonucleotide
  Target: SCN10A; (-) strand; PAM type: NRG; PAM sequence: GAG
cataatcagacattaaggag

SEQ ID NO: 13319 - DNA, 20 bp, Artificial Sequence
  Description of Artificial Sequence: Synthetic oligonucleotide
  Target: SCN10A; (-) strand; PAM type: NRG; PAM sequence: AGG
ctcataatcagacattaagg

SEQ ID NO: 13320 - DNA, 20 bp, Artificial Sequence
  Description of Artificial Sequence: Synthetic oligonucleotide
  Target: SCN10A; (-) strand; PAM type: NRG; PAM sequence: GAG
tctcataatcagacattaag

SEQ ID NO: 13321 - DNA, 20 bp, Artificial Sequence
  Description of Artificial Sequence: Synthetic oligonucleotide
  Target: SCN10A; (-) strand; PAM type: NRG; PAM sequence: AGG
catctcataatcagacatta

SEQ ID NO: 13322 - DNA, 20 bp, Artificial Sequence
  Description of Artificial Sequence: Synthetic oligonucleotide
  Target: SCN10A; (-) strand; PAM type: NRG; PAM sequence: AAG
acatctcataatcagacatt

SEQ ID NO: 13323 - DNA, 20 bp, Artificial Sequence
  Description of Artificial Sequence: Synthetic oligonucleotide
  Target: SCN10A; (-) strand; PAM type: NRG; PAM sequence: CAG
gtctgttcacatctcataat

SEQ ID NO: 13324 - DNA, 20 bp, Artificial Sequence
  Description of Artificial Sequence: Synthetic oligonucleotide
  Target: SCN10A; (-) strand; PAM type: NRG; PAM sequence: GAG
cagcttttgaatacattcca

SEQ ID NO: 13325 - DNA, 20 bp, Artificial Sequence
  Description of Artificial Sequence: Synthetic oligonucleotide
  Target: SCN10A; (-) strand; PAM type: NRG; PAM sequence: CAG
ggcagcttttgaatacattc

SEQ ID NO: 13326 - DNA, 20 bp, Artificial Sequence
  Description of Artificial Sequence: Synthetic oligonucleotide
  Target: SCN10A; (-) strand; PAM type: NRG; PAM sequence: CAG
ctgttgtgtagctaaagagg

SEQ ID NO: 13327 - DNA, 20 bp, Artificial Sequence
  Description of Artificial Sequence: Synthetic oligonucleotide
  Target: SCN10A; (-) strand; PAM type: NRG; PAM sequence: AGG
tttctgttgtgtagctaaag

SEQ ID NO: 13328 - DNA, 20 bp, Artificial Sequence
  Description of Artificial Sequence: Synthetic oligonucleotide
  Target: SCN10A; (-) strand; PAM type: NRG; PAM sequence: GAG
ctttctgttgtgtagctaaa

SEQ ID NO: 13329 - DNA, 20 bp, Artificial Sequence
  Description of Artificial Sequence: Synthetic oligonucleotide
  Target: SCN10A; (-) strand; PAM type: NRG; PAM sequence: AAG
acctttctgttgtgtagcta

SEQ ID NO: 13330 - DNA, 20 bp, Artificial Sequence
  Description of Artificial Sequence: Synthetic oligonucleotide
  Target: SCN10A; (-) strand; PAM type: NRG; PAM sequence: TAG
ggctggacctttctgttgtg

SEQ ID NO: 13331 - DNA, 20 bp, Artificial Sequence
  Description of Artificial Sequence: Synthetic oligonucleotide
  Target: SCN10A; (-) strand; PAM type: NRG; PAM sequence: TGG
ttttctgaggctgaaatggc

SEQ ID NO: 13332 - DNA, 20 bp, Artificial Sequence
  Description of Artificial Sequence: Synthetic oligonucleotide
  Target: SCN10A; (-) strand; PAM type: NRG; PAM sequence: TGG
actcttttctgaggctgaaa

SEQ ID NO: 13333 - DNA, 20 bp, Artificial Sequence
  Description of Artificial Sequence: Synthetic oligonucleotide
  Target: SCN10A; (-) strand; PAM type: NRG; PAM sequence: AGG
gggaaaagcactcttttctg

SEQ ID NO: 13334 - DNA, 20 bp, Artificial Sequence
  Description of Artificial Sequence: Synthetic oligonucleotide
  Target: SCN10A; (-) strand; PAM type: NRG; PAM sequence: GAG
tgggaaaagcactcttttct

SEQ ID NO: 13335 - DNA, 20 bp, Artificial Sequence
  Description of Artificial Sequence: Synthetic oligonucleotide
  Target: SCN10A; (-) strand; PAM type: NRG; PAM sequence: AAG
ctgccccatttatatgggaa

SEQ ID NO: 13336 - DNA, 20 bp, Artificial Sequence
  Description of Artificial Sequence: Synthetic oligonucleotide
  Target: SCN10A; (-) strand; PAM type: NRG; PAM sequence: GGG
ggtgcctgccccatttatat

SEQ ID NO: 13337 - DNA, 20 bp, Artificial Sequence
  Description of Artificial Sequence: Synthetic oligonucleotide
  Target: SCN10A; (-) strand; PAM type: NRG; PAM sequence: TGG
tggtgcctgccccatttata

SEQ ID NO: 13338 - DNA, 20 bp, Artificial Sequence
  Description of Artificial Sequence: Synthetic oligonucleotide
  Target: SCN10A; (-) strand; PAM type: NRG; PAM sequence: TGG
tctcgtgctgtagaactcca

SEQ ID NO: 13339 - DNA, 20 bp, Artificial Sequence
  Description of Artificial Sequence: Synthetic oligonucleotide
  Target: SCN10A; (-) strand; PAM type: NRG; PAM sequence: TAG
agacttcgcatctcgtgctg

SEQ ID NO: 13340 - DNA, 20 bp, Artificial Sequence
  Description of Artificial Sequence: Synthetic oligonucleotide
  Target: SCN10A; (-) strand; PAM type: NRG; PAM sequence: TAG
aagaaaatgaatgctttcta

SEQ ID NO: 13341 - DNA, 20 bp, Artificial Sequence
  Description of Artificial Sequence: Synthetic oligonucleotide
  Target: SCN10A; (-) strand; PAM type: NRG; PAM sequence: AAG
tgtaaaattggtgggaaggg

SEQ ID NO: 13342 - DNA, 20 bp, Artificial Sequence
  Description of Artificial Sequence: Synthetic oligonucleotide
  Target: SCN10A; (-) strand; PAM type: NRG; PAM sequence: GGG
acttgtaaaattggtgggaa

SEQ ID NO: 13343 - DNA, 20 bp, Artificial Sequence
  Description of Artificial Sequence: Synthetic oligonucleotide
  Target: SCN10A; (-) strand; PAM type: NRG; PAM sequence: AGG
cacttgtaaaattggtggga

SEQ ID NO: 13344 - DNA, 20 bp, Artificial Sequence
  Description of Artificial Sequence: Synthetic oligonucleotide
  Target: SCN10A; (-) strand; PAM type: NRG; PAM sequence: AAG
tcacttgtaaaattggtggg

SEQ ID NO: 13345 - DNA, 20 bp, Artificial Sequence
  Description of Artificial Sequence: Synthetic oligonucleotide
  Target: SCN10A; (-) strand; PAM type: NRG; PAM sequence: GGG
tcctcacttgtaaaattggt

SEQ ID NO: 13346 - DNA, 20 bp, Artificial Sequence
  Description of Artificial Sequence: Synthetic oligonucleotide
  Target: SCN10A; (-) strand; PAM type: NRG; PAM sequence: TGG
ttcctcacttgtaaaattgg

SEQ ID NO: 13347 - DNA, 20 bp, Artificial Sequence
  Description of Artificial Sequence: Synthetic oligonucleotide
  Target: SCN10A; (-) strand; PAM type: NRG; PAM sequence: TGG
aatttcctcacttgtaaaat

SEQ ID NO: 13348 - DNA, 20 bp, Artificial Sequence
  Description of Artificial Sequence: Synthetic oligonucleotide
  Target: SCN10A; (-) strand; PAM type: NRG; PAM sequence: AAG
tgtctggctgaccagggcta

SEQ ID NO: 13349 - DNA, 20 bp, Artificial Sequence
  Description of Artificial Sequence: Synthetic oligonucleotide
  Target: SCN10A; (-) strand; PAM type: NRG; PAM sequence: GGG
accaattgtctggctgacca

SEQ ID NO: 13350 - DNA, 20 bp, Artificial Sequence
  Description of Artificial Sequence: Synthetic oligonucleotide
  Target: SCN10A; (-) strand; PAM type: NRG; PAM sequence: AGG
caccaattgtctggctgacc

SEQ ID NO: 13351 - DNA, 20 bp, Artificial Sequence
  Description of Artificial Sequence: Synthetic oligonucleotide
  Target: SCN10A; (-) strand; PAM type: NRG; PAM sequence: CAG
ccaccaattgtctggctgac

SEQ ID NO: 13352 - DNA, 20 bp, Artificial Sequence
  Description of Artificial Sequence: Synthetic oligonucleotide
  Target: SCN10A; (-) strand; PAM type: NRG; PAM sequence: TGG
taacttttccaccaattgtc

SEQ ID NO: 13353 - DNA, 20 bp, Artificial Sequence
  Description of Artificial Sequence: Synthetic oligonucleotide
  Target: SCN10A; (-) strand; PAM type: NRG; PAM sequence: TGG
tgggatctggaaatgccagt

SEQ ID NO: 13354 - DNA, 20 bp, Artificial Sequence
  Description of Artificial Sequence: Synthetic oligonucleotide
  Target: SCN10A; (-) strand; PAM type: NRG; PAM sequence: CAG
gtcctgggatctggaaatgc

SEQ ID NO: 13355 - DNA, 20 bp, Artificial Sequence
  Description of Artificial Sequence: Synthetic oligonucleotide
  Target: SCN10A; (-) strand; PAM type: NRG; PAM sequence: TGG
aagagcactgtcctgggatc

SEQ ID NO: 13356 - DNA, 20 bp, Artificial Sequence
  Description of Artificial Sequence: Synthetic oligonucleotide
  Target: SCN10A; (-) strand; PAM type: NRG; PAM sequence: GGG
gcaggaaagagcactgtcct

SEQ ID NO: 13357 - DNA, 20 bp, Artificial Sequence
  Description of Artificial Sequence: Synthetic oligonucleotide
  Target: SCN10A; (-) strand; PAM type: NRG; PAM sequence: TGG
agcaggaaagagcactgtcc

SEQ ID NO: 13358 - DNA, 20 bp, Artificial Sequence
  Description of Artificial Sequence: Synthetic oligonucleotide
  Target: SCN10A; (-) strand; PAM type: NRG; PAM sequence: GAG
aggctgggtggagcaggaaa

SEQ ID NO: 13359 - DNA, 20 bp, Artificial Sequence
  Description of Artificial Sequence: Synthetic oligonucleotide
  Target: SCN10A; (-) strand; PAM type: NRG; PAM sequence: AAG
tgaggctgggtggagcagga

SEQ ID NO: 13360 - DNA, 20 bp, Artificial Sequence
  Description of Artificial Sequence: Synthetic oligonucleotide
  Target: SCN10A; (-) strand; PAM type: NRG; PAM sequence: AGG
agattgaggctgggtggagc

SEQ ID NO: 13361 - DNA, 20 bp, Artificial Sequence
  Description of Artificial Sequence: Synthetic oligonucleotide
  Target: SCN10A; (-) strand; PAM type: NRG; PAM sequence: CAG
gagattgaggctgggtggag

SEQ ID NO: 13362 - DNA, 20 bp, Artificial Sequence
  Description of Artificial Sequence: Synthetic oligonucleotide
  Target: SCN10A; (-) strand; PAM type: NRG; PAM sequence: GAG
tttgagattgaggctgggtg

SEQ ID NO: 13363 - DNA, 20 bp, Artificial Sequence
  Description of Artificial Sequence: Synthetic oligonucleotide
  Target: SCN10A; (-) strand; PAM type: NRG; PAM sequence: TGG
agtttgagattgaggctggg

SEQ ID NO: 13364 - DNA, 20 bp, Artificial Sequence
  Description of Artificial Sequence: Synthetic oligonucleotide
  Target: SCN10A; (-) strand; PAM type: NRG; PAM sequence: GGG
ttcagtttgagattgaggct

SEQ ID NO: 13365 - DNA, 20 bp, Artificial Sequence
  Description of Artificial Sequence: Synthetic oligonucleotide
  Target: SCN10A; (-) strand; PAM type: NRG; PAM sequence: TGG
tttcagtttgagattgaggc

SEQ ID NO: 13366 - DNA, 20 bp, Artificial Sequence
  Description of Artificial Sequence: Synthetic oligonucleotide
  Target: SCN10A; (-) strand; PAM type: NRG; PAM sequence: AGG
tatttttcagtttgagattg

SEQ ID NO: 13367 - DNA, 20 bp, Artificial Sequence
  Description of Artificial Sequence: Synthetic oligonucleotide
  Target: SCN10A; (-) strand; PAM type: NRG; PAM sequence: GAG
atatttttcagtttgagatt

SEQ ID NO: 13368 - DNA, 20 bp, Artificial Sequence
  Description of Artificial Sequence: Synthetic oligonucleotide
  Target: SCN10A; (-) strand; PAM type: NRG; PAM sequence: GAG
atcctgatatttttcagttt

SEQ ID NO: 13369 - DNA, 20 bp, Artificial Sequence
  Description of Artificial Sequence: Synthetic oligonucleotide
  Target: SCN10A; (-) strand; PAM type: NRG; PAM sequence: CAG
tctgggatcctgatattttt

SEQ ID NO: 13370 - DNA, 20 bp, Artificial Sequence
  Description of Artificial Sequence: Synthetic oligonucleotide
  Target: SCN10A; (-) strand; PAM type: NRG; PAM sequence: GGG
tcacttacccctcactttct

SEQ ID NO: 13371 - DNA, 20 bp, Artificial Sequence
  Description of Artificial Sequence: Synthetic oligonucleotide
  Target: SCN10A; (-) strand; PAM type: NRG; PAM sequence: TGG
gtcacttacccctcactttc

SEQ ID NO: 13372 - DNA, 20 bp, Artificial Sequence
  Description of Artificial Sequence: Synthetic oligonucleotide
  Target: SCN10A; (-) strand; PAM type: NRG; PAM sequence: GAG
gtgatgctgacctgtatcat

SEQ ID NO: 13373 - DNA, 20 bp, Artificial Sequence
  Description of Artificial Sequence: Synthetic oligonucleotide
  Target: SCN10A; (-) strand; PAM type: NRG; PAM sequence: AAG
cacaccagcgttatatcata

SEQ ID NO: 13374 - DNA, 20 bp, Artificial Sequence
  Description of Artificial Sequence: Synthetic oligonucleotide
  Target: SCN10A; (-) strand; PAM type: NRG; PAM sequence: CAG
ttttaaatgtatgtccacac

SEQ ID NO: 13375 - DNA, 20 bp, Artificial Sequence
  Description of Artificial Sequence: Synthetic oligonucleotide
  Target: SCN10A; (-) strand; PAM type: NRG; PAM sequence: GAG
ctatgtcatgaaaagccttt

SEQ ID NO: 13376 - DNA, 20 bp, Artificial Sequence
  Description of Artificial Sequence: Synthetic oligonucleotide
  Target: SCN10A; (-) strand; PAM type: NRG; PAM sequence: AAG
cctgtggcctatgtcatgaa

SEQ ID NO: 13377 - DNA, 20 bp, Artificial Sequence
  Description of Artificial Sequence: Synthetic oligonucleotide
  Target: SCN10A; (-) strand; PAM type: NRG; PAM sequence: TGG
ctgacccagggtaacacctg

SEQ ID NO: 13378 - DNA, 20 bp, Artificial Sequence
  Description of Artificial Sequence: Synthetic oligonucleotide
  Target: SCN10A; (-) strand; PAM type: NRG; PAM sequence: GGG
cggacaactgctctgaccca

SEQ ID NO: 13379 - DNA, 20 bp, Artificial Sequence
  Description of Artificial Sequence: Synthetic oligonucleotide
  Target: SCN10A; (-) strand; PAM type: NRG; PAM sequence: AGG
tcggacaactgctctgaccc

SEQ ID NO: 13380 - DNA, 20 bp, Artificial Sequence
  Description of Artificial Sequence: Synthetic oligonucleotide
  Target: SCN10A; (-) strand; PAM type: NRG; PAM sequence: CAG
gtcggacaactgctctgacc

SEQ ID NO: 13381 - DNA, 20 bp, Artificial Sequence
  Description of Artificial Sequence: Synthetic oligonucleotide
  Target: SCN10A; (-) strand; PAM type: NRG; PAM sequence: CGG
tgactgcatgtgagagctgt

SEQ ID NO: 13382 - DNA, 20 bp, Artificial Sequence
  Description of Artificial Sequence: Synthetic oligonucleotide
  Target: SCN10A; (-) strand; PAM type: NRG; PAM sequence: GAG
ttttgcatgactgcatgtga

SEQ ID NO: 13383 - DNA, 20 bp, Artificial Sequence
  Description of Artificial Sequence: Synthetic oligonucleotide
  Target: SCN10A; (-) strand; PAM type: NRG; PAM sequence: GAG
gattttgcatgactgcatgt

SEQ ID NO: 13384 - DNA, 20 bp, Artificial Sequence
  Description of Artificial Sequence: Synthetic oligonucleotide
  Target: SCN10A; (-) strand; PAM type: NRG; PAM sequence: AGG
agagattggcaatattattt

SEQ ID NO: 13385 - DNA, 20 bp, Artificial Sequence
  Description of Artificial Sequence: Synthetic oligonucleotide
  Target: SCN10A; (-) strand; PAM type: NRG; PAM sequence: TAG
cagagattggcaatattatt

SEQ ID NO: 13386 - DNA, 20 bp, Artificial Sequence
  Description of Artificial Sequence: Synthetic oligonucleotide
  Target: SCN10A; (-) strand; PAM type: NRG; PAM sequence: TGG
gtggagcaccatacagagat

SEQ ID NO: 13387 - DNA, 20 bp, Artificial Sequence
  Description of Artificial Sequence: Synthetic oligonucleotide
  Target: SCN10A; (-) strand; PAM type: NRG; PAM sequence: GAG
cctctgtggagcaccataca

SEQ ID NO: 13388 - DNA, 20 bp, Artificial Sequence
  Description of Artificial Sequence: Synthetic oligonucleotide
  Target: SCN10A; (-) strand; PAM type: NRG; PAM sequence: CAG
gtcctctgtggagcaccata

SEQ ID NO: 13389 - DNA, 20 bp, Artificial Sequence
  Description of Artificial Sequence: Synthetic oligonucleotide
  Target: SCN10A; (-) strand; PAM type: NRG; PAM sequence: GAG
gtccaaggtagtcctctgtg

SEQ ID NO: 13390 - DNA, 20 bp, Artificial Sequence
  Description of Artificial Sequence: Synthetic oligonucleotide
  Target: SCN10A; (-) strand; PAM type: NRG; PAM sequence: TGG
aggtccaaggtagtcctctg

SEQ ID NO: 13391 - DNA, 20 bp, Artificial Sequence
  Description of Artificial Sequence: Synthetic oligonucleotide
  Target: SCN10A; (-) strand; PAM type: NRG; PAM sequence: TAG
acattactgaaggtccaagg

SEQ ID NO: 13392 - DNA, 20 bp, Artificial Sequence
  Description of Artificial Sequence: Synthetic oligonucleotide
  Target: SCN10A; (-) strand; PAM type: NRG; PAM sequence: AGG
agaacattactgaaggtcca

SEQ ID NO: 13393 - DNA, 20 bp, Artificial Sequence
  Description of Artificial Sequence: Synthetic oligonucleotide
  Target: SCN10A; (-) strand; PAM type: NRG; PAM sequence: AAG
aagaacattactgaaggtcc

SEQ ID NO: 13394 - DNA, 20 bp, Artificial Sequence
  Description of Artificial Sequence: Synthetic oligonucleotide
  Target: SCN10A; (-) strand; PAM type: NRG; PAM sequence: AGG
tagaacaagaacattactga

SEQ ID NO: 13395 - DNA, 20 bp, Artificial Sequence
  Description of Artificial Sequence: Synthetic oligonucleotide
  Target: SCN10A; (-) strand; PAM type: NRG; PAM sequence: AAG
atagaacaagaacattactg

SEQ ID NO: 13396 - DNA, 20 bp, Artificial Sequence
  Description of Artificial Sequence: Synthetic oligonucleotide
  Target: SCN10A; (-) strand; PAM type: NRG; PAM sequence: AAG
aacttccaaagatatagaac

SEQ ID NO: 13397 - DNA, 20 bp, Artificial Sequence
  Description of Artificial Sequence: Synthetic oligonucleotide
  Target: SCN10A; (-) strand; PAM type: NRG; PAM sequence: TAG
gaccagaacttccaaagata

SEQ ID NO: 13398 - DNA, 20 bp, Artificial Sequence
  Description of Artificial Sequence: Synthetic oligonucleotide
  Target: SCN10A; (-) strand; PAM type: NRG; PAM sequence: AAG
tctcaggaccagaacttcca

SEQ ID NO: 13399 - DNA, 20 bp, Artificial Sequence
  Description of Artificial Sequence: Synthetic oligonucleotide
  Target: SCN10A; (-) strand; PAM type: NRG; PAM sequence: CAG
tgagacaaacttctcaggac

SEQ ID NO: 13400 - DNA, 20 bp, Artificial Sequence
  Description of Artificial Sequence: Synthetic oligonucleotide
  Target: SCN10A; (-) strand; PAM type: NRG; PAM sequence: AGG
tttactgagacaaacttctc

SEQ ID NO: 13401 - DNA, 20 bp, Artificial Sequence
  Description of Artificial Sequence: Synthetic oligonucleotide
  Target: SCN10A; (-) strand; PAM type: NRG; PAM sequence: CAG
atttactgagacaaacttct

SEQ ID NO: 13402 - DNA, 20 bp, Artificial Sequence
  Description of Artificial Sequence: Synthetic oligonucleotide
  Target: SCN10A; (-) strand; PAM type: NRG; PAM sequence: GAG
gtaatcagattatatttact

SEQ ID NO: 13403 - DNA, 20 bp, Artificial Sequence
  Description of Artificial Sequence: Synthetic oligonucleotide
  Target: SCN10A; (-) strand; PAM type: NRG; PAM sequence: CAG
ccttttatttttgttgtaat

SEQ ID NO: 13404 - DNA, 20 bp, Artificial Sequence
  Description of Artificial Sequence: Synthetic oligonucleotide
  Target: SCN10A; (-) strand; PAM type: NRG; PAM sequence: CAG
tcatgggttctcttactctc

SEQ ID NO: 13405 - DNA, 20 bp, Artificial Sequence
  Description of Artificial Sequence: Synthetic oligonucleotide
  Target: SCN10A; (-) strand; PAM type: NRG; PAM sequence: GGG
gaatttcaatatcagatcat

SEQ ID NO: 13406 - DNA, 20 bp, Artificial Sequence
  Description of Artificial Sequence: Synthetic oligonucleotide
  Target: SCN10A; (-) strand; PAM type: NRG; PAM sequence: TGG
tgaatttcaatatcagatca

SEQ ID NO: 13407 - DNA, 20 bp, Artificial Sequence
  Description of Artificial Sequence: Synthetic oligonucleotide
  Target: SCN10A; (-) strand; PAM type: NRG; PAM sequence: CAG
tcccttctgaatttcaatat

SEQ ID NO: 13408 - DNA, 20 bp, Artificial Sequence
  Description of Artificial Sequence: Synthetic oligonucleotide
  Target: SCN10A; (-) strand; PAM type: NRG; PAM sequence: GAG
aaataggagtcagaagctaa

SEQ ID NO: 13409 - DNA, 20 bp, Artificial Sequence
  Description of Artificial Sequence: Synthetic oligonucleotide
  Target: SCN10A; (-) strand; PAM type: NRG; PAM sequence: AAG
acaaataggagtcagaagct

SEQ ID NO: 13410 - DNA, 20 bp, Artificial Sequence
  Description of Artificial Sequence: Synthetic oligonucleotide
  Target: SCN10A; (-) strand; PAM type: NRG; PAM sequence: AAG
catacacaaataggagtcag

SEQ ID NO: 13411 - DNA, 20 bp, Artificial Sequence
  Description of Artificial Sequence: Synthetic oligonucleotide
  Target: SCN10A; (-) strand; PAM type: NRG; PAM sequence: CAG
catcatacacaaataggagt

SEQ ID NO: 13412 - DNA, 20 bp, Artificial Sequence
  Description of Artificial Sequence: Synthetic oligonucleotide
  Target: SCN10A; (-) strand; PAM type: NRG; PAM sequence: GAG
aaaccatcatacacaaatag

SEQ ID NO: 13413 - DNA, 20 bp, Artificial Sequence
  Description of Artificial Sequence: Synthetic oligonucleotide
  Target: SCN10A; (-) strand; PAM type: NRG; PAM sequence: AGG
aaaaaccatcatacacaaat

SEQ ID NO: 13414 - DNA, 20 bp, Artificial Sequence
  Description of Artificial Sequence: Synthetic oligonucleotide
  Target: SCN10A; (-) strand; PAM type: NRG; PAM sequence: TAG
aaaaaaccatcatacacaaa

SEQ ID NO: 13415 - DNA, 20 bp, Artificial Sequence
  Description of Artificial Sequence: Synthetic oligonucleotide
  Target: SCN10A; (-) strand; PAM type: NRG; PAM sequence: TGG
aactgggcagggaatgcaac

SEQ ID NO: 13416 - DNA, 20 bp, Artificial Sequence
  Description of Artificial Sequence: Synthetic oligonucleotide
  Target: SCN10A; (-) strand; PAM type: NRG; PAM sequence: GGG
cacaatgtcagaactgggca

SEQ ID NO: 13417 - DNA, 20 bp, Artificial Sequence
  Description of Artificial Sequence: Synthetic oligonucleotide
  Target: SCN10A; (-) strand; PAM type: NRG; PAM sequence: AGG
tcacaatgtcagaactgggc

SEQ ID NO: 13418 - DNA, 20 bp, Artificial Sequence
  Description of Artificial Sequence: Synthetic oligonucleotide
  Target: SCN10A; (-) strand; PAM type: NRG; PAM sequence: CAG
gtcacaatgtcagaactggg

SEQ ID NO: 13419 - DNA, 20 bp, Artificial Sequence
  Description of Artificial Sequence: Synthetic oligonucleotide
  Target: SCN10A; (-) strand; PAM type: NRG; PAM sequence: GGG
ctggtcacaatgtcagaact

SEQ ID NO: 13420 - DNA, 20 bp, Artificial Sequence
  Description of Artificial Sequence: Synthetic oligonucleotide
  Target: SCN10A; (-) strand; PAM type: NRG; PAM sequence: TGG
actggtcacaatgtcagaac

SEQ ID NO: 13421 - DNA, 20 bp, Artificial Sequence
  Description of Artificial Sequence: Synthetic oligonucleotide
  Target: SCN10A; (-) strand; PAM type: NRG; PAM sequence: CAG
catgccactggtcacaatgt

SEQ ID NO: 13422 - DNA, 20 bp, Artificial Sequence
  Description of Artificial Sequence: Synthetic oligonucleotide
  Target: SCN10A; (-) strand; PAM type: NRG; PAM sequence: TGG
gcctcaccaatgcatgccac

SEQ ID NO: 13423 - DNA, 20 bp, Artificial Sequence
  Description of Artificial Sequence: Synthetic oligonucleotide
  Target: SCN10A; (-) strand; PAM type: NRG; PAM sequence: CAG
ttgcagatcacacccagcta

SEQ ID NO: 13424 - DNA, 20 bp, Artificial Sequence
  Description of Artificial Sequence: Synthetic oligonucleotide
  Target: SCN10A; (-) strand; PAM type: NRG; PAM sequence: CAG
ttcccattgcagatcacacc

SEQ ID NO: 13425 - DNA, 20 bp, Artificial Sequence
  Description of Artificial Sequence: Synthetic oligonucleotide
  Target: SCN10A; (-) strand; PAM type: NRG; PAM sequence: CAG
gtgttaactctttcccattg

SEQ ID NO: 13426 - DNA, 20 bp, Artificial Sequence
  Description of Artificial Sequence: Synthetic oligonucleotide
  Target: SCN10A; (-) strand; PAM type: NRG; PAM sequence: CAG
cactccagcctggatatgtt

SEQ ID NO: 13427 - DNA, 20 bp, Artificial Sequence
  Description of Artificial Sequence: Synthetic oligonucleotide
  Target: SCN10A; (-) strand; PAM type: NRG; PAM sequence: TGG
ctagtgagaacactccagcc

SEQ ID NO: 13428 - DNA, 20 bp, Artificial Sequence
  Description of Artificial Sequence: Synthetic oligonucleotide
  Target: SCN10A; (-) strand; PAM type: NRG; PAM sequence: CAG
gggccctagtgagaacactc

SEQ ID NO: 13429 - DNA, 20 bp, Artificial Sequence
  Description of Artificial Sequence: Synthetic oligonucleotide
  Target: SCN10A; (-) strand; PAM type: NRG; PAM sequence: GAG
gattgcccctgggccctagt

SEQ ID NO: 13430 - DNA, 20 bp, Artificial Sequence
  Description of Artificial Sequence: Synthetic oligonucleotide
  Target: SCN10A; (-) strand; PAM type: NRG; PAM sequence: TAG
agctgattgcccctgggccc

SEQ ID NO: 13431 - DNA, 20 bp, Artificial Sequence
  Description of Artificial Sequence: Synthetic oligonucleotide
  Target: SCN10A; (-) strand; PAM type: NRG; PAM sequence: GGG
gtatggagctgattgcccct

SEQ ID NO: 13432 - DNA, 20 bp, Artificial Sequence
  Description of Artificial Sequence: Synthetic oligonucleotide
  Target: SCN10A; (-) strand; PAM type: NRG; PAM sequence: TGG
agtatggagctgattgcccc

SEQ ID NO: 13433 - DNA, 20 bp, Artificial Sequence
  Description of Artificial Sequence: Synthetic oligonucleotide
  Target: SCN10A; (-) strand; PAM type: NRG; PAM sequence: GAG
aagatgaagccaccagtatg

SEQ ID NO: 13434 - DNA, 20 bp, Artificial Sequence
  Description of Artificial Sequence: Synthetic oligonucleotide
  Target: SCN10A; (-) strand; PAM type: NRG; PAM sequence: TGG
tgaagatgaagccaccagta

SEQ ID NO: 13435 - DNA, 20 bp, Artificial Sequence
  Description of Artificial Sequence: Synthetic oligonucleotide
  Target: SCN10A; (-) strand; PAM type: NRG; PAM sequence: CAG
caaaatgaagatgaagccac

SEQ ID NO: 13436 - DNA, 20 bp, Artificial Sequence
  Description of Artificial Sequence: Synthetic oligonucleotide
  Target: SCN10A; (-) strand; PAM type: NRG; PAM sequence: AAG
ctcaatacaaaatgaagatg

SEQ ID NO: 13437 - DNA, 20 bp, Artificial Sequence
  Description of Artificial Sequence: Synthetic oligonucleotide
  Target: SCN10A; (-) strand; PAM type: NRG; PAM sequence: AAG
atctagctcaatacaaaatg

SEQ ID NO: 13438 - DNA, 20 bp, Artificial Sequence
  Description of Artificial Sequence: Synthetic oligonucleotide
  Target: SCN10A; (-) strand; PAM type: NRG; PAM sequence: TAG
agagtcaacatgaggacatc

SEQ ID NO: 13439 - DNA, 20 bp, Artificial Sequence
  Description of Artificial Sequence: Synthetic oligonucleotide
  Target: SCN10A; (-) strand; PAM type: NRG; PAM sequence: AGG
ttagtgatagagtcaacatg

SEQ ID NO: 13440 - DNA, 20 bp, Artificial Sequence
  Description of Artificial Sequence: Synthetic oligonucleotide
  Target: SCN10A; (-) strand; PAM type: NRG; PAM sequence: GAG
cttagtgatagagtcaacat

SEQ ID NO: 13441 - DNA, 20 bp, Artificial Sequence
  Description of Artificial Sequence: Synthetic oligonucleotide
  Target: SCN10A; (-) strand; PAM type: NRG; PAM sequence: GAG
cactagaggccttagtgata

SEQ ID NO: 13442 - DNA, 20 bp, Artificial Sequence
  Description of Artificial Sequence: Synthetic oligonucleotide
  Target: SCN10A; (-) strand; PAM type: NRG; PAM sequence: TAG
gtcactagaggccttagtga

SEQ ID NO: 13443 - DNA, 20 bp, Artificial Sequence
  Description of Artificial Sequence: Synthetic oligonucleotide
  Target: SCN10A; (-) strand; PAM type: NRG; PAM sequence: TAG
gagagtgtcactagaggcct

SEQ ID NO: 13444 - DNA, 20 bp, Artificial Sequence
  Description of Artificial Sequence: Synthetic oligonucleotide
  Target: SCN10A; (-) strand; PAM type: NRG; PAM sequence: AGG
tcctatgagagtgtcactag

SEQ ID NO: 13445 - DNA, 20 bp, Artificial Sequence
  Description of Artificial Sequence: Synthetic oligonucleotide
  Target: SCN10A; (-) strand; PAM type: NRG; PAM sequence: GAG
gtcctatgagagtgtcacta

SEQ ID NO: 13446 - DNA, 20 bp, Artificial Sequence
  Description of Artificial Sequence: Synthetic oligonucleotide
  Target: SCN10A; (-) strand; PAM type: NRG; PAM sequence: TAG
ccgtcctatgagagtgtcac

SEQ ID NO: 13447 - DNA, 20 bp, Artificial Sequence
  Description of Artificial Sequence: Synthetic oligonucleotide
  Target: SCN10A; (-) strand; PAM type: NRG; PAM sequence: GAG
tcattcccaccgtcctatga

SEQ ID NO: 13448 - DNA, 20 bp, Artificial Sequence
  Description of Artificial Sequence: Synthetic oligonucleotide
  Target: SCN10A; (-) strand; PAM type: NRG; PAM sequence: GAG
catcattcccaccgtcctat

SEQ ID NO: 13449 - DNA, 20 bp, Artificial Sequence
  Description of Artificial Sequence: Synthetic oligonucleotide
  Target: SCN10A; (-) strand; PAM type: NRG; PAM sequence: CAG
aaatgaaaattgtgtactcc

SEQ ID NO: 13450 - DNA, 20 bp, Artificial Sequence
  Description of Artificial Sequence: Synthetic oligonucleotide
  Target: SCN10A; (-) strand; PAM type: NRG; PAM sequence: CAG
tgaaggttttgttgcattca

SEQ ID NO: 13451 - DNA, 20 bp, Artificial Sequence
  Description of Artificial Sequence: Synthetic oligonucleotide
  Target: SCN10A; (-) strand; PAM type: NRG; PAM sequence: AGG
gctgcatcactcccagatga

SEQ ID NO: 13452 - DNA, 20 bp, Artificial Sequence
  Description of Artificial Sequence: Synthetic oligonucleotide
  Target: SCN10A; (-) strand; PAM type: NRG; PAM sequence: AAG
ggctgcatcactcccagatg

SEQ ID NO: 13453 - DNA, 20 bp, Artificial Sequence
  Description of Artificial Sequence: Synthetic oligonucleotide
  Target: SCN10A; (-) strand; PAM type: NRG; PAM sequence: CAG
ggaggaggctgcatcactcc

SEQ ID NO: 13454 - DNA, 20 bp, Artificial Sequence
  Description of Artificial Sequence: Synthetic oligonucleotide
  Target: SCN10A; (-) strand; PAM type: NRG; PAM sequence: AGG
tgtgcccagagctgaggagg

SEQ ID NO: 13455 - DNA, 20 bp, Artificial Sequence
  Description of Artificial Sequence: Synthetic oligonucleotide
  Target: SCN10A; (-) strand; PAM type: NRG; PAM sequence: GAG
gtgtgcccagagctgaggag

SEQ ID NO: 13456 - DNA, 20 bp, Artificial Sequence
  Description of Artificial Sequence: Synthetic oligonucleotide
  Target: SCN10A; (-) strand; PAM type: NRG; PAM sequence: AGG
atgtgtgcccagagctgagg

SEQ ID NO: 13457 - DNA, 20 bp, Artificial Sequence
  Description of Artificial Sequence: Synthetic oligonucleotide
  Target: SCN10A; (-) strand; PAM type: NRG; PAM sequence: GAG
catgtgtgcccagagctgag

SEQ ID NO: 13458 - DNA, 20 bp, Artificial Sequence
  Description of Artificial Sequence: Synthetic oligonucleotide
  Target: SCN10A; (-) strand; PAM type: NRG; PAM sequence: AGG
cccatgtgtgcccagagctg

SEQ ID NO: 13459 - DNA, 20 bp, Artificial Sequence
  Description of Artificial Sequence: Synthetic oligonucleotide
  Target: SCN10A; (-) strand; PAM type: NRG; PAM sequence: GAG
ccccatgtgtgcccagagct

SEQ ID NO: 13460 - DNA, 20 bp, Artificial Sequence
  Description of Artificial Sequence: Synthetic oligonucleotide
  Target: SCN10A; (-) strand; PAM type: NRG; PAM sequence: GAG
taacaccccatgtgtgccca

SEQ ID NO: 13461 - DNA, 20 bp, Artificial Sequence
  Description of Artificial Sequence: Synthetic oligonucleotide
  Target: SCN10A; (-) strand; PAM type: NRG; PAM sequence: CAG
tctaacaccccatgtgtgcc

SEQ ID NO: 13462 - DNA, 20 bp, Artificial Sequence
  Description of Artificial Sequence: Synthetic oligonucleotide
  Target: SCN10A; (-) strand; PAM type: NRG; PAM sequence: TGG
ctatgtgctgcaccgctcca

SEQ ID NO: 13463 - DNA, 20 bp, Artificial Sequence
  Description of Artificial Sequence: Synthetic oligonucleotide
  Target: SCN10A; (-) strand; PAM type: NRG; PAM sequence: GAG
gtcattcaaaaggcctatcg

SEQ ID NO: 13464 - DNA, 20 bp, Artificial Sequence
  Description of Artificial Sequence: Synthetic oligonucleotide
  Target: SCN10A; (-) strand; PAM type: NRG; PAM sequence: CGG
ctgtcattcaaaaggcctat

SEQ ID NO: 13465 - DNA, 20 bp, Artificial Sequence
  Description of Artificial Sequence: Synthetic oligonucleotide
  Target: SCN10A; (-) strand; PAM type: NRG; PAM sequence: AGG
ttcagccactgtcattcaaa

SEQ ID NO: 13466 - DNA, 20 bp, Artificial Sequence
  Description of Artificial Sequence: Synthetic oligonucleotide
  Target: SCN10A; (-) strand; PAM type: NRG; PAM sequence: AAG
tttcagccactgtcattcaa

SEQ ID NO: 13467 - DNA, 20 bp, Artificial Sequence
  Description of Artificial Sequence: Synthetic oligonucleotide
  Target: SCN10A; (-) strand; PAM type: NRG; PAM sequence: CAG
atggaagcaagaagacattt

SEQ ID NO: 13468 - DNA, 20 bp, Artificial Sequence
  Description of Artificial Sequence: Synthetic oligonucleotide
  Target: SCN10A; (-) strand; PAM type: NRG; PAM sequence: AAG
cactctccgatggaagcaag

SEQ ID NO: 13469 - DNA, 20 bp, Artificial Sequence
  Description of Artificial Sequence: Synthetic oligonucleotide
  Target: SCN10A; (-) strand; PAM type: NRG; PAM sequence: AAG
aaccactctccgatggaagc

SEQ ID NO: 13470 - DNA, 20 bp, Artificial Sequence
  Description of Artificial Sequence: Synthetic oligonucleotide
  Target: SCN10A; (-) strand; PAM type: NRG; PAM sequence: AAG
tagcaaccactctccgatgg

SEQ ID NO: 13471 - DNA, 20 bp, Artificial Sequence
  Description of Artificial Sequence: Synthetic oligonucleotide
  Target: SCN10A; (-) strand; PAM type: NRG; PAM sequence: TGG
caatagcaaccactctccga

SEQ ID NO: 13472 - DNA, 20 bp, Artificial Sequence
  Description of Artificial Sequence: Synthetic oligonucleotide
  Target: SCN10A; (-) strand; PAM type: NRG; PAM sequence: TAG
aaaatcatcctatgaaccaa

SEQ ID NO: 13473 - DNA, 20 bp, Artificial Sequence
  Description of Artificial Sequence: Synthetic oligonucleotide
  Target: SCN10A; (-) strand; PAM type: NRG; PAM sequence: TGG
aaatatggaggagaagttta

SEQ ID NO: 13474 - DNA, 20 bp, Artificial Sequence
  Description of Artificial Sequence: Synthetic oligonucleotide
  Target: SCN10A; (-) strand; PAM type: NRG; PAM sequence: AAG
tgaaggcaaatatggaggag

SEQ ID NO: 13475 - DNA, 20 bp, Artificial Sequence
  Description of Artificial Sequence: Synthetic oligonucleotide
  Target: SCN10A; (-) strand; PAM type: NRG; PAM sequence: GAG
ctctgaaggcaaatatggag

SEQ ID NO: 13476 - DNA, 20 bp, Artificial Sequence
  Description of Artificial Sequence: Synthetic oligonucleotide
  Target: SCN10A; (-) strand; PAM type: NRG; PAM sequence: AGG
ttctctgaaggcaaatatgg

SEQ ID NO: 13477 - DNA, 20 bp, Artificial Sequence
  Description of Artificial Sequence: Synthetic oligonucleotide
  Target: SCN10A; (-) strand; PAM type: NRG; PAM sequence: GAG
attctctgaaggcaaatatg

SEQ ID NO: 13478 - DNA, 20 bp, Artificial Sequence
  Description of Artificial Sequence: Synthetic oligonucleotide
  Target: SCN10A; (-) strand; PAM type: NRG; PAM sequence: TGG
ggattctctgaaggcaaata

SEQ ID NO: 13479 - DNA, 20 bp, Artificial Sequence
  Description of Artificial Sequence: Synthetic oligonucleotide
  Target: SCN10A; (-) strand; PAM type: NRG; PAM sequence: AGG
cggggagttggattctctga

SEQ ID NO: 13480 - DNA, 20 bp, Artificial Sequence
  Description of Artificial Sequence: Synthetic oligonucleotide
  Target: SCN10A; (-) strand; PAM type: NRG; PAM sequence: AAG
ccggggagttggattctctg

SEQ ID NO: 13481 - DNA, 20 bp, Artificial Sequence
  Description of Artificial Sequence: Synthetic oligonucleotide
  Target: SCN10A; (-) strand; PAM type: NRG; PAM sequence: TGG
cctaggagaatccggggagt

SEQ ID NO: 13482 - DNA, 20 bp, Artificial Sequence
  Description of Artificial Sequence: Synthetic oligonucleotide
  Target: SCN10A; (-) strand; PAM type: NRG; PAM sequence: GAG
atgtcctaggagaatccggg

SEQ ID NO: 13483 - DNA, 20 bp, Artificial Sequence
  Description of Artificial Sequence: Synthetic oligonucleotide
  Target: SCN10A; (-) strand; PAM type: NRG; PAM sequence: GGG
gaatgtcctaggagaatccg

SEQ ID NO: 13484 - DNA, 20 bp, Artificial Sequence
  Description of Artificial Sequence: Synthetic oligonucleotide
  Target: SCN10A; (-) strand; PAM type: NRG; PAM sequence: GGG
agaatgtcctaggagaatcc

SEQ ID NO: 13485 - DNA, 20 bp, Artificial Sequence
  Description of Artificial Sequence: Synthetic oligonucleotide
  Target: SCN10A; (-) strand; PAM type: NRG; PAM sequence: CGG
aagaatgtcctaggagaatc

SEQ ID NO: 13486 - DNA, 20 bp, Artificial Sequence
  Description of Artificial Sequence: Synthetic oligonucleotide
  Target: SCN10A; (-) strand; PAM type: NRG; PAM sequence: GAG
tttcaccaagaatgtcctag

SEQ ID NO: 13487 - DNA, 20 bp, Artificial Sequence
  Description of Artificial Sequence: Synthetic oligonucleotide
  Target: SCN10A; (-) strand; PAM type: NRG; PAM sequence: AGG
gctttcaccaagaatgtcct

SEQ ID NO: 13488 - DNA, 20 bp, Artificial Sequence
  Description of Artificial Sequence: Synthetic oligonucleotide
  Target: SCN10A; (-) strand; PAM type: NRG; PAM sequence: TAG
tgctttcaccaagaatgtcc

SEQ ID NO: 13489 - DNA, 20 bp, Artificial Sequence
  Description of Artificial Sequence: Synthetic oligonucleotide
  Target: SCN10A; (-) strand; PAM type: NRG; PAM sequence: AAG
acatcctttttgctttcacc

SEQ ID NO: 13490 - DNA, 20 bp, Artificial Sequence
  Description of Artificial Sequence: Synthetic oligonucleotide
  Target: SCN10A; (-) strand; PAM type: NRG; PAM sequence: TGG
tggagataagatccactgct

SEQ ID NO: 13491 - DNA, 20 bp, Artificial Sequence
  Description of Artificial Sequence: Synthetic oligonucleotide
  Target: SCN10A; (-) strand; PAM type: NRG; PAM sequence: AAG
tgcctttggtccctggagat

SEQ ID NO: 13492 - DNA, 20 bp, Artificial Sequence
  Description of Artificial Sequence: Synthetic oligonucleotide
  Target: SCN10A; (-) strand; PAM type: NRG; PAM sequence: GAG
ggacctgcctttggtccctg

SEQ ID NO: 13493 - DNA, 20 bp, Artificial Sequence
  Description of Artificial Sequence: Synthetic oligonucleotide
  Target: SCN10A; (-) strand; PAM type: NRG; PAM sequence: TGG
atggacctgcctttggtccc

SEQ ID NO: 13494 - DNA, 20 bp, Artificial Sequence
  Description of Artificial Sequence: Synthetic oligonucleotide
  Target: SCN10A; (-) strand; PAM type: NRG; PAM sequence: TGG
gatccagatggacctgcctt

SEQ ID NO: 13495 - DNA, 20 bp, Artificial Sequence
  Description of Artificial Sequence: Synthetic oligonucleotide
  Target: SCN10A; (-) strand; PAM type: NRG; PAM sequence: TGG
tcgaaatatactgatccaga

SEQ ID NO: 13496 - DNA, 20 bp, Artificial Sequence
  Description of Artificial Sequence: Synthetic oligonucleotide
  Target: SCN10A; (-) strand; PAM type: NRG; PAM sequence: CAG
ccaatcgaaatatactgatc

SEQ ID NO: 13497 - DNA, 20 bp, Artificial Sequence
  Description of Artificial Sequence: Synthetic oligonucleotide
  Target: SCN10A; (-) strand; PAM type: NRG; PAM sequence: GAG
gacactctctctggtcccct

SEQ ID NO: 13498 - DNA, 20 bp, Artificial Sequence
  Description of Artificial Sequence: Synthetic oligonucleotide
  Target: SCN10A; (-) strand; PAM type: NRG; PAM sequence: TGG
gactttgcagacactctctc

SEQ ID NO: 13499 - DNA, 20 bp, Artificial Sequence
  Description of Artificial Sequence: Synthetic oligonucleotide
  Target: SCN10A; (-) strand; PAM type: NRG; PAM sequence: CAG
ttctgctctctcggactttg

SEQ ID NO: 13500 - DNA, 20 bp, Artificial Sequence
  Description of Artificial Sequence: Synthetic oligonucleotide
  Target: SCN10A; (-) strand; PAM type: NRG; PAM sequence: CGG
tattaccttttctgctctct

SEQ ID NO: 13501 - DNA, 20 bp, Artificial Sequence
  Description of Artificial Sequence: Synthetic oligonucleotide
  Target: SCN10A; (-) strand; PAM type: NRG; PAM sequence: CAG
agtttgacccagaggccact

SEQ ID NO: 13502 - DNA, 20 bp, Artificial Sequence
  Description of Artificial Sequence: Synthetic oligonucleotide
  Target: SCN10A; (-) strand; PAM type: NRG; PAM sequence: AGG
ctgggagaagtttgacccag

SEQ ID NO: 13503 - DNA, 20 bp, Artificial Sequence
  Description of Artificial Sequence: Synthetic oligonucleotide
  Target: SCN10A; (-) strand; PAM type: NRG; PAM sequence: GAG
cctgggagaagtttgaccca

SEQ ID NO: 13504 - DNA, 20 bp, Artificial Sequence
  Description of Artificial Sequence: Synthetic oligonucleotide
  Target: SCN10A; (-) strand; PAM type: NRG; PAM sequence: CAG
gacctgggagaagtttgacc

SEQ ID NO: 13505 - DNA, 20 bp, Artificial Sequence
  Description of Artificial Sequence: Synthetic oligonucleotide
  Target: SCN10A; (-) strand; PAM type: NRG; PAM sequence: AAG
tgttctatgagacctgggag

SEQ ID NO: 13506 - DNA, 20 bp, Artificial Sequence
  Description of Artificial Sequence: Synthetic oligonucleotide
  Target: SCN10A; (-) strand; PAM type: NRG; PAM sequence: GAG
acatgttctatgagacctgg

SEQ ID NO: 13507 - DNA, 20 bp, Artificial Sequence
  Description of Artificial Sequence: Synthetic oligonucleotide
  Target: SCN10A; (-) strand; PAM type: NRG; PAM sequence: GGG
tgacatgttctatgagacct

SEQ ID NO: 13508 - DNA, 20 bp, Artificial Sequence
  Description of Artificial Sequence: Synthetic oligonucleotide
  Target: SCN10A; (-) strand; PAM type: NRG; PAM sequence: TGG
ttgacatgttctatgagacc

SEQ ID NO: 13509 - DNA, 20 bp, Artificial Sequence
  Description of Artificial Sequence: Synthetic oligonucleotide
  Target: SCN10A; (-) strand; PAM type: NRG; PAM sequence: GAG
acgactttgacatgttctat

SEQ ID NO: 13510 - DNA, 20 bp, Artificial Sequence
  Description of Artificial Sequence: Synthetic oligonucleotide
  Target: SCN10A; (-) strand; PAM type: NRG; PAM sequence: AGG
gagcactgagcccctgagtg

SEQ ID NO: 13511 - DNA, 20 bp, Artificial Sequence
  Description of Artificial Sequence: Synthetic oligonucleotide
  Target: SCN10A; (-) strand; PAM type: NRG; PAM sequence: GAG
agagcactgagcccctgagt

SEQ ID NO: 13512 - DNA, 20 bp, Artificial Sequence
  Description of Artificial Sequence: Synthetic oligonucleotide
  Target: SCN10A; (-) strand; PAM type: NRG; PAM sequence: GAG
gaggagagcactgagcccct

SEQ ID NO: 13513 - DNA, 20 bp, Artificial Sequence
  Description of Artificial Sequence: Synthetic oligonucleotide
  Target: SCN10A; (-) strand; PAM type: NRG; PAM sequence: GAG
tggccacggaggagagcact

SEQ ID NO: 13514 - DNA, 20 bp, Artificial Sequence
  Description of Artificial Sequence: Synthetic oligonucleotide
  Target: SCN10A; (-) strand; PAM type: NRG; PAM sequence: GAG
ttcaatgtggccacggagga

SEQ ID NO: 13515 - DNA, 20 bp, Artificial Sequence
  Description of Artificial Sequence: Synthetic oligonucleotide
  Target: SCN10A; (-) strand; PAM type: NRG; PAM sequence: GAG
acttcaatgtggccacggag

SEQ ID NO: 13516 - DNA, 20 bp, Artificial Sequence
  Description of Artificial Sequence: Synthetic oligonucleotide
  Target: SCN10A; (-) strand; PAM type: NRG; PAM sequence: AGG
gaacttcaatgtggccacgg

SEQ ID NO: 13517 - DNA, 20 bp, Artificial Sequence
  Description of Artificial Sequence: Synthetic oligonucleotide
  Target: SCN10A; (-) strand; PAM type: NRG; PAM sequence: GAG
agaacttcaatgtggccacg

SEQ ID NO: 13518 - DNA, 20 bp, Artificial Sequence
  Description of Artificial Sequence: Synthetic oligonucleotide
  Target: SCN10A; (-) strand; PAM type: NRG; PAM sequence: CGG
ggagaacttcaatgtggcca

SEQ ID NO: 13519 - DNA, 20 bp, Artificial Sequence
  Description of Artificial Sequence: Synthetic oligonucleotide
  Target: SCN10A; (-) strand; PAM type: NRG; PAM sequence: TGG
gattctggagaacttcaatg

SEQ ID NO: 13520 - DNA, 20 bp, Artificial Sequence
  Description of Artificial Sequence: Synthetic oligonucleotide
  Target: SCN10A; (-) strand; PAM type: NRG; PAM sequence: GAG
tgtacattgcagtgattctg

SEQ ID NO: 13521 - DNA, 20 bp, Artificial Sequence
  Description of Artificial Sequence: Synthetic oligonucleotide
  Target: SCN10A; (-) strand; PAM type: NRG; PAM sequence: TGG
catgtacattgcagtgattc

SEQ ID NO: 13522 - DNA, 20 bp, Artificial Sequence
  Description of Artificial Sequence: Synthetic oligonucleotide
  Target: SCN10A; (-) strand; PAM type: NRG; PAM sequence: CAG
catggtcaacatgtacattg

SEQ ID NO: 13523 - DNA, 20 bp, Artificial Sequence
  Description of Artificial Sequence: Synthetic oligonucleotide
  Target: SCN10A; (-) strand; PAM type: NRG; PAM sequence: TGG
catcatctccttcctcatca

SEQ ID NO: 13524 - DNA, 20 bp, Artificial Sequence
  Description of Artificial Sequence: Synthetic oligonucleotide
  Target: SCN10A; (-) strand; PAM type: NRG; PAM sequence: AGG
gactgtgggagcccagccgt

SEQ ID NO: 13525 - DNA, 20 bp, Artificial Sequence
  Description of Artificial Sequence: Synthetic oligonucleotide
  Target: SCN10A; (-) strand; PAM type: NRG; PAM sequence: TAG
ggactgtgggagcccagccg

SEQ ID NO: 13526 - DNA, 20 bp, Artificial Sequence
  Description of Artificial Sequence: Synthetic oligonucleotide
  Target: SCN10A; (-) strand; PAM type: NRG; PAM sequence: CAG
cagaggggactgtgggagcc

SEQ ID NO: 13527 - DNA, 20 bp, Artificial Sequence
  Description of Artificial Sequence: Synthetic oligonucleotide
  Target: SCN10A; (-) strand; PAM type: NRG; PAM sequence: GAG
ggcaccagaggggactgtgg

SEQ ID NO: 13528 - DNA, 20 bp, Artificial Sequence
  Description of Artificial Sequence: Synthetic oligonucleotide
  Target: SCN10A; (-) strand; PAM type: NRG; PAM sequence: GGG
atggcaccagaggggactgt

SEQ ID NO: 13529 - DNA, 20 bp, Artificial Sequence
  Description of Artificial Sequence: Synthetic oligonucleotide
  Target: SCN10A; (-) strand; PAM type: NRG; PAM sequence: TGG
aatggcaccagaggggactg

SEQ ID NO: 13530 - DNA, 20 bp, Artificial Sequence
  Description of Artificial Sequence: Synthetic oligonucleotide
  Target: SCN10A; (-) strand; PAM type: NRG; PAM sequence: GGG
caacagcaatggcaccagag

SEQ ID NO: 13531 - DNA, 20 bp, Artificial Sequence
  Description of Artificial Sequence: Synthetic oligonucleotide
  Target: SCN10A; (-) strand; PAM type: NRG; PAM sequence: GGG
ccaacagcaatggcaccaga

SEQ ID NO: 13532 - DNA, 20 bp, Artificial Sequence
  Description of Artificial Sequence: Synthetic oligonucleotide
  Target: SCN10A; (-) strand; PAM type: NRG; PAM sequence: AGG
cccaacagcaatggcaccag

SEQ ID NO: 13533 - DNA, 20 bp, Artificial Sequence
  Description of Artificial Sequence: Synthetic oligonucleotide
  Target: SCN10A; (-) strand; PAM type: NRG; PAM sequence: GAG
gcccaacagcaatggcacca

SEQ ID NO: 13534 - DNA, 20 bp, Artificial Sequence
  Description of Artificial Sequence: Synthetic oligonucleotide
  Target: SCN10A; (-) strand; PAM type: NRG; PAM sequence: CAG
ctgcccaacagcaatggcac

SEQ ID NO: 13535 - DNA, 20 bp, Artificial Sequence
  Description of Artificial Sequence: Synthetic oligonucleotide
  Target: SCN10A; (-) strand; PAM type: NRG; PAM sequence: TGG
cccaatctgcccaacagcaa

SEQ ID NO: 13536 - DNA, 20 bp, Artificial Sequence
  Description of Artificial Sequence: Synthetic oligonucleotide
  Target: SCN10A; (-) strand; PAM type: NRG; PAM sequence: CAG
tgtgaccccaatctgcccaa

SEQ ID NO: 13537 - DNA, 20 bp, Artificial Sequence
  Description of Artificial Sequence: Synthetic oligonucleotide
  Target: SCN10A; (-) strand; PAM type: NRG; PAM sequence: GGG
tcagccccatcctcaacaca

SEQ ID NO: 13538 - DNA, 20 bp, Artificial Sequence
  Description of Artificial Sequence: Synthetic oligonucleotide
  Target: SCN10A; (-) strand; PAM type: NRG; PAM sequence: AGG
ctcagccccatcctcaacac

SEQ ID NO: 13539 - DNA, 20 bp, Artificial Sequence
  Description of Artificial Sequence: Synthetic oligonucleotide
  Target: SCN10A; (-) strand; PAM type: NRG; PAM sequence: CAG
cctcagccccatcctcaaca

SEQ ID NO: 13540 - DNA, 20 bp, Artificial Sequence
  Description of Artificial Sequence: Synthetic oligonucleotide
  Target: SCN10A; (-) strand; PAM type: NRG; PAM sequence: CAG
gccggctgggatggcctcct

SEQ ID NO: 13541 - DNA, 20 bp, Artificial Sequence
  Description of Artificial Sequence: Synthetic oligonucleotide
  Target: SCN10A; (-) strand; PAM type: NRG; PAM sequence: TGG
accacgtcggccggctggga

SEQ ID NO: 13542 - DNA, 20 bp, Artificial Sequence
  Description of Artificial Sequence: Synthetic oligonucleotide
  Target: SCN10A; (-) strand; PAM type: NRG; PAM sequence: GGG
gattaccacgtcggccggct

SEQ ID NO: 13543 - DNA, 20 bp, Artificial Sequence
  Description of Artificial Sequence: Synthetic oligonucleotide
  Target: SCN10A; (-) strand; PAM type: NRG; PAM sequence: TGG
agattaccacgtcggccggc

SEQ ID NO: 13544 - DNA, 20 bp, Artificial Sequence
  Description of Artificial Sequence: Synthetic oligonucleotide
  Target: SCN10A; (-) strand; PAM type: NRG; PAM sequence: CGG
ttccagattaccacgtcggc

SEQ ID NO: 13545 - DNA, 20 bp, Artificial Sequence
  Description of Artificial Sequence: Synthetic oligonucleotide
  Target: SCN10A; (-) strand; PAM type: NRG; PAM sequence: CGG
cctcttccagattaccacgt

SEQ ID NO: 13546 - DNA, 20 bp, Artificial Sequence
  Description of Artificial Sequence: Synthetic oligonucleotide
  Target: SCN10A; (-) strand; PAM type: NRG; PAM sequence: CAG
acagcatgctgtgcctcttc

SEQ ID NO: 13547 - DNA, 20 bp, Artificial Sequence
  Description of Artificial Sequence: Synthetic oligonucleotide
  Target: SCN10A; (-) strand; PAM type: NRG; PAM sequence: CAG
aacttccagaccttcgccaa

SEQ ID NO: 13548 - DNA, 20 bp, Artificial Sequence
  Description of Artificial Sequence: Synthetic oligonucleotide
  Target: SCN10A; (-) strand; PAM type: NRG; PAM sequence: CAG
tcgacgacatgttcaacttc

SEQ ID NO: 13549 - DNA, 20 bp, Artificial Sequence
  Description of Artificial Sequence: Synthetic oligonucleotide
  Target: SCN10A; (-) strand; PAM type: NRG; PAM sequence: TGG
ccccatgtgaggtgggaggc

SEQ ID NO: 13550 - DNA, 20 bp, Artificial Sequence
  Description of Artificial Sequence: Synthetic oligonucleotide
  Target: SCN10A; (-) strand; PAM type: NRG; PAM sequence: AGG
ctttccccatgtgaggtggg

SEQ ID NO: 13551 - DNA, 20 bp, Artificial Sequence
  Description of Artificial Sequence: Synthetic oligonucleotide
  Target: SCN10A; (-) strand; PAM type: NRG; PAM sequence: GAG
gctttccccatgtgaggtgg

SEQ ID NO: 13552 - DNA, 20 bp, Artificial Sequence
  Description of Artificial Sequence: Synthetic oligonucleotide
  Target: SCN10A; (-) strand; PAM type: NRG; PAM sequence: GGG
cagctttccccatgtgaggt

SEQ ID NO: 13553 - DNA, 20 bp, Artificial Sequence
  Description of Artificial Sequence: Synthetic oligonucleotide
  Target: SCN10A; (-) strand; PAM type: NRG; PAM sequence: TGG
ccagctttccccatgtgagg

SEQ ID NO: 13554 - DNA, 20 bp, Artificial Sequence
  Description of Artificial Sequence: Synthetic oligonucleotide
  Target: SCN10A; (-) strand; PAM type: NRG; PAM sequence: AGG
tgtccagctttccccatgtg

SEQ ID NO: 13555 - DNA, 20 bp, Artificial Sequence
  Description of Artificial Sequence: Synthetic oligonucleotide
  Target: SCN10A; (-) strand; PAM type: NRG; PAM sequence: GAG
atgtccagctttccccatgt

SEQ ID NO: 13556 - DNA, 20 bp, Artificial Sequence
  Description of Artificial Sequence: Synthetic oligonucleotide
  Target: SCN10A; (-) strand; PAM type: NRG; PAM sequence: CAG
tactctatcttcggtatgtc

SEQ ID NO: 13557 - DNA, 20 bp, Artificial Sequence
  Description of Artificial Sequence: Synthetic oligonucleotide
  Target: SCN10A; (-) strand; PAM type: NRG; PAM sequence: CGG
atgttcatctactctatctt

SEQ ID NO: 13558 - DNA, 20 bp, Artificial Sequence
  Description of Artificial Sequence: Synthetic oligonucleotide
  Target: SCN10A; (-) strand; PAM type: NRG; PAM sequence: GGG
tgcctgccctcttcaacatc

SEQ ID NO: 13559 - DNA, 20 bp, Artificial Sequence
  Description of Artificial Sequence: Synthetic oligonucleotide
  Target: SCN10A; (-) strand; PAM type: NRG; PAM sequence: CGG
ctgcctgccctcttcaacat

SEQ ID NO: 13560 - DNA, 20 bp, Artificial Sequence
  Description of Artificial Sequence: Synthetic oligonucleotide
  Target: SCN10A; (-) strand; PAM type: NRG; PAM sequence: GGG
gactgatccgagcggccaag

SEQ ID NO: 13561 - DNA, 20 bp, Artificial Sequence
  Description of Artificial Sequence: Synthetic oligonucleotide
  Target: SCN10A; (-) strand; PAM type: NRG; PAM sequence: GGG
agactgatccgagcggccaa

SEQ ID NO: 13562 - DNA, 20 bp, Artificial Sequence
  Description of Artificial Sequence: Synthetic oligonucleotide
  Target: SCN10A; (-) strand; PAM type: NRG; PAM sequence: AGG
cagactgatccgagcggcca

SEQ ID NO: 13563 - DNA, 20 bp, Artificial Sequence
  Description of Artificial Sequence: Synthetic oligonucleotide
  Target: SCN10A; (-) strand; PAM type: NRG; PAM sequence: AAG
tcagactgatccgagcggcc

SEQ ID NO: 13564 - DNA, 20 bp, Artificial Sequence
  Description of Artificial Sequence: Synthetic oligonucleotide
  Target: SCN10A; (-) strand; PAM type: NRG; PAM sequence: CGG
catcctcagactgatccgag

SEQ ID NO: 13565 - DNA, 20 bp, Artificial Sequence
  Description of Artificial Sequence: Synthetic oligonucleotide
  Target: SCN10A; (-) strand; PAM type: NRG; PAM sequence: GAG
ccgcatcctcagactgatcc

SEQ ID NO: 13566 - DNA, 20 bp, Artificial Sequence
  Description of Artificial Sequence: Synthetic oligonucleotide
  Target: SCN10A; (-) strand; PAM type: NRG; PAM sequence: CAG
gcccgaattggccgcatcct

SEQ ID NO: 13567 - DNA, 20 bp, Artificial Sequence
  Description of Artificial Sequence: Synthetic oligonucleotide
  Target: SCN10A; (-) strand; PAM type: NRG; PAM sequence: TGG
gtcatccgcctggcccgaat

SEQ ID NO: 13568 - DNA, 20 bp, Artificial Sequence
  Description of Artificial Sequence: Synthetic oligonucleotide
  Target: SCN10A; (-) strand; PAM type: NRG; PAM sequence: TGG
gctcttcagagtcatccgcc

SEQ ID NO: 13569 - DNA, 20 bp, Artificial Sequence
  Description of Artificial Sequence: Synthetic oligonucleotide
  Target: SCN10A; (-) strand; PAM type: NRG; PAM sequence: GAG
cttctccccaacgctcttca

SEQ ID NO: 13570 - DNA, 20 bp, Artificial Sequence
  Description of Artificial Sequence: Synthetic oligonucleotide
  Target: SCN10A; (-) strand; PAM type: NRG; PAM sequence: CAG
tacttctccccaacgctctt

SEQ ID NO: 13571 - DNA, 20 bp, Artificial Sequence
  Description of Artificial Sequence: Synthetic oligonucleotide
  Target: SCN10A; (-) strand; PAM type: NRG; PAM sequence: AAG
gcaattcttaagtcacttca

SEQ ID NO: 13572 - DNA, 20 bp, Artificial Sequence
  Description of Artificial Sequence: Synthetic oligonucleotide
  Target: SCN10A; (-) strand; PAM type: NRG; PAM sequence: AAG
tgattttttctgcaattctt

SEQ ID NO: 13573 - DNA, 20 bp, Artificial Sequence
  Description of Artificial Sequence: Synthetic oligonucleotide
  Target: SCN10A; (-) strand; PAM type: NRG; PAM sequence: AGG
taatttcttccttcttttaa

SEQ ID NO: 13574 - DNA, 20 bp, Artificial Sequence
  Description of Artificial Sequence: Synthetic oligonucleotide
  Target: SCN10A; (-) strand; PAM type: NRG; PAM sequence: AAG
ataatttcttccttctttta

SEQ ID NO: 13575 - DNA, 20 bp, Artificial Sequence
  Description of Artificial Sequence: Synthetic oligonucleotide
  Target: SCN10A; (-) strand; PAM type: NRG; PAM sequence: TAG
tcatggctggagatactaat

SEQ ID NO: 13576 - DNA, 20 bp, Artificial Sequence
  Description of Artificial Sequence: Synthetic oligonucleotide
  Target: SCN10A; (-) strand; PAM type: NRG; PAM sequence: GAG
tttgtcacgtctcatggctg

SEQ ID NO: 13577 - DNA, 20 bp, Artificial Sequence
  Description of Artificial Sequence: Synthetic oligonucleotide
  Target: SCN10A; (-) strand; PAM type: NRG; PAM sequence: TGG
actttgtcacgtctcatggc

SEQ ID NO: 13578 - DNA, 20 bp, Artificial Sequence
  Description of Artificial Sequence: Synthetic oligonucleotide
  Target: SCN10A; (-) strand; PAM type: NRG; PAM sequence: TGG
gccaactttgtcacgtctca

SEQ ID NO: 13579 - DNA, 20 bp, Artificial Sequence
  Description of Artificial Sequence: Synthetic oligonucleotide
  Target: SCN10A; (-) strand; PAM type: NRG; PAM sequence: CAG
agcaaagcagagtgtcatca

SEQ ID NO: 13580 - DNA, 20 bp, Artificial Sequence
  Description of Artificial Sequence: Synthetic oligonucleotide
  Target: SCN10A; (-) strand; PAM type: NRG; PAM sequence: GAG
agtctataccaagcaaagca

SEQ ID NO: 13581 - DNA, 20 bp, Artificial Sequence
  Description of Artificial Sequence: Synthetic oligonucleotide
  Target: SCN10A; (-) strand; PAM type: NRG; PAM sequence: CAG
gcagtctataccaagcaaag

SEQ ID NO: 13582 - DNA, 20 bp, Artificial Sequence
  Description of Artificial Sequence: Synthetic oligonucleotide
  Target: SCN10A; (-) strand; PAM type: NRG; PAM sequence: AAG
gtggcagtctataccaagca

SEQ ID NO: 13583 - DNA, 20 bp, Artificial Sequence
  Description of Artificial Sequence: Synthetic oligonucleotide
  Target: SCN10A; (-) strand; PAM type: NRG; PAM sequence: AAG
cccaagtggcagtctatacc

SEQ ID NO: 13584 - DNA, 20 bp, Artificial Sequence
  Description of Artificial Sequence: Synthetic oligonucleotide
  Target: SCN10A; (-) strand; PAM type: NRG; PAM sequence: CAG
aaatgtggatgcccaagtgg

SEQ ID NO: 13585 - DNA, 20 bp, Artificial Sequence
  Description of Artificial Sequence: Synthetic oligonucleotide
  Target: SCN10A; (-) strand; PAM type: NRG; PAM sequence: TGG
ctcaaatgtggatgcccaag

SEQ ID NO: 13586 - DNA, 20 bp, Artificial Sequence
  Description of Artificial Sequence: Synthetic oligonucleotide
  Target: SCN10A; (-) strand; PAM type: NRG; PAM sequence: AAG
gtcctcaaatgtggatgccc

SEQ ID NO: 13587 - DNA, 20 bp, Artificial Sequence
  Description of Artificial Sequence: Synthetic oligonucleotide
  Target: SCN10A; (-) strand; PAM type: NRG; PAM sequence: TGG
gggcccagagtcctcaaatg

SEQ ID NO: 13588 - DNA, 20 bp, Artificial Sequence
  Description of Artificial Sequence: Synthetic oligonucleotide
  Target: SCN10A; (-) strand; PAM type: NRG; PAM sequence: GAG
tgccaggctctgagggccca

SEQ ID NO: 13589 - DNA, 20 bp, Artificial Sequence
  Description of Artificial Sequence: Synthetic oligonucleotide
  Target: SCN10A; (-) strand; PAM type: NRG; PAM sequence: CAG
catgccaggctctgagggcc

SEQ ID NO: 13590 - DNA, 20 bp, Artificial Sequence
  Description of Artificial Sequence: Synthetic oligonucleotide
  Target: SCN10A; (-) strand; PAM type: NRG; PAM sequence: GGG
cctaccatgccaggctctga

SEQ ID NO: 13591 - DNA, 20 bp, Artificial Sequence
  Description of Artificial Sequence: Synthetic oligonucleotide
  Target: SCN10A; (-) strand; PAM type: NRG; PAM sequence: AGG
acctaccatgccaggctctg

SEQ ID NO: 13592 - DNA, 20 bp, Artificial Sequence
  Description of Artificial Sequence: Synthetic oligonucleotide
  Target: SCN10A; (-) strand; PAM type: NRG; PAM sequence: GAG
tacctaccatgccaggctct

SEQ ID NO: 13593 - DNA, 20 bp, Artificial Sequence
  Description of Artificial Sequence: Synthetic oligonucleotide
  Target: SCN10A; (-) strand; PAM type: NRG; PAM sequence: AGG
tttgtgctacctaccatgcc

SEQ ID NO: 13594 - DNA, 20 bp, Artificial Sequence
  Description of Artificial Sequence: Synthetic oligonucleotide
  Target: SCN10A; (-) strand; PAM type: NRG; PAM sequence: CAG
ctttgtgctacctaccatgc

SEQ ID NO: 13595 - DNA, 20 bp, Artificial Sequence
  Description of Artificial Sequence: Synthetic oligonucleotide
  Target: SCN10A; (-) strand; PAM type: NRG; PAM sequence: GAG
ttatgcaatgggcatttact

SEQ ID NO: 13596 - DNA, 20 bp, Artificial Sequence
  Description of Artificial Sequence: Synthetic oligonucleotide
  Target: SCN10A; (-) strand; PAM type: NRG; PAM sequence: GGG
gaagagaggacttatgcaat

SEQ ID NO: 13597 - DNA, 20 bp, Artificial Sequence
  Description of Artificial Sequence: Synthetic oligonucleotide
  Target: SCN10A; (-) strand; PAM type: NRG; PAM sequence: TGG
ggaagagaggacttatgcaa

SEQ ID NO: 13598 - DNA, 20 bp, Artificial Sequence
  Description of Artificial Sequence: Synthetic oligonucleotide
  Target: SCN10A; (-) strand; PAM type: NRG; PAM sequence: AGG
gtaagacggaggaggaagag

SEQ ID NO: 13599 - DNA, 20 bp, Artificial Sequence
  Description of Artificial Sequence: Synthetic oligonucleotide
  Target: SCN10A; (-) strand; PAM type: NRG; PAM sequence: GAG
ggtaagacggaggaggaaga

SEQ ID NO: 13600 - DNA, 20 bp, Artificial Sequence
  Description of Artificial Sequence: Synthetic oligonucleotide
  Target: SCN10A; (-) strand; PAM type: NRG; PAM sequence: GAG
agggtaagacggaggaggaa

SEQ ID NO: 13601 - DNA, 20 bp, Artificial Sequence
  Description of Artificial Sequence: Synthetic oligonucleotide
  Target: SCN10A; (-) strand; PAM type: NRG; PAM sequence: AAG
gaagggtaagacggaggagg

SEQ ID NO: 13602 - DNA, 20 bp, Artificial Sequence
  Description of Artificial Sequence: Synthetic oligonucleotide
  Target: SCN10A; (-) strand; PAM type: NRG; PAM sequence: AGG
taggaagggtaagacggagg

SEQ ID NO: 13603 - DNA, 20 bp, Artificial Sequence
  Description of Artificial Sequence: Synthetic oligonucleotide
  Target: SCN10A; (-) strand; PAM type: NRG; PAM sequence: GAG
gtaggaagggtaagacggag

SEQ ID NO: 13604 - DNA, 20 bp, Artificial Sequence
  Description of Artificial Sequence: Synthetic oligonucleotide
  Target: SCN10A; (-) strand; PAM type: NRG; PAM sequence: AGG
tggtaggaagggtaagacgg

SEQ ID NO: 13605 - DNA, 20 bp, Artificial Sequence
  Description of Artificial Sequence: Synthetic oligonucleotide
  Target: SCN10A; (-) strand; PAM type: NRG; PAM sequence: GAG
atggtaggaagggtaagacg

SEQ ID NO: 13606 - DNA, 20 bp, Artificial Sequence
  Description of Artificial Sequence: Synthetic oligonucleotide
  Target: SCN10A; (-) strand; PAM type: NRG; PAM sequence: CGG
acatggtaggaagggtaaga

SEQ ID NO: 13607 - DNA, 20 bp, Artificial Sequence
  Description of Artificial Sequence: Synthetic oligonucleotide
  Target: SCN10A; (-) strand; PAM type: NRG; PAM sequence: AAG
gataacatggtaggaagggt

SEQ ID NO: 13608 - DNA, 20 bp, Artificial Sequence
  Description of Artificial Sequence: Synthetic oligonucleotide
  Target: SCN10A; (-) strand; PAM type: NRG; PAM sequence: GGG
caaagataacatggtaggaa

SEQ ID NO: 13609 - DNA, 20 bp, Artificial Sequence
  Description of Artificial Sequence: Synthetic oligonucleotide
  Target: SCN10A; (-) strand; PAM type: NRG; PAM sequence: AGG
gcaaagataacatggtagga

SEQ ID NO: 13610 - DNA, 20 bp, Artificial Sequence
  Description of Artificial Sequence: Synthetic oligonucleotide
  Target: SCN10A; (-) strand; PAM type: NRG; PAM sequence: AAG
ggcaaagataacatggtagg

SEQ ID NO: 13611 - DNA, 20 bp, Artificial Sequence
  Description of Artificial Sequence: Synthetic oligonucleotide
  Target: SCN10A; (-) strand; PAM type: NRG; PAM sequence: AGG
ggaggcaaagataacatggt

SEQ ID NO: 13612 - DNA, 20 bp, Artificial Sequence
  Description of Artificial Sequence: Synthetic oligonucleotide
  Target: SCN10A; (-) strand; PAM type: NRG; PAM sequence: TAG
cggaggcaaagataacatgg

SEQ ID NO: 13613 - DNA, 20 bp, Artificial Sequence
  Description of Artificial Sequence: Synthetic oligonucleotide
  Target: SCN10A; (-) strand; PAM type: NRG; PAM sequence: TGG
aggcggaggcaaagataaca

SEQ ID NO: 13614 - DNA, 20 bp, Artificial Sequence
  Description of Artificial Sequence: Synthetic oligonucleotide
  Target: SCN10A; (-) strand; PAM type: NRG; PAM sequence: AAG
ggatattctaggcggaggca

SEQ ID NO: 13615 - DNA, 20 bp, Artificial Sequence
  Description of Artificial Sequence: Synthetic oligonucleotide
  Target: SCN10A; (-) strand; PAM type: NRG; PAM sequence: AGG
caagaggatattctaggcgg

SEQ ID NO: 13616 - DNA, 20 bp, Artificial Sequence
  Description of Artificial Sequence: Synthetic oligonucleotide
  Target: SCN10A; (-) strand; PAM type: NRG; PAM sequence: GAG
ccaagaggatattctaggcg

SEQ ID NO: 13617 - DNA, 20 bp, Artificial Sequence
  Description of Artificial Sequence: Synthetic oligonucleotide
  Target: SCN10A; (-) strand; PAM type: NRG; PAM sequence: CGG
gaccaagaggatattctagg

SEQ ID NO: 13618 - DNA, 20 bp, Artificial Sequence
  Description of Artificial Sequence: Synthetic oligonucleotide
  Target: SCN10A; (-) strand; PAM type: NRG; PAM sequence: AGG
gttgaccaagaggatattct

SEQ ID NO: 13619 - DNA, 20 bp, Artificial Sequence
  Description of Artificial Sequence: Synthetic oligonucleotide
  Target: SCN10A; (-) strand; PAM type: NRG; PAM sequence: TAG
ggttgaccaagaggatattc

SEQ ID NO: 13620 - DNA, 20 bp, Artificial Sequence
  Description of Artificial Sequence: Synthetic oligonucleotide
  Target: SCN10A; (-) strand; PAM type: NRG; PAM sequence: AGG
gactgtggaggttgaccaag

SEQ ID NO: 13621 - DNA, 20 bp, Artificial Sequence
  Description of Artificial Sequence: Synthetic oligonucleotide
  Target: SCN10A; (-) strand; PAM type: NRG; PAM sequence: GAG
tgactgtggaggttgaccaa

SEQ ID NO: 13622 - DNA, 20 bp, Artificial Sequence
  Description of Artificial Sequence: Synthetic oligonucleotide
  Target: SCN10A; (-) strand; PAM type: NRG; PAM sequence: AAG
tttgactgtggaggttgacc

SEQ ID NO: 13623 - DNA, 20 bp, Artificial Sequence
  Description of Artificial Sequence: Synthetic oligonucleotide
  Target: SCN10A; (-) strand; PAM type: NRG; PAM sequence: AGG
agataagtttttgactgtgg

SEQ ID NO: 13624 - DNA, 20 bp, Artificial Sequence
  Description of Artificial Sequence: Synthetic oligonucleotide
  Target: SCN10A; (-) strand; PAM type: NRG; PAM sequence: GAG
aagataagtttttgactgtg

SEQ ID NO: 13625 - DNA, 20 bp, Artificial Sequence
  Description of Artificial Sequence: Synthetic oligonucleotide
  Target: SCN10A; (-) strand; PAM type: NRG; PAM sequence: TGG
agaagataagtttttgactg

SEQ ID NO: 13626 - DNA, 20 bp, Artificial Sequence
  Description of Artificial Sequence: Synthetic oligonucleotide
  Target: SCN10A; (-) strand; PAM type: NRG; PAM sequence: AAG
tgaacttggctgcagaagat

SEQ ID NO: 13627 - DNA, 20 bp, Artificial Sequence
  Description of Artificial Sequence: Synthetic oligonucleotide
  Target: SCN10A; (-) strand; PAM type: NRG; PAM sequence: AAG
ccagctgaacttggctgcag

SEQ ID NO: 13628 - DNA, 20 bp, Artificial Sequence
  Description of Artificial Sequence: Synthetic oligonucleotide
  Target: SCN10A; (-) strand; PAM type: NRG; PAM sequence: CAG
cttccagctgaacttggctg

SEQ ID NO: 13629 - DNA, 20 bp, Artificial Sequence
  Description of Artificial Sequence: Synthetic oligonucleotide
  Target: SCN10A; (-) strand; PAM type: NRG; PAM sequence: TGG
cagtcacttccagctgaact

SEQ ID NO: 13630 - DNA, 20 bp, Artificial Sequence
  Description of Artificial Sequence: Synthetic oligonucleotide
  Target: SCN10A; (-) strand; PAM type: NRG; PAM sequence: CAG
gaataaactgcagtcacttc

SEQ ID NO: 13631 - DNA, 20 bp, Artificial Sequence
  Description of Artificial Sequence: Synthetic oligonucleotide
  Target: SCN10A; (-) strand; PAM type: NRG; PAM sequence: CAG
tgagcctgtggaataaactg

SEQ ID NO: 13632 - DNA, 20 bp, Artificial Sequence
  Description of Artificial Sequence: Synthetic oligonucleotide
  Target: SCN10A; (-) strand; PAM type: NRG; PAM sequence: TGG
ggccaaagactgtgagcctg

SEQ ID NO: 13633 - DNA, 20 bp, Artificial Sequence
  Description of Artificial Sequence: Synthetic oligonucleotide
  Target: SCN10A; (-) strand; PAM type: NRG; PAM sequence: GAG
aaaaacaggccaaagactgt

SEQ ID NO: 13634 - DNA, 20 bp, Artificial Sequence
  Description of Artificial Sequence: Synthetic oligonucleotide
  Target: SCN10A; (-) strand; PAM type: NRG; PAM sequence: AAG
tcataggaaaaaacaggcca

SEQ ID NO: 13635 - DNA, 20 bp, Artificial Sequence
  Description of Artificial Sequence: Synthetic oligonucleotide
  Target: SCN10A; (-) strand; PAM type: NRG; PAM sequence: AGG
tctgtgtcataggaaaaaac

SEQ ID NO: 13636 - DNA, 20 bp, Artificial Sequence
  Description of Artificial Sequence: Synthetic oligonucleotide
  Target: SCN10A; (-) strand; PAM type: NRG; PAM sequence: CAG
gtctgtgtcataggaaaaaa

SEQ ID NO: 13637 - DNA, 20 bp, Artificial Sequence
  Description of Artificial Sequence: Synthetic oligonucleotide
  Target: SCN10A; (-) strand; PAM type: NRG; PAM sequence: AGG
aggagcagggtctgtgtcat

SEQ ID NO: 13638 - DNA, 20 bp, Artificial Sequence
  Description of Artificial Sequence: Synthetic oligonucleotide
  Target: SCN10A; (-) strand; PAM type: NRG; PAM sequence: TAG
gaggagcagggtctgtgtca

SEQ ID NO: 13639 - DNA, 20 bp, Artificial Sequence
  Description of Artificial Sequence: Synthetic oligonucleotide
  Target: SCN10A; (-) strand; PAM type: NRG; PAM sequence: GGG
tgcagtatcagggaggagca

SEQ ID NO: 13640 - DNA, 20 bp, Artificial Sequence
  Description of Artificial Sequence: Synthetic oligonucleotide
  Target: SCN10A; (-) strand; PAM type: NRG; PAM sequence: AGG
ctgcagtatcagggaggagc

SEQ ID NO: 13641 - DNA, 20 bp, Artificial Sequence
  Description of Artificial Sequence: Synthetic oligonucleotide
  Target: SCN10A; (-) strand; PAM type: NRG; PAM sequence: CAG
gctgcagtatcagggaggag

SEQ ID NO: 13642 - DNA, 20 bp, Artificial Sequence
  Description of Artificial Sequence: Synthetic oligonucleotide
  Target: SCN10A; (-) strand; PAM type: NRG; PAM sequence: GAG
aaggctgcagtatcagggag

SEQ ID NO: 13643 - DNA, 20 bp, Artificial Sequence
  Description of Artificial Sequence: Synthetic oligonucleotide
  Target: SCN10A; (-) strand; PAM type: NRG; PAM sequence: AGG
caaaggctgcagtatcaggg

SEQ ID NO: 13644 - DNA, 20 bp, Artificial Sequence
  Description of Artificial Sequence: Synthetic oligonucleotide
  Target: SCN10A; (-) strand; PAM type: NRG; PAM sequence: GAG
ccaaaggctgcagtatcagg

SEQ ID NO: 13645 - DNA, 20 bp, Artificial Sequence
  Description of Artificial Sequence: Synthetic oligonucleotide
  Target: SCN10A; (-) strand; PAM type: NRG; PAM sequence: GGG
acccaaaggctgcagtatca

SEQ ID NO: 13646 - DNA, 20 bp, Artificial Sequence
  Description of Artificial Sequence: Synthetic oligonucleotide
  Target: SCN10A; (-) strand; PAM type: NRG; PAM sequence: AGG
gacccaaaggctgcagtatc

SEQ ID NO: 13647 - DNA, 20 bp, Artificial Sequence
  Description of Artificial Sequence: Synthetic oligonucleotide
  Target: SCN10A; (-) strand; PAM type: NRG; PAM sequence: CAG
tgacccaaaggctgcagtat

SEQ ID NO: 13648 - DNA, 20 bp, Artificial Sequence
  Description of Artificial Sequence: Synthetic oligonucleotide
  Target: SCN10A; (-) strand; PAM type: NRG; PAM sequence: CAG
agggcatgacccaaaggctg

SEQ ID NO: 13649 - DNA, 20 bp, Artificial Sequence
  Description of Artificial Sequence: Synthetic oligonucleotide
  Target: SCN10A; (-) strand; PAM type: NRG; PAM sequence: AGG
gaggaaagggcatgacccaa

SEQ ID NO: 13650 - DNA, 20 bp, Artificial Sequence
  Description of Artificial Sequence: Synthetic oligonucleotide
  Target: SCN10A; (-) strand; PAM type: NRG; PAM sequence: AAG
ggaggaaagggcatgaccca

SEQ ID NO: 13651 - DNA, 20 bp, Artificial Sequence
  Description of Artificial Sequence: Synthetic oligonucleotide
  Target: SCN10A; (-) strand; PAM type: NRG; PAM sequence: GGG
caggaccagggtggaggaaa

SEQ ID NO: 13652 - DNA, 20 bp, Artificial Sequence
  Description of Artificial Sequence: Synthetic oligonucleotide
  Target: SCN10A; (-) strand; PAM type: NRG; PAM sequence: AGG
acaggaccagggtggaggaa

SEQ ID NO: 13653 - DNA, 20 bp, Artificial Sequence
  Description of Artificial Sequence: Synthetic oligonucleotide
  Target: SCN10A; (-) strand; PAM type: NRG; PAM sequence: AAG
cacaggaccagggtggagga

SEQ ID NO: 13654 - DNA, 20 bp, Artificial Sequence
  Description of Artificial Sequence: Synthetic oligonucleotide
  Target: SCN10A; (-) strand; PAM type: NRG; PAM sequence: AGG
agagcacaggaccagggtgg

SEQ ID NO: 13655 - DNA, 20 bp, Artificial Sequence
  Description of Artificial Sequence: Synthetic oligonucleotide
  Target: SCN10A; (-) strand; PAM type: NRG; PAM sequence: GAG
cagagcacaggaccagggtg

SEQ ID NO: 13656 - DNA, 20 bp, Artificial Sequence
  Description of Artificial Sequence: Synthetic oligonucleotide
  Target: SCN10A; (-) strand; PAM type: NRG; PAM sequence: TGG
cacagagcacaggaccaggg

SEQ ID NO: 13657 - DNA, 20 bp, Artificial Sequence
  Description of Artificial Sequence: Synthetic oligonucleotide
  Target: SCN10A; (-) strand; PAM type: NRG; PAM sequence: GGG
cttcacagagcacaggacca

SEQ ID NO: 13658 - DNA, 20 bp, Artificial Sequence
  Description of Artificial Sequence: Synthetic oligonucleotide
  Target: SCN10A; (-) strand; PAM type: NRG; PAM sequence: AGG
ccttcacagagcacaggacc

SEQ ID NO: 13659 - DNA, 20 bp, Artificial Sequence
  Description of Artificial Sequence: Synthetic oligonucleotide
  Target: SCN10A; (-) strand; PAM type: NRG; PAM sequence: CAG
gccttcacagagcacaggac

SEQ ID NO: 13660 - DNA, 20 bp, Artificial Sequence
  Description of Artificial Sequence: Synthetic oligonucleotide
  Target: SCN10A; (-) strand; PAM type: NRG; PAM sequence: AGG
tcctggccttcacagagcac

SEQ ID NO: 13661 - DNA, 20 bp, Artificial Sequence
  Description of Artificial Sequence: Synthetic oligonucleotide
  Target: SCN10A; (-) strand; PAM type: NRG; PAM sequence: CAG
gtcctggccttcacagagca

SEQ ID NO: 13662 - DNA, 20 bp, Artificial Sequence
  Description of Artificial Sequence: Synthetic oligonucleotide
  Target: SCN10A; (-) strand; PAM type: NRG; PAM sequence: GAG
aaggggtcctggccttcaca

SEQ ID NO: 13663 - DNA, 20 bp, Artificial Sequence
  Description of Artificial Sequence: Synthetic oligonucleotide
  Target: SCN10A; (-) strand; PAM type: NRG; PAM sequence: CAG
ataaggggtcctggccttca

SEQ ID NO: 13664 - DNA, 20 bp, Artificial Sequence
  Description of Artificial Sequence: Synthetic oligonucleotide
  Target: SCN10A; (-) strand; PAM type: NRG; PAM sequence: TGG
agaggaatcataaggggtcc

SEQ ID NO: 13665 - DNA, 20 bp, Artificial Sequence
  Description of Artificial Sequence: Synthetic oligonucleotide
  Target: SCN10A; (-) strand; PAM type: NRG; PAM sequence: GGG
gtagggagaggaatcataag

SEQ ID NO: 13666 - DNA, 20 bp, Artificial Sequence
  Description of Artificial Sequence: Synthetic oligonucleotide
  Target: SCN10A; (-) strand; PAM type: NRG; PAM sequence: GGG
ggtagggagaggaatcataa

SEQ ID NO: 13667 - DNA, 20 bp, Artificial Sequence
  Description of Artificial Sequence: Synthetic oligonucleotide
  Target: SCN10A; (-) strand; PAM type: NRG; PAM sequence: AGG
aggtagggagaggaatcata

SEQ ID NO: 13668 - DNA, 20 bp, Artificial Sequence
  Description of Artificial Sequence: Synthetic oligonucleotide
  Target: SCN10A; (-) strand; PAM type: NRG; PAM sequence: AAG
gaggtagggagaggaatcat

SEQ ID NO: 13669 - DNA, 20 bp, Artificial Sequence
  Description of Artificial Sequence: Synthetic oligonucleotide
  Target: SCN10A; (-) strand; PAM type: NRG; PAM sequence: AGG
tcacagtaggaggtagggag

SEQ ID NO: 13670 - DNA, 20 bp, Artificial Sequence
  Description of Artificial Sequence: Synthetic oligonucleotide
  Target: SCN10A; (-) strand; PAM type: NRG; PAM sequence: GAG
ttcacagtaggaggtaggga

SEQ ID NO: 13671 - DNA, 20 bp, Artificial Sequence
  Description of Artificial Sequence: Synthetic oligonucleotide
  Target: SCN10A; (-) strand; PAM type: NRG; PAM sequence: GAG
tcttcacagtaggaggtagg

SEQ ID NO: 13672 - DNA, 20 bp, Artificial Sequence
  Description of Artificial Sequence: Synthetic oligonucleotide
  Target: SCN10A; (-) strand; PAM type: NRG; PAM sequence: GGG
aatcttcacagtaggaggta

SEQ ID NO: 13673 - DNA, 20 bp, Artificial Sequence
  Description of Artificial Sequence: Synthetic oligonucleotide
  Target: SCN10A; (-) strand; PAM type: NRG; PAM sequence: AGG
caatcttcacagtaggaggt

SEQ ID NO: 13674 - DNA, 20 bp, Artificial Sequence
  Description of Artificial Sequence: Synthetic oligonucleotide
  Target: SCN10A; (-) strand; PAM type: NRG; PAM sequence: TAG
tcaatcttcacagtaggagg

SEQ ID NO: 13675 - DNA, 20 bp, Artificial Sequence
  Description of Artificial Sequence: Synthetic oligonucleotide
  Target: SCN10A; (-) strand; PAM type: NRG; PAM sequence: AGG
gagtcaatcttcacagtagg

SEQ ID NO: 13676 - DNA, 20 bp, Artificial Sequence
  Description of Artificial Sequence: Synthetic oligonucleotide
  Target: SCN10A; (-) strand; PAM type: NRG; PAM sequence: GAG
agagtcaatcttcacagtag

SEQ ID NO: 13677 - DNA, 20 bp, Artificial Sequence
  Description of Artificial Sequence: Synthetic oligonucleotide
  Target: SCN10A; (-) strand; PAM type: NRG; PAM sequence: AGG
acagagtcaatcttcacagt

SEQ ID NO: 13678 - DNA, 20 bp, Artificial Sequence
  Description of Artificial Sequence: Synthetic oligonucleotide
  Target: SCN10A; (-) strand; PAM type: NRG; PAM sequence: TAG
aacagagtcaatcttcacag

SEQ ID NO: 13679 - DNA, 20 bp, Artificial Sequence
  Description of Artificial Sequence: Synthetic oligonucleotide
  Target: SCN10A; (-) strand; PAM type: NRG; PAM sequence: CAG
agaaacagagtcaatcttca

SEQ ID NO: 13680 - DNA, 20 bp, Artificial Sequence
  Description of Artificial Sequence: Synthetic oligonucleotide
  Target: SCN10A; (-) strand; PAM type: NRG; PAM sequence: GAG
aggaccgggtgccagaaaca

SEQ ID NO: 13681 - DNA, 20 bp, Artificial Sequence
  Description of Artificial Sequence: Synthetic oligonucleotide
  Target: SCN10A; (-) strand; PAM type: NRG; PAM sequence: CAG
acaggaccgggtgccagaaa

SEQ ID NO: 13682 - DNA, 20 bp, Artificial Sequence
  Description of Artificial Sequence: Synthetic oligonucleotide
  Target: SCN10A; (-) strand; PAM type: NRG; PAM sequence: CAG
ttagccacaggaccgggtgc

SEQ ID NO: 13683 - DNA, 20 bp, Artificial Sequence
  Description of Artificial Sequence: Synthetic oligonucleotide
  Target: SCN10A; (-) strand; PAM type: NRG; PAM sequence: GGG
gtacaattagccacaggacc

SEQ ID NO: 13684 - DNA, 20 bp, Artificial Sequence
  Description of Artificial Sequence: Synthetic oligonucleotide
  Target: SCN10A; (-) strand; PAM type: NRG; PAM sequence: CGG
cgtacaattagccacaggac

SEQ ID NO: 13685 - DNA, 20 bp, Artificial Sequence
  Description of Artificial Sequence: Synthetic oligonucleotide
  Target: SCN10A; (-) strand; PAM type: NRG; PAM sequence: AGG
ggctccgtacaattagccac

SEQ ID NO: 13686 - DNA, 20 bp, Artificial Sequence
  Description of Artificial Sequence: Synthetic oligonucleotide
  Target: SCN10A; (-) strand; PAM type: NRG; PAM sequence: CAG
aggctccgtacaattagcca

SEQ ID NO: 13687 - DNA, 20 bp, Artificial Sequence
  Description of Artificial Sequence: Synthetic oligonucleotide
  Target: SCN10A; (-) strand; PAM type: NRG; PAM sequence: TAG
aacaccaggctccgtacaat

SEQ ID NO: 13688 - DNA, 20 bp, Artificial Sequence
  Description of Artificial Sequence: Synthetic oligonucleotide
  Target: SCN10A; (-) strand; PAM type: NRG; PAM sequence: AGG
gcccccttgtaattaacacc

SEQ ID NO: 13689 - DNA, 20 bp, Artificial Sequence
  Description of Artificial Sequence: Synthetic oligonucleotide
  Target: SCN10A; (-) strand; PAM type: NRG; PAM sequence: CAG
ggcccccttgtaattaacac

SEQ ID NO: 13690 - DNA, 20 bp, Artificial Sequence
  Description of Artificial Sequence: Synthetic oligonucleotide
  Target: SCN10A; (-) strand; PAM type: NRG; PAM sequence: AGG
agccagttgcccgaatcctc

SEQ ID NO: 13691 - DNA, 20 bp, Artificial Sequence
  Description of Artificial Sequence: Synthetic oligonucleotide
  Target: SCN10A; (-) strand; PAM type: NRG; PAM sequence: CAG
cagccagttgcccgaatcct

SEQ ID NO: 13692 - DNA, 20 bp, Artificial Sequence
  Description of Artificial Sequence: Synthetic oligonucleotide
  Target: SCN10A; (-) strand; PAM type: NRG; PAM sequence: CAG
cttatgctttagctgtcagc

SEQ ID NO: 13693 - DNA, 20 bp, Artificial Sequence
  Description of Artificial Sequence: Synthetic oligonucleotide
  Target: SCN10A; (-) strand; PAM type: NRG; PAM sequence: CAG
atcccttatgctttagctgt

SEQ ID NO: 13694 - DNA, 20 bp, Artificial Sequence
  Description of Artificial Sequence: Synthetic oligonucleotide
  Target: SCN10A; (-) strand; PAM type: NRG; PAM sequence: TAG
cattcaaatcccttatgctt

SEQ ID NO: 13695 - DNA, 20 bp, Artificial Sequence
  Description of Artificial Sequence: Synthetic oligonucleotide
  Target: SCN10A; (-) strand; PAM type: NRG; PAM sequence: TGG
taaggcattgtgcagacagc

SEQ ID NO: 13696 - DNA, 20 bp, Artificial Sequence
  Description of Artificial Sequence: Synthetic oligonucleotide
  Target: SCN10A; (-) strand; PAM type: NRG; PAM sequence: CAG
aaattaaggcattgtgcaga

SEQ ID NO: 13697 - DNA, 20 bp, Artificial Sequence
  Description of Artificial Sequence: Synthetic oligonucleotide
  Target: SCN10A; (-) strand; PAM type: NRG; PAM sequence: CAG
aaacaaattaaggcattgtg

SEQ ID NO: 13698 - DNA, 20 bp, Artificial Sequence
  Description of Artificial Sequence: Synthetic oligonucleotide
  Target: SCN10A; (-) strand; PAM type: NRG; PAM sequence: AGG
aaaaaaaaaaaaacaaatta

SEQ ID NO: 13699 - DNA, 20 bp, Artificial Sequence
  Description of Artificial Sequence: Synthetic oligonucleotide
  Target: SCN10A; (-) strand; PAM type: NRG; PAM sequence: AAG
aaaaaaaaaaaaaacaaatt

SEQ ID NO: 13700 - DNA, 20 bp, Artificial Sequence
  Description of Artificial Sequence: Synthetic oligonucleotide
  Target: SCN10A; (-) strand; PAM type: NRG; PAM sequence: TGG
acataaagttcaaaaacagc

SEQ ID NO: 13701 - DNA, 20 bp, Artificial Sequence
  Description of Artificial Sequence: Synthetic oligonucleotide
  Target: SCN10A; (-) strand; PAM type: NRG; PAM sequence: CAG
cctaacataaagttcaaaaa

SEQ ID NO: 13702 - DNA, 20 bp, Artificial Sequence
  Description of Artificial Sequence: Synthetic oligonucleotide
  Target: SCN10A; (-) strand; PAM type: NRG; PAM sequence: AAG
tatctccaggccctaacata

SEQ ID NO: 13703 - DNA, 20 bp, Artificial Sequence
  Description of Artificial Sequence: Synthetic oligonucleotide
  Target: SCN10A; (-) strand; PAM type: NRG; PAM sequence: AGG
ccccaaaaaaacctatctcc

SEQ ID NO: 13704 - DNA, 20 bp, Artificial Sequence
  Description of Artificial Sequence: Synthetic oligonucleotide
  Target: SCN10A; (-) strand; PAM type: NRG; PAM sequence: CAG
cccccaaaaaaacctatctc

SEQ ID NO: 13705 - DNA, 20 bp, Artificial Sequence
  Description of Artificial Sequence: Synthetic oligonucleotide
  Target: SCN10A; (-) strand; PAM type: NRG; PAM sequence: CAG
ttcatagttggagttggggg

SEQ ID NO: 13706 - DNA, 20 bp, Artificial Sequence
  Description of Artificial Sequence: Synthetic oligonucleotide
  Target: SCN10A; (-) strand; PAM type: NRG; PAM sequence: GGG
ttgttcatagttggagttgg

SEQ ID NO: 13707 - DNA, 20 bp, Artificial Sequence
  Description of Artificial Sequence: Synthetic oligonucleotide
  Target: SCN10A; (-) strand; PAM type: NRG; PAM sequence: GGG
tttgttcatagttggagttg

SEQ ID NO: 13708 - DNA, 20 bp, Artificial Sequence
  Description of Artificial Sequence: Synthetic oligonucleotide
  Target: SCN10A; (-) strand; PAM type: NRG; PAM sequence: GGG
ctttgttcatagttggagtt

SEQ ID NO: 13709 - DNA, 20 bp, Artificial Sequence
  Description of Artificial Sequence: Synthetic oligonucleotide
  Target: SCN10A; (-) strand; PAM type: NRG; PAM sequence: TGG
actttgttcatagttggagt

SEQ ID NO: 13710 - DNA, 20 bp, Artificial Sequence
  Description of Artificial Sequence: Synthetic oligonucleotide
  Target: SCN10A; (-) strand; PAM type: NRG; PAM sequence: GAG
tccaactttgttcatagttg

SEQ ID NO: 13711 - DNA, 20 bp, Artificial Sequence
  Description of Artificial Sequence: Synthetic oligonucleotide
  Target: SCN10A; (-) strand; PAM type: NRG; PAM sequence: TGG
tttccaactttgttcatagt

SEQ ID NO: 13712 - DNA, 20 bp, Artificial Sequence
  Description of Artificial Sequence: Synthetic oligonucleotide
  Target: SCN10A; (-) strand; PAM type: NRG; PAM sequence: TAG
tatatttccaactttgttca

SEQ ID NO: 13713 - DNA, 20 bp, Artificial Sequence
  Description of Artificial Sequence: Synthetic oligonucleotide
  Target: SCN10A; (-) strand; PAM type: NRG; PAM sequence: GGG
caagttagacatcatataga

SEQ ID NO: 13714 - DNA, 20 bp, Artificial Sequence
  Description of Artificial Sequence: Synthetic oligonucleotide
  Target: SCN10A; (-) strand; PAM type: NRG; PAM sequence: AGG
tcaagttagacatcatatag

SEQ ID NO: 13715 - DNA, 20 bp, Artificial Sequence
  Description of Artificial Sequence: Synthetic oligonucleotide
  Target: SCN10A; (-) strand; PAM type: NRG; PAM sequence: GAG
ttcaagttagacatcatata

SEQ ID NO: 13716 - DNA, 20 bp, Artificial Sequence
  Description of Artificial Sequence: Synthetic oligonucleotide
  Target: SCN10A; (-) strand; PAM type: NRG; PAM sequence: TAG
tcttcaagttagacatcata

SEQ ID NO: 13717 - DNA, 20 bp, Artificial Sequence
  Description of Artificial Sequence: Synthetic oligonucleotide
  Target: SCN10A; (-) strand; PAM type: NRG; PAM sequence: TAG
aaaatcaaacatcttcaagt

SEQ ID NO: 13718 - DNA, 20 bp, Artificial Sequence
  Description of Artificial Sequence: Synthetic oligonucleotide
  Target: SCN10A; (-) strand; PAM type: NRG; PAM sequence: AAG
accaaaaatcaaacatcttc

SEQ ID NO: 13719 - DNA, 20 bp, Artificial Sequence
  Description of Artificial Sequence: Synthetic oligonucleotide
  Target: SCN10A; (-) strand; PAM type: NRG; PAM sequence: AAG
ataaggctccccaggtcccc

SEQ ID NO: 13720 - DNA, 20 bp, Artificial Sequence
  Description of Artificial Sequence: Synthetic oligonucleotide
  Target: SCN10A; (-) strand; PAM type: NRG; PAM sequence: AGG
tggtacaaataaggctcccc

SEQ ID NO: 13721 - DNA, 20 bp, Artificial Sequence
  Description of Artificial Sequence: Synthetic oligonucleotide
  Target: SCN10A; (-) strand; PAM type: NRG; PAM sequence: CAG
ttggtacaaataaggctccc

SEQ ID NO: 13722 - DNA, 20 bp, Artificial Sequence
  Description of Artificial Sequence: Synthetic oligonucleotide
  Target: SCN10A; (-) strand; PAM type: NRG; PAM sequence: AGG
ggaggcctttggtacaaata

SEQ ID NO: 13723 - DNA, 20 bp, Artificial Sequence
  Description of Artificial Sequence: Synthetic oligonucleotide
  Target: SCN10A; (-) strand; PAM type: NRG; PAM sequence: AAG
tggaggcctttggtacaaat

SEQ ID NO: 13724 - DNA, 20 bp, Artificial Sequence
  Description of Artificial Sequence: Synthetic oligonucleotide
  Target: SCN10A; (-) strand; PAM type: NRG; PAM sequence: TGG
tcatctttggtggaggcctt

SEQ ID NO: 13725 - DNA, 20 bp, Artificial Sequence
  Description of Artificial Sequence: Synthetic oligonucleotide
  Target: SCN10A; (-) strand; PAM type: NRG; PAM sequence: AGG
ccttgcctcatctttggtgg

SEQ ID NO: 13726 - DNA, 20 bp, Artificial Sequence
  Description of Artificial Sequence: Synthetic oligonucleotide
  Target: SCN10A; (-) strand; PAM type: NRG; PAM sequence: GAG
gccttgcctcatctttggtg

SEQ ID NO: 13727 - DNA, 20 bp, Artificial Sequence
  Description of Artificial Sequence: Synthetic oligonucleotide
  Target: SCN10A; (-) strand; PAM type: NRG; PAM sequence: TGG
aggccttgcctcatctttgg

SEQ ID NO: 13728 - DNA, 20 bp, Artificial Sequence
  Description of Artificial Sequence: Synthetic oligonucleotide
  Target: SCN10A; (-) strand; PAM type: NRG; PAM sequence: TGG
taaaggccttgcctcatctt

SEQ ID NO: 13729 - DNA, 20 bp, Artificial Sequence
  Description of Artificial Sequence: Synthetic oligonucleotide
  Target: SCN10A; (-) strand; PAM type: NRG; PAM sequence: AGG
ttgaaccctctcttacctaa

SEQ ID NO: 13730 - DNA, 20 bp, Artificial Sequence
  Description of Artificial Sequence: Synthetic oligonucleotide
  Target: SCN10A; (-) strand; PAM type: NRG; PAM sequence: AAG
gttgaaccctctcttaccta

SEQ ID NO: 13731 - DNA, 20 bp, Artificial Sequence
  Description of Artificial Sequence: Synthetic oligonucleotide
  Target: SCN10A; (-) strand; PAM type: NRG; PAM sequence: GAG
tccctcaccatttttcctgt

SEQ ID NO: 13732 - DNA, 20 bp, Artificial Sequence
  Description of Artificial Sequence: Synthetic oligonucleotide
  Target: SCN10A; (-) strand; PAM type: NRG; PAM sequence: GAG
gggaacctggcaaggagcga

SEQ ID NO: 13733 - DNA, 20 bp, Artificial Sequence
  Description of Artificial Sequence: Synthetic oligonucleotide
  Target: SCN10A; (-) strand; PAM type: NRG; PAM sequence: GAG
cagggaacctggcaaggagc

SEQ ID NO: 13734 - DNA, 20 bp, Artificial Sequence
  Description of Artificial Sequence: Synthetic oligonucleotide
  Target: SCN10A; (-) strand; PAM type: NRG; PAM sequence: GAG
ggcccagggaacctggcaag

SEQ ID NO: 13735 - DNA, 20 bp, Artificial Sequence
  Description of Artificial Sequence: Synthetic oligonucleotide
  Target: SCN10A; (-) strand; PAM type: NRG; PAM sequence: AGG
agggcccagggaacctggca

SEQ ID NO: 13736 - DNA, 20 bp, Artificial Sequence
  Description of Artificial Sequence: Synthetic oligonucleotide
  Target: SCN10A; (-) strand; PAM type: NRG; PAM sequence: AAG
gagggcccagggaacctggc

SEQ ID NO: 13737 - DNA, 20 bp, Artificial Sequence
  Description of Artificial Sequence: Synthetic oligonucleotide
  Target: SCN10A; (-) strand; PAM type: NRG; PAM sequence: TGG
gggagagggcccagggaacc

SEQ ID NO: 13738 - DNA, 20 bp, Artificial Sequence
  Description of Artificial Sequence: Synthetic oligonucleotide
  Target: SCN10A; (-) strand; PAM type: NRG; PAM sequence: GGG
caagtaggggagagggccca

SEQ ID NO: 13739 - DNA, 20 bp, Artificial Sequence
  Description of Artificial Sequence: Synthetic oligonucleotide
  Target: SCN10A; (-) strand; PAM type: NRG; PAM sequence: AGG
gcaagtaggggagagggccc

SEQ ID NO: 13740 - DNA, 20 bp, Artificial Sequence
  Description of Artificial Sequence: Synthetic oligonucleotide
  Target: SCN10A; (-) strand; PAM type: NRG; PAM sequence: CAG
agcaagtaggggagagggcc

SEQ ID NO: 13741 - DNA, 20 bp, Artificial Sequence
  Description of Artificial Sequence: Synthetic oligonucleotide
  Target: SCN10A; (-) strand; PAM type: NRG; PAM sequence: GGG
caaagagcaagtaggggaga

SEQ ID NO: 13742 - DNA, 20 bp, Artificial Sequence
  Description of Artificial Sequence: Synthetic oligonucleotide
  Target: SCN10A; (-) strand; PAM type: NRG; PAM sequence: AGG
acaaagagcaagtaggggag

SEQ ID NO: 13743 - DNA, 20 bp, Artificial Sequence
  Description of Artificial Sequence: Synthetic oligonucleotide
  Target: SCN10A; (-) strand; PAM type: NRG; PAM sequence: GAG
aacaaagagcaagtagggga

SEQ ID NO: 13744 - DNA, 20 bp, Artificial Sequence
  Description of Artificial Sequence: Synthetic oligonucleotide
  Target: SCN10A; (-) strand; PAM type: NRG; PAM sequence: GAG
acaacaaagagcaagtaggg

SEQ ID NO: 13745 - DNA, 20 bp, Artificial Sequence
  Description of Artificial Sequence: Synthetic oligonucleotide
  Target: SCN10A; (-) strand; PAM type: NRG; PAM sequence: GGG
taacaacaaagagcaagtag

SEQ ID NO: 13746 - DNA, 20 bp, Artificial Sequence
  Description of Artificial Sequence: Synthetic oligonucleotide
  Target: SCN10A; (-) strand; PAM type: NRG; PAM sequence: GGG
ataacaacaaagagcaagta

SEQ ID NO: 13747 - DNA, 20 bp, Artificial Sequence
  Description of Artificial Sequence: Synthetic oligonucleotide
  Target: SCN10A; (-) strand; PAM type: NRG; PAM sequence: AGG
cataacaacaaagagcaagt

SEQ ID NO: 13748 - DNA, 20 bp, Artificial Sequence
  Description of Artificial Sequence: Synthetic oligonucleotide
  Target: SCN10A; (-) strand; PAM type: NRG; PAM sequence: TAG
gcataacaacaaagagcaag

SEQ ID NO: 13749 - DNA, 20 bp, Artificial Sequence
  Description of Artificial Sequence: Synthetic oligonucleotide
  Target: SCN10A; (-) strand; PAM type: NRG; PAM sequence: AAG
tgtgcataacaacaaagagc

SEQ ID NO: 13750 - DNA, 20 bp, Artificial Sequence
  Description of Artificial Sequence: Synthetic oligonucleotide
  Target: SCN10A; (-) strand; PAM type: NRG; PAM sequence: GAG
cccatgtgcataacaacaaa

SEQ ID NO: 13751 - DNA, 20 bp, Artificial Sequence
  Description of Artificial Sequence: Synthetic oligonucleotide
  Target: SCN10A; (-) strand; PAM type: NRG; PAM sequence: AAG
gacccatgtgcataacaaca

SEQ ID NO: 13752 - DNA, 20 bp, Artificial Sequence
  Description of Artificial Sequence: Synthetic oligonucleotide
  Target: SCN10A; (-) strand; PAM type: NRG; PAM sequence: AAG
caaaattataattatttccc

SEQ ID NO: 13753 - DNA, 20 bp, Artificial Sequence
  Description of Artificial Sequence: Synthetic oligonucleotide
  Target: SCN10A; (-) strand; PAM type: NRG; PAM sequence: AAG
ttcacagaaggtcttccaca

SEQ ID NO: 13754 - DNA, 20 bp, Artificial Sequence
  Description of Artificial Sequence: Synthetic oligonucleotide
  Target: SCN10A; (-) strand; PAM type: NRG; PAM sequence: AGG
ttaaactggaaattcacaga

SEQ ID NO: 13755 - DNA, 20 bp, Artificial Sequence
  Description of Artificial Sequence: Synthetic oligonucleotide
  Target: SCN10A; (-) strand; PAM type: NRG; PAM sequence: AAG
gttaaactggaaattcacag

SEQ ID NO: 13756 - DNA, 20 bp, Artificial Sequence
  Description of Artificial Sequence: Synthetic oligonucleotide
  Target: SCN10A; (-) strand; PAM type: NRG; PAM sequence: CAG
ctagttaaactggaaattca

SEQ ID NO: 13757 - DNA, 20 bp, Artificial Sequence
  Description of Artificial Sequence: Synthetic oligonucleotide
  Target: SCN10A; (-) strand; PAM type: NRG; PAM sequence: TGG
ggaacatgtcctagttaaac

SEQ ID NO: 13758 - DNA, 20 bp, Artificial Sequence
  Description of Artificial Sequence: Synthetic oligonucleotide
  Target: SCN10A; (-) strand; PAM type: NRG; PAM sequence: TAG
tacacgatgggaacatgtcc

SEQ ID NO: 13759 - DNA, 20 bp, Artificial Sequence
  Description of Artificial Sequence: Synthetic oligonucleotide
  Target: SCN10A; (-) strand; PAM type: NRG; PAM sequence: GGG
aataatgtaccctacacgat

SEQ ID NO: 13760 - DNA, 20 bp, Artificial Sequence
  Description of Artificial Sequence: Synthetic oligonucleotide
  Target: SCN10A; (-) strand; PAM type: NRG; PAM sequence: TGG
aaataatgtaccctacacga

SEQ ID NO: 13761 - DNA, 20 bp, Artificial Sequence
  Description of Artificial Sequence: Synthetic oligonucleotide
  Target: SCN10A; (-) strand; PAM type: NRG; PAM sequence: TAG
gaaaattttaccagagtatg

SEQ ID NO: 13762 - DNA, 20 bp, Artificial Sequence
  Description of Artificial Sequence: Synthetic oligonucleotide
  Target: SCN10A; (-) strand; PAM type: NRG; PAM sequence: GAG
tctggcagaaaattttacca

SEQ ID NO: 13763 - DNA, 20 bp, Artificial Sequence
  Description of Artificial Sequence: Synthetic oligonucleotide
  Target: SCN10A; (-) strand; PAM type: NRG; PAM sequence: CAG
tgtctggcagaaaattttac

SEQ ID NO: 13764 - DNA, 20 bp, Artificial Sequence
  Description of Artificial Sequence: Synthetic oligonucleotide
  Target: SCN10A; (-) strand; PAM type: NRG; PAM sequence: CAG
gctgtagaccagttgtctgg

SEQ ID NO: 13765 - DNA, 20 bp, Artificial Sequence
  Description of Artificial Sequence: Synthetic oligonucleotide
  Target: SCN10A; (-) strand; PAM type: NRG; PAM sequence: TGG
tgtgctgtagaccagttgtc

SEQ ID NO: 13766 - DNA, 20 bp, Artificial Sequence
  Description of Artificial Sequence: Synthetic oligonucleotide
  Target: SCN10A; (-) strand; PAM type: NRG; PAM sequence: CAG
aattaaaatgtgctgtagac

SEQ ID NO: 13767 - DNA, 20 bp, Artificial Sequence
  Description of Artificial Sequence: Synthetic oligonucleotide
  Target: SCN10A; (-) strand; PAM type: NRG; PAM sequence: TAG
gagcaaattaaaatgtgctg

SEQ ID NO: 13768 - DNA, 20 bp, Artificial Sequence
  Description of Artificial Sequence: Synthetic oligonucleotide
  Target: SCN10A; (-) strand; PAM type: NRG; PAM sequence: GAG
tcccttaaaataagatcctg

SEQ ID NO: 13769 - DNA, 20 bp, Artificial Sequence
  Description of Artificial Sequence: Synthetic oligonucleotide
  Target: SCN10A; (-) strand; PAM type: NRG; PAM sequence: TGG
tctcccttaaaataagatcc

SEQ ID NO: 13770 - DNA, 20 bp, Artificial Sequence
  Description of Artificial Sequence: Synthetic oligonucleotide
  Target: SCN10A; (-) strand; PAM type: NRG; PAM sequence: AAG
gaaccattctcccttaaaat

SEQ ID NO: 13771 - DNA, 20 bp, Artificial Sequence
  Description of Artificial Sequence: Synthetic oligonucleotide
  Target: SCN10A; (-) strand; PAM type: NRG; PAM sequence: AGG
atctaattgttacaagtacg

SEQ ID NO: 13772 - DNA, 20 bp, Artificial Sequence
  Description of Artificial Sequence: Synthetic oligonucleotide
  Target: SCN10A; (-) strand; PAM type: NRG; PAM sequence: GAG
tatctaattgttacaagtac

SEQ ID NO: 13773 - DNA, 20 bp, Artificial Sequence
  Description of Artificial Sequence: Synthetic oligonucleotide
  Target: SCN10A; (-) strand; PAM type: NRG; PAM sequence: AAG
attgagtatctaattgttac

SEQ ID NO: 13774 - DNA, 20 bp, Artificial Sequence
  Description of Artificial Sequence: Synthetic oligonucleotide
  Target: SCN10A; (-) strand; PAM type: NRG; PAM sequence: GAG
cccaccaacaagaggtgatt

SEQ ID NO: 13775 - DNA, 20 bp, Artificial Sequence
  Description of Artificial Sequence: Synthetic oligonucleotide
  Target: SCN10A; (-) strand; PAM type: NRG; PAM sequence: AGG
tcttctttcccaccaacaag

SEQ ID NO: 13776 - DNA, 20 bp, Artificial Sequence
  Description of Artificial Sequence: Synthetic oligonucleotide
  Target: SCN10A; (-) strand; PAM type: NRG; PAM sequence: GAG
ttcttctttcccaccaacaa

SEQ ID NO: 13777 - DNA, 20 bp, Artificial Sequence
  Description of Artificial Sequence: Synthetic oligonucleotide
  Target: SCN10A; (-) strand; PAM type: NRG; PAM sequence: AAG
ctttcttctttcccaccaac

SEQ ID NO: 13778 - DNA, 20 bp, Artificial Sequence
  Description of Artificial Sequence: Synthetic oligonucleotide
  Target: SCN10A; (-) strand; PAM type: NRG; PAM sequence: CAG
ttatagagctggaaaataag

SEQ ID NO: 13779 - DNA, 20 bp, Artificial Sequence
  Description of Artificial Sequence: Synthetic oligonucleotide
  Target: SCN10A; (-) strand; PAM type: NRG; PAM sequence: AAG
cccttatagagctggaaaat

SEQ ID NO: 13780 - DNA, 20 bp, Artificial Sequence
  Description of Artificial Sequence: Synthetic oligonucleotide
  Target: SCN10A; (-) strand; PAM type: NRG; PAM sequence: TGG
gcaggaatcccttatagagc

SEQ ID NO: 13781 - DNA, 20 bp, Artificial Sequence
  Description of Artificial Sequence: Synthetic oligonucleotide
  Target: SCN10A; (-) strand; PAM type: NRG; PAM sequence: GAG
tggggcaggaatcccttata

SEQ ID NO: 13782 - DNA, 20 bp, Artificial Sequence
  Description of Artificial Sequence: Synthetic oligonucleotide
  Target: SCN10A; (-) strand; PAM type: NRG; PAM sequence: TAG
gctggggcaggaatccctta

SEQ ID NO: 13783 - DNA, 20 bp, Artificial Sequence
  Description of Artificial Sequence: Synthetic oligonucleotide
  Target: SCN10A; (-) strand; PAM type: NRG; PAM sequence: AGG
gtagcaccatccgctggggc

SEQ ID NO: 13784 - DNA, 20 bp, Artificial Sequence
  Description of Artificial Sequence: Synthetic oligonucleotide
  Target: SCN10A; (-) strand; PAM type: NRG; PAM sequence: CAG
ggtagcaccatccgctgggg

SEQ ID NO: 13785 - DNA, 20 bp, Artificial Sequence
  Description of Artificial Sequence: Synthetic oligonucleotide
  Target: SCN10A; (-) strand; PAM type: NRG; PAM sequence: GGG
cagggtagcaccatccgctg

SEQ ID NO: 13786 - DNA, 20 bp, Artificial Sequence
  Description of Artificial Sequence: Synthetic oligonucleotide
  Target: SCN10A; (-) strand; PAM type: NRG; PAM sequence: GGG
acagggtagcaccatccgct

SEQ ID NO: 13787 - DNA, 20 bp, Artificial Sequence
  Description of Artificial Sequence: Synthetic oligonucleotide
  Target: SCN10A; (-) strand; PAM type: NRG; PAM sequence: TGG
tacagggtagcaccatccgc

SEQ ID NO: 13788 - DNA, 20 bp, Artificial Sequence
  Description of Artificial Sequence: Synthetic oligonucleotide
  Target: SCN10A; (-) strand; PAM type: NRG; PAM sequence: TAG
agttcctgtggcttacaggg

SEQ ID NO: 13789 - DNA, 20 bp, Artificial Sequence
  Description of Artificial Sequence: Synthetic oligonucleotide
  Target: SCN10A; (-) strand; PAM type: NRG; PAM sequence: GGG
accagttcctgtggcttaca

SEQ ID NO: 13790 - DNA, 20 bp, Artificial Sequence
  Description of Artificial Sequence: Synthetic oligonucleotide
  Target: SCN10A; (-) strand; PAM type: NRG; PAM sequence: AGG
taccagttcctgtggcttac

SEQ ID NO: 13791 - DNA, 20 bp, Artificial Sequence
  Description of Artificial Sequence: Synthetic oligonucleotide
  Target: SCN10A; (-) strand; PAM type: NRG; PAM sequence: CAG
ctaccagttcctgtggctta

SEQ ID NO: 13792 - DNA, 20 bp, Artificial Sequence
  Description of Artificial Sequence: Synthetic oligonucleotide
  Target: SCN10A; (-) strand; PAM type: NRG; PAM sequence: TGG
atcttaactaccagttcctg

SEQ ID NO: 13793 - DNA, 20 bp, Artificial Sequence
  Description of Artificial Sequence: Synthetic oligonucleotide
  Target: SCN10A; (-) strand; PAM type: NRG; PAM sequence: CAG
gatggggatatcttaactac

SEQ ID NO: 13794 - DNA, 20 bp, Artificial Sequence
  Description of Artificial Sequence: Synthetic oligonucleotide
  Target: SCN10A; (-) strand; PAM type: NRG; PAM sequence: GGG
aagtacttagttctatgatg

SEQ ID NO: 13795 - DNA, 20 bp, Artificial Sequence
  Description of Artificial Sequence: Synthetic oligonucleotide
  Target: SCN10A; (-) strand; PAM type: NRG; PAM sequence: GGG
caagtacttagttctatgat

SEQ ID NO: 13796 - DNA, 20 bp, Artificial Sequence
  Description of Artificial Sequence: Synthetic oligonucleotide
  Target: SCN10A; (-) strand; PAM type: NRG; PAM sequence: TGG
ccaagtacttagttctatga

SEQ ID NO: 13797 - DNA, 20 bp, Artificial Sequence
  Description of Artificial Sequence: Synthetic oligonucleotide
  Target: SCN10A; (-) strand; PAM type: NRG; PAM sequence: TAG
ataaaacatagccaagtact

SEQ ID NO: 13798 - DNA, 20 bp, Artificial Sequence
  Description of Artificial Sequence: Synthetic oligonucleotide
  Target: SCN10A; (-) strand; PAM type: NRG; PAM sequence: AAG
tatagaaataaaacatagcc

SEQ ID NO: 13799 - DNA, 20 bp, Artificial Sequence
  Description of Artificial Sequence: Synthetic oligonucleotide
  Target: SCN10A; (-) strand; PAM type: NRG; PAM sequence: TAG
agtaatatagaaataaaaca

SEQ ID NO: 13800 - DNA, 20 bp, Artificial Sequence
  Description of Artificial Sequence: Synthetic oligonucleotide
  Target: SCN10A; (-) strand; PAM type: NRG; PAM sequence: TAG
ttgtttgtgtatcagtaata

SEQ ID NO: 13801 - DNA, 20 bp, Artificial Sequence
  Description of Artificial Sequence: Synthetic oligonucleotide
  Target: SCN10A; (-) strand; PAM type: NRG; PAM sequence: CAG
aagggagcttgtttgtgtat

SEQ ID NO: 13802 - DNA, 20 bp, Artificial Sequence
  Description of Artificial Sequence: Synthetic oligonucleotide
  Target: SCN10A; (-) strand; PAM type: NRG; PAM sequence: GAG
tgattttatattaaagaagg

SEQ ID NO: 13803 - DNA, 20 bp, Artificial Sequence
  Description of Artificial Sequence: Synthetic oligonucleotide
  Target: SCN10A; (-) strand; PAM type: NRG; PAM sequence: GGG
tttgattttatattaaagaa

SEQ ID NO: 13804 - DNA, 20 bp, Artificial Sequence
  Description of Artificial Sequence: Synthetic oligonucleotide
  Target: SCN10A; (-) strand; PAM type: NRG; PAM sequence: AGG
ttttgattttatattaaaga

SEQ ID NO: 13805 - DNA, 20 bp, Artificial Sequence
  Description of Artificial Sequence: Synthetic oligonucleotide
  Target: SCN10A; (-) strand; PAM type: NRG; PAM sequence: AAG
attttgattttatattaaag

SEQ ID NO: 13806 - DNA, 20 bp, Artificial Sequence
  Description of Artificial Sequence: Synthetic oligonucleotide
  Target: SCN10A; (-) strand; PAM type: NRG; PAM sequence: AAG
gctattttgattttatatta

SEQ ID NO: 13807 - DNA, 20 bp, Artificial Sequence
  Description of Artificial Sequence: Synthetic oligonucleotide
  Target: SCN10A; (-) strand; PAM type: NRG; PAM sequence: AGG
tccaaaatgaaagattccaa

SEQ ID NO: 13808 - DNA, 20 bp, Artificial Sequence
  Description of Artificial Sequence: Synthetic oligonucleotide
  Target: SCN10A; (-) strand; PAM type: NRG; PAM sequence: AAG
ttccaaaatgaaagattcca

SEQ ID NO: 13809 - DNA, 20 bp, Artificial Sequence
  Description of Artificial Sequence: Synthetic oligonucleotide
  Target: SCN10A; (-) strand; PAM type: NRG; PAM sequence: AAG
ttgtttgtcttccaaaatga

SEQ ID NO: 13810 - DNA, 20 bp, Artificial Sequence
  Description of Artificial Sequence: Synthetic oligonucleotide
  Target: SCN10A; (-) strand; PAM type: NRG; PAM sequence: TAG
gtttttgttggttggttggt

SEQ ID NO: 13811 - DNA, 20 bp, Artificial Sequence
  Description of Artificial Sequence: Synthetic oligonucleotide
  Target: SCN10A; (-) strand; PAM type: NRG; PAM sequence: TGG
aggagtttttgttggttggt

SEQ ID NO: 13812 - DNA, 20 bp, Artificial Sequence
  Description of Artificial Sequence: Synthetic oligonucleotide
  Target: SCN10A; (-) strand; PAM type: NRG; PAM sequence: TGG
taataggagtttttgttggt

SEQ ID NO: 13813 - DNA, 20 bp, Artificial Sequence
  Description of Artificial Sequence: Synthetic oligonucleotide
  Target: SCN10A; (-) strand; PAM type: NRG; PAM sequence: TGG
agcataataggagtttttgt

SEQ ID NO: 13814 - DNA, 20 bp, Artificial Sequence
  Description of Artificial Sequence: Synthetic oligonucleotide
  Target: SCN10A; (-) strand; PAM type: NRG; PAM sequence: GAG
tatctcacttagcataatag

SEQ ID NO: 13815 - DNA, 20 bp, Artificial Sequence
  Description of Artificial Sequence: Synthetic oligonucleotide
  Target: SCN10A; (-) strand; PAM type: NRG; PAM sequence: AGG
cttatctcacttagcataat

SEQ ID NO: 13816 - DNA, 20 bp, Artificial Sequence
  Description of Artificial Sequence: Synthetic oligonucleotide
  Target: SCN10A; (-) strand; PAM type: NRG; PAM sequence: TAG
gcttatctcacttagcataa

SEQ ID NO: 13817 - DNA, 20 bp, Artificial Sequence
  Description of Artificial Sequence: Synthetic oligonucleotide
  Target: SCN10A; (-) strand; PAM type: NRG; PAM sequence: TAG
tgtgtctggcttatctcact

SEQ ID NO: 13818 - DNA, 20 bp, Artificial Sequence
  Description of Artificial Sequence: Synthetic oligonucleotide
  Target: SCN10A; (-) strand; PAM type: NRG; PAM sequence: TGG
cgtttttgtccttctgtgtc

SEQ ID NO: 13819 - DNA, 20 bp, Artificial Sequence
  Description of Artificial Sequence: Synthetic oligonucleotide
  Target: SCN10A; (-) strand; PAM type: NRG; PAM sequence: TAG
tcccatgagtttgactattt

SEQ ID NO: 13820 - DNA, 20 bp, Artificial Sequence
  Description of Artificial Sequence: Synthetic oligonucleotide
  Target: SCN10A; (-) strand; PAM type: NRG; PAM sequence: GAG
attctattctctgctcccat

SEQ ID NO: 13821 - DNA, 20 bp, Artificial Sequence
  Description of Artificial Sequence: Synthetic oligonucleotide
  Target: SCN10A; (-) strand; PAM type: NRG; PAM sequence: TGG
tttcccctcctcccagctcc

SEQ ID NO: 13822 - DNA, 20 bp, Artificial Sequence
  Description of Artificial Sequence: Synthetic oligonucleotide
  Target: SCN10A; (-) strand; PAM type: NRG; PAM sequence: CAG
tccccaatttcccctcctcc

SEQ ID NO: 13823 - DNA, 20 bp, Artificial Sequence
  Description of Artificial Sequence: Synthetic oligonucleotide
  Target: SCN10A; (-) strand; PAM type: NRG; PAM sequence: AAG
ggaagtttgtacactttgac

SEQ ID NO: 13824 - DNA, 20 bp, Artificial Sequence
  Description of Artificial Sequence: Synthetic oligonucleotide
  Target: SCN10A; (-) strand; PAM type: NRG; PAM sequence: AAG
tattcatgtcacataactgg

SEQ ID NO: 13825 - DNA, 20 bp, Artificial Sequence
  Description of Artificial Sequence: Synthetic oligonucleotide
  Target: SCN10A; (-) strand; PAM type: NRG; PAM sequence: TGG
atttattcatgtcacataac

SEQ ID NO: 13826 - DNA, 20 bp, Artificial Sequence
  Description of Artificial Sequence: Synthetic oligonucleotide
  Target: SCN10A; (-) strand; PAM type: NRG; PAM sequence: AGG
tatgctataagtagagctct

SEQ ID NO: 13827 - DNA, 20 bp, Artificial Sequence
  Description of Artificial Sequence: Synthetic oligonucleotide
  Target: SCN10A; (-) strand; PAM type: NRG; PAM sequence: TAG
ctatgctataagtagagctc

SEQ ID NO: 13828 - DNA, 20 bp, Artificial Sequence
  Description of Artificial Sequence: Synthetic oligonucleotide
  Target: SCN10A; (-) strand; PAM type: NRG; PAM sequence: GAG
tagggactatgctataagta

SEQ ID NO: 13829 - DNA, 20 bp, Artificial Sequence
  Description of Artificial Sequence: Synthetic oligonucleotide
  Target: SCN10A; (-) strand; PAM type: NRG; PAM sequence: TAG
tatagggactatgctataag

SEQ ID NO: 13830 - DNA, 20 bp, Artificial Sequence
  Description of Artificial Sequence: Synthetic oligonucleotide
  Target: SCN10A; (-) strand; PAM type: NRG; PAM sequence: AAG
aactatagggactatgctat

SEQ ID NO: 13831 - DNA, 20 bp, Artificial Sequence
  Description of Artificial Sequence: Synthetic oligonucleotide
  Target: SCN10A; (-) strand; PAM type: NRG; PAM sequence: GGG
acacggtattgctaactata

SEQ ID NO: 13832 - DNA, 20 bp, Artificial Sequence
  Description of Artificial Sequence: Synthetic oligonucleotide
  Target: SCN10A; (-) strand; PAM type: NRG; PAM sequence: AGG
aacacggtattgctaactat

SEQ ID NO: 13833 - DNA, 20 bp, Artificial Sequence
  Description of Artificial Sequence: Synthetic oligonucleotide
  Target: SCN10A; (-) strand; PAM type: NRG; PAM sequence: TAG
caacacggtattgctaacta

SEQ ID NO: 13834 - DNA, 20 bp, Artificial Sequence
  Description of Artificial Sequence: Synthetic oligonucleotide
  Target: SCN10A; (-) strand; PAM type: NRG; PAM sequence: CGG
aaatttttaggtagacaaca

SEQ ID NO: 13835 - DNA, 20 bp, Artificial Sequence
  Description of Artificial Sequence: Synthetic oligonucleotide
  Target: SCN10A; (-) strand; PAM type: NRG; PAM sequence: TAG
tctcttggcaaatttttagg

SEQ ID NO: 13836 - DNA, 20 bp, Artificial Sequence
  Description of Artificial Sequence: Synthetic oligonucleotide
  Target: SCN10A; (-) strand; PAM type: NRG; PAM sequence: AGG
tattctcttggcaaattttt

SEQ ID NO: 13837 - DNA, 20 bp, Artificial Sequence
  Description of Artificial Sequence: Synthetic oligonucleotide
  Target: SCN10A; (-) strand; PAM type: NRG; PAM sequence: TAG
ttattctcttggcaaatttt

SEQ ID NO: 13838 - DNA, 20 bp, Artificial Sequence
  Description of Artificial Sequence: Synthetic oligonucleotide
  Target: SCN10A; (-) strand; PAM type: NRG; PAM sequence: TGG
acacttaagatttattctct

SEQ ID NO: 13839 - DNA, 20 bp, Artificial Sequence
  Description of Artificial Sequence: Synthetic oligonucleotide
  Target: SCN10A; (-) strand; PAM type: NRG; PAM sequence: AAG
attgggtgctaggaacactt

SEQ ID NO: 13840 - DNA, 20 bp, Artificial Sequence
  Description of Artificial Sequence: Synthetic oligonucleotide
  Target: SCN10A; (-) strand; PAM type: NRG; PAM sequence: AGG
ttatttatttattgggtgct

SEQ ID NO: 13841 - DNA, 20 bp, Artificial Sequence
  Description of Artificial Sequence: Synthetic oligonucleotide
  Target: SCN10A; (-) strand; PAM type: NRG; PAM sequence: TAG
tttatttatttattgggtgc

SEQ ID NO: 13842 - DNA, 20 bp, Artificial Sequence
  Description of Artificial Sequence: Synthetic oligonucleotide
  Target: SCN10A; (-) strand; PAM type: NRG; PAM sequence: GGG
tgcctatttatttatttatt

SEQ ID NO: 13843 - DNA, 20 bp, Artificial Sequence
  Description of Artificial Sequence: Synthetic oligonucleotide
  Target: SCN10A; (-) strand; PAM type: NRG; PAM sequence: TGG
ctgcctatttatttatttat

SEQ ID NO: 13844 - DNA, 20 bp, Artificial Sequence
  Description of Artificial Sequence: Synthetic oligonucleotide
  Target: SCN10A; (-) strand; PAM type: NRG; PAM sequence: CAG
accatcaccaccatcaatgc

SEQ ID NO: 13845 - DNA, 20 bp, Artificial Sequence
  Description of Artificial Sequence: Synthetic oligonucleotide
  Target: SCN10A; (-) strand; PAM type: NRG; PAM sequence: AAG
aactttatgagtttggagat

SEQ ID NO: 13846 - DNA, 20 bp, Artificial Sequence
  Description of Artificial Sequence: Synthetic oligonucleotide
  Target: SCN10A; (-) strand; PAM type: NRG; PAM sequence: GAG
tacacaactttatgagtttg

SEQ ID NO: 13847 - DNA, 20 bp, Artificial Sequence
  Description of Artificial Sequence: Synthetic oligonucleotide
  Target: SCN10A; (-) strand; PAM type: NRG; PAM sequence: TGG
tgtacacaactttatgagtt

SEQ ID NO: 13848 - DNA, 20 bp, Artificial Sequence
  Description of Artificial Sequence: Synthetic oligonucleotide
  Target: SCN10A; (-) strand; PAM type: NRG; PAM sequence: GAG
tttaatgtacacaactttat

SEQ ID NO: 13849 - DNA, 20 bp, Artificial Sequence
  Description of Artificial Sequence: Synthetic oligonucleotide
  Target: SCN10A; (-) strand; PAM type: NRG; PAM sequence: AAG
aggtatgatccacatgtaaa

SEQ ID NO: 13850 - DNA, 20 bp, Artificial Sequence
  Description of Artificial Sequence: Synthetic oligonucleotide
  Target: SCN10A; (-) strand; PAM type: NRG; PAM sequence: AGG
tgttttttaacactttattg

SEQ ID NO: 13851 - DNA, 20 bp, Artificial Sequence
  Description of Artificial Sequence: Synthetic oligonucleotide
  Target: SCN10A; (-) strand; PAM type: NRG; PAM sequence: GAG
ctgttttttaacactttatt

SEQ ID NO: 13852 - DNA, 20 bp, Artificial Sequence
  Description of Artificial Sequence: Synthetic oligonucleotide
  Target: SCN10A; (-) strand; PAM type: NRG; PAM sequence: CAG
gcgtgtatttccggggattt

SEQ ID NO: 13853 - DNA, 20 bp, Artificial Sequence
  Description of Artificial Sequence: Synthetic oligonucleotide
  Target: SCN10A; (-) strand; PAM type: NRG; PAM sequence: GGG
ttgggttgcgtgtatttccg

SEQ ID NO: 13854 - DNA, 20 bp, Artificial Sequence
  Description of Artificial Sequence: Synthetic oligonucleotide
  Target: SCN10A; (-) strand; PAM type: NRG; PAM sequence: GGG
cttgggttgcgtgtatttcc

SEQ ID NO: 13855 - DNA, 20 bp, Artificial Sequence
  Description of Artificial Sequence: Synthetic oligonucleotide
  Target: SCN10A; (-) strand; PAM type: NRG; PAM sequence: CGG
ccttgggttgcgtgtatttc

SEQ ID NO: 13856 - DNA, 20 bp, Artificial Sequence
  Description of Artificial Sequence: Synthetic oligonucleotide
  Target: SCN10A; (-) strand; PAM type: NRG; PAM sequence: GGG
tggtgctgaaacacagcctt

SEQ ID NO: 13857 - DNA, 20 bp, Artificial Sequence
  Description of Artificial Sequence: Synthetic oligonucleotide
  Target: SCN10A; (-) strand; PAM type: NRG; PAM sequence: TGG
ttggtgctgaaacacagcct

SEQ ID NO: 13858 - DNA, 20 bp, Artificial Sequence
  Description of Artificial Sequence: Synthetic oligonucleotide
  Target: SCN10A; (-) strand; PAM type: NRG; PAM sequence: CAG
cccaccttggtgctgaaaca

SEQ ID NO: 13859 - DNA, 20 bp, Artificial Sequence
  Description of Artificial Sequence: Synthetic oligonucleotide
  Target: SCN10A; (-) strand; PAM type: NRG; PAM sequence: TGG
tttcatcaacctccccacct

SEQ ID NO: 13860 - DNA, 20 bp, Artificial Sequence
  Description of Artificial Sequence: Synthetic oligonucleotide
  Target: SCN10A; (-) strand; PAM type: NRG; PAM sequence: CAG
agtatctaaatacaacttaa

SEQ ID NO: 13861 - DNA, 20 bp, Artificial Sequence
  Description of Artificial Sequence: Synthetic oligonucleotide
  Target: SCN10A; (-) strand; PAM type: NRG; PAM sequence: GAG
gatttagtaacaagagctga

SEQ ID NO: 13862 - DNA, 20 bp, Artificial Sequence
  Description of Artificial Sequence: Synthetic oligonucleotide
  Target: SCN10A; (-) strand; PAM type: NRG; PAM sequence: GAG
ctgatttagtaacaagagct

SEQ ID NO: 13863 - DNA, 20 bp, Artificial Sequence
  Description of Artificial Sequence: Synthetic oligonucleotide
  Target: SCN10A; (-) strand; PAM type: NRG; PAM sequence: GAG
tgccactgatttagtaacaa

SEQ ID NO: 13864 - DNA, 20 bp, Artificial Sequence
  Description of Artificial Sequence: Synthetic oligonucleotide
  Target: SCN10A; (-) strand; PAM type: NRG; PAM sequence: AAG
tttgccactgatttagtaac

SEQ ID NO: 13865 - DNA, 20 bp, Artificial Sequence
  Description of Artificial Sequence: Synthetic oligonucleotide
  Target: SCN10A; (-) strand; PAM type: NRG; PAM sequence: TAG
gatttaatttgccactgatt

SEQ ID NO: 13866 - DNA, 20 bp, Artificial Sequence
  Description of Artificial Sequence: Synthetic oligonucleotide
  Target: SCN10A; (-) strand; PAM type: NRG; PAM sequence: TAG
ttcatgtcggggtgtagctg

SEQ ID NO: 13867 - DNA, 20 bp, Artificial Sequence
  Description of Artificial Sequence: Synthetic oligonucleotide
  Target: SCN10A; (-) strand; PAM type: NRG; PAM sequence: TAG
ttacttttcatgtcggggtg

SEQ ID NO: 13868 - DNA, 20 bp, Artificial Sequence
  Description of Artificial Sequence: Synthetic oligonucleotide
  Target: SCN10A; (-) strand; PAM type: NRG; PAM sequence: GGG
cctgcttacttttcatgtcg

SEQ ID NO: 13869 - DNA, 20 bp, Artificial Sequence
  Description of Artificial Sequence: Synthetic oligonucleotide
  Target: SCN10A; (-) strand; PAM type: NRG; PAM sequence: GGG
acctgcttacttttcatgtc

SEQ ID NO: 13870 - DNA, 20 bp, Artificial Sequence
  Description of Artificial Sequence: Synthetic oligonucleotide
  Target: SCN10A; (-) strand; PAM type: NRG; PAM sequence: CGG
gacctgcttacttttcatgt

SEQ ID NO: 13871 - DNA, 20 bp, Artificial Sequence
  Description of Artificial Sequence: Synthetic oligonucleotide
  Target: SCN10A; (-) strand; PAM type: NRG; PAM sequence: TGG
cattataaatgtatcttgat

SEQ ID NO: 13872 - DNA, 20 bp, Artificial Sequence
  Description of Artificial Sequence: Synthetic oligonucleotide
  Target: SCN10A; (-) strand; PAM type: NRG; PAM sequence: TGG
tcatgctcaccagcttcacc

SEQ ID NO: 13873 - DNA, 20 bp, Artificial Sequence
  Description of Artificial Sequence: Synthetic oligonucleotide
  Target: SCN10A; (-) strand; PAM type: NRG; PAM sequence: CAG
aaaggccaaatcatgctcac

SEQ ID NO: 13874 - DNA, 20 bp, Artificial Sequence
  Description of Artificial Sequence: Synthetic oligonucleotide
  Target: SCN10A; (-) strand; PAM type: NRG; PAM sequence: AGG
gctgaagtttgaccctataa

SEQ ID NO: 13875 - DNA, 20 bp, Artificial Sequence
  Description of Artificial Sequence: Synthetic oligonucleotide
  Target: SCN10A; (-) strand; PAM type: NRG; PAM sequence: AAG
agctgaagtttgaccctata

SEQ ID NO: 13876 - DNA, 20 bp, Artificial Sequence
  Description of Artificial Sequence: Synthetic oligonucleotide
  Target: SCN10A; (-) strand; PAM type: NRG; PAM sequence: AAG
ctgggcttatgggttagctg

SEQ ID NO: 13877 - DNA, 20 bp, Artificial Sequence
  Description of Artificial Sequence: Synthetic oligonucleotide
  Target: SCN10A; (-) strand; PAM type: NRG; PAM sequence: TAG
ctgtccctgggcttatgggt

SEQ ID NO: 13878 - DNA, 20 bp, Artificial Sequence
  Description of Artificial Sequence: Synthetic oligonucleotide
  Target: SCN10A; (-) strand; PAM type: NRG; PAM sequence: GGG
gagactgtccctgggcttat

SEQ ID NO: 13879 - DNA, 20 bp, Artificial Sequence
  Description of Artificial Sequence: Synthetic oligonucleotide
  Target: SCN10A; (-) strand; PAM type: NRG; PAM sequence: TGG
agagactgtccctgggctta

SEQ ID NO: 13880 - DNA, 20 bp, Artificial Sequence
  Description of Artificial Sequence: Synthetic oligonucleotide
  Target: SCN10A; (-) strand; PAM type: NRG; PAM sequence: GGG
acagccaagagactgtccct

SEQ ID NO: 13881 - DNA, 20 bp, Artificial Sequence
  Description of Artificial Sequence: Synthetic oligonucleotide
  Target: SCN10A; (-) strand; PAM type: NRG; PAM sequence: TGG
aacagccaagagactgtccc

SEQ ID NO: 13882 - DNA, 20 bp, Artificial Sequence
  Description of Artificial Sequence: Synthetic oligonucleotide
  Target: SCN10A; (-) strand; PAM type: NRG; PAM sequence: GAG
tgcctgtcaccaacagccaa

SEQ ID NO: 13883 - DNA, 20 bp, Artificial Sequence
  Description of Artificial Sequence: Synthetic oligonucleotide
  Target: SCN10A; (-) strand; PAM type: NRG; PAM sequence: AAG
gctgcctgtcaccaacagcc

SEQ ID NO: 13884 - DNA, 20 bp, Artificial Sequence
  Description of Artificial Sequence: Synthetic oligonucleotide
  Target: SCN10A; (-) strand; PAM type: NRG; PAM sequence: CAG
aacttgctgcctgtcaccaa

SEQ ID NO: 13885 - DNA, 20 bp, Artificial Sequence
  Description of Artificial Sequence: Synthetic oligonucleotide
  Target: SCN10A; (-) strand; PAM type: NRG; PAM sequence: AGG
gttgaagctgagtttagaac

SEQ ID NO: 13886 - DNA, 20 bp, Artificial Sequence
  Description of Artificial Sequence: Synthetic oligonucleotide
  Target: SCN10A; (-) strand; PAM type: NRG; PAM sequence: CAG
ggttgaagctgagtttagaa

SEQ ID NO: 13887 - DNA, 20 bp, Artificial Sequence
  Description of Artificial Sequence: Synthetic oligonucleotide
  Target: SCN10A; (-) strand; PAM type: NRG; PAM sequence: TAG
ccaagggttgaagctgagtt

SEQ ID NO: 13888 - DNA, 20 bp, Artificial Sequence
  Description of Artificial Sequence: Synthetic oligonucleotide
  Target: SCN10A; (-) strand; PAM type: NRG; PAM sequence: GAG
agtttccaagggttgaagct

SEQ ID NO: 13889 - DNA, 20 bp, Artificial Sequence
  Description of Artificial Sequence: Synthetic oligonucleotide
  Target: SCN10A; (-) strand; PAM type: NRG; PAM sequence: AAG
cacagagtttccaagggttg

SEQ ID NO: 13890 - DNA, 20 bp, Artificial Sequence
  Description of Artificial Sequence: Synthetic oligonucleotide
  Target: SCN10A; (-) strand; PAM type: NRG; PAM sequence: GGG
cagggtcacagagtttccaa

SEQ ID NO: 13891 - DNA, 20 bp, Artificial Sequence
  Description of Artificial Sequence: Synthetic oligonucleotide
  Target: SCN10A; (-) strand; PAM type: NRG; PAM sequence: AGG
gcagggtcacagagtttcca

SEQ ID NO: 13892 - DNA, 20 bp, Artificial Sequence
  Description of Artificial Sequence: Synthetic oligonucleotide
  Target: SCN10A; (-) strand; PAM type: NRG; PAM sequence: AAG
tgcagggtcacagagtttcc

SEQ ID NO: 13893 - DNA, 20 bp, Artificial Sequence
  Description of Artificial Sequence: Synthetic oligonucleotide
  Target: SCN10A; (-) strand; PAM type: NRG; PAM sequence: GAG
gaatattatgcagggtcaca

SEQ ID NO: 13894 - DNA, 20 bp, Artificial Sequence
  Description of Artificial Sequence: Synthetic oligonucleotide
  Target: SCN10A; (-) strand; PAM type: NRG; PAM sequence: CAG
aagaatattatgcagggtca

SEQ ID NO: 13895 - DNA, 20 bp, Artificial Sequence
  Description of Artificial Sequence: Synthetic oligonucleotide
  Target: SCN10A; (-) strand; PAM type: NRG; PAM sequence: GGG
gagatcaagaatattatgca

SEQ ID NO: 13896 - DNA, 20 bp, Artificial Sequence
  Description of Artificial Sequence: Synthetic oligonucleotide
  Target: SCN10A; (-) strand; PAM type: NRG; PAM sequence: AGG
agagatcaagaatattatgc

SEQ ID NO: 13897 - DNA, 20 bp, Artificial Sequence
  Description of Artificial Sequence: Synthetic oligonucleotide
  Target: SCN10A; (-) strand; PAM type: NRG; PAM sequence: CAG
cagagatcaagaatattatg

SEQ ID NO: 13898 - DNA, 20 bp, Artificial Sequence
  Description of Artificial Sequence: Synthetic oligonucleotide
  Target: SCN10A; (-) strand; PAM type: NRG; PAM sequence: AAG
aaaattgagactcagagatc

SEQ ID NO: 13899 - DNA, 20 bp, Artificial Sequence
  Description of Artificial Sequence: Synthetic oligonucleotide
  Target: SCN10A; (-) strand; PAM type: NRG; PAM sequence: GAG
acatttaaaattgagactca

SEQ ID NO: 13900 - DNA, 20 bp, Artificial Sequence
  Description of Artificial Sequence: Synthetic oligonucleotide
  Target: SCN10A; (-) strand; PAM type: NRG; PAM sequence: CAG
atacatttaaaattgagact

SEQ ID NO: 13901 - DNA, 20 bp, Artificial Sequence
  Description of Artificial Sequence: Synthetic oligonucleotide
  Target: SCN10A; (-) strand; PAM type: NRG; PAM sequence: GAG
tattttatacatttaaaatt

SEQ ID NO: 13902 - DNA, 20 bp, Artificial Sequence
  Description of Artificial Sequence: Synthetic oligonucleotide
  Target: SCN10A; (-) strand; PAM type: NRG; PAM sequence: AGG
tcacagcagccctgtcaagc

SEQ ID NO: 13903 - DNA, 20 bp, Artificial Sequence
  Description of Artificial Sequence: Synthetic oligonucleotide
  Target: SCN10A; (-) strand; PAM type: NRG; PAM sequence: CAG
ttcacagcagccctgtcaag

SEQ ID NO: 13904 - DNA, 20 bp, Artificial Sequence
  Description of Artificial Sequence: Synthetic oligonucleotide
  Target: SCN10A; (-) strand; PAM type: NRG; PAM sequence: AAG
atgttcacagcagccctgtc

SEQ ID NO: 13905 - DNA, 20 bp, Artificial Sequence
  Description of Artificial Sequence: Synthetic oligonucleotide
  Target: SCN10A; (-) strand; PAM type: NRG; PAM sequence: CAG
ggctccatgaatgttcacag

SEQ ID NO: 13906 - DNA, 20 bp, Artificial Sequence
  Description of Artificial Sequence: Synthetic oligonucleotide
  Target: SCN10A; (-) strand; PAM type: NRG; PAM sequence: CAG
ctgggctccatgaatgttca

SEQ ID NO: 13907 - DNA, 20 bp, Artificial Sequence
  Description of Artificial Sequence: Synthetic oligonucleotide
  Target: SCN10A; (-) strand; PAM type: NRG; PAM sequence: GGG
taagttctgagcactgagct

SEQ ID NO: 13908 - DNA, 20 bp, Artificial Sequence
  Description of Artificial Sequence: Synthetic oligonucleotide
  Target: SCN10A; (-) strand; PAM type: NRG; PAM sequence: TGG
ctaagttctgagcactgagc

SEQ ID NO: 13909 - DNA, 20 bp, Artificial Sequence
  Description of Artificial Sequence: Synthetic oligonucleotide
  Target: SCN10A; (-) strand; PAM type: NRG; PAM sequence: GAG
cttcctaagttctgagcact

SEQ ID NO: 13910 - DNA, 20 bp, Artificial Sequence
  Description of Artificial Sequence: Synthetic oligonucleotide
  Target: SCN10A; (-) strand; PAM type: NRG; PAM sequence: GAG
ctgaatacttcctaagttct

SEQ ID NO: 13911 - DNA, 20 bp, Artificial Sequence
  Description of Artificial Sequence: Synthetic oligonucleotide
  Target: SCN10A; (-) strand; PAM type: NRG; PAM sequence: AAG
gccttgactgaatacttcct

SEQ ID NO: 13912 - DNA, 20 bp, Artificial Sequence
  Description of Artificial Sequence: Synthetic oligonucleotide
  Target: SCN10A; (-) strand; PAM type: NRG; PAM sequence: GAG
gaggctaacatggggaaatg

SEQ ID NO: 13913 - DNA, 20 bp, Artificial Sequence
  Description of Artificial Sequence: Synthetic oligonucleotide
  Target: SCN10A; (-) strand; PAM type: NRG; PAM sequence: TGG
tagaggctaacatggggaaa

SEQ ID NO: 13914 - DNA, 20 bp, Artificial Sequence
  Description of Artificial Sequence: Synthetic oligonucleotide
  Target: SCN10A; (-) strand; PAM type: NRG; PAM sequence: GGG
tagagttagaggctaacatg

SEQ ID NO: 13915 - DNA, 20 bp, Artificial Sequence
  Description of Artificial Sequence: Synthetic oligonucleotide
  Target: SCN10A; (-) strand; PAM type: NRG; PAM sequence: GGG
ctagagttagaggctaacat

SEQ ID NO: 13916 - DNA, 20 bp, Artificial Sequence
  Description of Artificial Sequence: Synthetic oligonucleotide
  Target: SCN10A; (-) strand; PAM type: NRG; PAM sequence: TGG
actagagttagaggctaaca

SEQ ID NO: 13917 - DNA, 20 bp, Artificial Sequence
  Description of Artificial Sequence: Synthetic oligonucleotide
  Target: SCN10A; (-) strand; PAM type: NRG; PAM sequence: AGG
gagaaaattactagagttag

SEQ ID NO: 13918 - DNA, 20 bp, Artificial Sequence
  Description of Artificial Sequence: Synthetic oligonucleotide
  Target: SCN10A; (-) strand; PAM type: NRG; PAM sequence: GAG
agagaaaattactagagtta

SEQ ID NO: 13919 - DNA, 20 bp, Artificial Sequence
  Description of Artificial Sequence: Synthetic oligonucleotide
  Target: SCN10A; (-) strand; PAM type: NRG; PAM sequence: TAG
tcagagaaaattactagagt

SEQ ID NO: 13920 - DNA, 20 bp, Artificial Sequence
  Description of Artificial Sequence: Synthetic oligonucleotide
  Target: SCN10A; (-) strand; PAM type: NRG; PAM sequence: GAG
gtgttcagagaaaattacta

SEQ ID NO: 13921 - DNA, 20 bp, Artificial Sequence
  Description of Artificial Sequence: Synthetic oligonucleotide
  Target: SCN10A; (-) strand; PAM type: NRG; PAM sequence: TAG
tggtgttcagagaaaattac

SEQ ID NO: 13922 - DNA, 20 bp, Artificial Sequence
  Description of Artificial Sequence: Synthetic oligonucleotide
  Target: SCN10A; (-) strand; PAM type: NRG; PAM sequence: GAG
tttgggtccagtggtgttca

SEQ ID NO: 13923 - DNA, 20 bp, Artificial Sequence
  Description of Artificial Sequence: Synthetic oligonucleotide
  Target: SCN10A; (-) strand; PAM type: NRG; PAM sequence: CAG
attttgggtccagtggtgtt

SEQ ID NO: 13924 - DNA, 20 bp, Artificial Sequence
  Description of Artificial Sequence: Synthetic oligonucleotide
  Target: SCN10A; (-) strand; PAM type: NRG; PAM sequence: TGG
gcccagtattttgggtccag

SEQ ID NO: 13925 - DNA, 20 bp, Artificial Sequence
  Description of Artificial Sequence: Synthetic oligonucleotide
  Target: SCN10A; (-) strand; PAM type: NRG; PAM sequence: CAG
caggcccagtattttgggtc

SEQ ID NO: 13926 - DNA, 20 bp, Artificial Sequence
  Description of Artificial Sequence: Synthetic oligonucleotide
  Target: SCN10A; (-) strand; PAM type: NRG; PAM sequence: GGG
aatgacaggcccagtatttt

SEQ ID NO: 13927 - DNA, 20 bp, Artificial Sequence
  Description of Artificial Sequence: Synthetic oligonucleotide
  Target: SCN10A; (-) strand; PAM type: NRG; PAM sequence: TGG
gaatgacaggcccagtattt

SEQ ID NO: 13928 - DNA, 20 bp, Artificial Sequence
  Description of Artificial Sequence: Synthetic oligonucleotide
  Target: SCN10A; (-) strand; PAM type: NRG; PAM sequence: CAG
gtgttgttgaatgacaggcc

SEQ ID NO: 13929 - DNA, 20 bp, Artificial Sequence
  Description of Artificial Sequence: Synthetic oligonucleotide
  Target: SCN10A; (-) strand; PAM type: NRG; PAM sequence: AGG
tctgggtgttgttgaatgac

SEQ ID NO: 13930 - DNA, 20 bp, Artificial Sequence
  Description of Artificial Sequence: Synthetic oligonucleotide
  Target: SCN10A; (-) strand; PAM type: NRG; PAM sequence: CAG
gtctgggtgttgttgaatga

SEQ ID NO: 13931 - DNA, 20 bp, Artificial Sequence
  Description of Artificial Sequence: Synthetic oligonucleotide
  Target: SCN10A; (-) strand; PAM type: NRG; PAM sequence: GGG
atactgttaaggcccagtct

SEQ ID NO: 13932 - DNA, 20 bp, Artificial Sequence
  Description of Artificial Sequence: Synthetic oligonucleotide
  Target: SCN10A; (-) strand; PAM type: NRG; PAM sequence: TGG
aatactgttaaggcccagtc

SEQ ID NO: 13933 - DNA, 20 bp, Artificial Sequence
  Description of Artificial Sequence: Synthetic oligonucleotide
  Target: SCN10A; (-) strand; PAM type: NRG; PAM sequence: CAG
aaattaatactgttaaggcc

SEQ ID NO: 13934 - DNA, 20 bp, Artificial Sequence
  Description of Artificial Sequence: Synthetic oligonucleotide
  Target: SCN10A; (-) strand; PAM type: NRG; PAM sequence: AGG
ccaagaaattaatactgtta

SEQ ID NO: 13935 - DNA, 20 bp, Artificial Sequence
  Description of Artificial Sequence: Synthetic oligonucleotide
  Target: SCN10A; (-) strand; PAM type: NRG; PAM sequence: AAG
gccaagaaattaatactgtt

SEQ ID NO: 13936 - DNA, 20 bp, Artificial Sequence
  Description of Artificial Sequence: Synthetic oligonucleotide
  Target: SCN10A; (-) strand; PAM type: NRG; PAM sequence: AAG
aaagtcaagatatcaatgcc

SEQ ID NO: 13937 - DNA, 20 bp, Artificial Sequence
  Description of Artificial Sequence: Synthetic oligonucleotide
  Target: SCN10A; (-) strand; PAM type: NRG; PAM sequence: AAG
acatgagtgatagaaaagtc

SEQ ID NO: 13938 - DNA, 20 bp, Artificial Sequence
  Description of Artificial Sequence: Synthetic oligonucleotide
  Target: SCN10A; (-) strand; PAM type: NRG; PAM sequence: AAG
agggaacatgagtgatagaa

SEQ ID NO: 13939 - DNA, 20 bp, Artificial Sequence
  Description of Artificial Sequence: Synthetic oligonucleotide
  Target: SCN10A; (-) strand; PAM type: NRG; PAM sequence: TAG
ctattagggaacatgagtga

SEQ ID NO: 13940 - DNA, 20 bp, Artificial Sequence
  Description of Artificial Sequence: Synthetic oligonucleotide
  Target: SCN10A; (-) strand; PAM type: NRG; PAM sequence: GAG
actgttctattagggaacat

SEQ ID NO: 13941 - DNA, 20 bp, Artificial Sequence
  Description of Artificial Sequence: Synthetic oligonucleotide
  Target: SCN10A; (-) strand; PAM type: NRG; PAM sequence: GGG
tctacacaactgttctatta

SEQ ID NO: 13942 - DNA, 20 bp, Artificial Sequence
  Description of Artificial Sequence: Synthetic oligonucleotide
  Target: SCN10A; (-) strand; PAM type: NRG; PAM sequence: AGG
ctctacacaactgttctatt

SEQ ID NO: 13943 - DNA, 20 bp, Artificial Sequence
  Description of Artificial Sequence: Synthetic oligonucleotide
  Target: SCN10A; (-) strand; PAM type: NRG; PAM sequence: TAG
tctctacacaactgttctat

SEQ ID NO: 13944 - DNA, 20 bp, Artificial Sequence
  Description of Artificial Sequence: Synthetic oligonucleotide
  Target: SCN10A; (-) strand; PAM type: NRG; PAM sequence: TGG
agattctcaagtctagggtc

SEQ ID NO: 13945 - DNA, 20 bp, Artificial Sequence
  Description of Artificial Sequence: Synthetic oligonucleotide
  Target: SCN10A; (-) strand; PAM type: NRG; PAM sequence: GGG
aaaggagattctcaagtcta

SEQ ID NO: 13946 - DNA, 20 bp, Artificial Sequence
  Description of Artificial Sequence: Synthetic oligonucleotide
  Target: SCN10A; (-) strand; PAM type: NRG; PAM sequence: AGG
caaaggagattctcaagtct

SEQ ID NO: 13947 - DNA, 20 bp, Artificial Sequence
  Description of Artificial Sequence: Synthetic oligonucleotide
  Target: SCN10A; (-) strand; PAM type: NRG; PAM sequence: TAG
tcaaaggagattctcaagtc

SEQ ID NO: 13948 - DNA, 20 bp, Artificial Sequence
  Description of Artificial Sequence: Synthetic oligonucleotide
  Target: SCN10A; (-) strand; PAM type: NRG; PAM sequence: AAG
attgttcaaaggagattctc

SEQ ID NO: 13949 - DNA, 20 bp, Artificial Sequence
  Description of Artificial Sequence: Synthetic oligonucleotide
  Target: SCN10A; (-) strand; PAM type: NRG; PAM sequence: GAG
tgggaggagattgttcaaag

SEQ ID NO: 13950 - DNA, 20 bp, Artificial Sequence
  Description of Artificial Sequence: Synthetic oligonucleotide
  Target: SCN10A; (-) strand; PAM type: NRG; PAM sequence: AGG
actgggaggagattgttcaa

SEQ ID NO: 13951 - DNA, 20 bp, Artificial Sequence
  Description of Artificial Sequence: Synthetic oligonucleotide
  Target: SCN10A; (-) strand; PAM type: NRG; PAM sequence: AAG
gactgggaggagattgttca

SEQ ID NO: 13952 - DNA, 20 bp, Artificial Sequence
  Description of Artificial Sequence: Synthetic oligonucleotide
  Target: SCN10A; (-) strand; PAM type: NRG; PAM sequence: GAG
aagtgaggaaagactgggag

SEQ ID NO: 13953 - DNA, 20 bp, Artificial Sequence
  Description of Artificial Sequence: Synthetic oligonucleotide
  Target: SCN10A; (-) strand; PAM type: NRG; PAM sequence: AGG
caaagtgaggaaagactggg

SEQ ID NO: 13954 - DNA, 20 bp, Artificial Sequence
  Description of Artificial Sequence: Synthetic oligonucleotide
  Target: SCN10A; (-) strand; PAM type: NRG; PAM sequence: GAG
tcaaagtgaggaaagactgg

SEQ ID NO: 13955 - DNA, 20 bp, Artificial Sequence
  Description of Artificial Sequence: Synthetic oligonucleotide
  Target: SCN10A; (-) strand; PAM type: NRG; PAM sequence: GGG
catcaaagtgaggaaagact

SEQ ID NO: 13956 - DNA, 20 bp, Artificial Sequence
  Description of Artificial Sequence: Synthetic oligonucleotide
  Target: SCN10A; (-) strand; PAM type: NRG; PAM sequence: TGG
ccatcaaagtgaggaaagac

SEQ ID NO: 13957 - DNA, 20 bp, Artificial Sequence
  Description of Artificial Sequence: Synthetic oligonucleotide
  Target: SCN10A; (-) strand; PAM type: NRG; PAM sequence: AAG
gattgccatcaaagtgagga

SEQ ID NO: 13958 - DNA, 20 bp, Artificial Sequence
  Description of Artificial Sequence: Synthetic oligonucleotide
  Target: SCN10A; (-) strand; PAM type: NRG; PAM sequence: AGG
gatggattgccatcaaagtg

SEQ ID NO: 13959 - DNA, 20 bp, Artificial Sequence
  Description of Artificial Sequence: Synthetic oligonucleotide
  Target: SCN10A; (-) strand; PAM type: NRG; PAM sequence: GAG
agatggattgccatcaaagt

SEQ ID NO: 13960 - DNA, 20 bp, Artificial Sequence
  Description of Artificial Sequence: Synthetic oligonucleotide
  Target: SCN10A; (-) strand; PAM type: NRG; PAM sequence: AAG
aaggagatggattgccatca

SEQ ID NO: 13961 - DNA, 20 bp, Artificial Sequence
  Description of Artificial Sequence: Synthetic oligonucleotide
  Target: SCN10A; (-) strand; PAM type: NRG; PAM sequence: TGG
atctgttctggaaaaggaga

SEQ ID NO: 13962 - DNA, 20 bp, Artificial Sequence
  Description of Artificial Sequence: Synthetic oligonucleotide
  Target: SCN10A; (-) strand; PAM type: NRG; PAM sequence: GAG
taaaatctgttctggaaaag

SEQ ID NO: 13963 - DNA, 20 bp, Artificial Sequence
  Description of Artificial Sequence: Synthetic oligonucleotide
  Target: SCN10A; (-) strand; PAM type: NRG; PAM sequence: AGG
cttaaaatctgttctggaaa

SEQ ID NO: 13964 - DNA, 20 bp, Artificial Sequence
  Description of Artificial Sequence: Synthetic oligonucleotide
  Target: SCN10A; (-) strand; PAM type: NRG; PAM sequence: AAG
tcttaaaatctgttctggaa

SEQ ID NO: 13965 - DNA, 20 bp, Artificial Sequence
  Description of Artificial Sequence: Synthetic oligonucleotide
  Target: SCN10A; (-) strand; PAM type: NRG; PAM sequence: TGG
atgagtcttaaaatctgttc

SEQ ID NO: 13966 - DNA, 20 bp, Artificial Sequence
  Description of Artificial Sequence: Synthetic oligonucleotide
  Target: SCN10A; (-) strand; PAM type: NRG; PAM sequence: GAG
caggtggtgtaatgtgagat

SEQ ID NO: 13967 - DNA, 20 bp, Artificial Sequence
  Description of Artificial Sequence: Synthetic oligonucleotide
  Target: SCN10A; (-) strand; PAM type: NRG; PAM sequence: GAG
gggggcaggtggtgtaatgt

SEQ ID NO: 13968 - DNA, 20 bp, Artificial Sequence
  Description of Artificial Sequence: Synthetic oligonucleotide
  Target: SCN10A; (-) strand; PAM type: NRG; PAM sequence: TGG
tcttgaaagcagggggcagg

SEQ ID NO: 13969 - DNA, 20 bp, Artificial Sequence
  Description of Artificial Sequence: Synthetic oligonucleotide
  Target: SCN10A; (-) strand; PAM type: NRG; PAM sequence: AGG
tggtcttgaaagcagggggc

SEQ ID NO: 13970 - DNA, 20 bp, Artificial Sequence
  Description of Artificial Sequence: Synthetic oligonucleotide
  Target: SCN10A; (-) strand; PAM type: NRG; PAM sequence: CAG
atggtcttgaaagcaggggg

SEQ ID NO: 13971 - DNA, 20 bp, Artificial Sequence
  Description of Artificial Sequence: Synthetic oligonucleotide
  Target: SCN10A; (-) strand; PAM type: NRG; PAM sequence: GGG
tttatggtcttgaaagcagg

SEQ ID NO: 13972 - DNA, 20 bp, Artificial Sequence
  Description of Artificial Sequence: Synthetic oligonucleotide
  Target: SCN10A; (-) strand; PAM type: NRG; PAM sequence: GGG
ttttatggtcttgaaagcag

SEQ ID NO: 13973 - DNA, 20 bp, Artificial Sequence
  Description of Artificial Sequence: Synthetic oligonucleotide
  Target: SCN10A; (-) strand; PAM type: NRG; PAM sequence: GGG
cttttatggtcttgaaagca

SEQ ID NO: 13974 - DNA, 20 bp, Artificial Sequence
  Description of Artificial Sequence: Synthetic oligonucleotide
  Target: SCN10A; (-) strand; PAM type: NRG; PAM sequence: AGG
acttttatggtcttgaaagc

SEQ ID NO: 13975 - DNA, 20 bp, Artificial Sequence
  Description of Artificial Sequence: Synthetic oligonucleotide
  Target: SCN10A; (-) strand; PAM type: NRG; PAM sequence: CAG
tacttttatggtcttgaaag

SEQ ID NO: 13976 - DNA, 20 bp, Artificial Sequence
  Description of Artificial Sequence: Synthetic oligonucleotide
  Target: SCN10A; (-) strand; PAM type: NRG; PAM sequence: AAG
ccttacttttatggtcttga

SEQ ID NO: 13977 - DNA, 20 bp, Artificial Sequence
  Description of Artificial Sequence: Synthetic oligonucleotide
  Target: SCN10A; (-) strand; PAM type: NRG; PAM sequence: TGG
tccagcagaccttactttta

SEQ ID NO: 13978 - DNA, 20 bp, Artificial Sequence
  Description of Artificial Sequence: Synthetic oligonucleotide
  Target: SCN10A; (-) strand; PAM type: NRG; PAM sequence: CAG
taagatgatggagtctccag

SEQ ID NO: 13979 - DNA, 20 bp, Artificial Sequence
  Description of Artificial Sequence: Synthetic oligonucleotide
  Target: SCN10A; (-) strand; PAM type: NRG; PAM sequence: CAG
ccgtaagatgatggagtctc

SEQ ID NO: 13980 - DNA, 20 bp, Artificial Sequence
  Description of Artificial Sequence: Synthetic oligonucleotide
  Target: SCN10A; (-) strand; PAM type: NRG; PAM sequence: GAG
cctcagaccgtaagatgatg

SEQ ID NO: 13981 - DNA, 20 bp, Artificial Sequence
  Description of Artificial Sequence: Synthetic oligonucleotide
  Target: SCN10A; (-) strand; PAM type: NRG; PAM sequence: TGG
aacctcagaccgtaagatga

SEQ ID NO: 13982 - DNA, 20 bp, Artificial Sequence
  Description of Artificial Sequence: Synthetic oligonucleotide
  Target: SCN10A; (-) strand; PAM type: NRG; PAM sequence: AAG
tcctgagaacctcagaccgt

SEQ ID NO: 13983 - DNA, 20 bp, Artificial Sequence
  Description of Artificial Sequence: Synthetic oligonucleotide
  Target: SCN10A; (-) strand; PAM type: NRG; PAM sequence: CAG
atcactcctcctgagaacct

SEQ ID NO: 13984 - DNA, 20 bp, Artificial Sequence
  Description of Artificial Sequence: Synthetic oligonucleotide
  Target: SCN10A; (-) strand; PAM type: NRG; PAM sequence: GAG
agggaataatcactcctcct

SEQ ID NO: 13985 - DNA, 20 bp, Artificial Sequence
  Description of Artificial Sequence: Synthetic oligonucleotide
  Target: SCN10A; (-) strand; PAM type: NRG; PAM sequence: GGG
tagaacctcaggggctgaca

SEQ ID NO: 13986 - DNA, 20 bp, Artificial Sequence
  Description of Artificial Sequence: Synthetic oligonucleotide
  Target: SCN10A; (-) strand; PAM type: NRG; PAM sequence: AGG
ctagaacctcaggggctgac

SEQ ID NO: 13987 - DNA, 20 bp, Artificial Sequence
  Description of Artificial Sequence: Synthetic oligonucleotide
  Target: SCN10A; (-) strand; PAM type: NRG; PAM sequence: CAG
gctagaacctcaggggctga

SEQ ID NO: 13988 - DNA, 20 bp, Artificial Sequence
  Description of Artificial Sequence: Synthetic oligonucleotide
  Target: SCN10A; (-) strand; PAM type: NRG; PAM sequence: GGG
gcccatggctagaacctcag

SEQ ID NO: 13989 - DNA, 20 bp, Artificial Sequence
  Description of Artificial Sequence: Synthetic oligonucleotide
  Target: SCN10A; (-) strand; PAM type: NRG; PAM sequence: GGG
agcccatggctagaacctca

SEQ ID NO: 13990 - DNA, 20 bp, Artificial Sequence
  Description of Artificial Sequence: Synthetic oligonucleotide
  Target: SCN10A; (-) strand; PAM type: NRG; PAM sequence: AGG
cagcccatggctagaacctc

SEQ ID NO: 13991 - DNA, 20 bp, Artificial Sequence
  Description of Artificial Sequence: Synthetic oligonucleotide
  Target: SCN10A; (-) strand; PAM type: NRG; PAM sequence: CAG
acagcccatggctagaacct

SEQ ID NO: 13992 - DNA, 20 bp, Artificial Sequence
  Description of Artificial Sequence: Synthetic oligonucleotide
  Target: SCN10A; (-) strand; PAM type: NRG; PAM sequence: TAG
ctgtgtgcacagcccatggc

SEQ ID NO: 13993 - DNA, 20 bp, Artificial Sequence
  Description of Artificial Sequence: Synthetic oligonucleotide
  Target: SCN10A; (-) strand; PAM type: NRG; PAM sequence: TGG
cctactgtgtgcacagccca

SEQ ID NO: 13994 - DNA, 20 bp, Artificial Sequence
  Description of Artificial Sequence: Synthetic oligonucleotide
  Target: SCN10A; (-) strand; PAM type: NRG; PAM sequence: CAG
tcaggcacctactgtgtgca

SEQ ID NO: 13995 - DNA, 20 bp, Artificial Sequence
  Description of Artificial Sequence: Synthetic oligonucleotide
  Target: SCN10A; (-) strand; PAM type: NRG; PAM sequence: AGG
tgctcacacgaagtgttttc

SEQ ID NO: 13996 - DNA, 20 bp, Artificial Sequence
  Description of Artificial Sequence: Synthetic oligonucleotide
  Target: SCN10A; (-) strand; PAM type: NRG; PAM sequence: CAG
atgctcacacgaagtgtttt

SEQ ID NO: 13997 - DNA, 20 bp, Artificial Sequence
  Description of Artificial Sequence: Synthetic oligonucleotide
  Target: SCN10A; (-) strand; PAM type: NRG; PAM sequence: AAG
gccttctccatgctcacacg

SEQ ID NO: 13998 - DNA, 20 bp, Artificial Sequence
  Description of Artificial Sequence: Synthetic oligonucleotide
  Target: SCN10A; (-) strand; PAM type: NRG; PAM sequence: TGG
gtgaaatgaagaggttctct

SEQ ID NO: 13999 - DNA, 20 bp, Artificial Sequence
  Description of Artificial Sequence: Synthetic oligonucleotide
  Target: SCN10A; (-) strand; PAM type: NRG; PAM sequence: AGG
gctctctcagtgaaatgaag

SEQ ID NO: 14000 - DNA, 20 bp, Artificial Sequence
  Description of Artificial Sequence: Synthetic oligonucleotide
  Target: SCN10A; (-) strand; PAM type: NRG; PAM sequence: GAG
tgctctctcagtgaaatgaa

SEQ ID NO: 14001 - DNA, 20 bp, Artificial Sequence
  Description of Artificial Sequence: Synthetic oligonucleotide
  Target: SCN10A; (-) strand; PAM type: NRG; PAM sequence: AAG
gctgctctctcagtgaaatg

SEQ ID NO: 14002 - DNA, 20 bp, Artificial Sequence
  Description of Artificial Sequence: Synthetic oligonucleotide
  Target: SCN10A; (-) strand; PAM type: NRG; PAM sequence: CAG
aatgccttgggctgctctct

SEQ ID NO: 14003 - DNA, 20 bp, Artificial Sequence
  Description of Artificial Sequence: Synthetic oligonucleotide
  Target: SCN10A; (-) strand; PAM type: NRG; PAM sequence: GGG
tagcaagttttaaatgcctt

SEQ ID NO: 14004 - DNA, 20 bp, Artificial Sequence
  Description of Artificial Sequence: Synthetic oligonucleotide
  Target: SCN10A; (-) strand; PAM type: NRG; PAM sequence: TGG
gtagcaagttttaaatgcct

SEQ ID NO: 14005 - DNA, 20 bp, Artificial Sequence
  Description of Artificial Sequence: Synthetic oligonucleotide
  Target: SCN10A; (-) strand; PAM type: NRG; PAM sequence: AAG
tgcagctttccaagagtagc

SEQ ID NO: 14006 - DNA, 20 bp, Artificial Sequence
  Description of Artificial Sequence: Synthetic oligonucleotide
  Target: SCN10A; (-) strand; PAM type: NRG; PAM sequence: TAG
tatttgcagctttccaagag

SEQ ID NO: 14007 - DNA, 20 bp, Artificial Sequence
  Description of Artificial Sequence: Synthetic oligonucleotide
  Target: SCN10A; (-) strand; PAM type: NRG; PAM sequence: GAG
ctgtatttgcagctttccaa

SEQ ID NO: 14008 - DNA, 20 bp, Artificial Sequence
  Description of Artificial Sequence: Synthetic oligonucleotide
  Target: SCN10A; (-) strand; PAM type: NRG; PAM sequence: AAG
ccctgtatttgcagctttcc

SEQ ID NO: 14009 - DNA, 20 bp, Artificial Sequence
  Description of Artificial Sequence: Synthetic oligonucleotide
  Target: SCN10A; (-) strand; PAM type: NRG; PAM sequence: CAG
ttagaagaaccctgtatttg

SEQ ID NO: 14010 - DNA, 20 bp, Artificial Sequence
  Description of Artificial Sequence: Synthetic oligonucleotide
  Target: SCN10A; (-) strand; PAM type: NRG; PAM sequence: AAG
gaaatacgtgtttatgttag

SEQ ID NO: 14011 - DNA, 20 bp, Artificial Sequence
  Description of Artificial Sequence: Synthetic oligonucleotide
  Target: SCN10A; (-) strand; PAM type: NRG; PAM sequence: TAG
tttgaaatacgtgtttatgt

SEQ ID NO: 14012 - DNA, 20 bp, Artificial Sequence
  Description of Artificial Sequence: Synthetic oligonucleotide
  Target: SCN10A; (-) strand; PAM type: NRG; PAM sequence: AGG
gggatgctcttctaaaacca

SEQ ID NO: 14013 - DNA, 20 bp, Artificial Sequence
  Description of Artificial Sequence: Synthetic oligonucleotide
  Target: SCN10A; (-) strand; PAM type: NRG; PAM sequence: AAG
tgggatgctcttctaaaacc

SEQ ID NO: 14014 - DNA, 20 bp, Artificial Sequence
  Description of Artificial Sequence: Synthetic oligonucleotide
  Target: SCN10A; (-) strand; PAM type: NRG; PAM sequence: GGG
acctctgtttgggggtcttt

SEQ ID NO: 14015 - DNA, 20 bp, Artificial Sequence
  Description of Artificial Sequence: Synthetic oligonucleotide
  Target: SCN10A; (-) strand; PAM type: NRG; PAM sequence: TGG
cacctctgtttgggggtctt

SEQ ID NO: 14016 - DNA, 20 bp, Artificial Sequence
  Description of Artificial Sequence: Synthetic oligonucleotide
  Target: SCN10A; (-) strand; PAM type: NRG; PAM sequence: GGG
gaagccccacctctgtttgg

SEQ ID NO: 14017 - DNA, 20 bp, Artificial Sequence
  Description of Artificial Sequence: Synthetic oligonucleotide
  Target: SCN10A; (-) strand; PAM type: NRG; PAM sequence: GGG
ggaagccccacctctgtttg

SEQ ID NO: 14018 - DNA, 20 bp, Artificial Sequence
  Description of Artificial Sequence: Synthetic oligonucleotide
  Target: SCN10A; (-) strand; PAM type: NRG; PAM sequence: GGG
gggaagccccacctctgttt

SEQ ID NO: 14019 - DNA, 20 bp, Artificial Sequence
  Description of Artificial Sequence: Synthetic oligonucleotide
  Target: SCN10A; (-) strand; PAM type: NRG; PAM sequence: TGG
ggggaagccccacctctgtt

SEQ ID NO: 14020 - DNA, 20 bp, Artificial Sequence
  Description of Artificial Sequence: Synthetic oligonucleotide
  Target: SCN10A; (-) strand; PAM type: NRG; PAM sequence: AAG
tgggcagccacgtggtgggg

SEQ ID NO: 14021 - DNA, 20 bp, Artificial Sequence
  Description of Artificial Sequence: Synthetic oligonucleotide
  Target: SCN10A; (-) strand; PAM type: NRG; PAM sequence: GGG
aagtgggcagccacgtggtg

SEQ ID NO: 14022 - DNA, 20 bp, Artificial Sequence
  Description of Artificial Sequence: Synthetic oligonucleotide
  Target: SCN10A; (-) strand; PAM type: NRG; PAM sequence: GGG
taagtgggcagccacgtggt

SEQ ID NO: 14023 - DNA, 20 bp, Artificial Sequence
  Description of Artificial Sequence: Synthetic oligonucleotide
  Target: SCN10A; (-) strand; PAM type: NRG; PAM sequence: TGG
gtaagtgggcagccacgtgg

SEQ ID NO: 14024 - DNA, 20 bp, Artificial Sequence
  Description of Artificial Sequence: Synthetic oligonucleotide
  Target: SCN10A; (-) strand; PAM type: NRG; PAM sequence: TGG
cgagtaagtgggcagccacg

SEQ ID NO: 14025 - DNA, 20 bp, Artificial Sequence
  Description of Artificial Sequence: Synthetic oligonucleotide
  Target: SCN10A; (-) strand; PAM type: NRG; PAM sequence: CAG
ctccattgcgagtaagtggg

SEQ ID NO: 14026 - DNA, 20 bp, Artificial Sequence
  Description of Artificial Sequence: Synthetic oligonucleotide
  Target: SCN10A; (-) strand; PAM type: NRG; PAM sequence: GGG
tctctccattgcgagtaagt

SEQ ID NO: 14027 - DNA, 20 bp, Artificial Sequence
  Description of Artificial Sequence: Synthetic oligonucleotide
  Target: SCN10A; (-) strand; PAM type: NRG; PAM sequence: TGG
ttctctccattgcgagtaag

SEQ ID NO: 14028 - DNA, 20 bp, Artificial Sequence
  Description of Artificial Sequence: Synthetic oligonucleotide
  Target: SCN10A; (-) strand; PAM type: NRG; PAM sequence: AAG
tggttctctccattgcgagt

SEQ ID NO: 14029 - DNA, 20 bp, Artificial Sequence
  Description of Artificial Sequence: Synthetic oligonucleotide
  Target: SCN10A; (-) strand; PAM type: NRG; PAM sequence: GAG
gtggtggttctctccattgc

SEQ ID NO: 14030 - DNA, 20 bp, Artificial Sequence
  Description of Artificial Sequence: Synthetic oligonucleotide
  Target: SCN10A; (-) strand; PAM type: NRG; PAM sequence: TGG
tgtgtttgacttcattgtgg

SEQ ID NO: 14031 - DNA, 20 bp, Artificial Sequence
  Description of Artificial Sequence: Synthetic oligonucleotide
  Target: SCN10A; (-) strand; PAM type: NRG; PAM sequence: TGG
gaatgtgtttgacttcattg

SEQ ID NO: 14032 - DNA, 20 bp, Artificial Sequence
  Description of Artificial Sequence: Synthetic oligonucleotide
  Target: SCN10A; (-) strand; PAM type: NRG; PAM sequence: TGG
agtactacttcacaaatggc

SEQ ID NO: 14033 - DNA, 20 bp, Artificial Sequence
  Description of Artificial Sequence: Synthetic oligonucleotide
  Target: SCN10A; (-) strand; PAM type: NRG; PAM sequence: TGG
aggcagtactacttcacaaa

SEQ ID NO: 14034 - DNA, 20 bp, Artificial Sequence
  Description of Artificial Sequence: Synthetic oligonucleotide
  Target: SCN10A; (-) strand; PAM type: NRG; PAM sequence: CAG
tgaagatgttcgctttgagg

SEQ ID NO: 14035 - DNA, 20 bp, Artificial Sequence
  Description of Artificial Sequence: Synthetic oligonucleotide
  Target: SCN10A; (-) strand; PAM type: NRG; PAM sequence: AGG
tcatgaagatgttcgctttg

SEQ ID NO: 14036 - DNA, 20 bp, Artificial Sequence
  Description of Artificial Sequence: Synthetic oligonucleotide
  Target: SCN10A; (-) strand; PAM type: NRG; PAM sequence: GAG
gtcatgaagatgttcgcttt

SEQ ID NO: 14037 - DNA, 20 bp, Artificial Sequence
  Description of Artificial Sequence: Synthetic oligonucleotide
  Target: SCN10A; (-) strand; PAM type: NRG; PAM sequence: AAG
tcacaggcgaatgtgtcatg

SEQ ID NO: 14038 - DNA, 20 bp, Artificial Sequence
  Description of Artificial Sequence: Synthetic oligonucleotide
  Target: SCN10A; (-) strand; PAM type: NRG; PAM sequence: AGG
ttctttgtggccgtcttcac

SEQ ID NO: 14039 - DNA, 20 bp, Artificial Sequence
  Description of Artificial Sequence: Synthetic oligonucleotide
  Target: SCN10A; (-) strand; PAM type: NRG; PAM sequence: CAG
gttctttgtggccgtcttca

SEQ ID NO: 14040 - DNA, 20 bp, Artificial Sequence
  Description of Artificial Sequence: Synthetic oligonucleotide
  Target: SCN10A; (-) strand; PAM type: NRG; PAM sequence: TGG
caaaatcaaccagttctttg

SEQ ID NO: 14041 - DNA, 20 bp, Artificial Sequence
  Description of Artificial Sequence: Synthetic oligonucleotide
  Target: SCN10A; (-) strand; PAM type: NRG; PAM sequence: CAG
aaattctgggcaaaatcaac

SEQ ID NO: 14042 - DNA, 20 bp, Artificial Sequence
  Description of Artificial Sequence: Synthetic oligonucleotide
  Target: SCN10A; (-) strand; PAM type: NRG; PAM sequence: GGG
gaagaaaagacgaaaattct

SEQ ID NO: 14043 - DNA, 20 bp, Artificial Sequence
  Description of Artificial Sequence: Synthetic oligonucleotide
  Target: SCN10A; (-) strand; PAM type: NRG; PAM sequence: TGG
tgaagaaaagacgaaaattc

SEQ ID NO: 14044 - DNA, 20 bp, Artificial Sequence
  Description of Artificial Sequence: Synthetic oligonucleotide
  Target: SCN10A; (-) strand; PAM type: NRG; PAM sequence: AAG
ctgatgaccaaagtgaagaa

SEQ ID NO: 14045 - DNA, 20 bp, Artificial Sequence
  Description of Artificial Sequence: Synthetic oligonucleotide
  Target: SCN10A; (-) strand; PAM type: NRG; PAM sequence: AAG
ggagactgatgaccaaagtg

SEQ ID NO: 14046 - DNA, 20 bp, Artificial Sequence
  Description of Artificial Sequence: Synthetic oligonucleotide
  Target: SCN10A; (-) strand; PAM type: NRG; PAM sequence: AAG
atggtggagactgatgacca

SEQ ID NO: 14047 - DNA, 20 bp, Artificial Sequence
  Description of Artificial Sequence: Synthetic oligonucleotide
  Target: SCN10A; (-) strand; PAM type: NRG; PAM sequence: GAG
acatgatcaccatgatggtg

SEQ ID NO: 14048 - DNA, 20 bp, Artificial Sequence
  Description of Artificial Sequence: Synthetic oligonucleotide
  Target: SCN10A; (-) strand; PAM type: NRG; PAM sequence: TGG
caacatgatcaccatgatgg

SEQ ID NO: 14049 - DNA, 20 bp, Artificial Sequence
  Description of Artificial Sequence: Synthetic oligonucleotide
  Target: SCN10A; (-) strand; PAM type: NRG; PAM sequence: TGG
cctcaacatgatcaccatga

SEQ ID NO: 14050 - DNA, 20 bp, Artificial Sequence
  Description of Artificial Sequence: Synthetic oligonucleotide
  Target: SCN10A; (-) strand; PAM type: NRG; PAM sequence: TGG
agcttttgacatcaccatca

SEQ ID NO: 14051 - DNA, 20 bp, Artificial Sequence
  Description of Artificial Sequence: Synthetic oligonucleotide
  Target: SCN10A; (-) strand; PAM type: NRG; PAM sequence: AAG
ctttgacatcgtgaccagac

SEQ ID NO: 14052 - DNA, 20 bp, Artificial Sequence
  Description of Artificial Sequence: Synthetic oligonucleotide
  Target: SCN10A; (-) strand; PAM type: NRG; PAM sequence: CAG
tttgtctttgacatcgtgac

SEQ ID NO: 14053 - DNA, 20 bp, Artificial Sequence
  Description of Artificial Sequence: Synthetic oligonucleotide
  Target: SCN10A; (-) strand; PAM type: NRG; PAM sequence: GGG
ttttctcagaacaagttcca

SEQ ID NO: 14054 - DNA, 20 bp, Artificial Sequence
  Description of Artificial Sequence: Synthetic oligonucleotide
  Target: SCN10A; (-) strand; PAM type: NRG; PAM sequence: AGG
gttttctcagaacaagttcc

SEQ ID NO: 14055 - DNA, 20 bp, Artificial Sequence
  Description of Artificial Sequence: Synthetic oligonucleotide
  Target: SCN10A; (-) strand; PAM type: NRG; PAM sequence: CAG
tgttttctcagaacaagttc

SEQ ID NO: 14056 - DNA, 20 bp, Artificial Sequence
  Description of Artificial Sequence: Synthetic oligonucleotide
  Target: SCN10A; (-) strand; PAM type: NRG; PAM sequence: AAG
atctcttgttttctcagaac

SEQ ID NO: 14057 - DNA, 20 bp, Artificial Sequence
  Description of Artificial Sequence: Synthetic oligonucleotide
  Target: SCN10A; (-) strand; PAM type: NRG; PAM sequence: CAG
gccactatctcttgttttct

SEQ ID NO: 14058 - DNA, 20 bp, Artificial Sequence
  Description of Artificial Sequence: Synthetic oligonucleotide
  Target: SCN10A; (-) strand; PAM type: NRG; PAM sequence: AGG
cctggtttgtgctggcccaa

SEQ ID NO: 14059 - DNA, 20 bp, Artificial Sequence
  Description of Artificial Sequence: Synthetic oligonucleotide
  Target: SCN10A; (-) strand; PAM type: NRG; PAM sequence: AAG
gcctggtttgtgctggccca

SEQ ID NO: 14060 - DNA, 20 bp, Artificial Sequence
  Description of Artificial Sequence: Synthetic oligonucleotide
  Target: SCN10A; (-) strand; PAM type: NRG; PAM sequence: TGG
cacagatgcctggtttgtgc

SEQ ID NO: 14061 - DNA, 20 bp, Artificial Sequence
  Description of Artificial Sequence: Synthetic oligonucleotide
  Target: SCN10A; (-) strand; PAM type: NRG; PAM sequence: TGG
ctacagataacacagatgcc

SEQ ID NO: 14062 - DNA, 20 bp, Artificial Sequence
  Description of Artificial Sequence: Synthetic oligonucleotide
  Target: SCN10A; (-) strand; PAM type: NRG; PAM sequence: CAG
aaactcatctacagataaca

SEQ ID NO: 14063 - DNA, 20 bp, Artificial Sequence
  Description of Artificial Sequence: Synthetic oligonucleotide
  Target: SCN10A; (-) strand; PAM type: NRG; PAM sequence: CAG
atggagacaaaactcatcta

SEQ ID NO: 14064 - DNA, 20 bp, Artificial Sequence
  Description of Artificial Sequence: Synthetic oligonucleotide
  Target: SCN10A; (-) strand; PAM type: NRG; PAM sequence: GAG
ttaagatgtggagtgtgatg

SEQ ID NO: 14065 - DNA, 20 bp, Artificial Sequence
  Description of Artificial Sequence: Synthetic oligonucleotide
  Target: SCN10A; (-) strand; PAM type: NRG; PAM sequence: TGG
tgttaagatgtggagtgtga

SEQ ID NO: 14066 - DNA, 20 bp, Artificial Sequence
  Description of Artificial Sequence: Synthetic oligonucleotide
  Target: SCN10A; (-) strand; PAM type: NRG; PAM sequence: GAG
ttcgcttctgttaagatgtg

SEQ ID NO: 14067 - DNA, 20 bp, Artificial Sequence
  Description of Artificial Sequence: Synthetic oligonucleotide
  Target: SCN10A; (-) strand; PAM type: NRG; PAM sequence: TGG
atttcgcttctgttaagatg

SEQ ID NO: 14068 - DNA, 20 bp, Artificial Sequence
  Description of Artificial Sequence: Synthetic oligonucleotide
  Target: SCN10A; (-) strand; PAM type: NRG; PAM sequence: AAG
gatagtatttcgcttctgtt

SEQ ID NO: 14069 - DNA, 20 bp, Artificial Sequence
  Description of Artificial Sequence: Synthetic oligonucleotide
  Target: SCN10A; (-) strand; PAM type: NRG; PAM sequence: TAG
aattttggaagaggtaagga

SEQ ID NO: 14070 - DNA, 20 bp, Artificial Sequence
  Description of Artificial Sequence: Synthetic oligonucleotide
  Target: SCN10A; (-) strand; PAM type: NRG; PAM sequence: AGG
gtgaaattttggaagaggta

SEQ ID NO: 14071 - DNA, 20 bp, Artificial Sequence
  Description of Artificial Sequence: Synthetic oligonucleotide
  Target: SCN10A; (-) strand; PAM type: NRG; PAM sequence: AAG
agtgaaattttggaagaggt

SEQ ID NO: 14072 - DNA, 20 bp, Artificial Sequence
  Description of Artificial Sequence: Synthetic oligonucleotide
  Target: SCN10A; (-) strand; PAM type: NRG; PAM sequence: AGG
taaaagtgaaattttggaag

SEQ ID NO: 14073 - DNA, 20 bp, Artificial Sequence
  Description of Artificial Sequence: Synthetic oligonucleotide
  Target: SCN10A; (-) strand; PAM type: NRG; PAM sequence: GAG
ctaaaagtgaaattttggaa

SEQ ID NO: 14074 - DNA, 20 bp, Artificial Sequence
  Description of Artificial Sequence: Synthetic oligonucleotide
  Target: SCN10A; (-) strand; PAM type: NRG; PAM sequence: AAG
aactaaaagtgaaattttgg

SEQ ID NO: 14075 - DNA, 20 bp, Artificial Sequence
  Description of Artificial Sequence: Synthetic oligonucleotide
  Target: SCN10A; (-) strand; PAM type: NRG; PAM sequence: TGG
gtcaactaaaagtgaaattt

SEQ ID NO: 14076 - DNA, 20 bp, Artificial Sequence
  Description of Artificial Sequence: Synthetic oligonucleotide
  Target: SCN10A; (-) strand; PAM type: NRG; PAM sequence: AAG
aatgaggtagagtcaactaa

SEQ ID NO: 14077 - DNA, 20 bp, Artificial Sequence
  Description of Artificial Sequence: Synthetic oligonucleotide
  Target: SCN10A; (-) strand; PAM type: NRG; PAM sequence: GAG
tgaactggggcaatgaggta

SEQ ID NO: 14078 - DNA, 20 bp, Artificial Sequence
  Description of Artificial Sequence: Synthetic oligonucleotide
  Target: SCN10A; (-) strand; PAM type: NRG; PAM sequence: TAG
cttgaactggggcaatgagg

SEQ ID NO: 14079 - DNA, 20 bp, Artificial Sequence
  Description of Artificial Sequence: Synthetic oligonucleotide
  Target: SCN10A; (-) strand; PAM type: NRG; PAM sequence: AGG
ggacttgaactggggcaatg

SEQ ID NO: 14080 - DNA, 20 bp, Artificial Sequence
  Description of Artificial Sequence: Synthetic oligonucleotide
  Target: SCN10A; (-) strand; PAM type: NRG; PAM sequence: GAG
aggacttgaactggggcaat

SEQ ID NO: 14081 - DNA, 20 bp, Artificial Sequence
  Description of Artificial Sequence: Synthetic oligonucleotide
  Target: SCN10A; (-) strand; PAM type: NRG; PAM sequence: GGG
ggtattaaggacttgaactg

SEQ ID NO: 14082 - DNA, 20 bp, Artificial Sequence
  Description of Artificial Sequence: Synthetic oligonucleotide
  Target: SCN10A; (-) strand; PAM type: NRG; PAM sequence: GGG
aggtattaaggacttgaact

SEQ ID NO: 14083 - DNA, 20 bp, Artificial Sequence
  Description of Artificial Sequence: Synthetic oligonucleotide
  Target: SCN10A; (-) strand; PAM type: NRG; PAM sequence: TGG
gaggtattaaggacttgaac

SEQ ID NO: 14084 - DNA, 20 bp, Artificial Sequence
  Description of Artificial Sequence: Synthetic oligonucleotide
  Target: SCN10A; (-) strand; PAM type: NRG; PAM sequence: AGG
aagggccaggagaggtatta

SEQ ID NO: 14085 - DNA, 20 bp, Artificial Sequence
  Description of Artificial Sequence: Synthetic oligonucleotide
  Target: SCN10A; (-) strand; PAM type: NRG; PAM sequence: AAG
aaagggccaggagaggtatt

SEQ ID NO: 14086 - DNA, 20 bp, Artificial Sequence
  Description of Artificial Sequence: Synthetic oligonucleotide
  Target: SCN10A; (-) strand; PAM type: NRG; PAM sequence: AGG
tggcatcaaagggccaggag

SEQ ID NO: 14087 - DNA, 20 bp, Artificial Sequence
  Description of Artificial Sequence: Synthetic oligonucleotide
  Target: SCN10A; (-) strand; PAM type: NRG; PAM sequence: GAG
gtggcatcaaagggccagga

SEQ ID NO: 14088 - DNA, 20 bp, Artificial Sequence
  Description of Artificial Sequence: Synthetic oligonucleotide
  Target: SCN10A; (-) strand; PAM type: NRG; PAM sequence: GAG
tggtggcatcaaagggccag

SEQ ID NO: 14089 - DNA, 20 bp, Artificial Sequence
  Description of Artificial Sequence: Synthetic oligonucleotide
  Target: SCN10A; (-) strand; PAM type: NRG; PAM sequence: AGG
cctggtggcatcaaagggcc

SEQ ID NO: 14090 - DNA, 20 bp, Artificial Sequence
  Description of Artificial Sequence: Synthetic oligonucleotide
  Target: SCN10A; (-) strand; PAM type: NRG; PAM sequence: CAG
gcctggtggcatcaaagggc

SEQ ID NO: 14091 - DNA, 20 bp, Artificial Sequence
  Description of Artificial Sequence: Synthetic oligonucleotide
  Target: SCN10A; (-) strand; PAM type: NRG; PAM sequence: GGG
aagggcctggtggcatcaaa

SEQ ID NO: 14092 - DNA, 20 bp, Artificial Sequence
  Description of Artificial Sequence: Synthetic oligonucleotide
  Target: SCN10A; (-) strand; PAM type: NRG; PAM sequence: AGG
gaagggcctggtggcatcaa

SEQ ID NO: 14093 - DNA, 20 bp, Artificial Sequence
  Description of Artificial Sequence: Synthetic oligonucleotide
  Target: SCN10A; (-) strand; PAM type: NRG; PAM sequence: AAG
agaagggcctggtggcatca

SEQ ID NO: 14094 - DNA, 20 bp, Artificial Sequence
  Description of Artificial Sequence: Synthetic oligonucleotide
  Target: SCN10A; (-) strand; PAM type: NRG; PAM sequence: TGG
aggacaaaagaagggcctgg

SEQ ID NO: 14095 - DNA, 20 bp, Artificial Sequence
  Description of Artificial Sequence: Synthetic oligonucleotide
  Target: SCN10A; (-) strand; PAM type: NRG; PAM sequence: TGG
accaggacaaaagaagggcc

SEQ ID NO: 14096 - DNA, 20 bp, Artificial Sequence
  Description of Artificial Sequence: Synthetic oligonucleotide
  Target: SCN10A; (-) strand; PAM type: NRG; PAM sequence: GGG
cacagaccaggacaaaagaa

SEQ ID NO: 14097 - DNA, 20 bp, Artificial Sequence
  Description of Artificial Sequence: Synthetic oligonucleotide
  Target: SCN10A; (-) strand; PAM type: NRG; PAM sequence: AGG
gcacagaccaggacaaaaga

SEQ ID NO: 14098 - DNA, 20 bp, Artificial Sequence
  Description of Artificial Sequence: Synthetic oligonucleotide
  Target: SCN10A; (-) strand; PAM type: NRG; PAM sequence: AAG
ggcacagaccaggacaaaag

SEQ ID NO: 14099 - DNA, 20 bp, Artificial Sequence
  Description of Artificial Sequence: Synthetic oligonucleotide
  Target: SCN10A; (-) strand; PAM type: NRG; PAM sequence: AAG
aagggcacagaccaggacaa

SEQ ID NO: 14100 - DNA, 20 bp, Artificial Sequence
  Description of Artificial Sequence: Synthetic oligonucleotide
  Target: SCN10A; (-) strand; PAM type: NRG; PAM sequence: AGG
tagaggcaagggcacagacc

SEQ ID NO: 14101 - DNA, 20 bp, Artificial Sequence
  Description of Artificial Sequence: Synthetic oligonucleotide
  Target: SCN10A; (-) strand; PAM type: NRG; PAM sequence: CAG
atagaggcaagggcacagac

SEQ ID NO: 14102 - DNA, 20 bp, Artificial Sequence
  Description of Artificial Sequence: Synthetic oligonucleotide
  Target: SCN10A; (-) strand; PAM type: NRG; PAM sequence: CAG
tgtgaatagaggcaagggca

SEQ ID NO: 14103 - DNA, 20 bp, Artificial Sequence
  Description of Artificial Sequence: Synthetic oligonucleotide
  Target: SCN10A; (-) strand; PAM type: NRG; PAM sequence: GGG
ggcattgtgaatagaggcaa

SEQ ID NO: 14104 - DNA, 20 bp, Artificial Sequence
  Description of Artificial Sequence: Synthetic oligonucleotide
  Target: SCN10A; (-) strand; PAM type: NRG; PAM sequence: AGG
gggcattgtgaatagaggca

SEQ ID NO: 14105 - DNA, 20 bp, Artificial Sequence
  Description of Artificial Sequence: Synthetic oligonucleotide
  Target: SCN10A; (-) strand; PAM type: NRG; PAM sequence: AAG
agggcattgtgaatagaggc

SEQ ID NO: 14106 - DNA, 20 bp, Artificial Sequence
  Description of Artificial Sequence: Synthetic oligonucleotide
  Target: SCN10A; (-) strand; PAM type: NRG; PAM sequence: AGG
taggagggcattgtgaatag

SEQ ID NO: 14107 - DNA, 20 bp, Artificial Sequence
  Description of Artificial Sequence: Synthetic oligonucleotide
  Target: SCN10A; (-) strand; PAM type: NRG; PAM sequence: GAG
ataggagggcattgtgaata

SEQ ID NO: 14108 - DNA, 20 bp, Artificial Sequence
  Description of Artificial Sequence: Synthetic oligonucleotide
  Target: SCN10A; (-) strand; PAM type: NRG; PAM sequence: TAG
agataggagggcattgtgaa

SEQ ID NO: 14109 - DNA, 20 bp, Artificial Sequence
  Description of Artificial Sequence: Synthetic oligonucleotide
  Target: SCN10A; (-) strand; PAM type: NRG; PAM sequence: GGG
agccaagagaggagatagga

SEQ ID NO: 14110 - DNA, 20 bp, Artificial Sequence
  Description of Artificial Sequence: Synthetic oligonucleotide
  Target: SCN10A; (-) strand; PAM type: NRG; PAM sequence: AGG
cagccaagagaggagatagg

SEQ ID NO: 14111 - DNA, 20 bp, Artificial Sequence
  Description of Artificial Sequence: Synthetic oligonucleotide
  Target: SCN10A; (-) strand; PAM type: NRG; PAM sequence: GAG
acagccaagagaggagatag

SEQ ID NO: 14112 - DNA, 20 bp, Artificial Sequence
  Description of Artificial Sequence: Synthetic oligonucleotide
  Target: SCN10A; (-) strand; PAM type: NRG; PAM sequence: AGG
agacagccaagagaggagat

SEQ ID NO: 14113 - DNA, 20 bp, Artificial Sequence
  Description of Artificial Sequence: Synthetic oligonucleotide
  Target: SCN10A; (-) strand; PAM type: NRG; PAM sequence: TAG
tagacagccaagagaggaga

SEQ ID NO: 14114 - DNA, 20 bp, Artificial Sequence
  Description of Artificial Sequence: Synthetic oligonucleotide
  Target: SCN10A; (-) strand; PAM type: NRG; PAM sequence: GAG
aatttagacagccaagagag

SEQ ID NO: 14115 - DNA, 20 bp, Artificial Sequence
  Description of Artificial Sequence: Synthetic oligonucleotide
  Target: SCN10A; (-) strand; PAM type: NRG; PAM sequence: AGG
ggaatttagacagccaagag

SEQ ID NO: 14116 - DNA, 20 bp, Artificial Sequence
  Description of Artificial Sequence: Synthetic oligonucleotide
  Target: SCN10A; (-) strand; PAM type: NRG; PAM sequence: GAG
tggaatttagacagccaaga

SEQ ID NO: 14117 - DNA, 20 bp, Artificial Sequence
  Description of Artificial Sequence: Synthetic oligonucleotide
  Target: SCN10A; (-) strand; PAM type: NRG; PAM sequence: GAG
gttggaatttagacagccaa

SEQ ID NO: 14118 - DNA, 20 bp, Artificial Sequence
  Description of Artificial Sequence: Synthetic oligonucleotide
  Target: SCN10A; (-) strand; PAM type: NRG; PAM sequence: AAG
ctgttggaatttagacagcc

SEQ ID NO: 14119 - DNA, 20 bp, Artificial Sequence
  Description of Artificial Sequence: Synthetic oligonucleotide
  Target: SCN10A; (-) strand; PAM type: NRG; PAM sequence: CAG
caagactgttggaatttaga

SEQ ID NO: 14120 - DNA, 20 bp, Artificial Sequence
  Description of Artificial Sequence: Synthetic oligonucleotide
  Target: SCN10A; (-) strand; PAM type: NRG; PAM sequence: TAG
tactcaagactgttggaatt

SEQ ID NO: 14121 - DNA, 20 bp, Artificial Sequence
  Description of Artificial Sequence: Synthetic oligonucleotide
  Target: SCN10A; (-) strand; PAM type: NRG; PAM sequence: TGG
gatggattactcaagactgt

SEQ ID NO: 14122 - DNA, 20 bp, Artificial Sequence
  Description of Artificial Sequence: Synthetic oligonucleotide
  Target: SCN10A; (-) strand; PAM type: NRG; PAM sequence: AAG
ttaaaagagatggattactc

SEQ ID NO: 14123 - DNA, 20 bp, Artificial Sequence
  Description of Artificial Sequence: Synthetic oligonucleotide
  Target: SCN10A; (-) strand; PAM type: NRG; PAM sequence: TGG
taagtggagcttaaaagaga

SEQ ID NO: 14124 - DNA, 20 bp, Artificial Sequence
  Description of Artificial Sequence: Synthetic oligonucleotide
  Target: SCN10A; (-) strand; PAM type: NRG; PAM sequence: GAG
gcagtaagtggagcttaaaa

SEQ ID NO: 14125 - DNA, 20 bp, Artificial Sequence
  Description of Artificial Sequence: Synthetic oligonucleotide
  Target: SCN10A; (-) strand; PAM type: NRG; PAM sequence: AAG
atgcagtaagtggagcttaa

SEQ ID NO: 14126 - DNA, 20 bp, Artificial Sequence
  Description of Artificial Sequence: Synthetic oligonucleotide
  Target: SCN10A; (-) strand; PAM type: NRG; PAM sequence: GAG
gacactccatgcagtaagtg

SEQ ID NO: 14127 - DNA, 20 bp, Artificial Sequence
  Description of Artificial Sequence: Synthetic oligonucleotide
  Target: SCN10A; (-) strand; PAM type: NRG; PAM sequence: TGG
gggacactccatgcagtaag

SEQ ID NO: 14128 - DNA, 20 bp, Artificial Sequence
  Description of Artificial Sequence: Synthetic oligonucleotide
  Target: SCN10A; (-) strand; PAM type: NRG; PAM sequence: AAG
taagggacactccatgcagt

SEQ ID NO: 14129 - DNA, 20 bp, Artificial Sequence
  Description of Artificial Sequence: Synthetic oligonucleotide
  Target: SCN10A; (-) strand; PAM type: NRG; PAM sequence: CAG
tgactaagggacactccatg

SEQ ID NO: 14130 - DNA, 20 bp, Artificial Sequence
  Description of Artificial Sequence: Synthetic oligonucleotide
  Target: SCN10A; (-) strand; PAM type: NRG; PAM sequence: GGG
gtgtgttgtcacgtgactaa

SEQ ID NO: 14131 - DNA, 20 bp, Artificial Sequence
  Description of Artificial Sequence: Synthetic oligonucleotide
  Target: SCN10A; (-) strand; PAM type: NRG; PAM sequence: AGG
agtgtgttgtcacgtgacta

SEQ ID NO: 14132 - DNA, 20 bp, Artificial Sequence
  Description of Artificial Sequence: Synthetic oligonucleotide
  Target: SCN10A; (-) strand; PAM type: NRG; PAM sequence: AAG
tagtgtgttgtcacgtgact

SEQ ID NO: 14133 - DNA, 20 bp, Artificial Sequence
  Description of Artificial Sequence: Synthetic oligonucleotide
  Target: SCN10A; (-) strand; PAM type: NRG; PAM sequence: TAG
ggatccccaaagggacaggg

SEQ ID NO: 14134 - DNA, 20 bp, Artificial Sequence
  Description of Artificial Sequence: Synthetic oligonucleotide
  Target: SCN10A; (-) strand; PAM type: NRG; PAM sequence: GGG
gtgggatccccaaagggaca

SEQ ID NO: 14135 - DNA, 20 bp, Artificial Sequence
  Description of Artificial Sequence: Synthetic oligonucleotide
  Target: SCN10A; (-) strand; PAM type: NRG; PAM sequence: AGG
agtgggatccccaaagggac

SEQ ID NO: 14136 - DNA, 20 bp, Artificial Sequence
  Description of Artificial Sequence: Synthetic oligonucleotide
  Target: SCN10A; (-) strand; PAM type: NRG; PAM sequence: CAG
aagtgggatccccaaaggga

SEQ ID NO: 14137 - DNA, 20 bp, Artificial Sequence
  Description of Artificial Sequence: Synthetic oligonucleotide
  Target: SCN10A; (-) strand; PAM type: NRG; PAM sequence: GGG
tgaaaagtgggatccccaaa

SEQ ID NO: 14138 - DNA, 20 bp, Artificial Sequence
  Description of Artificial Sequence: Synthetic oligonucleotide
  Target: SCN10A; (-) strand; PAM type: NRG; PAM sequence: AGG
ctgaaaagtgggatccccaa

SEQ ID NO: 14139 - DNA, 20 bp, Artificial Sequence
  Description of Artificial Sequence: Synthetic oligonucleotide
  Target: SCN10A; (-) strand; PAM type: NRG; PAM sequence: AAG
actgaaaagtgggatcccca

SEQ ID NO: 14140 - DNA, 20 bp, Artificial Sequence
  Description of Artificial Sequence: Synthetic oligonucleotide
  Target: SCN10A; (-) strand; PAM type: NRG; PAM sequence: GGG
ctcgaggctgactgaaaagt

SEQ ID NO: 14141 - DNA, 20 bp, Artificial Sequence
  Description of Artificial Sequence: Synthetic oligonucleotide
  Target: SCN10A; (-) strand; PAM type: NRG; PAM sequence: TGG
actcgaggctgactgaaaag

SEQ ID NO: 14142 - DNA, 20 bp, Artificial Sequence
  Description of Artificial Sequence: Synthetic oligonucleotide
  Target: SCN10A; (-) strand; PAM type: NRG; PAM sequence: AAG
agaactcgaggctgactgaa

SEQ ID NO: 14143 - DNA, 20 bp, Artificial Sequence
  Description of Artificial Sequence: Synthetic oligonucleotide
  Target: SCN10A; (-) strand; PAM type: NRG; PAM sequence: AGG
atacaaaatgctagaactcg

SEQ ID NO: 14144 - DNA, 20 bp, Artificial Sequence
  Description of Artificial Sequence: Synthetic oligonucleotide
  Target: SCN10A; (-) strand; PAM type: NRG; PAM sequence: GAG
tatacaaaatgctagaactc

SEQ ID NO: 14145 - DNA, 20 bp, Artificial Sequence
  Description of Artificial Sequence: Synthetic oligonucleotide
  Target: SCN10A; (-) strand; PAM type: NRG; PAM sequence: TAG
aagacgcatatacaaaatgc

SEQ ID NO: 14146 - DNA, 20 bp, Artificial Sequence
  Description of Artificial Sequence: Synthetic oligonucleotide
  Target: SCN10A; (-) strand; PAM type: NRG; PAM sequence: AAG
cagctcattgtctagtagag

SEQ ID NO: 14147 - DNA, 20 bp, Artificial Sequence
  Description of Artificial Sequence: Synthetic oligonucleotide
  Target: SCN10A; (-) strand; PAM type: NRG; PAM sequence: GAG
aaacagctcattgtctagta

SEQ ID NO: 14148 - DNA, 20 bp, Artificial Sequence
  Description of Artificial Sequence: Synthetic oligonucleotide
  Target: SCN10A; (-) strand; PAM type: NRG; PAM sequence: TAG
tcaaacagctcattgtctag

SEQ ID NO: 14149 - DNA, 20 bp, Artificial Sequence
  Description of Artificial Sequence: Synthetic oligonucleotide
  Target: SCN10A; (-) strand; PAM type: NRG; PAM sequence: TAG
tcctcaaacagctcattgtc

SEQ ID NO: 14150 - DNA, 20 bp, Artificial Sequence
  Description of Artificial Sequence: Synthetic oligonucleotide
  Target: SCN10A; (-) strand; PAM type: NRG; PAM sequence: CAG
gtatagcccttgtcctcaaa

SEQ ID NO: 14151 - DNA, 20 bp, Artificial Sequence
  Description of Artificial Sequence: Synthetic oligonucleotide
  Target: SCN10A; (-) strand; PAM type: NRG; PAM sequence: TAG
aaacaaagttaaggaaggta

SEQ ID NO: 14152 - DNA, 20 bp, Artificial Sequence
  Description of Artificial Sequence: Synthetic oligonucleotide
  Target: SCN10A; (-) strand; PAM type: NRG; PAM sequence: AGG
cagggaaacaaagttaagga

SEQ ID NO: 14153 - DNA, 20 bp, Artificial Sequence
  Description of Artificial Sequence: Synthetic oligonucleotide
  Target: SCN10A; (-) strand; PAM type: NRG; PAM sequence: AAG
gcagggaaacaaagttaagg

SEQ ID NO: 14154 - DNA, 20 bp, Artificial Sequence
  Description of Artificial Sequence: Synthetic oligonucleotide
  Target: SCN10A; (-) strand; PAM type: NRG; PAM sequence: AGG
actgcagggaaacaaagtta

SEQ ID NO: 14155 - DNA, 20 bp, Artificial Sequence
  Description of Artificial Sequence: Synthetic oligonucleotide
  Target: SCN10A; (-) strand; PAM type: NRG; PAM sequence: AAG
cactgcagggaaacaaagtt

SEQ ID NO: 14156 - DNA, 20 bp, Artificial Sequence
  Description of Artificial Sequence: Synthetic oligonucleotide
  Target: SCN10A; (-) strand; PAM type: NRG; PAM sequence: AAG
cagggcactgcagggaaaca

SEQ ID NO: 14157 - DNA, 20 bp, Artificial Sequence
  Description of Artificial Sequence: Synthetic oligonucleotide
  Target: SCN10A; (-) strand; PAM type: NRG; PAM sequence: GGG
gcaatgtgcagggcactgca

SEQ ID NO: 14158 - DNA, 20 bp, Artificial Sequence
  Description of Artificial Sequence: Synthetic oligonucleotide
  Target: SCN10A; (-) strand; PAM type: NRG; PAM sequence: AGG
tgcaatgtgcagggcactgc

SEQ ID NO: 14159 - DNA, 20 bp, Artificial Sequence
  Description of Artificial Sequence: Synthetic oligonucleotide
  Target: SCN10A; (-) strand; PAM type: NRG; PAM sequence: CAG
ttgcaatgtgcagggcactg

SEQ ID NO: 14160 - DNA, 20 bp, Artificial Sequence
  Description of Artificial Sequence: Synthetic oligonucleotide
  Target: SCN10A; (-) strand; PAM type: NRG; PAM sequence: GGG
ttgaactcttgcaatgtgca

SEQ ID NO: 14161 - DNA, 20 bp, Artificial Sequence
  Description of Artificial Sequence: Synthetic oligonucleotide
  Target: SCN10A; (-) strand; PAM type: NRG; PAM sequence: AGG
cttgaactcttgcaatgtgc

SEQ ID NO: 14162 - DNA, 20 bp, Artificial Sequence
  Description of Artificial Sequence: Synthetic oligonucleotide
  Target: SCN10A; (-) strand; PAM type: NRG; PAM sequence: CAG
tcttgaactcttgcaatgtg

SEQ ID NO: 14163 - DNA, 20 bp, Artificial Sequence
  Description of Artificial Sequence: Synthetic oligonucleotide
  Target: SCN10A; (-) strand; PAM type: NRG; PAM sequence: CAG
gctcaaattaatatttcaag

SEQ ID NO: 14164 - DNA, 20 bp, Artificial Sequence
  Description of Artificial Sequence: Synthetic oligonucleotide
  Target: SCN10A; (-) strand; PAM type: NRG; PAM sequence: AAG
gtagctcaaattaatatttc

SEQ ID NO: 14165 - DNA, 20 bp, Artificial Sequence
  Description of Artificial Sequence: Synthetic oligonucleotide
  Target: SCN10A; (-) strand; PAM type: NRG; PAM sequence: TAG
tgactttactctcagcaaag

SEQ ID NO: 14166 - DNA, 20 bp, Artificial Sequence
  Description of Artificial Sequence: Synthetic oligonucleotide
  Target: SCN10A; (-) strand; PAM type: NRG; PAM sequence: AAG
acttgactttactctcagca

SEQ ID NO: 14167 - DNA, 20 bp, Artificial Sequence
  Description of Artificial Sequence: Synthetic oligonucleotide
  Target: SCN10A; (-) strand; PAM type: NRG; PAM sequence: CAG
tttgcacttgactttactct

SEQ ID NO: 14168 - DNA, 20 bp, Artificial Sequence
  Description of Artificial Sequence: Synthetic oligonucleotide
  Target: SCN10A; (-) strand; PAM type: NRG; PAM sequence: AAG
gagggaacatttccaagaat

SEQ ID NO: 14169 - DNA, 20 bp, Artificial Sequence
  Description of Artificial Sequence: Synthetic oligonucleotide
  Target: SCN10A; (-) strand; PAM type: NRG; PAM sequence: AAG
ggaacagagggaacatttcc

SEQ ID NO: 14170 - DNA, 20 bp, Artificial Sequence
  Description of Artificial Sequence: Synthetic oligonucleotide
  Target: SCN10A; (-) strand; PAM type: NRG; PAM sequence: GGG
tgcacagcaccaggaacaga

SEQ ID NO: 14171 - DNA, 20 bp, Artificial Sequence
  Description of Artificial Sequence: Synthetic oligonucleotide
  Target: SCN10A; (-) strand; PAM type: NRG; PAM sequence: AGG
ttgcacagcaccaggaacag

SEQ ID NO: 14172 - DNA, 20 bp, Artificial Sequence
  Description of Artificial Sequence: Synthetic oligonucleotide
  Target: SCN10A; (-) strand; PAM type: NRG; PAM sequence: GAG
tttgcacagcaccaggaaca

SEQ ID NO: 14173 - DNA, 20 bp, Artificial Sequence
  Description of Artificial Sequence: Synthetic oligonucleotide
  Target: SCN10A; (-) strand; PAM type: NRG; PAM sequence: CAG
catttgcacagcaccaggaa

SEQ ID NO: 14174 - DNA, 20 bp, Artificial Sequence
  Description of Artificial Sequence: Synthetic oligonucleotide
  Target: SCN10A; (-) strand; PAM type: NRG; PAM sequence: AGG
ttaggcatttgcacagcacc

SEQ ID NO: 14175 - DNA, 20 bp, Artificial Sequence
  Description of Artificial Sequence: Synthetic oligonucleotide
  Target: SCN10A; (-) strand; PAM type: NRG; PAM sequence: CAG
cttaggcatttgcacagcac

SEQ ID NO: 14176 - DNA, 20 bp, Artificial Sequence
  Description of Artificial Sequence: Synthetic oligonucleotide
  Target: SCN10A; (-) strand; PAM type: NRG; PAM sequence: CAG
catttgcttaggcatttgca

SEQ ID NO: 14177 - DNA, 20 bp, Artificial Sequence
  Description of Artificial Sequence: Synthetic oligonucleotide
  Target: SCN10A; (-) strand; PAM type: NRG; PAM sequence: AGG
ccctatacctgcatttgctt

SEQ ID NO: 14178 - DNA, 20 bp, Artificial Sequence
  Description of Artificial Sequence: Synthetic oligonucleotide
  Target: SCN10A; (-) strand; PAM type: NRG; PAM sequence: TAG
gccctatacctgcatttgct

SEQ ID NO: 14179 - DNA, 20 bp, Artificial Sequence
  Description of Artificial Sequence: Synthetic oligonucleotide
  Target: SCN10A; (-) strand; PAM type: NRG; PAM sequence: AAG
cttccaagatgcaaacaacc

SEQ ID NO: 14180 - DNA, 20 bp, Artificial Sequence
  Description of Artificial Sequence: Synthetic oligonucleotide
  Target: SCN10A; (-) strand; PAM type: NRG; PAM sequence: AAG
aggccactctgcctccttcc

SEQ ID NO: 14181 - DNA, 20 bp, Artificial Sequence
  Description of Artificial Sequence: Synthetic oligonucleotide
  Target: SCN10A; (-) strand; PAM type: NRG; PAM sequence: AGG
aaatgatctcttggttatcc

SEQ ID NO: 14182 - DNA, 20 bp, Artificial Sequence
  Description of Artificial Sequence: Synthetic oligonucleotide
  Target: SCN10A; (-) strand; PAM type: NRG; PAM sequence: CAG
taaatgatctcttggttatc

SEQ ID NO: 14183 - DNA, 20 bp, Artificial Sequence
  Description of Artificial Sequence: Synthetic oligonucleotide
  Target: SCN10A; (-) strand; PAM type: NRG; PAM sequence: TGG
accagatataaatgatctct

SEQ ID NO: 14184 - DNA, 20 bp, Artificial Sequence
  Description of Artificial Sequence: Synthetic oligonucleotide
  Target: SCN10A; (-) strand; PAM type: NRG; PAM sequence: CAG
aaagacaccataaaaataac

SEQ ID NO: 14185 - DNA, 20 bp, Artificial Sequence
  Description of Artificial Sequence: Synthetic oligonucleotide
  Target: SCN10A; (-) strand; PAM type: NRG; PAM sequence: AAG
atcacagtaggagcttttta

SEQ ID NO: 14186 - DNA, 20 bp, Artificial Sequence
  Description of Artificial Sequence: Synthetic oligonucleotide
  Target: SCN10A; (-) strand; PAM type: NRG; PAM sequence: GAG
agaagagaagatcacagtag

SEQ ID NO: 14187 - DNA, 20 bp, Artificial Sequence
  Description of Artificial Sequence: Synthetic oligonucleotide
  Target: SCN10A; (-) strand; PAM type: NRG; PAM sequence: AGG
aaagaagagaagatcacagt

SEQ ID NO: 14188 - DNA, 20 bp, Artificial Sequence
  Description of Artificial Sequence: Synthetic oligonucleotide
  Target: SCN10A; (-) strand; PAM type: NRG; PAM sequence: TAG
aaaagaagagaagatcacag

SEQ ID NO: 14189 - DNA, 20 bp, Artificial Sequence
  Description of Artificial Sequence: Synthetic oligonucleotide
  Target: SCN10A; (-) strand; PAM type: NRG; PAM sequence: CAG
actaaaagaagagaagatca

SEQ ID NO: 14190 - DNA, 20 bp, Artificial Sequence
  Description of Artificial Sequence: Synthetic oligonucleotide
  Target: SCN10A; (-) strand; PAM type: NRG; PAM sequence: AAG
tcacagcactaaaagaagag

SEQ ID NO: 14191 - DNA, 20 bp, Artificial Sequence
  Description of Artificial Sequence: Synthetic oligonucleotide
  Target: SCN10A; (-) strand; PAM type: NRG; PAM sequence: GAG
tgttcacagcactaaaagaa

SEQ ID NO: 14192 - DNA, 20 bp, Artificial Sequence
  Description of Artificial Sequence: Synthetic oligonucleotide
  Target: SCN10A; (-) strand; PAM type: NRG; PAM sequence: AAG
gatgttcacagcactaaaag

SEQ ID NO: 14193 - DNA, 20 bp, Artificial Sequence
  Description of Artificial Sequence: Synthetic oligonucleotide
  Target: SCN10A; (-) strand; PAM type: NRG; PAM sequence: AAG
taagatgttcacagcactaa

SEQ ID NO: 14194 - DNA, 20 bp, Artificial Sequence
  Description of Artificial Sequence: Synthetic oligonucleotide
  Target: SCN10A; (-) strand; PAM type: NRG; PAM sequence: CAG
acagagcagtaagatgttca

SEQ ID NO: 14195 - DNA, 20 bp, Artificial Sequence
  Description of Artificial Sequence: Synthetic oligonucleotide
  Target: SCN10A; (-) strand; PAM type: NRG; PAM sequence: AAG
tcaaggactcacagagcagt

SEQ ID NO: 14196 - DNA, 20 bp, Artificial Sequence
  Description of Artificial Sequence: Synthetic oligonucleotide
  Target: SCN10A; (-) strand; PAM type: NRG; PAM sequence: CAG
gggatcaaggactcacagag

SEQ ID NO: 14197 - DNA, 20 bp, Artificial Sequence
  Description of Artificial Sequence: Synthetic oligonucleotide
  Target: SCN10A; (-) strand; PAM type: NRG; PAM sequence: GAG
gttgggatcaaggactcaca

SEQ ID NO: 14198 - DNA, 20 bp, Artificial Sequence
  Description of Artificial Sequence: Synthetic oligonucleotide
  Target: SCN10A; (-) strand; PAM type: NRG; PAM sequence: CAG
gggttgggatcaaggactca

SEQ ID NO: 14199 - DNA, 20 bp, Artificial Sequence
  Description of Artificial Sequence: Synthetic oligonucleotide
  Target: SCN10A; (-) strand; PAM type: NRG; PAM sequence: AGG
ggggaatggggttgggatca

SEQ ID NO: 14200 - DNA, 20 bp, Artificial Sequence
  Description of Artificial Sequence: Synthetic oligonucleotide
  Target: SCN10A; (-) strand; PAM type: NRG; PAM sequence: AAG
tggggaatggggttgggatc

SEQ ID NO: 14201 - DNA, 20 bp, Artificial Sequence
  Description of Artificial Sequence: Synthetic oligonucleotide
  Target: SCN10A; (-) strand; PAM type: NRG; PAM sequence: GGG
aaagcgtggggaatggggtt

SEQ ID NO: 14202 - DNA, 20 bp, Artificial Sequence
  Description of Artificial Sequence: Synthetic oligonucleotide
  Target: SCN10A; (-) strand; PAM type: NRG; PAM sequence: TGG
caaagcgtggggaatggggt

SEQ ID NO: 14203 - DNA, 20 bp, Artificial Sequence
  Description of Artificial Sequence: Synthetic oligonucleotide
  Target: SCN10A; (-) strand; PAM type: NRG; PAM sequence: GGG
aggtcaaagcgtggggaatg

SEQ ID NO: 14204 - DNA, 20 bp, Artificial Sequence
  Description of Artificial Sequence: Synthetic oligonucleotide
  Target: SCN10A; (-) strand; PAM type: NRG; PAM sequence: GGG
aaggtcaaagcgtggggaat

SEQ ID NO: 14205 - DNA, 20 bp, Artificial Sequence
  Description of Artificial Sequence: Synthetic oligonucleotide
  Target: SCN10A; (-) strand; PAM type: NRG; PAM sequence: TGG
gaaggtcaaagcgtggggaa

SEQ ID NO: 14206 - DNA, 20 bp, Artificial Sequence
  Description of Artificial Sequence: Synthetic oligonucleotide
  Target: SCN10A; (-) strand; PAM type: NRG; PAM sequence: GGG
tgggagaaggtcaaagcgtg

SEQ ID NO: 14207 - DNA, 20 bp, Artificial Sequence
  Description of Artificial Sequence: Synthetic oligonucleotide
  Target: SCN10A; (-) strand; PAM type: NRG; PAM sequence: GGG
ttgggagaaggtcaaagcgt

SEQ ID NO: 14208 - DNA, 20 bp, Artificial Sequence
  Description of Artificial Sequence: Synthetic oligonucleotide
  Target: SCN10A; (-) strand; PAM type: NRG; PAM sequence: TGG
tttgggagaaggtcaaagcg

SEQ ID NO: 14209 - DNA, 20 bp, Artificial Sequence
  Description of Artificial Sequence: Synthetic oligonucleotide
  Target: SCN10A; (-) strand; PAM type: NRG; PAM sequence: AAG
gaagttttgggagaaggtca

SEQ ID NO: 14210 - DNA, 20 bp, Artificial Sequence
  Description of Artificial Sequence: Synthetic oligonucleotide
  Target: SCN10A; (-) strand; PAM type: NRG; PAM sequence: AGG
tcaggagaagttttgggaga

SEQ ID NO: 14211 - DNA, 20 bp, Artificial Sequence
  Description of Artificial Sequence: Synthetic oligonucleotide
  Target: SCN10A; (-) strand; PAM type: NRG; PAM sequence: AAG
gtcaggagaagttttgggag

SEQ ID NO: 14212 - DNA, 20 bp, Artificial Sequence
  Description of Artificial Sequence: Synthetic oligonucleotide
  Target: SCN10A; (-) strand; PAM type: NRG; PAM sequence: GAG
gaggtcaggagaagttttgg

SEQ ID NO: 14213 - DNA, 20 bp, Artificial Sequence
  Description of Artificial Sequence: Synthetic oligonucleotide
  Target: SCN10A; (-) strand; PAM type: NRG; PAM sequence: GGG
tagaggtcaggagaagtttt

SEQ ID NO: 14214 - DNA, 20 bp, Artificial Sequence
  Description of Artificial Sequence: Synthetic oligonucleotide
  Target: SCN10A; (-) strand; PAM type: NRG; PAM sequence: TGG
atagaggtcaggagaagttt

SEQ ID NO: 14215 - DNA, 20 bp, Artificial Sequence
  Description of Artificial Sequence: Synthetic oligonucleotide
  Target: SCN10A; (-) strand; PAM type: NRG; PAM sequence: AAG
agctccatagaggtcaggag

SEQ ID NO: 14216 - DNA, 20 bp, Artificial Sequence
  Description of Artificial Sequence: Synthetic oligonucleotide
  Target: SCN10A; (-) strand; PAM type: NRG; PAM sequence: GAG
gtgagctccatagaggtcag

SEQ ID NO: 14217 - DNA, 20 bp, Artificial Sequence
  Description of Artificial Sequence: Synthetic oligonucleotide
  Target: SCN10A; (-) strand; PAM type: NRG; PAM sequence: AGG
aggtgagctccatagaggtc

SEQ ID NO: 14218 - DNA, 20 bp, Artificial Sequence
  Description of Artificial Sequence: Synthetic oligonucleotide
  Target: SCN10A; (-) strand; PAM type: NRG; PAM sequence: CAG
caggtgagctccatagaggt

SEQ ID NO: 14219 - DNA, 20 bp, Artificial Sequence
  Description of Artificial Sequence: Synthetic oligonucleotide
  Target: SCN10A; (-) strand; PAM type: NRG; PAM sequence: AGG
aaggcaggtgagctccatag

SEQ ID NO: 14220 - DNA, 20 bp, Artificial Sequence
  Description of Artificial Sequence: Synthetic oligonucleotide
  Target: SCN10A; (-) strand; PAM type: NRG; PAM sequence: GAG
caaggcaggtgagctccata

SEQ ID NO: 14221 - DNA, 20 bp, Artificial Sequence
  Description of Artificial Sequence: Synthetic oligonucleotide
  Target: SCN10A; (-) strand; PAM type: NRG; PAM sequence: TAG
atcaaggcaggtgagctcca

SEQ ID NO: 14222 - DNA, 20 bp, Artificial Sequence
  Description of Artificial Sequence: Synthetic oligonucleotide
  Target: SCN10A; (-) strand; PAM type: NRG; PAM sequence: GAG
atgtgcagatcaaggcaggt

SEQ ID NO: 14223 - DNA, 20 bp, Artificial Sequence
  Description of Artificial Sequence: Synthetic oligonucleotide
  Target: SCN10A; (-) strand; PAM type: NRG; PAM sequence: AGG
agatatgtgcagatcaaggc

SEQ ID NO: 14224 - DNA, 20 bp, Artificial Sequence
  Description of Artificial Sequence: Synthetic oligonucleotide
  Target: SCN10A; (-) strand; PAM type: NRG; PAM sequence: CAG
gagatatgtgcagatcaagg

SEQ ID NO: 14225 - DNA, 20 bp, Artificial Sequence
  Description of Artificial Sequence: Synthetic oligonucleotide
  Target: SCN10A; (-) strand; PAM type: NRG; PAM sequence: AGG
ggggagatatgtgcagatca

SEQ ID NO: 14226 - DNA, 20 bp, Artificial Sequence
  Description of Artificial Sequence: Synthetic oligonucleotide
  Target: SCN10A; (-) strand; PAM type: NRG; PAM sequence: AAG
gggggagatatgtgcagatc

SEQ ID NO: 14227 - DNA, 20 bp, Artificial Sequence
  Description of Artificial Sequence: Synthetic oligonucleotide
  Target: SCN10A; (-) strand; PAM type: NRG; PAM sequence: CAG
tgaatagggggagatatgtg

SEQ ID NO: 14228 - DNA, 20 bp, Artificial Sequence
  Description of Artificial Sequence: Synthetic oligonucleotide
  Target: SCN10A; (-) strand; PAM type: NRG; PAM sequence: GAG
tggcagcctttgaatagggg

SEQ ID NO: 14229 - DNA, 20 bp, Artificial Sequence
  Description of Artificial Sequence: Synthetic oligonucleotide
  Target: SCN10A; (-) strand; PAM type: NRG; PAM sequence: GGG
aatggcagcctttgaatagg

SEQ ID NO: 14230 - DNA, 20 bp, Artificial Sequence
  Description of Artificial Sequence: Synthetic oligonucleotide
  Target: SCN10A; (-) strand; PAM type: NRG; PAM sequence: GGG
gaatggcagcctttgaatag

SEQ ID NO: 14231 - DNA, 20 bp, Artificial Sequence
  Description of Artificial Sequence: Synthetic oligonucleotide
  Target: SCN10A; (-) strand; PAM type: NRG; PAM sequence: GGG
agaatggcagcctttgaata

SEQ ID NO: 14232 - DNA, 20 bp, Artificial Sequence
  Description of Artificial Sequence: Synthetic oligonucleotide
  Target: SCN10A; (-) strand; PAM type: NRG; PAM sequence: AGG
gagaatggcagcctttgaat

SEQ ID NO: 14233 - DNA, 20 bp, Artificial Sequence
  Description of Artificial Sequence: Synthetic oligonucleotide
  Target: SCN10A; (-) strand; PAM type: NRG; PAM sequence: TAG
ggagaatggcagcctttgaa

SEQ ID NO: 14234 - DNA, 20 bp, Artificial Sequence
  Description of Artificial Sequence: Synthetic oligonucleotide
  Target: SCN10A; (-) strand; PAM type: NRG; PAM sequence: CAG
catggggtaggggagaatgg

SEQ ID NO: 14235 - DNA, 20 bp, Artificial Sequence
  Description of Artificial Sequence: Synthetic oligonucleotide
  Target: SCN10A; (-) strand; PAM type: NRG; PAM sequence: TGG
gtacatggggtaggggagaa

SEQ ID NO: 14236 - DNA, 20 bp, Artificial Sequence
  Description of Artificial Sequence: Synthetic oligonucleotide
  Target: SCN10A; (-) strand; PAM type: NRG; PAM sequence: GAG
ctgaggtacatggggtaggg

SEQ ID NO: 14237 - DNA, 20 bp, Artificial Sequence
  Description of Artificial Sequence: Synthetic oligonucleotide
  Target: SCN10A; (-) strand; PAM type: NRG; PAM sequence: GGG
ccctgaggtacatggggtag

SEQ ID NO: 14238 - DNA, 20 bp, Artificial Sequence
  Description of Artificial Sequence: Synthetic oligonucleotide
  Target: SCN10A; (-) strand; PAM type: NRG; PAM sequence: GGG
cccctgaggtacatggggta

SEQ ID NO: 14239 - DNA, 20 bp, Artificial Sequence
  Description of Artificial Sequence: Synthetic oligonucleotide
  Target: SCN10A; (-) strand; PAM type: NRG; PAM sequence: AGG
acccctgaggtacatggggt

SEQ ID NO: 14240 - DNA, 20 bp, Artificial Sequence
  Description of Artificial Sequence: Synthetic oligonucleotide
  Target: SCN10A; (-) strand; PAM type: NRG; PAM sequence: TAG
aacccctgaggtacatgggg

SEQ ID NO: 14241 - DNA, 20 bp, Artificial Sequence
  Description of Artificial Sequence: Synthetic oligonucleotide
  Target: SCN10A; (-) strand; PAM type: NRG; PAM sequence: GGG
cctaacccctgaggtacatg

SEQ ID NO: 14242 - DNA, 20 bp, Artificial Sequence
  Description of Artificial Sequence: Synthetic oligonucleotide
  Target: SCN10A; (-) strand; PAM type: NRG; PAM sequence: GGG
gcctaacccctgaggtacat

SEQ ID NO: 14243 - DNA, 20 bp, Artificial Sequence
  Description of Artificial Sequence: Synthetic oligonucleotide
  Target: SCN10A; (-) strand; PAM type: NRG; PAM sequence: TGG
ggcctaacccctgaggtaca

SEQ ID NO: 14244 - DNA, 20 bp, Artificial Sequence
  Description of Artificial Sequence: Synthetic oligonucleotide
  Target: SCN10A; (-) strand; PAM type: NRG; PAM sequence: AGG
aacgccaggcctaacccctg

SEQ ID NO: 14245 - DNA, 20 bp, Artificial Sequence
  Description of Artificial Sequence: Synthetic oligonucleotide
  Target: SCN10A; (-) strand; PAM type: NRG; PAM sequence: GAG
gaacgccaggcctaacccct

SEQ ID NO: 14246 - DNA, 20 bp, Artificial Sequence
  Description of Artificial Sequence: Synthetic oligonucleotide
  Target: SCN10A; (-) strand; PAM type: NRG; PAM sequence: AGG
tggtgaacaaggagaacgcc

SEQ ID NO: 14247 - DNA, 20 bp, Artificial Sequence
  Description of Artificial Sequence: Synthetic oligonucleotide
  Target: SCN10A; (-) strand; PAM type: NRG; PAM sequence: CAG
gtggtgaacaaggagaacgc

SEQ ID NO: 14248 - DNA, 20 bp, Artificial Sequence
  Description of Artificial Sequence: Synthetic oligonucleotide
  Target: SCN10A; (-) strand; PAM type: NRG; PAM sequence: GAG
aagggtcagtggtgaacaag

SEQ ID NO: 14249 - DNA, 20 bp, Artificial Sequence
  Description of Artificial Sequence: Synthetic oligonucleotide
  Target: SCN10A; (-) strand; PAM type: NRG; PAM sequence: AGG
ggaagggtcagtggtgaaca

SEQ ID NO: 14250 - DNA, 20 bp, Artificial Sequence
  Description of Artificial Sequence: Synthetic oligonucleotide
  Target: SCN10A; (-) strand; PAM type: NRG; PAM sequence: AAG
tggaagggtcagtggtgaac

SEQ ID NO: 14251 - DNA, 20 bp, Artificial Sequence
  Description of Artificial Sequence: Synthetic oligonucleotide
  Target: SCN10A; (-) strand; PAM type: NRG; PAM sequence: TGG
cagtggtgtggaagggtcag

SEQ ID NO: 14252 - DNA, 20 bp, Artificial Sequence
  Description of Artificial Sequence: Synthetic oligonucleotide
  Target: SCN10A; (-) strand; PAM type: NRG; PAM sequence: CAG
gagcagtggtgtggaagggt

SEQ ID NO: 14253 - DNA, 20 bp, Artificial Sequence
  Description of Artificial Sequence: Synthetic oligonucleotide
  Target: SCN10A; (-) strand; PAM type: NRG; PAM sequence: GGG
ggaagagcagtggtgtggaa

SEQ ID NO: 14254 - DNA, 20 bp, Artificial Sequence
  Description of Artificial Sequence: Synthetic oligonucleotide
  Target: SCN10A; (-) strand; PAM type: NRG; PAM sequence: AGG
aggaagagcagtggtgtgga

SEQ ID NO: 14255 - DNA, 20 bp, Artificial Sequence
  Description of Artificial Sequence: Synthetic oligonucleotide
  Target: SCN10A; (-) strand; PAM type: NRG; PAM sequence: AAG
caggaagagcagtggtgtgg

SEQ ID NO: 14256 - DNA, 20 bp, Artificial Sequence
  Description of Artificial Sequence: Synthetic oligonucleotide
  Target: SCN10A; (-) strand; PAM type: NRG; PAM sequence: TGG
acacaggaagagcagtggtg

SEQ ID NO: 14257 - DNA, 20 bp, Artificial Sequence
  Description of Artificial Sequence: Synthetic oligonucleotide
  Target: SCN10A; (-) strand; PAM type: NRG; PAM sequence: TGG
acaagacacaggaagagcag

SEQ ID NO: 14258 - DNA, 20 bp, Artificial Sequence
  Description of Artificial Sequence: Synthetic oligonucleotide
  Target: SCN10A; (-) strand; PAM type: NRG; PAM sequence: CAG
tttacaagacacaggaagag

SEQ ID NO: 14259 - DNA, 20 bp, Artificial Sequence
  Description of Artificial Sequence: Synthetic oligonucleotide
  Target: SCN10A; (-) strand; PAM type: NRG; PAM sequence: GAG
ggttttacaagacacaggaa

SEQ ID NO: 14260 - DNA, 20 bp, Artificial Sequence
  Description of Artificial Sequence: Synthetic oligonucleotide
  Target: SCN10A; (-) strand; PAM type: NRG; PAM sequence: AAG
ggggttttacaagacacagg

SEQ ID NO: 14261 - DNA, 20 bp, Artificial Sequence
  Description of Artificial Sequence: Synthetic oligonucleotide
  Target: SCN10A; (-) strand; PAM type: NRG; PAM sequence: AGG
gaaggggttttacaagacac

SEQ ID NO: 14262 - DNA, 20 bp, Artificial Sequence
  Description of Artificial Sequence: Synthetic oligonucleotide
  Target: SCN10A; (-) strand; PAM type: NRG; PAM sequence: CAG
agaaggggttttacaagaca

SEQ ID NO: 14263 - DNA, 20 bp, Artificial Sequence
  Description of Artificial Sequence: Synthetic oligonucleotide
  Target: SCN10A; (-) strand; PAM type: NRG; PAM sequence: AAG
aaagcaagaaggggttttac

SEQ ID NO: 14264 - DNA, 20 bp, Artificial Sequence
  Description of Artificial Sequence: Synthetic oligonucleotide
  Target: SCN10A; (-) strand; PAM type: NRG; PAM sequence: GGG
caaagcttcaaagcaagaag

SEQ ID NO: 14265 - DNA, 20 bp, Artificial Sequence
  Description of Artificial Sequence: Synthetic oligonucleotide
  Target: SCN10A; (-) strand; PAM type: NRG; PAM sequence: GGG
gcaaagcttcaaagcaagaa

SEQ ID NO: 14266 - DNA, 20 bp, Artificial Sequence
  Description of Artificial Sequence: Synthetic oligonucleotide
  Target: SCN10A; (-) strand; PAM type: NRG; PAM sequence: AGG
ggcaaagcttcaaagcaaga

SEQ ID NO: 14267 - DNA, 20 bp, Artificial Sequence
  Description of Artificial Sequence: Synthetic oligonucleotide
  Target: SCN10A; (-) strand; PAM type: NRG; PAM sequence: AAG
tggcaaagcttcaaagcaag

SEQ ID NO: 14268 - DNA, 20 bp, Artificial Sequence
  Description of Artificial Sequence: Synthetic oligonucleotide
  Target: SCN10A; (-) strand; PAM type: NRG; PAM sequence: AAG
aggtggcaaagcttcaaagc

SEQ ID NO: 14269 - DNA, 20 bp, Artificial Sequence
  Description of Artificial Sequence: Synthetic oligonucleotide
  Target: SCN10A; (-) strand; PAM type: NRG; PAM sequence: AAG
aactaggtggcaaagcttca

SEQ ID NO: 14270 - DNA, 20 bp, Artificial Sequence
  Description of Artificial Sequence: Synthetic oligonucleotide
  Target: SCN10A; (-) strand; PAM type: NRG; PAM sequence: AAG
agtgacaaaactaggtggca

SEQ ID NO: 14271 - DNA, 20 bp, Artificial Sequence
  Description of Artificial Sequence: Synthetic oligonucleotide
  Target: SCN10A; (-) strand; PAM type: NRG; PAM sequence: TGG
gaagaagtgacaaaactagg

SEQ ID NO: 14272 - DNA, 20 bp, Artificial Sequence
  Description of Artificial Sequence: Synthetic oligonucleotide
  Target: SCN10A; (-) strand; PAM type: NRG; PAM sequence: AGG
aatgaagaagtgacaaaact

SEQ ID NO: 14273 - DNA, 20 bp, Artificial Sequence
  Description of Artificial Sequence: Synthetic oligonucleotide
  Target: SCN10A; (-) strand; PAM type: NRG; PAM sequence: TAG
taatgaagaagtgacaaaac

SEQ ID NO: 14274 - DNA, 20 bp, Artificial Sequence
  Description of Artificial Sequence: Synthetic oligonucleotide
  Target: SCN10A; (-) strand; PAM type: NRG; PAM sequence: AAG
ggcaagcggcagtaatgaag

SEQ ID NO: 14275 - DNA, 20 bp, Artificial Sequence
  Description of Artificial Sequence: Synthetic oligonucleotide
  Target: SCN10A; (-) strand; PAM type: NRG; PAM sequence: AAG
tttggcaagcggcagtaatg

SEQ ID NO: 14276 - DNA, 20 bp, Artificial Sequence
  Description of Artificial Sequence: Synthetic oligonucleotide
  Target: SCN10A; (-) strand; PAM type: NRG; PAM sequence: CAG
accaagagtttggcaagcgg

SEQ ID NO: 14277 - DNA, 20 bp, Artificial Sequence
  Description of Artificial Sequence: Synthetic oligonucleotide
  Target: SCN10A; (-) strand; PAM type: NRG; PAM sequence: CGG
gggaccaagagtttggcaag

SEQ ID NO: 14278 - DNA, 20 bp, Artificial Sequence
  Description of Artificial Sequence: Synthetic oligonucleotide
  Target: SCN10A; (-) strand; PAM type: NRG; PAM sequence: AAG
agagggaccaagagtttggc

SEQ ID NO: 14279 - DNA, 20 bp, Artificial Sequence
  Description of Artificial Sequence: Synthetic oligonucleotide
  Target: SCN10A; (-) strand; PAM type: NRG; PAM sequence: TGG
aggcagagggaccaagagtt

SEQ ID NO: 14280 - DNA, 20 bp, Artificial Sequence
  Description of Artificial Sequence: Synthetic oligonucleotide
  Target: SCN10A; (-) strand; PAM type: NRG; PAM sequence: GAG
tactgaggcagagggaccaa

SEQ ID NO: 14281 - DNA, 20 bp, Artificial Sequence
  Description of Artificial Sequence: Synthetic oligonucleotide
  Target: SCN10A; (-) strand; PAM type: NRG; PAM sequence: AAG
attactgaggcagagggacc

SEQ ID NO: 14282 - DNA, 20 bp, Artificial Sequence
  Description of Artificial Sequence: Synthetic oligonucleotide
  Target: SCN10A; (-) strand; PAM type: NRG; PAM sequence: GGG
cccatcattactgaggcaga

SEQ ID NO: 14283 - DNA, 20 bp, Artificial Sequence
  Description of Artificial Sequence: Synthetic oligonucleotide
  Target: SCN10A; (-) strand; PAM type: NRG; PAM sequence: AGG
acccatcattactgaggcag

SEQ ID NO: 14284 - DNA, 20 bp, Artificial Sequence
  Description of Artificial Sequence: Synthetic oligonucleotide
  Target: SCN10A; (-) strand; PAM type: NRG; PAM sequence: GAG
cacccatcattactgaggca

SEQ ID NO: 14285 - DNA, 20 bp, Artificial Sequence
  Description of Artificial Sequence: Synthetic oligonucleotide
  Target: SCN10A; (-) strand; PAM type: NRG; PAM sequence: CAG
ctcacccatcattactgagg

SEQ ID NO: 14286 - DNA, 20 bp, Artificial Sequence
  Description of Artificial Sequence: Synthetic oligonucleotide
  Target: SCN10A; (-) strand; PAM type: NRG; PAM sequence: AGG
agcctcacccatcattactg

SEQ ID NO: 14287 - DNA, 20 bp, Artificial Sequence
  Description of Artificial Sequence: Synthetic oligonucleotide
  Target: SCN10A; (-) strand; PAM type: NRG; PAM sequence: GAG
gagcctcacccatcattact

SEQ ID NO: 14288 - DNA, 20 bp, Artificial Sequence
  Description of Artificial Sequence: Synthetic oligonucleotide
  Target: SCN10A; (-) strand; PAM type: NRG; PAM sequence: GAG
gagtgggcaaatatggccaa

SEQ ID NO: 14289 - DNA, 20 bp, Artificial Sequence
  Description of Artificial Sequence: Synthetic oligonucleotide
  Target: SCN10A; (-) strand; PAM type: NRG; PAM sequence: AAG
aagagtgggcaaatatggcc

SEQ ID NO: 14290 - DNA, 20 bp, Artificial Sequence
  Description of Artificial Sequence: Synthetic oligonucleotide
  Target: SCN10A; (-) strand; PAM type: NRG; PAM sequence: TGG
tagccaagagtgggcaaata

SEQ ID NO: 14291 - DNA, 20 bp, Artificial Sequence
  Description of Artificial Sequence: Synthetic oligonucleotide
  Target: SCN10A; (-) strand; PAM type: NRG; PAM sequence: GGG
ctaggataatagccaagagt

SEQ ID NO: 14292 - DNA, 20 bp, Artificial Sequence
  Description of Artificial Sequence: Synthetic oligonucleotide
  Target: SCN10A; (-) strand; PAM type: NRG; PAM sequence: TGG
cctaggataatagccaagag

SEQ ID NO: 14293 - DNA, 20 bp, Artificial Sequence
  Description of Artificial Sequence: Synthetic oligonucleotide
  Target: SCN10A; (-) strand; PAM type: NRG; PAM sequence: GAG
ttgcctaggataatagccaa

SEQ ID NO: 14294 - DNA, 20 bp, Artificial Sequence
  Description of Artificial Sequence: Synthetic oligonucleotide
  Target: SCN10A; (-) strand; PAM type: NRG; PAM sequence: AAG
tgttgcctaggataatagcc

SEQ ID NO: 14295 - DNA, 20 bp, Artificial Sequence
  Description of Artificial Sequence: Synthetic oligonucleotide
  Target: SCN10A; (-) strand; PAM type: NRG; PAM sequence: TAG
attaatgttgcctaggataa

SEQ ID NO: 14296 - DNA, 20 bp, Artificial Sequence
  Description of Artificial Sequence: Synthetic oligonucleotide
  Target: SCN10A; (-) strand; PAM type: NRG; PAM sequence: AGG
catggacattaatgttgcct

SEQ ID NO: 14297 - DNA, 20 bp, Artificial Sequence
  Description of Artificial Sequence: Synthetic oligonucleotide
  Target: SCN10A; (-) strand; PAM type: NRG; PAM sequence: TAG
acatggacattaatgttgcc

SEQ ID NO: 14298 - DNA, 20 bp, Artificial Sequence
  Description of Artificial Sequence: Synthetic oligonucleotide
  Target: SCN10A; (-) strand; PAM type: NRG; PAM sequence: TGG
gagacaaagagtaatgcaca

SEQ ID NO: 14299 - DNA, 20 bp, Artificial Sequence
  Description of Artificial Sequence: Synthetic oligonucleotide
  Target: SCN10A; (-) strand; PAM type: NRG; PAM sequence: GAG
gcaataaaccaagagacaaa

SEQ ID NO: 14300 - DNA, 20 bp, Artificial Sequence
  Description of Artificial Sequence: Synthetic oligonucleotide
  Target: SCN10A; (-) strand; PAM type: NRG; PAM sequence: AAG
gtgcaataaaccaagagaca

SEQ ID NO: 14301 - DNA, 20 bp, Artificial Sequence
  Description of Artificial Sequence: Synthetic oligonucleotide
  Target: SCN10A; (-) strand; PAM type: NRG; PAM sequence: GAG
agatttgtgcaataaaccaa

SEQ ID NO: 14302 - DNA, 20 bp, Artificial Sequence
  Description of Artificial Sequence: Synthetic oligonucleotide
  Target: SCN10A; (-) strand; PAM type: NRG; PAM sequence: AAG
agagatttgtgcaataaacc

SEQ ID NO: 14303 - DNA, 20 bp, Artificial Sequence
  Description of Artificial Sequence: Synthetic oligonucleotide
  Target: SCN10A; (-) strand; PAM type: NRG; PAM sequence: GAG
taggagaaactaggtcatta

SEQ ID NO: 14304 - DNA, 20 bp, Artificial Sequence
  Description of Artificial Sequence: Synthetic oligonucleotide
  Target: SCN10A; (-) strand; PAM type: NRG; PAM sequence: TAG
gttaggagaaactaggtcat

SEQ ID NO: 14305 - DNA, 20 bp, Artificial Sequence
  Description of Artificial Sequence: Synthetic oligonucleotide
  Target: SCN10A; (-) strand; PAM type: NRG; PAM sequence: AGG
gctttaagttaggagaaact

SEQ ID NO: 14306 - DNA, 20 bp, Artificial Sequence
  Description of Artificial Sequence: Synthetic oligonucleotide
  Target: SCN10A; (-) strand; PAM type: NRG; PAM sequence: TAG
tgctttaagttaggagaaac

SEQ ID NO: 14307 - DNA, 20 bp, Artificial Sequence
  Description of Artificial Sequence: Synthetic oligonucleotide
  Target: SCN10A; (-) strand; PAM type: NRG; PAM sequence: GAG
aatattctgctttaagttag

SEQ ID NO: 14308 - DNA, 20 bp, Artificial Sequence
  Description of Artificial Sequence: Synthetic oligonucleotide
  Target: SCN10A; (-) strand; PAM type: NRG; PAM sequence: AGG
gaaatattctgctttaagtt

SEQ ID NO: 14309 - DNA, 20 bp, Artificial Sequence
  Description of Artificial Sequence: Synthetic oligonucleotide
  Target: SCN10A; (-) strand; PAM type: NRG; PAM sequence: TAG
tgaaatattctgctttaagt

SEQ ID NO: 14310 - DNA, 20 bp, Artificial Sequence
  Description of Artificial Sequence: Synthetic oligonucleotide
  Target: SCN10A; (-) strand; PAM type: NRG; PAM sequence: AAG
tttctgaaatattctgcttt

SEQ ID NO: 14311 - DNA, 20 bp, Artificial Sequence
  Description of Artificial Sequence: Synthetic oligonucleotide
  Target: SCN10A; (-) strand; PAM type: NRG; PAM sequence: AAG
tggtagctggagggagatgt

SEQ ID NO: 14312 - DNA, 20 bp, Artificial Sequence
  Description of Artificial Sequence: Synthetic oligonucleotide
  Target: SCN10A; (-) strand; PAM type: NRG; PAM sequence: GAG
tctaagatggtagctggagg

SEQ ID NO: 14313 - DNA, 20 bp, Artificial Sequence
  Description of Artificial Sequence: Synthetic oligonucleotide
  Target: SCN10A; (-) strand; PAM type: NRG; PAM sequence: GGG
gatctaagatggtagctgga

SEQ ID NO: 14314 - DNA, 20 bp, Artificial Sequence
  Description of Artificial Sequence: Synthetic oligonucleotide
  Target: SCN10A; (-) strand; PAM type: NRG; PAM sequence: AGG
agatctaagatggtagctgg

SEQ ID NO: 14315 - DNA, 20 bp, Artificial Sequence
  Description of Artificial Sequence: Synthetic oligonucleotide
  Target: SCN10A; (-) strand; PAM type: NRG; PAM sequence: GAG
gagatctaagatggtagctg

SEQ ID NO: 14316 - DNA, 20 bp, Artificial Sequence
  Description of Artificial Sequence: Synthetic oligonucleotide
  Target: SCN10A; (-) strand; PAM type: NRG; PAM sequence: TGG
aagagatctaagatggtagc

SEQ ID NO: 14317 - DNA, 20 bp, Artificial Sequence
  Description of Artificial Sequence: Synthetic oligonucleotide
  Target: SCN10A; (-) strand; PAM type: NRG; PAM sequence: TAG
tgggaagagatctaagatgg

SEQ ID NO: 14318 - DNA, 20 bp, Artificial Sequence
  Description of Artificial Sequence: Synthetic oligonucleotide
  Target: SCN10A; (-) strand; PAM type: NRG; PAM sequence: TGG
aggtgggaagagatctaaga

SEQ ID NO: 14319 - DNA, 20 bp, Artificial Sequence
  Description of Artificial Sequence: Synthetic oligonucleotide
  Target: SCN10A; (-) strand; PAM type: NRG; PAM sequence: AAG
ttgaaggtgggaagagatct

SEQ ID NO: 14320 - DNA, 20 bp, Artificial Sequence
  Description of Artificial Sequence: Synthetic oligonucleotide
  Target: SCN10A; (-) strand; PAM type: NRG; PAM sequence: GAG
ttttgctttgaaggtgggaa

SEQ ID NO: 14321 - DNA, 20 bp, Artificial Sequence
  Description of Artificial Sequence: Synthetic oligonucleotide
  Target: SCN10A; (-) strand; PAM type: NRG; PAM sequence: AAG
aattttgctttgaaggtggg

SEQ ID NO: 14322 - DNA, 20 bp, Artificial Sequence
  Description of Artificial Sequence: Synthetic oligonucleotide
  Target: SCN10A; (-) strand; PAM type: NRG; PAM sequence: GGG
agaaattttgctttgaaggt

SEQ ID NO: 14323 - DNA, 20 bp, Artificial Sequence
  Description of Artificial Sequence: Synthetic oligonucleotide
  Target: SCN10A; (-) strand; PAM type: NRG; PAM sequence: TGG
aagaaattttgctttgaagg

SEQ ID NO: 14324 - DNA, 20 bp, Artificial Sequence
  Description of Artificial Sequence: Synthetic oligonucleotide
  Target: SCN10A; (-) strand; PAM type: NRG; PAM sequence: AGG
ttcaagaaattttgctttga

SEQ ID NO: 14325 - DNA, 20 bp, Artificial Sequence
  Description of Artificial Sequence: Synthetic oligonucleotide
  Target: SCN10A; (-) strand; PAM type: NRG; PAM sequence: AAG
tttcaagaaattttgctttg

SEQ ID NO: 14326 - DNA, 20 bp, Artificial Sequence
  Description of Artificial Sequence: Synthetic oligonucleotide
  Target: SCN10A; (-) strand; PAM type: NRG; PAM sequence: AAG
tgattgtacacaactctttc

SEQ ID NO: 14327 - DNA, 20 bp, Artificial Sequence
  Description of Artificial Sequence: Synthetic oligonucleotide
  Target: SCN10A; (-) strand; PAM type: NRG; PAM sequence: GGG
gtgggctgaggagtgaatga

SEQ ID NO: 14328 - DNA, 20 bp, Artificial Sequence
  Description of Artificial Sequence: Synthetic oligonucleotide
  Target: SCN10A; (-) strand; PAM type: NRG; PAM sequence: AGG
tgtgggctgaggagtgaatg

SEQ ID NO: 14329 - DNA, 20 bp, Artificial Sequence
  Description of Artificial Sequence: Synthetic oligonucleotide
  Target: SCN10A; (-) strand; PAM type: NRG; PAM sequence: GAG
atgtgggctgaggagtgaat

SEQ ID NO: 14330 - DNA, 20 bp, Artificial Sequence
  Description of Artificial Sequence: Synthetic oligonucleotide
  Target: SCN10A; (-) strand; PAM type: NRG; PAM sequence: GAG
ctctgttgatgtgggctgag

SEQ ID NO: 14331 - DNA, 20 bp, Artificial Sequence
  Description of Artificial Sequence: Synthetic oligonucleotide
  Target: SCN10A; (-) strand; PAM type: NRG; PAM sequence: AGG
agctctgttgatgtgggctg

SEQ ID NO: 14332 - DNA, 20 bp, Artificial Sequence
  Description of Artificial Sequence: Synthetic oligonucleotide
  Target: SCN10A; (-) strand; PAM type: NRG; PAM sequence: GAG
aagctctgttgatgtgggct

SEQ ID NO: 14333 - DNA, 20 bp, Artificial Sequence
  Description of Artificial Sequence: Synthetic oligonucleotide
  Target: SCN10A; (-) strand; PAM type: NRG; PAM sequence: GGG
ggcaaaagctctgttgatgt

SEQ ID NO: 14334 - DNA, 20 bp, Artificial Sequence
  Description of Artificial Sequence: Synthetic oligonucleotide
  Target: SCN10A; (-) strand; PAM type: NRG; PAM sequence: TGG
aggcaaaagctctgttgatg

SEQ ID NO: 14335 - DNA, 20 bp, Artificial Sequence
  Description of Artificial Sequence: Synthetic oligonucleotide
  Target: SCN10A; (-) strand; PAM type: NRG; PAM sequence: AAG
ctctgtcaggatagaggcaa

SEQ ID NO: 14336 - DNA, 20 bp, Artificial Sequence
  Description of Artificial Sequence: Synthetic oligonucleotide
  Target: SCN10A; (-) strand; PAM type: NRG; PAM sequence: AGG
aacaatctctgtcaggatag

SEQ ID NO: 14337 - DNA, 20 bp, Artificial Sequence
  Description of Artificial Sequence: Synthetic oligonucleotide
  Target: SCN10A; (-) strand; PAM type: NRG; PAM sequence: GAG
gaacaatctctgtcaggata

SEQ ID NO: 14338 - DNA, 20 bp, Artificial Sequence
  Description of Artificial Sequence: Synthetic oligonucleotide
  Target: SCN10A; (-) strand; PAM type: NRG; PAM sequence: TAG
gagaacaatctctgtcagga

SEQ ID NO: 14339 - DNA, 20 bp, Artificial Sequence
  Description of Artificial Sequence: Synthetic oligonucleotide
  Target: SCN10A; (-) strand; PAM type: NRG; PAM sequence: AGG
tagtgagaacaatctctgtc

SEQ ID NO: 14340 - DNA, 20 bp, Artificial Sequence
  Description of Artificial Sequence: Synthetic oligonucleotide
  Target: SCN10A; (-) strand; PAM type: NRG; PAM sequence: CAG
ttagtgagaacaatctctgt

SEQ ID NO: 14341 - DNA, 20 bp, Artificial Sequence
  Description of Artificial Sequence: Synthetic oligonucleotide
  Target: SCN10A; (-) strand; PAM type: NRG; PAM sequence: GAG
aagtcattcatgatcttagt

SEQ ID NO: 14342 - DNA, 20 bp, Artificial Sequence
  Description of Artificial Sequence: Synthetic oligonucleotide
  Target: SCN10A; (-) strand; PAM type: NRG; PAM sequence: TAG
tgggaagtcattcatgatct

SEQ ID NO: 14343 - DNA, 20 bp, Artificial Sequence
  Description of Artificial Sequence: Synthetic oligonucleotide
  Target: SCN10A; (-) strand; PAM type: NRG; PAM sequence: AAG
cttggatctaatattatggg

SEQ ID NO: 14344 - DNA, 20 bp, Artificial Sequence
  Description of Artificial Sequence: Synthetic oligonucleotide
  Target: SCN10A; (-) strand; PAM type: NRG; PAM sequence: GGG
gtccttggatctaatattat

SEQ ID NO: 14345 - DNA, 20 bp, Artificial Sequence
  Description of Artificial Sequence: Synthetic oligonucleotide
  Target: SCN10A; (-) strand; PAM type: NRG; PAM sequence: TGG
cgtccttggatctaatatta

SEQ ID NO: 14346 - DNA, 20 bp, Artificial Sequence
  Description of Artificial Sequence: Synthetic oligonucleotide
  Target: SCN10A; (-) strand; PAM type: NRG; PAM sequence: TGG
caatatcagacaagcgtcct

SEQ ID NO: 14347 - DNA, 20 bp, Artificial Sequence
  Description of Artificial Sequence: Synthetic oligonucleotide
  Target: SCN10A; (-) strand; PAM type: NRG; PAM sequence: AAG
ggtactaggcaatatcagac

SEQ ID NO: 14348 - DNA, 20 bp, Artificial Sequence
  Description of Artificial Sequence: Synthetic oligonucleotide
  Target: SCN10A; (-) strand; PAM type: NRG; PAM sequence: CAG
agaagggtactaggcaatat

SEQ ID NO: 14349 - DNA, 20 bp, Artificial Sequence
  Description of Artificial Sequence: Synthetic oligonucleotide
  Target: SCN10A; (-) strand; PAM type: NRG; PAM sequence: AGG
tttcaaggtagaagggtact

SEQ ID NO: 14350 - DNA, 20 bp, Artificial Sequence
  Description of Artificial Sequence: Synthetic oligonucleotide
  Target: SCN10A; (-) strand; PAM type: NRG; PAM sequence: TAG
atttcaaggtagaagggtac

SEQ ID NO: 14351 - DNA, 20 bp, Artificial Sequence
  Description of Artificial Sequence: Synthetic oligonucleotide
  Target: SCN10A; (-) strand; PAM type: NRG; PAM sequence: GGG
agcaacatttcaaggtagaa

SEQ ID NO: 14352 - DNA, 20 bp, Artificial Sequence
  Description of Artificial Sequence: Synthetic oligonucleotide
  Target: SCN10A; (-) strand; PAM type: NRG; PAM sequence: AGG
aagcaacatttcaaggtaga

SEQ ID NO: 14353 - DNA, 20 bp, Artificial Sequence
  Description of Artificial Sequence: Synthetic oligonucleotide
  Target: SCN10A; (-) strand; PAM type: NRG; PAM sequence: AAG
aaagcaacatttcaaggtag

SEQ ID NO: 14354 - DNA, 20 bp, Artificial Sequence
  Description of Artificial Sequence: Synthetic oligonucleotide
  Target: SCN10A; (-) strand; PAM type: NRG; PAM sequence: TAG
aagaaagcaacatttcaagg

SEQ ID NO: 14355 - DNA, 20 bp, Artificial Sequence
  Description of Artificial Sequence: Synthetic oligonucleotide
  Target: SCN10A; (-) strand; PAM type: NRG; PAM sequence: AGG
accaagaaagcaacatttca

SEQ ID NO: 14356 - DNA, 20 bp, Artificial Sequence
  Description of Artificial Sequence: Synthetic oligonucleotide
  Target: SCN10A; (-) strand; PAM type: NRG; PAM sequence: AAG
gaccaagaaagcaacatttc

SEQ ID NO: 14357 - DNA, 20 bp, Artificial Sequence
  Description of Artificial Sequence: Synthetic oligonucleotide
  Target: SCN10A; (-) strand; PAM type: NRG; PAM sequence: AAG
aggcatggtggagaccaaga

SEQ ID NO: 14358 - DNA, 20 bp, Artificial Sequence
  Description of Artificial Sequence: Synthetic oligonucleotide
  Target: SCN10A; (-) strand; PAM type: NRG; PAM sequence: AAG
tgtaaggcatggtggagacc

SEQ ID NO: 14359 - DNA, 20 bp, Artificial Sequence
  Description of Artificial Sequence: Synthetic oligonucleotide
  Target: SCN10A; (-) strand; PAM type: NRG; PAM sequence: GAG
cagaaatgtaaggcatggtg

SEQ ID NO: 14360 - DNA, 20 bp, Artificial Sequence
  Description of Artificial Sequence: Synthetic oligonucleotide
  Target: SCN10A; (-) strand; PAM type: NRG; PAM sequence: TGG
agcagaaatgtaaggcatgg

SEQ ID NO: 14361 - DNA, 20 bp, Artificial Sequence
  Description of Artificial Sequence: Synthetic oligonucleotide
  Target: SCN10A; (-) strand; PAM type: NRG; PAM sequence: TGG
agaagcagaaatgtaaggca

SEQ ID NO: 14362 - DNA, 20 bp, Artificial Sequence
  Description of Artificial Sequence: Synthetic oligonucleotide
  Target: SCN10A; (-) strand; PAM type: NRG; PAM sequence: AGG
agaaaagaagcagaaatgta

SEQ ID NO: 14363 - DNA, 20 bp, Artificial Sequence
  Description of Artificial Sequence: Synthetic oligonucleotide
  Target: SCN10A; (-) strand; PAM type: NRG; PAM sequence: AAG
aagaaaagaagcagaaatgt

SEQ ID NO: 14364 - DNA, 20 bp, Artificial Sequence
  Description of Artificial Sequence: Synthetic oligonucleotide
  Target: SCN10A; (-) strand; PAM type: NRG; PAM sequence: CAG
acaaatggcaagaaaagaag

SEQ ID NO: 14365 - DNA, 20 bp, Artificial Sequence
  Description of Artificial Sequence: Synthetic oligonucleotide
  Target: SCN10A; (-) strand; PAM type: NRG; PAM sequence: AAG
atcacaaatggcaagaaaag

SEQ ID NO: 14366 - DNA, 20 bp, Artificial Sequence
  Description of Artificial Sequence: Synthetic oligonucleotide
  Target: SCN10A; (-) strand; PAM type: NRG; PAM sequence: AAG
agcatcacaaatggcaagaa

SEQ ID NO: 14367 - DNA, 20 bp, Artificial Sequence
  Description of Artificial Sequence: Synthetic oligonucleotide
  Target: SCN10A; (-) strand; PAM type: NRG; PAM sequence: AAG
aaaagagcatcacaaatggc

SEQ ID NO: 14368 - DNA, 20 bp, Artificial Sequence
  Description of Artificial Sequence: Synthetic oligonucleotide
  Target: SCN10A; (-) strand; PAM type: NRG; PAM sequence: TGG
ctataaaagagcatcacaaa

SEQ ID NO: 14369 - DNA, 20 bp, Artificial Sequence
  Description of Artificial Sequence: Synthetic oligonucleotide
  Target: SCN10A; (-) strand; PAM type: NRG; PAM sequence: GAG
gggtaaaggagactataaaa

SEQ ID NO: 14370 - DNA, 20 bp, Artificial Sequence
  Description of Artificial Sequence: Synthetic oligonucleotide
  Target: SCN10A; (-) strand; PAM type: NRG; PAM sequence: AAG
ttgggtaaaggagactataa

SEQ ID NO: 14371 - DNA, 20 bp, Artificial Sequence
  Description of Artificial Sequence: Synthetic oligonucleotide
  Target: SCN10A; (-) strand; PAM type: NRG; PAM sequence: GAG
tgtctaaaagttgggtaaag

SEQ ID NO: 14372 - DNA, 20 bp, Artificial Sequence
  Description of Artificial Sequence: Synthetic oligonucleotide
  Target: SCN10A; (-) strand; PAM type: NRG; PAM sequence: AGG
gatgtctaaaagttgggtaa

SEQ ID NO: 14373 - DNA, 20 bp, Artificial Sequence
  Description of Artificial Sequence: Synthetic oligonucleotide
  Target: SCN10A; (-) strand; PAM type: NRG; PAM sequence: AAG
tgatgtctaaaagttgggta

SEQ ID NO: 14374 - DNA, 20 bp, Artificial Sequence
  Description of Artificial Sequence: Synthetic oligonucleotide
  Target: SCN10A; (-) strand; PAM type: NRG; PAM sequence: GGG
aactctgatgtctaaaagtt

SEQ ID NO: 14375 - DNA, 20 bp, Artificial Sequence
  Description of Artificial Sequence: Synthetic oligonucleotide
  Target: SCN10A; (-) strand; PAM type: NRG; PAM sequence: TGG
gaactctgatgtctaaaagt

SEQ ID NO: 14376 - DNA, 20 bp, Artificial Sequence
  Description of Artificial Sequence: Synthetic oligonucleotide
  Target: SCN10A; (-) strand; PAM type: NRG; PAM sequence: AAG
cgaagaactctgatgtctaa

SEQ ID NO: 14377 - DNA, 20 bp, Artificial Sequence
  Description of Artificial Sequence: Synthetic oligonucleotide
  Target: SCN10A; (-) strand; PAM type: NRG; PAM sequence: AAG
atgctcaagactgagcctcg

SEQ ID NO: 14378 - DNA, 20 bp, Artificial Sequence
  Description of Artificial Sequence: Synthetic oligonucleotide
  Target: SCN10A; (-) strand; PAM type: NRG; PAM sequence: GAG
agcaaaggatgctcaagact

SEQ ID NO: 14379 - DNA, 20 bp, Artificial Sequence
  Description of Artificial Sequence: Synthetic oligonucleotide
  Target: SCN10A; (-) strand; PAM type: NRG; PAM sequence: AAG
gtgaagagcaaaggatgctc

SEQ ID NO: 14380 - DNA, 20 bp, Artificial Sequence
  Description of Artificial Sequence: Synthetic oligonucleotide
  Target: SCN10A; (-) strand; PAM type: NRG; PAM sequence: AGG
aaaaatggggtgaagagcaa

SEQ ID NO: 14381 - DNA, 20 bp, Artificial Sequence
  Description of Artificial Sequence: Synthetic oligonucleotide
  Target: SCN10A; (-) strand; PAM type: NRG; PAM sequence: AAG
aaaaaatggggtgaagagca

SEQ ID NO: 14382 - DNA, 20 bp, Artificial Sequence
  Description of Artificial Sequence: Synthetic oligonucleotide
  Target: SCN10A; (-) strand; PAM type: NRG; PAM sequence: GAG
gggagaaaaaatggggtgaa

SEQ ID NO: 14383 - DNA, 20 bp, Artificial Sequence
  Description of Artificial Sequence: Synthetic oligonucleotide
  Target: SCN10A; (-) strand; PAM type: NRG; PAM sequence: AAG
aagggagaaaaaatggggtg

SEQ ID NO: 14384 - DNA, 20 bp, Artificial Sequence
  Description of Artificial Sequence: Synthetic oligonucleotide
  Target: SCN10A; (-) strand; PAM type: NRG; PAM sequence: GGG
ttgtcaagggagaaaaaatg

SEQ ID NO: 14385 - DNA, 20 bp, Artificial Sequence
  Description of Artificial Sequence: Synthetic oligonucleotide
  Target: SCN10A; (-) strand; PAM type: NRG; PAM sequence: GGG
attgtcaagggagaaaaaat

SEQ ID NO: 14386 - DNA, 20 bp, Artificial Sequence
  Description of Artificial Sequence: Synthetic oligonucleotide
  Target: SCN10A; (-) strand; PAM type: NRG; PAM sequence: TGG
aattgtcaagggagaaaaaa

SEQ ID NO: 14387 - DNA, 20 bp, Artificial Sequence
  Description of Artificial Sequence: Synthetic oligonucleotide
  Target: SCN10A; (-) strand; PAM type: NRG; PAM sequence: GAG
ggctggataaattgtcaagg

SEQ ID NO: 14388 - DNA, 20 bp, Artificial Sequence
  Description of Artificial Sequence: Synthetic oligonucleotide
  Target: SCN10A; (-) strand; PAM type: NRG; PAM sequence: GGG
ctggctggataaattgtcaa

SEQ ID NO: 14389 - DNA, 20 bp, Artificial Sequence
  Description of Artificial Sequence: Synthetic oligonucleotide
  Target: SCN10A; (-) strand; PAM type: NRG; PAM sequence: AGG
cctggctggataaattgtca

SEQ ID NO: 14390 - DNA, 20 bp, Artificial Sequence
  Description of Artificial Sequence: Synthetic oligonucleotide
  Target: SCN10A; (-) strand; PAM type: NRG; PAM sequence: AAG
tcctggctggataaattgtc

SEQ ID NO: 14391 - DNA, 20 bp, Artificial Sequence
  Description of Artificial Sequence: Synthetic oligonucleotide
  Target: SCN10A; (-) strand; PAM type: NRG; PAM sequence: TGG
catatatgttaattcctggc

SEQ ID NO: 14392 - DNA, 20 bp, Artificial Sequence
  Description of Artificial Sequence: Synthetic oligonucleotide
  Target: SCN10A; (-) strand; PAM type: NRG; PAM sequence: TGG
tgcacatatatgttaattcc

SEQ ID NO: 14393 - DNA, 20 bp, Artificial Sequence
  Description of Artificial Sequence: Synthetic oligonucleotide
  Target: SCN10A; (-) strand; PAM type: NRG; PAM sequence: AAG
agaggcaaacagttggccaa

SEQ ID NO: 14394 - DNA, 20 bp, Artificial Sequence
  Description of Artificial Sequence: Synthetic oligonucleotide
  Target: SCN10A; (-) strand; PAM type: NRG; PAM sequence: TGG
cagtgacagaggcaaacagt

SEQ ID NO: 14395 - DNA, 20 bp, Artificial Sequence
  Description of Artificial Sequence: Synthetic oligonucleotide
  Target: SCN10A; (-) strand; PAM type: NRG; PAM sequence: CAG
agtccagtgacagaggcaaa

SEQ ID NO: 14396 - DNA, 20 bp, Artificial Sequence
  Description of Artificial Sequence: Synthetic oligonucleotide
  Target: SCN10A; (-) strand; PAM type: NRG; PAM sequence: AGG
agtttacagtccagtgacag

SEQ ID NO: 14397 - DNA, 20 bp, Artificial Sequence
  Description of Artificial Sequence: Synthetic oligonucleotide
  Target: SCN10A; (-) strand; PAM type: NRG; PAM sequence: GAG
cagtttacagtccagtgaca

SEQ ID NO: 14398 - DNA, 20 bp, Artificial Sequence
  Description of Artificial Sequence: Synthetic oligonucleotide
  Target: SCN10A; (-) strand; PAM type: NRG; PAM sequence: CAG
tacagtttacagtccagtga

SEQ ID NO: 14399 - DNA, 20 bp, Artificial Sequence
  Description of Artificial Sequence: Synthetic oligonucleotide
  Target: SCN10A; (-) strand; PAM type: NRG; PAM sequence: CAG
tactcttacagtttacagtc

SEQ ID NO: 14400 - DNA, 20 bp, Artificial Sequence
  Description of Artificial Sequence: Synthetic oligonucleotide
  Target: SCN10A; (-) strand; PAM type: NRG; PAM sequence: CAG
gttcctactcttacagttta

SEQ ID NO: 14401 - DNA, 20 bp, Artificial Sequence
  Description of Artificial Sequence: Synthetic oligonucleotide
  Target: SCN10A; (-) strand; PAM type: NRG; PAM sequence: CAG
agacaaagttcctactctta

SEQ ID NO: 14402 - DNA, 20 bp, Artificial Sequence
  Description of Artificial Sequence: Synthetic oligonucleotide
  Target: SCN10A; (-) strand; PAM type: NRG; PAM sequence: AAG
agcagtgagcaagacagaca

SEQ ID NO: 14403 - DNA, 20 bp, Artificial Sequence
  Description of Artificial Sequence: Synthetic oligonucleotide
  Target: SCN10A; (-) strand; PAM type: NRG; PAM sequence: CAG
ggttagagcagtgagcaaga

SEQ ID NO: 14404 - DNA, 20 bp, Artificial Sequence
  Description of Artificial Sequence: Synthetic oligonucleotide
  Target: SCN10A; (-) strand; PAM type: NRG; PAM sequence: AAG
ccagggttagagcagtgagc

SEQ ID NO: 14405 - DNA, 20 bp, Artificial Sequence
  Description of Artificial Sequence: Synthetic oligonucleotide
  Target: SCN10A; (-) strand; PAM type: NRG; PAM sequence: GAG
gacaccagggttagagcagt

SEQ ID NO: 14406 - DNA, 20 bp, Artificial Sequence
  Description of Artificial Sequence: Synthetic oligonucleotide
  Target: SCN10A; (-) strand; PAM type: NRG; PAM sequence: CAG
tgcagacaccagggttagag

SEQ ID NO: 14407 - DNA, 20 bp, Artificial Sequence
  Description of Artificial Sequence: Synthetic oligonucleotide
  Target: SCN10A; (-) strand; PAM type: NRG; PAM sequence: GAG
ctatgcagacaccagggtta

SEQ ID NO: 14408 - DNA, 20 bp, Artificial Sequence
  Description of Artificial Sequence: Synthetic oligonucleotide
  Target: SCN10A; (-) strand; PAM type: NRG; PAM sequence: TAG
cactatgcagacaccagggt

SEQ ID NO: 14409 - DNA, 20 bp, Artificial Sequence
  Description of Artificial Sequence: Synthetic oligonucleotide
  Target: SCN10A; (-) strand; PAM type: NRG; PAM sequence: GGG
caggcactatgcagacacca

SEQ ID NO: 14410 - DNA, 20 bp, Artificial Sequence
  Description of Artificial Sequence: Synthetic oligonucleotide
  Target: SCN10A; (-) strand; PAM type: NRG; PAM sequence: AGG
ccaggcactatgcagacacc

SEQ ID NO: 14411 - DNA, 20 bp, Artificial Sequence
  Description of Artificial Sequence: Synthetic oligonucleotide
  Target: SCN10A; (-) strand; PAM type: NRG; PAM sequence: CAG
gccaggcactatgcagacac

SEQ ID NO: 14412 - DNA, 20 bp, Artificial Sequence
  Description of Artificial Sequence: Synthetic oligonucleotide
  Target: SCN10A; (-) strand; PAM type: NRG; PAM sequence: CAG
tgttgcagccaggcactatg

SEQ ID NO: 14413 - DNA, 20 bp, Artificial Sequence
  Description of Artificial Sequence: Synthetic oligonucleotide
  Target: SCN10A; (-) strand; PAM type: NRG; PAM sequence: AGG
gcagagcatctgttgcagcc

SEQ ID NO: 14414 - DNA, 20 bp, Artificial Sequence
  Description of Artificial Sequence: Synthetic oligonucleotide
  Target: SCN10A; (-) strand; PAM type: NRG; PAM sequence: CAG
tgcagagcatctgttgcagc

SEQ ID NO: 14415 - DNA, 20 bp, Artificial Sequence
  Description of Artificial Sequence: Synthetic oligonucleotide
  Target: SCN10A; (-) strand; PAM type: NRG; PAM sequence: CAG
aatttgcagagcatctgttg

SEQ ID NO: 14416 - DNA, 20 bp, Artificial Sequence
  Description of Artificial Sequence: Synthetic oligonucleotide
  Target: SCN10A; (-) strand; PAM type: NRG; PAM sequence: GAG
cattcatttacaaatttgca

SEQ ID NO: 14417 - DNA, 20 bp, Artificial Sequence
  Description of Artificial Sequence: Synthetic oligonucleotide
  Target: SCN10A; (-) strand; PAM type: NRG; PAM sequence: CAG
tccattcatttacaaatttg

SEQ ID NO: 14418 - DNA, 20 bp, Artificial Sequence
  Description of Artificial Sequence: Synthetic oligonucleotide
  Target: SCN10A; (-) strand; PAM type: NRG; PAM sequence: GAG
tttgagctatggttaactca

SEQ ID NO: 14419 - DNA, 20 bp, Artificial Sequence
  Description of Artificial Sequence: Synthetic oligonucleotide
  Target: SCN10A; (-) strand; PAM type: NRG; PAM sequence: CAG
catttgagctatggttaact

SEQ ID NO: 14420 - DNA, 20 bp, Artificial Sequence
  Description of Artificial Sequence: Synthetic oligonucleotide
  Target: SCN10A; (-) strand; PAM type: NRG; PAM sequence: TGG
ttaaattttcatttgagcta

SEQ ID NO: 14421 - DNA, 20 bp, Artificial Sequence
  Description of Artificial Sequence: Synthetic oligonucleotide
  Target: SCN10A; (-) strand; PAM type: NRG; PAM sequence: GAG
gtgactttaaattttcattt

SEQ ID NO: 14422 - DNA, 20 bp, Artificial Sequence
  Description of Artificial Sequence: Synthetic oligonucleotide
  Target: SCN10A; (-) strand; PAM type: NRG; PAM sequence: GGG
attgaatttagtcaaataaa

SEQ ID NO: 14423 - DNA, 20 bp, Artificial Sequence
  Description of Artificial Sequence: Synthetic oligonucleotide
  Target: SCN10A; (-) strand; PAM type: NRG; PAM sequence: AGG
aattgaatttagtcaaataa

SEQ ID NO: 14424 - DNA, 20 bp, Artificial Sequence
  Description of Artificial Sequence: Synthetic oligonucleotide
  Target: SCN10A; (-) strand; PAM type: NRG; PAM sequence: AAG
gaattgaatttagtcaaata

SEQ ID NO: 14425 - DNA, 20 bp, Artificial Sequence
  Description of Artificial Sequence: Synthetic oligonucleotide
  Target: SCN10A; (-) strand; PAM type: NRG; PAM sequence: TAG
ccttggtacagaattgaatt

SEQ ID NO: 14426 - DNA, 20 bp, Artificial Sequence
  Description of Artificial Sequence: Synthetic oligonucleotide
  Target: SCN10A; (-) strand; PAM type: NRG; PAM sequence: CAG
ttcagtatgtacccttggta

SEQ ID NO: 14427 - DNA, 20 bp, Artificial Sequence
  Description of Artificial Sequence: Synthetic oligonucleotide
  Target: SCN10A; (-) strand; PAM type: NRG; PAM sequence: TGG
atacattcagtatgtaccct

SEQ ID NO: 14428 - DNA, 20 bp, Artificial Sequence
  Description of Artificial Sequence: Synthetic oligonucleotide
  Target: SCN10A; (-) strand; PAM type: NRG; PAM sequence: CAG
gcttgcacatcccatacatt

SEQ ID NO: 14429 - DNA, 20 bp, Artificial Sequence
  Description of Artificial Sequence: Synthetic oligonucleotide
  Target: SCN10A; (-) strand; PAM type: NRG; PAM sequence: AGG
cctcatagccactcatgcag

SEQ ID NO: 14430 - DNA, 20 bp, Artificial Sequence
  Description of Artificial Sequence: Synthetic oligonucleotide
  Target: SCN10A; (-) strand; PAM type: NRG; PAM sequence: GAG
ccctcatagccactcatgca

SEQ ID NO: 14431 - DNA, 20 bp, Artificial Sequence
  Description of Artificial Sequence: Synthetic oligonucleotide
  Target: SCN10A; (-) strand; PAM type: NRG; PAM sequence: CAG
ctccctcatagccactcatg

SEQ ID NO: 14432 - DNA, 20 bp, Artificial Sequence
  Description of Artificial Sequence: Synthetic oligonucleotide
  Target: SCN10A; (-) strand; PAM type: NRG; PAM sequence: TAG
gttcttctcttcctccctca

SEQ ID NO: 14433 - DNA, 20 bp, Artificial Sequence
  Description of Artificial Sequence: Synthetic oligonucleotide
  Target: SCN10A; (-) strand; PAM type: NRG; PAM sequence: AGG
ctccctggaagggatcagac

SEQ ID NO: 14434 - DNA, 20 bp, Artificial Sequence
  Description of Artificial Sequence: Synthetic oligonucleotide
  Target: SCN10A; (-) strand; PAM type: NRG; PAM sequence: CAG
gctccctggaagggatcaga

SEQ ID NO: 14435 - DNA, 20 bp, Artificial Sequence
  Description of Artificial Sequence: Synthetic oligonucleotide
  Target: SCN10A; (-) strand; PAM type: NRG; PAM sequence: CAG
gtgggctccctggaagggat

SEQ ID NO: 14436 - DNA, 20 bp, Artificial Sequence
  Description of Artificial Sequence: Synthetic oligonucleotide
  Target: SCN10A; (-) strand; PAM type: NRG; PAM sequence: GGG
ctcccgtgggctccctggaa

SEQ ID NO: 14437 - DNA, 20 bp, Artificial Sequence
  Description of Artificial Sequence: Synthetic oligonucleotide
  Target: SCN10A; (-) strand; PAM type: NRG; PAM sequence: AGG
gctcccgtgggctccctgga

SEQ ID NO: 14438 - DNA, 20 bp, Artificial Sequence
  Description of Artificial Sequence: Synthetic oligonucleotide
  Target: SCN10A; (-) strand; PAM type: NRG; PAM sequence: AAG
agctcccgtgggctccctgg

SEQ ID NO: 14439 - DNA, 20 bp, Artificial Sequence
  Description of Artificial Sequence: Synthetic oligonucleotide
  Target: SCN10A; (-) strand; PAM type: NRG; PAM sequence: TGG
tgcagctcccgtgggctccc

SEQ ID NO: 14440 - DNA, 20 bp, Artificial Sequence
  Description of Artificial Sequence: Synthetic oligonucleotide
  Target: SCN10A; (-) strand; PAM type: NRG; PAM sequence: GGG
gcttgctgtgcagctcccgt

SEQ ID NO: 14441 - DNA, 20 bp, Artificial Sequence
  Description of Artificial Sequence: Synthetic oligonucleotide
  Target: SCN10A; (-) strand; PAM type: NRG; PAM sequence: TGG
tgcttgctgtgcagctcccg

SEQ ID NO: 14442 - DNA, 20 bp, Artificial Sequence
  Description of Artificial Sequence: Synthetic oligonucleotide
  Target: SCN10A; (-) strand; PAM type: NRG; PAM sequence: CAG
ttccccctctgcttgctgtg

SEQ ID NO: 14443 - DNA, 20 bp, Artificial Sequence
  Description of Artificial Sequence: Synthetic oligonucleotide
  Target: SCN10A; (-) strand; PAM type: NRG; PAM sequence: CAG
ggcaaggatcagcctcatca

SEQ ID NO: 14444 - DNA, 20 bp, Artificial Sequence
  Description of Artificial Sequence: Synthetic oligonucleotide
  Target: SCN10A; (-) strand; PAM type: NRG; PAM sequence: CAG
atgaagcagaaggcaaggat

SEQ ID NO: 14445 - DNA, 20 bp, Artificial Sequence
  Description of Artificial Sequence: Synthetic oligonucleotide
  Target: SCN10A; (-) strand; PAM type: NRG; PAM sequence: AGG
ccaccatgaagcagaaggca

SEQ ID NO: 14446 - DNA, 20 bp, Artificial Sequence
  Description of Artificial Sequence: Synthetic oligonucleotide
  Target: SCN10A; (-) strand; PAM type: NRG; PAM sequence: AAG
cccaccatgaagcagaaggc

SEQ ID NO: 14447 - DNA, 20 bp, Artificial Sequence
  Description of Artificial Sequence: Synthetic oligonucleotide
  Target: SCN10A; (-) strand; PAM type: NRG; PAM sequence: AGG
catccccaccatgaagcaga

SEQ ID NO: 14448 - DNA, 20 bp, Artificial Sequence
  Description of Artificial Sequence: Synthetic oligonucleotide
  Target: SCN10A; (-) strand; PAM type: NRG; PAM sequence: AAG
ccatccccaccatgaagcag

SEQ ID NO: 14449 - DNA, 20 bp, Artificial Sequence
  Description of Artificial Sequence: Synthetic oligonucleotide
  Target: SCN10A; (-) strand; PAM type: NRG; PAM sequence: CAG
aacccatccccaccatgaag

SEQ ID NO: 14450 - DNA, 20 bp, Artificial Sequence
  Description of Artificial Sequence: Synthetic oligonucleotide
  Target: SCN10A; (-) strand; PAM type: NRG; PAM sequence: AAG
agcaacccatccccaccatg

SEQ ID NO: 14451 - DNA, 20 bp, Artificial Sequence
  Description of Artificial Sequence: Synthetic oligonucleotide
  Target: SCN10A; (-) strand; PAM type: NRG; PAM sequence: TAG
tttgctctaacccaacagga

SEQ ID NO: 14452 - DNA, 20 bp, Artificial Sequence
  Description of Artificial Sequence: Synthetic oligonucleotide
  Target: SCN10A; (-) strand; PAM type: NRG; PAM sequence: AGG
attctttgctctaacccaac

SEQ ID NO: 14453 - DNA, 20 bp, Artificial Sequence
  Description of Artificial Sequence: Synthetic oligonucleotide
  Target: SCN10A; (-) strand; PAM type: NRG; PAM sequence: CAG
gattctttgctctaacccaa

SEQ ID NO: 14454 - DNA, 20 bp, Artificial Sequence
  Description of Artificial Sequence: Synthetic oligonucleotide
  Target: SCN10A; (-) strand; PAM type: NRG; PAM sequence: TGG
gccatgagcaaaggccactt

SEQ ID NO: 14455 - DNA, 20 bp, Artificial Sequence
  Description of Artificial Sequence: Synthetic oligonucleotide
  Target: SCN10A; (-) strand; PAM type: NRG; PAM sequence: AGG
agcagttctgccatgagcaa

SEQ ID NO: 14456 - DNA, 20 bp, Artificial Sequence
  Description of Artificial Sequence: Synthetic oligonucleotide
  Target: SCN10A; (-) strand; PAM type: NRG; PAM sequence: AAG
cagcagttctgccatgagca

SEQ ID NO: 14457 - DNA, 20 bp, Artificial Sequence
  Description of Artificial Sequence: Synthetic oligonucleotide
  Target: SCN10A; (-) strand; PAM type: NRG; PAM sequence: GAG
tgagccagcagttctgccat

SEQ ID NO: 14458 - DNA, 20 bp, Artificial Sequence
  Description of Artificial Sequence: Synthetic oligonucleotide
  Target: SCN10A; (-) strand; PAM type: NRG; PAM sequence: CAG
ccaggaaagatgtgagccag

SEQ ID NO: 14459 - DNA, 20 bp, Artificial Sequence
  Description of Artificial Sequence: Synthetic oligonucleotide
  Target: SCN10A; (-) strand; PAM type: NRG; PAM sequence: CAG
gccccaggaaagatgtgagc

SEQ ID NO: 14460 - DNA, 20 bp, Artificial Sequence
  Description of Artificial Sequence: Synthetic oligonucleotide
  Target: SCN10A; (-) strand; PAM type: NRG; PAM sequence: GAG
tcctgccccaggaaagatgt

SEQ ID NO: 14461 - DNA, 20 bp, Artificial Sequence
  Description of Artificial Sequence: Synthetic oligonucleotide
  Target: SCN10A; (-) strand; PAM type: NRG; PAM sequence: AAG
atccccctcctgccccagga

SEQ ID NO: 14462 - DNA, 20 bp, Artificial Sequence
  Description of Artificial Sequence: Synthetic oligonucleotide
  Target: SCN10A; (-) strand; PAM type: NRG; PAM sequence: AGG
agcaatccccctcctgcccc

SEQ ID NO: 14463 - DNA, 20 bp, Artificial Sequence
  Description of Artificial Sequence: Synthetic oligonucleotide
  Target: SCN10A; (-) strand; PAM type: NRG; PAM sequence: CAG
cagcaatccccctcctgccc

SEQ ID NO: 14464 - DNA, 20 bp, Artificial Sequence
  Description of Artificial Sequence: Synthetic oligonucleotide
  Target: SCN10A; (-) strand; PAM type: NRG; PAM sequence: CAG
aatggaagggattagtggct

SEQ ID NO: 14465 - DNA, 20 bp, Artificial Sequence
  Description of Artificial Sequence: Synthetic oligonucleotide
  Target: SCN10A; (-) strand; PAM type: NRG; PAM sequence: TGG
gatgaaatggaagggattag

SEQ ID NO: 14466 - DNA, 20 bp, Artificial Sequence
  Description of Artificial Sequence: Synthetic oligonucleotide
  Target: SCN10A; (-) strand; PAM type: NRG; PAM sequence: TAG
agtgatgaaatggaagggat

SEQ ID NO: 14467 - DNA, 20 bp, Artificial Sequence
  Description of Artificial Sequence: Synthetic oligonucleotide
  Target: SCN10A; (-) strand; PAM type: NRG; PAM sequence: GGG
ttttcagtgatgaaatggaa

SEQ ID NO: 14468 - DNA, 20 bp, Artificial Sequence
  Description of Artificial Sequence: Synthetic oligonucleotide
  Target: SCN10A; (-) strand; PAM type: NRG; PAM sequence: AGG
attttcagtgatgaaatgga

SEQ ID NO: 14469 - DNA, 20 bp, Artificial Sequence
  Description of Artificial Sequence: Synthetic oligonucleotide
  Target: SCN10A; (-) strand; PAM type: NRG; PAM sequence: AAG
cattttcagtgatgaaatgg

SEQ ID NO: 14470 - DNA, 20 bp, Artificial Sequence
  Description of Artificial Sequence: Synthetic oligonucleotide
  Target: SCN10A; (-) strand; PAM type: NRG; PAM sequence: TGG
caccattttcagtgatgaaa

SEQ ID NO: 14471 - DNA, 20 bp, Artificial Sequence
  Description of Artificial Sequence: Synthetic oligonucleotide
  Target: SCN10A; (-) strand; PAM type: NRG; PAM sequence: CAG
ctgtattttttcaccatttt

SEQ ID NO: 14472 - DNA, 20 bp, Artificial Sequence
  Description of Artificial Sequence: Synthetic oligonucleotide
  Target: SCN10A; (-) strand; PAM type: NRG; PAM sequence: GGG
gaagtcatgtgaccatgaat

SEQ ID NO: 14473 - DNA, 20 bp, Artificial Sequence
  Description of Artificial Sequence: Synthetic oligonucleotide
  Target: SCN10A; (-) strand; PAM type: NRG; PAM sequence: TGG
agaagtcatgtgaccatgaa

SEQ ID NO: 14474 - DNA, 20 bp, Artificial Sequence
  Description of Artificial Sequence: Synthetic oligonucleotide
  Target: SCN10A; (-) strand; PAM type: NRG; PAM sequence: AAG
tgcctgctctgtttaattag

SEQ ID NO: 14475 - DNA, 20 bp, Artificial Sequence
  Description of Artificial Sequence: Synthetic oligonucleotide
  Target: SCN10A; (-) strand; PAM type: NRG; PAM sequence: TAG
cgttgcctgctctgtttaat

SEQ ID NO: 14476 - DNA, 20 bp, Artificial Sequence
  Description of Artificial Sequence: Synthetic oligonucleotide
  Target: SCN10A; (-) strand; PAM type: NRG; PAM sequence: CAG
tccagggcaaacttcacacc

SEQ ID NO: 14477 - DNA, 20 bp, Artificial Sequence
  Description of Artificial Sequence: Synthetic oligonucleotide
  Target: SCN10A; (-) strand; PAM type: NRG; PAM sequence: GGG
ccctaaagtcagaatatcca

SEQ ID NO: 14478 - DNA, 20 bp, Artificial Sequence
  Description of Artificial Sequence: Synthetic oligonucleotide
  Target: SCN10A; (-) strand; PAM type: NRG; PAM sequence: AGG
tccctaaagtcagaatatcc

SEQ ID NO: 14479 - DNA, 20 bp, Artificial Sequence
  Description of Artificial Sequence: Synthetic oligonucleotide
  Target: SCN10A; (-) strand; PAM type: NRG; PAM sequence: CAG
ttccctaaagtcagaatatc

SEQ ID NO: 14480 - DNA, 20 bp, Artificial Sequence
  Description of Artificial Sequence: Synthetic oligonucleotide
  Target: SCN10A; (-) strand; PAM type: NRG; PAM sequence: CAG
gctactccattccctaaagt

SEQ ID NO: 14481 - DNA, 20 bp, Artificial Sequence
  Description of Artificial Sequence: Synthetic oligonucleotide
  Target: SCN10A; (-) strand; PAM type: NRG; PAM sequence: AAG
gcaagctactccattcccta

SEQ ID NO: 14482 - DNA, 20 bp, Artificial Sequence
  Description of Artificial Sequence: Synthetic oligonucleotide
  Target: SCN10A; (-) strand; PAM type: NRG; PAM sequence: AAG
ctaatccaagagcagctagc

SEQ ID NO: 14483 - DNA, 20 bp, Artificial Sequence
  Description of Artificial Sequence: Synthetic oligonucleotide
  Target: SCN10A; (-) strand; PAM type: NRG; PAM sequence: TAG
tgggctaatccaagagcagc

SEQ ID NO: 14484 - DNA, 20 bp, Artificial Sequence
  Description of Artificial Sequence: Synthetic oligonucleotide
  Target: SCN10A; (-) strand; PAM type: NRG; PAM sequence: CAG
accgtgggctaatccaagag

SEQ ID NO: 14485 - DNA, 20 bp, Artificial Sequence
  Description of Artificial Sequence: Synthetic oligonucleotide
  Target: SCN10A; (-) strand; PAM type: NRG; PAM sequence: GAG
ctgaccgtgggctaatccaa

SEQ ID NO: 14486 - DNA, 20 bp, Artificial Sequence
  Description of Artificial Sequence: Synthetic oligonucleotide
  Target: SCN10A; (-) strand; PAM type: NRG; PAM sequence: AAG
ccctgaccgtgggctaatcc

SEQ ID NO: 14487 - DNA, 20 bp, Artificial Sequence
  Description of Artificial Sequence: Synthetic oligonucleotide
  Target: SCN10A; (-) strand; PAM type: NRG; PAM sequence: GGG
aaggtatgatccctgaccgt

SEQ ID NO: 14488 - DNA, 20 bp, Artificial Sequence
  Description of Artificial Sequence: Synthetic oligonucleotide
  Target: SCN10A; (-) strand; PAM type: NRG; PAM sequence: TGG
aaaggtatgatccctgaccg

SEQ ID NO: 14489 - DNA, 20 bp, Artificial Sequence
  Description of Artificial Sequence: Synthetic oligonucleotide
  Target: SCN10A; (-) strand; PAM type: NRG; PAM sequence: AGG
gagagcaccaagggttgcaa

SEQ ID NO: 14490 - DNA, 20 bp, Artificial Sequence
  Description of Artificial Sequence: Synthetic oligonucleotide
  Target: SCN10A; (-) strand; PAM type: NRG; PAM sequence: AAG
tgagagcaccaagggttgca

SEQ ID NO: 14491 - DNA, 20 bp, Artificial Sequence
  Description of Artificial Sequence: Synthetic oligonucleotide
  Target: SCN10A; (-) strand; PAM type: NRG; PAM sequence: GGG
atcgtctctgagagcaccaa

SEQ ID NO: 14492 - DNA, 20 bp, Artificial Sequence
  Description of Artificial Sequence: Synthetic oligonucleotide
  Target: SCN10A; (-) strand; PAM type: NRG; PAM sequence: AGG
catcgtctctgagagcacca

SEQ ID NO: 14493 - DNA, 20 bp, Artificial Sequence
  Description of Artificial Sequence: Synthetic oligonucleotide
  Target: SCN10A; (-) strand; PAM type: NRG; PAM sequence: AAG
tcatcgtctctgagagcacc

SEQ ID NO: 14494 - DNA, 20 bp, Artificial Sequence
  Description of Artificial Sequence: Synthetic oligonucleotide
  Target: SCN10A; (-) strand; PAM type: NRG; PAM sequence: GAG
acccacttcatcgtctctga

SEQ ID NO: 14495 - DNA, 20 bp, Artificial Sequence
  Description of Artificial Sequence: Synthetic oligonucleotide
  Target: SCN10A; (-) strand; PAM type: NRG; PAM sequence: GAG
tcacccacttcatcgtctct

SEQ ID NO: 14496 - DNA, 20 bp, Artificial Sequence
  Description of Artificial Sequence: Synthetic oligonucleotide
  Target: SCN10A; (-) strand; PAM type: NRG; PAM sequence: GAG
tagaaatataataggctcta

SEQ ID NO: 14497 - DNA, 20 bp, Artificial Sequence
  Description of Artificial Sequence: Synthetic oligonucleotide
  Target: SCN10A; (-) strand; PAM type: NRG; PAM sequence: TAG
tatagaaatataataggctc

SEQ ID NO: 14498 - DNA, 20 bp, Artificial Sequence
  Description of Artificial Sequence: Synthetic oligonucleotide
  Target: SCN10A; (-) strand; PAM type: NRG; PAM sequence: AGG
ccactttatagaaatataat

SEQ ID NO: 14499 - DNA, 20 bp, Artificial Sequence
  Description of Artificial Sequence: Synthetic oligonucleotide
  Target: SCN10A; (-) strand; PAM type: NRG; PAM sequence: TAG
tccactttatagaaatataa

SEQ ID NO: 14500 - DNA, 20 bp, Artificial Sequence
  Description of Artificial Sequence: Synthetic oligonucleotide
  Target: SCN10A; (-) strand; PAM type: NRG; PAM sequence: TAG
ctctcacatactccacttta

SEQ ID NO: 14501 - DNA, 20 bp, Artificial Sequence
  Description of Artificial Sequence: Synthetic oligonucleotide
  Target: SCN10A; (-) strand; PAM type: NRG; PAM sequence: CAG
gctacagaaatcaataaaag

SEQ ID NO: 14502 - DNA, 20 bp, Artificial Sequence
  Description of Artificial Sequence: Synthetic oligonucleotide
  Target: SCN10A; (-) strand; PAM type: NRG; PAM sequence: AAG
cctgctacagaaatcaataa

SEQ ID NO: 14503 - DNA, 20 bp, Artificial Sequence
  Description of Artificial Sequence: Synthetic oligonucleotide
  Target: SCN10A; (-) strand; PAM type: NRG; PAM sequence: CAG
ttctttaacattccctgcta

SEQ ID NO: 14504 - DNA, 20 bp, Artificial Sequence
  Description of Artificial Sequence: Synthetic oligonucleotide
  Target: SCN10A; (-) strand; PAM type: NRG; PAM sequence: GGG
gttaaggattccacaagact

SEQ ID NO: 14505 - DNA, 20 bp, Artificial Sequence
  Description of Artificial Sequence: Synthetic oligonucleotide
  Target: SCN10A; (-) strand; PAM type: NRG; PAM sequence: TGG
agttaaggattccacaagac

SEQ ID NO: 14506 - DNA, 20 bp, Artificial Sequence
  Description of Artificial Sequence: Synthetic oligonucleotide
  Target: SCN10A; (-) strand; PAM type: NRG; PAM sequence: AAG
ggaaaagttaaggattccac

SEQ ID NO: 14507 - DNA, 20 bp, Artificial Sequence
  Description of Artificial Sequence: Synthetic oligonucleotide
  Target: SCN10A; (-) strand; PAM type: NRG; PAM sequence: AGG
ttcttccataggaaaagtta

SEQ ID NO: 14508 - DNA, 20 bp, Artificial Sequence
  Description of Artificial Sequence: Synthetic oligonucleotide
  Target: SCN10A; (-) strand; PAM type: NRG; PAM sequence: AAG
tttcttccataggaaaagtt

SEQ ID NO: 14509 - DNA, 20 bp, Artificial Sequence
  Description of Artificial Sequence: Synthetic oligonucleotide
  Target: SCN10A; (-) strand; PAM type: NRG; PAM sequence: AAG
tcttgtttcttccataggaa

SEQ ID NO: 14510 - DNA, 20 bp, Artificial Sequence
  Description of Artificial Sequence: Synthetic oligonucleotide
  Target: SCN10A; (-) strand; PAM type: NRG; PAM sequence: AGG
ctaaatcttgtttcttccat

SEQ ID NO: 14511 - DNA, 20 bp, Artificial Sequence
  Description of Artificial Sequence: Synthetic oligonucleotide
  Target: SCN10A; (-) strand; PAM type: NRG; PAM sequence: TAG
tctaaatcttgtttcttcca

SEQ ID NO: 14512 - DNA, 20 bp, Artificial Sequence
  Description of Artificial Sequence: Synthetic oligonucleotide
  Target: SCN10A; (-) strand; PAM type: NRG; PAM sequence: AGG
tctcacctctgatgatgctc

SEQ ID NO: 14513 - DNA, 20 bp, Artificial Sequence
  Description of Artificial Sequence: Synthetic oligonucleotide
  Target: SCN10A; (-) strand; PAM type: NRG; PAM sequence: CAG
ctctcacctctgatgatgct

SEQ ID NO: 14514 - DNA, 20 bp, Artificial Sequence
  Description of Artificial Sequence: Synthetic oligonucleotide
  Target: SCN10A; (-) strand; PAM type: NRG; PAM sequence: GAG
gcttacctgggaccacatag

SEQ ID NO: 14515 - DNA, 20 bp, Artificial Sequence
  Description of Artificial Sequence: Synthetic oligonucleotide
  Target: SCN10A; (-) strand; PAM type: NRG; PAM sequence: AGG
gagcttacctgggaccacat

SEQ ID NO: 14516 - DNA, 20 bp, Artificial Sequence
  Description of Artificial Sequence: Synthetic oligonucleotide
  Target: SCN10A; (-) strand; PAM type: NRG; PAM sequence: TAG
agagcttacctgggaccaca

SEQ ID NO: 14517 - DNA, 20 bp, Artificial Sequence
  Description of Artificial Sequence: Synthetic oligonucleotide
  Target: SCN10A; (-) strand; PAM type: NRG; PAM sequence: GGG
tttcatgacagagcttacct

SEQ ID NO: 14518 - DNA, 20 bp, Artificial Sequence
  Description of Artificial Sequence: Synthetic oligonucleotide
  Target: SCN10A; (-) strand; PAM type: NRG; PAM sequence: TGG
atttcatgacagagcttacc

SEQ ID NO: 14519 - DNA, 20 bp, Artificial Sequence
  Description of Artificial Sequence: Synthetic oligonucleotide
  Target: SCN10A; (-) strand; PAM type: NRG; PAM sequence: GAG
atgggtgccatttcatgaca

SEQ ID NO: 14520 - DNA, 20 bp, Artificial Sequence
  Description of Artificial Sequence: Synthetic oligonucleotide
  Target: SCN10A; (-) strand; PAM type: NRG; PAM sequence: CAG
gcatgggtgccatttcatga

SEQ ID NO: 14521 - DNA, 20 bp, Artificial Sequence
  Description of Artificial Sequence: Synthetic oligonucleotide
  Target: SCN10A; (-) strand; PAM type: NRG; PAM sequence: GGG
tttctgccccatcagtgcat

SEQ ID NO: 14522 - DNA, 20 bp, Artificial Sequence
  Description of Artificial Sequence: Synthetic oligonucleotide
  Target: SCN10A; (-) strand; PAM type: NRG; PAM sequence: TGG
atttctgccccatcagtgca

SEQ ID NO: 14523 - DNA, 20 bp, Artificial Sequence
  Description of Artificial Sequence: Synthetic oligonucleotide
  Target: SCN10A; (-) strand; PAM type: NRG; PAM sequence: CAG
acacaggatttctgccccat

SEQ ID NO: 14524 - DNA, 20 bp, Artificial Sequence
  Description of Artificial Sequence: Synthetic oligonucleotide
  Target: SCN10A; (-) strand; PAM type: NRG; PAM sequence: AGG
taccagcaaagcactgacac

SEQ ID NO: 14525 - DNA, 20 bp, Artificial Sequence
  Description of Artificial Sequence: Synthetic oligonucleotide
  Target: SCN10A; (-) strand; PAM type: NRG; PAM sequence: CAG
ataccagcaaagcactgaca

SEQ ID NO: 14526 - DNA, 20 bp, Artificial Sequence
  Description of Artificial Sequence: Synthetic oligonucleotide
  Target: SCN10A; (-) strand; PAM type: NRG; PAM sequence: AAG
tcaagctggtcataccagca

SEQ ID NO: 14527 - DNA, 20 bp, Artificial Sequence
  Description of Artificial Sequence: Synthetic oligonucleotide
  Target: SCN10A; (-) strand; PAM type: NRG; PAM sequence: CAG
aaaggtcaagctggtcatac

SEQ ID NO: 14528 - DNA, 20 bp, Artificial Sequence
  Description of Artificial Sequence: Synthetic oligonucleotide
  Target: SCN10A; (-) strand; PAM type: NRG; PAM sequence: TGG
aggagccccaaaggtcaagc

SEQ ID NO: 14529 - DNA, 20 bp, Artificial Sequence
  Description of Artificial Sequence: Synthetic oligonucleotide
  Target: SCN10A; (-) strand; PAM type: NRG; PAM sequence: AAG
ccttaggagccccaaaggtc

SEQ ID NO: 14530 - DNA, 20 bp, Artificial Sequence
  Description of Artificial Sequence: Synthetic oligonucleotide
  Target: SCN10A; (-) strand; PAM type: NRG; PAM sequence: AGG
tctccccttaggagccccaa

SEQ ID NO: 14531 - DNA, 20 bp, Artificial Sequence
  Description of Artificial Sequence: Synthetic oligonucleotide
  Target: SCN10A; (-) strand; PAM type: NRG; PAM sequence: AAG
ttctccccttaggagcccca

SEQ ID NO: 14532 - DNA, 20 bp, Artificial Sequence
  Description of Artificial Sequence: Synthetic oligonucleotide
  Target: SCN10A; (-) strand; PAM type: NRG; PAM sequence: GAG
tgtccaccttctccccttag

SEQ ID NO: 14533 - DNA, 20 bp, Artificial Sequence
  Description of Artificial Sequence: Synthetic oligonucleotide
  Target: SCN10A; (-) strand; PAM type: NRG; PAM sequence: AGG
aatgtccaccttctcccctt

SEQ ID NO: 14534 - DNA, 20 bp, Artificial Sequence
  Description of Artificial Sequence: Synthetic oligonucleotide
  Target: SCN10A; (-) strand; PAM type: NRG; PAM sequence: TAG
gaatgtccaccttctcccct

SEQ ID NO: 14535 - DNA, 20 bp, Artificial Sequence
  Description of Artificial Sequence: Synthetic oligonucleotide
  Target: SCN10A; (-) strand; PAM type: NRG; PAM sequence: TGG
tttggccagattattggccc

SEQ ID NO: 14536 - DNA, 20 bp, Artificial Sequence
  Description of Artificial Sequence: Synthetic oligonucleotide
  Target: SCN10A; (-) strand; PAM type: NRG; PAM sequence: TGG
cttgcttttggccagattat

SEQ ID NO: 14537 - DNA, 20 bp, Artificial Sequence
  Description of Artificial Sequence: Synthetic oligonucleotide
  Target: SCN10A; (-) strand; PAM type: NRG; PAM sequence: CAG
aggcccagcttgcttttggc

SEQ ID NO: 14538 - DNA, 20 bp, Artificial Sequence
  Description of Artificial Sequence: Synthetic oligonucleotide
  Target: SCN10A; (-) strand; PAM type: NRG; PAM sequence: TGG
tcccaggcccagcttgcttt

SEQ ID NO: 14539 - DNA, 20 bp, Artificial Sequence
  Description of Artificial Sequence: Synthetic oligonucleotide
  Target: SCN10A; (-) strand; PAM type: NRG; PAM sequence: CAG
aagacccttcttcccaggcc

SEQ ID NO: 14540 - DNA, 20 bp, Artificial Sequence
  Description of Artificial Sequence: Synthetic oligonucleotide
  Target: SCN10A; (-) strand; PAM type: NRG; PAM sequence: AGG
caactaagacccttcttccc

SEQ ID NO: 14541 - DNA, 20 bp, Artificial Sequence
  Description of Artificial Sequence: Synthetic oligonucleotide
  Target: SCN10A; (-) strand; PAM type: NRG; PAM sequence: CAG
ccaactaagacccttcttcc

SEQ ID NO: 14542 - DNA, 20 bp, Artificial Sequence
  Description of Artificial Sequence: Synthetic oligonucleotide
  Target: SCN10A; (-) strand; PAM type: NRG; PAM sequence: AAG
ggaaattcccactcccaact

SEQ ID NO: 14543 - DNA, 20 bp, Artificial Sequence
  Description of Artificial Sequence: Synthetic oligonucleotide
  Target: SCN10A; (-) strand; PAM type: NRG; PAM sequence: AGG
agaaagaaatccaaggcaaa

SEQ ID NO: 14544 - DNA, 20 bp, Artificial Sequence
  Description of Artificial Sequence: Synthetic oligonucleotide
  Target: SCN10A; (-) strand; PAM type: NRG; PAM sequence: AAG
aagaaagaaatccaaggcaa

SEQ ID NO: 14545 - DNA, 20 bp, Artificial Sequence
  Description of Artificial Sequence: Synthetic oligonucleotide
  Target: SCN10A; (-) strand; PAM type: NRG; PAM sequence: AGG
agaaccaagaaagaaatcca

SEQ ID NO: 14546 - DNA, 20 bp, Artificial Sequence
  Description of Artificial Sequence: Synthetic oligonucleotide
  Target: SCN10A; (-) strand; PAM type: NRG; PAM sequence: AAG
tagaaccaagaaagaaatcc

SEQ ID NO: 14547 - DNA, 20 bp, Artificial Sequence
  Description of Artificial Sequence: Synthetic oligonucleotide
  Target: SCN10A; (-) strand; PAM type: NRG; PAM sequence: AAG
ttcaaagtctagaaccaaga

SEQ ID NO: 14548 - DNA, 20 bp, Artificial Sequence
  Description of Artificial Sequence: Synthetic oligonucleotide
  Target: SCN10A; (-) strand; PAM type: NRG; PAM sequence: AAG
cctcttcaaagtctagaacc

SEQ ID NO: 14549 - DNA, 20 bp, Artificial Sequence
  Description of Artificial Sequence: Synthetic oligonucleotide
  Target: SCN10A; (-) strand; PAM type: NRG; PAM sequence: TAG
catcttccctcttcaaagtc

SEQ ID NO: 14550 - DNA, 20 bp, Artificial Sequence
  Description of Artificial Sequence: Synthetic oligonucleotide
  Target: SCN10A; (-) strand; PAM type: NRG; PAM sequence: AAG
cggatcatcttccctcttca

SEQ ID NO: 14551 - DNA, 20 bp, Artificial Sequence
  Description of Artificial Sequence: Synthetic oligonucleotide
  Target: SCN10A; (-) strand; PAM type: NRG; PAM sequence: CGG
acatgcccagtggcacaagc

SEQ ID NO: 14552 - DNA, 20 bp, Artificial Sequence
  Description of Artificial Sequence: Synthetic oligonucleotide
  Target: SCN10A; (-) strand; PAM type: NRG; PAM sequence: AAG
acccacatgcccagtggcac

SEQ ID NO: 14553 - DNA, 20 bp, Artificial Sequence
  Description of Artificial Sequence: Synthetic oligonucleotide
  Target: SCN10A; (-) strand; PAM type: NRG; PAM sequence: TGG
tttgacacccacatgcccag

SEQ ID NO: 14554 - DNA, 20 bp, Artificial Sequence
  Description of Artificial Sequence: Synthetic oligonucleotide
  Target: SCN10A; (-) strand; PAM type: NRG; PAM sequence: CAG
atctttgacacccacatgcc

SEQ ID NO: 14555 - DNA, 20 bp, Artificial Sequence
  Description of Artificial Sequence: Synthetic oligonucleotide
  Target: SCN10A; (-) strand; PAM type: NRG; PAM sequence: AGG
ctgaccagcatccaaatggc

SEQ ID NO: 14556 - DNA, 20 bp, Artificial Sequence
  Description of Artificial Sequence: Synthetic oligonucleotide
  Target: SCN10A; (-) strand; PAM type: NRG; PAM sequence: CAG
cctgaccagcatccaaatgg

SEQ ID NO: 14557 - DNA, 20 bp, Artificial Sequence
  Description of Artificial Sequence: Synthetic oligonucleotide
  Target: SCN10A; (-) strand; PAM type: NRG; PAM sequence: TGG
gctcctgaccagcatccaaa

SEQ ID NO: 14558 - DNA, 20 bp, Artificial Sequence
  Description of Artificial Sequence: Synthetic oligonucleotide
  Target: SCN10A; (-) strand; PAM type: NRG; PAM sequence: CAG
ggaccatcctagctcctgac

SEQ ID NO: 14559 - DNA, 20 bp, Artificial Sequence
  Description of Artificial Sequence: Synthetic oligonucleotide
  Target: SCN10A; (-) strand; PAM type: NRG; PAM sequence: TAG
ccataggtcttggaccatcc

SEQ ID NO: 14560 - DNA, 20 bp, Artificial Sequence
  Description of Artificial Sequence: Synthetic oligonucleotide
  Target: SCN10A; (-) strand; PAM type: NRG; PAM sequence: TGG
actccaggacccataggtct

SEQ ID NO: 14561 - DNA, 20 bp, Artificial Sequence
  Description of Artificial Sequence: Synthetic oligonucleotide
  Target: SCN10A; (-) strand; PAM type: NRG; PAM sequence: AGG
ggctgcactccaggacccat

SEQ ID NO: 14562 - DNA, 20 bp, Artificial Sequence
  Description of Artificial Sequence: Synthetic oligonucleotide
  Target: SCN10A; (-) strand; PAM type: NRG; PAM sequence: TAG
tggctgcactccaggaccca

SEQ ID NO: 14563 - DNA, 20 bp, Artificial Sequence
  Description of Artificial Sequence: Synthetic oligonucleotide
  Target: SCN10A; (-) strand; PAM type: NRG; PAM sequence: AGG
cctgcagatggctgcactcc

SEQ ID NO: 14564 - DNA, 20 bp, Artificial Sequence
  Description of Artificial Sequence: Synthetic oligonucleotide
  Target: SCN10A; (-) strand; PAM type: NRG; PAM sequence: CAG
acctgcagatggctgcactc

SEQ ID NO: 14565 - DNA, 20 bp, Artificial Sequence
  Description of Artificial Sequence: Synthetic oligonucleotide
  Target: SCN10A; (-) strand; PAM type: NRG; PAM sequence: TGG
gtccaagcagcacctgcaga

SEQ ID NO: 14566 - DNA, 20 bp, Artificial Sequence
  Description of Artificial Sequence: Synthetic oligonucleotide
  Target: SCN10A; (-) strand; PAM type: NRG; PAM sequence: CAG
cagagtccaagcagcacctg

SEQ ID NO: 14567 - DNA, 20 bp, Artificial Sequence
  Description of Artificial Sequence: Synthetic oligonucleotide
  Target: SCN10A; (-) strand; PAM type: NRG; PAM sequence: CAG
agcacaaagcagagtccaag

SEQ ID NO: 14568 - DNA, 20 bp, Artificial Sequence
  Description of Artificial Sequence: Synthetic oligonucleotide
  Target: SCN10A; (-) strand; PAM type: NRG; PAM sequence: AAG
atcagcacaaagcagagtcc

SEQ ID NO: 14569 - DNA, 20 bp, Artificial Sequence
  Description of Artificial Sequence: Synthetic oligonucleotide
  Target: SCN10A; (-) strand; PAM type: NRG; PAM sequence: GAG
agagaaatcagcacaaagca

SEQ ID NO: 14570 - DNA, 20 bp, Artificial Sequence
  Description of Artificial Sequence: Synthetic oligonucleotide
  Target: SCN10A; (-) strand; PAM type: NRG; PAM sequence: CAG
acagagaaatcagcacaaag

SEQ ID NO: 14571 - DNA, 20 bp, Artificial Sequence
  Description of Artificial Sequence: Synthetic oligonucleotide
  Target: SCN10A; (-) strand; PAM type: NRG; PAM sequence: AAG
ccaacagagaaatcagcaca

SEQ ID NO: 14572 - DNA, 20 bp, Artificial Sequence
  Description of Artificial Sequence: Synthetic oligonucleotide
  Target: SCN10A; (-) strand; PAM type: NRG; PAM sequence: CAG
agggatgccaacagagaaat

SEQ ID NO: 14573 - DNA, 20 bp, Artificial Sequence
  Description of Artificial Sequence: Synthetic oligonucleotide
  Target: SCN10A; (-) strand; PAM type: NRG; PAM sequence: GAG
aagtggcagggatgccaaca

SEQ ID NO: 14574 - DNA, 20 bp, Artificial Sequence
  Description of Artificial Sequence: Synthetic oligonucleotide
  Target: SCN10A; (-) strand; PAM type: NRG; PAM sequence: CAG
tgaagtggcagggatgccaa

SEQ ID NO: 14575 - DNA, 20 bp, Artificial Sequence
  Description of Artificial Sequence: Synthetic oligonucleotide
  Target: SCN10A; (-) strand; PAM type: NRG; PAM sequence: GGG
aacaaaactttgaagtggca

SEQ ID NO: 14576 - DNA, 20 bp, Artificial Sequence
  Description of Artificial Sequence: Synthetic oligonucleotide
  Target: SCN10A; (-) strand; PAM type: NRG; PAM sequence: AGG
aaacaaaactttgaagtggc

SEQ ID NO: 14577 - DNA, 20 bp, Artificial Sequence
  Description of Artificial Sequence: Synthetic oligonucleotide
  Target: SCN10A; (-) strand; PAM type: NRG; PAM sequence: CAG
taaacaaaactttgaagtgg

SEQ ID NO: 14578 - DNA, 20 bp, Artificial Sequence
  Description of Artificial Sequence: Synthetic oligonucleotide
  Target: SCN10A; (-) strand; PAM type: NRG; PAM sequence: TGG
atttaaacaaaactttgaag

SEQ ID NO: 14579 - DNA, 20 bp, Artificial Sequence
  Description of Artificial Sequence: Synthetic oligonucleotide
  Target: SCN10A; (-) strand; PAM type: NRG; PAM sequence: AAG
aacatttaaacaaaactttg

SEQ ID NO: 14580 - DNA, 20 bp, Artificial Sequence
  Description of Artificial Sequence: Synthetic oligonucleotide
  Target: SCN10A; (-) strand; PAM type: NRG; PAM sequence: TAG
tcgcatagctgaggcaaggc

SEQ ID NO: 14581 - DNA, 20 bp, Artificial Sequence
  Description of Artificial Sequence: Synthetic oligonucleotide
  Target: SCN10A; (-) strand; PAM type: NRG; PAM sequence: AGG
aatttcgcatagctgaggca

SEQ ID NO: 14582 - DNA, 20 bp, Artificial Sequence
  Description of Artificial Sequence: Synthetic oligonucleotide
  Target: SCN10A; (-) strand; PAM type: NRG; PAM sequence: AAG
taatttcgcatagctgaggc

SEQ ID NO: 14583 - DNA, 20 bp, Artificial Sequence
  Description of Artificial Sequence: Synthetic oligonucleotide
  Target: SCN10A; (-) strand; PAM type: NRG; PAM sequence: AGG
tccctaatttcgcatagctg

SEQ ID NO: 14584 - DNA, 20 bp, Artificial Sequence
  Description of Artificial Sequence: Synthetic oligonucleotide
  Target: SCN10A; (-) strand; PAM type: NRG; PAM sequence: GAG
ttccctaatttcgcatagct

SEQ ID NO: 14585 - DNA, 20 bp, Artificial Sequence
  Description of Artificial Sequence: Synthetic oligonucleotide
  Target: SCN10A; (-) strand; PAM type: NRG; PAM sequence: TAG
ctttgttccctaatttcgca

SEQ ID NO: 14586 - DNA, 20 bp, Artificial Sequence
  Description of Artificial Sequence: Synthetic oligonucleotide
  Target: SCN10A; (-) strand; PAM type: NRG; PAM sequence: AGG
ttaatattctggcccaagca

SEQ ID NO: 14587 - DNA, 20 bp, Artificial Sequence
  Description of Artificial Sequence: Synthetic oligonucleotide
  Target: SCN10A; (-) strand; PAM type: NRG; PAM sequence: AAG
cttaatattctggcccaagc

SEQ ID NO: 14588 - DNA, 20 bp, Artificial Sequence
  Description of Artificial Sequence: Synthetic oligonucleotide
  Target: SCN10A; (-) strand; PAM type: NRG; PAM sequence: AAG
tccccttaatattctggccc

SEQ ID NO: 14589 - DNA, 20 bp, Artificial Sequence
  Description of Artificial Sequence: Synthetic oligonucleotide
  Target: SCN10A; (-) strand; PAM type: NRG; PAM sequence: TGG
tggctctccccttaatattc

SEQ ID NO: 14590 - DNA, 20 bp, Artificial Sequence
  Description of Artificial Sequence: Synthetic oligonucleotide
  Target: SCN10A; (-) strand; PAM type: NRG; PAM sequence: TGG
ctagccttagtggaggaacg

SEQ ID NO: 14591 - DNA, 20 bp, Artificial Sequence
  Description of Artificial Sequence: Synthetic oligonucleotide
  Target: SCN10A; (-) strand; PAM type: NRG; PAM sequence: AGG
ccttttgctagccttagtgg

SEQ ID NO: 14592 - DNA, 20 bp, Artificial Sequence
  Description of Artificial Sequence: Synthetic oligonucleotide
  Target: SCN10A; (-) strand; PAM type: NRG; PAM sequence: GAG
accttttgctagccttagtg

SEQ ID NO: 14593 - DNA, 20 bp, Artificial Sequence
  Description of Artificial Sequence: Synthetic oligonucleotide
  Target: SCN10A; (-) strand; PAM type: NRG; PAM sequence: TGG
caaccttttgctagccttag

SEQ ID NO: 14594 - DNA, 20 bp, Artificial Sequence
  Description of Artificial Sequence: Synthetic oligonucleotide
  Target: SCN10A; (-) strand; PAM type: NRG; PAM sequence: TAG
tctcaaccttttgctagcct

SEQ ID NO: 14595 - DNA, 20 bp, Artificial Sequence
  Description of Artificial Sequence: Synthetic oligonucleotide
  Target: SCN10A; (-) strand; PAM type: NRG; PAM sequence: TAG
attcactctcaaccttttgc

SEQ ID NO: 14596 - DNA, 20 bp, Artificial Sequence
  Description of Artificial Sequence: Synthetic oligonucleotide
  Target: SCN10A; (-) strand; PAM type: NRG; PAM sequence: TAG
tgaatggaagaagagtggat

SEQ ID NO: 14597 - DNA, 20 bp, Artificial Sequence
  Description of Artificial Sequence: Synthetic oligonucleotide
  Target: SCN10A; (-) strand; PAM type: NRG; PAM sequence: TGG
tcctttgaatggaagaagag

SEQ ID NO: 14598 - DNA, 20 bp, Artificial Sequence
  Description of Artificial Sequence: Synthetic oligonucleotide
  Target: SCN10A; (-) strand; PAM type: NRG; PAM sequence: GAG
ccatcctttgaatggaagaa

SEQ ID NO: 14599 - DNA, 20 bp, Artificial Sequence
  Description of Artificial Sequence: Synthetic oligonucleotide
  Target: SCN10A; (-) strand; PAM type: NRG; PAM sequence: AAG
ctccatcctttgaatggaag

SEQ ID NO: 14600 - DNA, 20 bp, Artificial Sequence
  Description of Artificial Sequence: Synthetic oligonucleotide
  Target: SCN10A; (-) strand; PAM type: NRG; PAM sequence: AAG
attctccatcctttgaatgg

SEQ ID NO: 14601 - DNA, 20 bp, Artificial Sequence
  Description of Artificial Sequence: Synthetic oligonucleotide
  Target: SCN10A; (-) strand; PAM type: NRG; PAM sequence: TGG
gagattctccatcctttgaa

SEQ ID NO: 14602 - DNA, 20 bp, Artificial Sequence
  Description of Artificial Sequence: Synthetic oligonucleotide
  Target: SCN10A; (-) strand; PAM type: NRG; PAM sequence: GAG
tcataaccaattctgttcct

SEQ ID NO: 14603 - DNA, 20 bp, Artificial Sequence
  Description of Artificial Sequence: Synthetic oligonucleotide
  Target: SCN10A; (-) strand; PAM type: NRG; PAM sequence: AAG
gacctccacatgtggagggg

SEQ ID NO: 14604 - DNA, 20 bp, Artificial Sequence
  Description of Artificial Sequence: Synthetic oligonucleotide
  Target: SCN10A; (-) strand; PAM type: NRG; PAM sequence: GGG
ggagacctccacatgtggag

SEQ ID NO: 14605 - DNA, 20 bp, Artificial Sequence
  Description of Artificial Sequence: Synthetic oligonucleotide
  Target: SCN10A; (-) strand; PAM type: NRG; PAM sequence: GGG
gggagacctccacatgtgga

SEQ ID NO: 14606 - DNA, 20 bp, Artificial Sequence
  Description of Artificial Sequence: Synthetic oligonucleotide
  Target: SCN10A; (-) strand; PAM type: NRG; PAM sequence: AGG
ggggagacctccacatgtgg

SEQ ID NO: 14607 - DNA, 20 bp, Artificial Sequence
  Description of Artificial Sequence: Synthetic oligonucleotide
  Target: SCN10A; (-) strand; PAM type: NRG; PAM sequence: GAG
gggggagacctccacatgtg

SEQ ID NO: 14608 - DNA, 20 bp, Artificial Sequence
  Description of Artificial Sequence: Synthetic oligonucleotide
  Target: SCN10A; (-) strand; PAM type: NRG; PAM sequence: TGG
cagggggagacctccacatg

SEQ ID NO: 14609 - DNA, 20 bp, Artificial Sequence
  Description of Artificial Sequence: Synthetic oligonucleotide
  Target: SCN10A; (-) strand; PAM type: NRG; PAM sequence: GAG
ctccgaggatggcacagggg

SEQ ID NO: 14610 - DNA, 20 bp, Artificial Sequence
  Description of Artificial Sequence: Synthetic oligonucleotide
  Target: SCN10A; (-) strand; PAM type: NRG; PAM sequence: GGG
tcctccgaggatggcacagg

SEQ ID NO: 14611 - DNA, 20 bp, Artificial Sequence
  Description of Artificial Sequence: Synthetic oligonucleotide
  Target: SCN10A; (-) strand; PAM type: NRG; PAM sequence: GGG
atcctccgaggatggcacag

SEQ ID NO: 14612 - DNA, 20 bp, Artificial Sequence
  Description of Artificial Sequence: Synthetic oligonucleotide
  Target: SCN10A; (-) strand; PAM type: NRG; PAM sequence: GGG
gatcctccgaggatggcaca

SEQ ID NO: 14613 - DNA, 20 bp, Artificial Sequence
  Description of Artificial Sequence: Synthetic oligonucleotide
  Target: SCN10A; (-) strand; PAM type: NRG; PAM sequence: AGG
agatcctccgaggatggcac

SEQ ID NO: 14614 - DNA, 20 bp, Artificial Sequence
  Description of Artificial Sequence: Synthetic oligonucleotide
  Target: SCN10A; (-) strand; PAM type: NRG; PAM sequence: CAG
aagatcctccgaggatggca

SEQ ID NO: 14615 - DNA, 20 bp, Artificial Sequence
  Description of Artificial Sequence: Synthetic oligonucleotide
  Target: SCN10A; (-) strand; PAM type: NRG; PAM sequence: TGG
caactaagatcctccgagga

SEQ ID NO: 14616 - DNA, 20 bp, Artificial Sequence
  Description of Artificial Sequence: Synthetic oligonucleotide
  Target: SCN10A; (-) strand; PAM type: NRG; PAM sequence: AGG
gctgcaactaagatcctccg

SEQ ID NO: 14617 - DNA, 20 bp, Artificial Sequence
  Description of Artificial Sequence: Synthetic oligonucleotide
  Target: SCN10A; (-) strand; PAM type: NRG; PAM sequence: GAG
agctgcaactaagatcctcc

SEQ ID NO: 14618 - DNA, 20 bp, Artificial Sequence
  Description of Artificial Sequence: Synthetic oligonucleotide
  Target: SCN10A; (-) strand; PAM type: NRG; PAM sequence: AAG
ctcctaattaagctgcaact

SEQ ID NO: 14619 - DNA, 20 bp, Artificial Sequence
  Description of Artificial Sequence: Synthetic oligonucleotide
  Target: SCN10A; (-) strand; PAM type: NRG; PAM sequence: AAG
aatcaccatttctcctaatt

SEQ ID NO: 14620 - DNA, 20 bp, Artificial Sequence
  Description of Artificial Sequence: Synthetic oligonucleotide
  Target: SCN10A; (-) strand; PAM type: NRG; PAM sequence: AAG
ggagttgatggtcaggcagg

SEQ ID NO: 14621 - DNA, 20 bp, Artificial Sequence
  Description of Artificial Sequence: Synthetic oligonucleotide
  Target: SCN10A; (-) strand; PAM type: NRG; PAM sequence: AGG
gacggagttgatggtcaggc

SEQ ID NO: 14622 - DNA, 20 bp, Artificial Sequence
  Description of Artificial Sequence: Synthetic oligonucleotide
  Target: SCN10A; (-) strand; PAM type: NRG; PAM sequence: CAG
agacggagttgatggtcagg

SEQ ID NO: 14623 - DNA, 20 bp, Artificial Sequence
  Description of Artificial Sequence: Synthetic oligonucleotide
  Target: SCN10A; (-) strand; PAM type: NRG; PAM sequence: AGG
gggagacggagttgatggtc

SEQ ID NO: 14624 - DNA, 20 bp, Artificial Sequence
  Description of Artificial Sequence: Synthetic oligonucleotide
  Target: SCN10A; (-) strand; PAM type: NRG; PAM sequence: CAG
tgggagacggagttgatggt

SEQ ID NO: 14625 - DNA, 20 bp, Artificial Sequence
  Description of Artificial Sequence: Synthetic oligonucleotide
  Target: SCN10A; (-) strand; PAM type: NRG; PAM sequence: TGG
ggagtgggagacggagttga

SEQ ID NO: 14626 - DNA, 20 bp, Artificial Sequence
  Description of Artificial Sequence: Synthetic oligonucleotide
  Target: SCN10A; (-) strand; PAM type: NRG; PAM sequence: GAG
gtaaataggagtgggagacg

SEQ ID NO: 14627 - DNA, 20 bp, Artificial Sequence
  Description of Artificial Sequence: Synthetic oligonucleotide
  Target: SCN10A; (-) strand; PAM type: NRG; PAM sequence: CGG
cagtaaataggagtgggaga

SEQ ID NO: 14628 - DNA, 20 bp, Artificial Sequence
  Description of Artificial Sequence: Synthetic oligonucleotide
  Target: SCN10A; (-) strand; PAM type: NRG; PAM sequence: GAG
caggcagtaaataggagtgg

SEQ ID NO: 14629 - DNA, 20 bp, Artificial Sequence
  Description of Artificial Sequence: Synthetic oligonucleotide
  Target: SCN10A; (-) strand; PAM type: NRG; PAM sequence: GGG
tccaggcagtaaataggagt

SEQ ID NO: 14630 - DNA, 20 bp, Artificial Sequence
  Description of Artificial Sequence: Synthetic oligonucleotide
  Target: SCN10A; (-) strand; PAM type: NRG; PAM sequence: TGG
ttccaggcagtaaataggag

SEQ ID NO: 14631 - DNA, 20 bp, Artificial Sequence
  Description of Artificial Sequence: Synthetic oligonucleotide
  Target: SCN10A; (-) strand; PAM type: NRG; PAM sequence: GAG
aaattccaggcagtaaatag

SEQ ID NO: 14632 - DNA, 20 bp, Artificial Sequence
  Description of Artificial Sequence: Synthetic oligonucleotide
  Target: SCN10A; (-) strand; PAM type: NRG; PAM sequence: AGG
tgaaattccaggcagtaaat

SEQ ID NO: 14633 - DNA, 20 bp, Artificial Sequence
  Description of Artificial Sequence: Synthetic oligonucleotide
  Target: SCN10A; (-) strand; PAM type: NRG; PAM sequence: TAG
ttgaaattccaggcagtaaa

SEQ ID NO: 14634 - DNA, 20 bp, Artificial Sequence
  Description of Artificial Sequence: Synthetic oligonucleotide
  Target: SCN10A; (-) strand; PAM type: NRG; PAM sequence: CAG
cctaatgttgaaattccagg

SEQ ID NO: 14635 - DNA, 20 bp, Artificial Sequence
  Description of Artificial Sequence: Synthetic oligonucleotide
  Target: SCN10A; (-) strand; PAM type: NRG; PAM sequence: AGG
gaccctaatgttgaaattcc

SEQ ID NO: 14636 - DNA, 20 bp, Artificial Sequence
  Description of Artificial Sequence: Synthetic oligonucleotide
  Target: SCN10A; (-) strand; PAM type: NRG; PAM sequence: CAG
tgaccctaatgttgaaattc

SEQ ID NO: 14637 - DNA, 20 bp, Artificial Sequence
  Description of Artificial Sequence: Synthetic oligonucleotide
  Target: SCN10A; (-) strand; PAM type: NRG; PAM sequence: AGG
gagagggcatctacctacaa

SEQ ID NO: 14638 - DNA, 20 bp, Artificial Sequence
  Description of Artificial Sequence: Synthetic oligonucleotide
  Target: SCN10A; (-) strand; PAM type: NRG; PAM sequence: AAG
ggagagggcatctacctaca

SEQ ID NO: 14639 - DNA, 20 bp, Artificial Sequence
  Description of Artificial Sequence: Synthetic oligonucleotide
  Target: SCN10A; (-) strand; PAM type: NRG; PAM sequence: GGG
tcaaaaagggaccctggaga

SEQ ID NO: 14640 - DNA, 20 bp, Artificial Sequence
  Description of Artificial Sequence: Synthetic oligonucleotide
  Target: SCN10A; (-) strand; PAM type: NRG; PAM sequence: AGG
ttcaaaaagggaccctggag

SEQ ID NO: 14641 - DNA, 20 bp, Artificial Sequence
  Description of Artificial Sequence: Synthetic oligonucleotide
  Target: SCN10A; (-) strand; PAM type: NRG; PAM sequence: GAG
tttcaaaaagggaccctgga

SEQ ID NO: 14642 - DNA, 20 bp, Artificial Sequence
  Description of Artificial Sequence: Synthetic oligonucleotide
  Target: SCN10A; (-) strand; PAM type: NRG; PAM sequence: GAG
tatttcaaaaagggaccctg

SEQ ID NO: 14643 - DNA, 20 bp, Artificial Sequence
  Description of Artificial Sequence: Synthetic oligonucleotide
  Target: SCN10A; (-) strand; PAM type: NRG; PAM sequence: TGG
catatttcaaaaagggaccc

SEQ ID NO: 14644 - DNA, 20 bp, Artificial Sequence
  Description of Artificial Sequence: Synthetic oligonucleotide
  Target: SCN10A; (-) strand; PAM type: NRG; PAM sequence: GGG
gataaatcatatttcaaaaa

SEQ ID NO: 14645 - DNA, 20 bp, Artificial Sequence
  Description of Artificial Sequence: Synthetic oligonucleotide
  Target: SCN10A; (-) strand; PAM type: NRG; PAM sequence: AGG
agataaatcatatttcaaaa

SEQ ID NO: 14646 - DNA, 20 bp, Artificial Sequence
  Description of Artificial Sequence: Synthetic oligonucleotide
  Target: SCN10A; (-) strand; PAM type: NRG; PAM sequence: AAG
aagataaatcatatttcaaa

SEQ ID NO: 14647 - DNA, 20 bp, Artificial Sequence
  Description of Artificial Sequence: Synthetic oligonucleotide
  Target: SCN10A; (-) strand; PAM type: NRG; PAM sequence: AAG
gaagacaacattcttaggac

SEQ ID NO: 14648 - DNA, 20 bp, Artificial Sequence
  Description of Artificial Sequence: Synthetic oligonucleotide
  Target: SCN10A; (-) strand; PAM type: NRG; PAM sequence: AGG
tcaaggaagacaacattctt

SEQ ID NO: 14649 - DNA, 20 bp, Artificial Sequence
  Description of Artificial Sequence: Synthetic oligonucleotide
  Target: SCN10A; (-) strand; PAM type: NRG; PAM sequence: TAG
ctcaaggaagacaacattct

SEQ ID NO: 14650 - DNA, 20 bp, Artificial Sequence
  Description of Artificial Sequence: Synthetic oligonucleotide
  Target: SCN10A; (-) strand; PAM type: NRG; PAM sequence: AAG
aaagcttcctcccctcaagg

SEQ ID NO: 14651 - DNA, 20 bp, Artificial Sequence
  Description of Artificial Sequence: Synthetic oligonucleotide
  Target: SCN10A; (-) strand; PAM type: NRG; PAM sequence: AGG
aagaaagcttcctcccctca

SEQ ID NO: 14652 - DNA, 20 bp, Artificial Sequence
  Description of Artificial Sequence: Synthetic oligonucleotide
  Target: SCN10A; (-) strand; PAM type: NRG; PAM sequence: AAG
aaagaaagcttcctcccctc

SEQ ID NO: 14653 - DNA, 20 bp, Artificial Sequence
  Description of Artificial Sequence: Synthetic oligonucleotide
  Target: SCN10A; (-) strand; PAM type: NRG; PAM sequence: AAG
accccataggctgccaaaga

SEQ ID NO: 14654 - DNA, 20 bp, Artificial Sequence
  Description of Artificial Sequence: Synthetic oligonucleotide
  Target: SCN10A; (-) strand; PAM type: NRG; PAM sequence: AAG
cccaaccccataggctgcca

SEQ ID NO: 14655 - DNA, 20 bp, Artificial Sequence
  Description of Artificial Sequence: Synthetic oligonucleotide
  Target: SCN10A; (-) strand; PAM type: NRG; PAM sequence: AGG
ctgtcatcacccaaccccat

SEQ ID NO: 14656 - DNA, 20 bp, Artificial Sequence
  Description of Artificial Sequence: Synthetic oligonucleotide
  Target: SCN10A; (-) strand; PAM type: NRG; PAM sequence: TAG
cctgtcatcacccaacccca

SEQ ID NO: 14657 - DNA, 20 bp, Artificial Sequence
  Description of Artificial Sequence: Synthetic oligonucleotide
  Target: SCN10A; (-) strand; PAM type: NRG; PAM sequence: CAG
tcaatctctctttgacatcc

SEQ ID NO: 14658 - DNA, 20 bp, Artificial Sequence
  Description of Artificial Sequence: Synthetic oligonucleotide
  Target: SCN10A; (-) strand; PAM type: NRG; PAM sequence: TGG
ggcaaaaacatgaaagtttt

SEQ ID NO: 14659 - DNA, 20 bp, Artificial Sequence
  Description of Artificial Sequence: Synthetic oligonucleotide
  Target: SCN10A; (-) strand; PAM type: NRG; PAM sequence: AAG
aacccttggcaaaaacatga

SEQ ID NO: 14660 - DNA, 20 bp, Artificial Sequence
  Description of Artificial Sequence: Synthetic oligonucleotide
  Target: SCN10A; (-) strand; PAM type: NRG; PAM sequence: TGG
tgtgtgctagggacaaccct

SEQ ID NO: 14661 - DNA, 20 bp, Artificial Sequence
  Description of Artificial Sequence: Synthetic oligonucleotide
  Target: SCN10A; (-) strand; PAM type: NRG; PAM sequence: GGG
tgccaaggaggtgtgtgcta

SEQ ID NO: 14662 - DNA, 20 bp, Artificial Sequence
  Description of Artificial Sequence: Synthetic oligonucleotide
  Target: SCN10A; (-) strand; PAM type: NRG; PAM sequence: AGG
atgccaaggaggtgtgtgct

SEQ ID NO: 14663 - DNA, 20 bp, Artificial Sequence
  Description of Artificial Sequence: Synthetic oligonucleotide
  Target: SCN10A; (-) strand; PAM type: NRG; PAM sequence: TAG
gatgccaaggaggtgtgtgc

SEQ ID NO: 14664 - DNA, 20 bp, Artificial Sequence
  Description of Artificial Sequence: Synthetic oligonucleotide
  Target: SCN10A; (-) strand; PAM type: NRG; PAM sequence: AGG
atttgagccagatgccaagg

SEQ ID NO: 14665 - DNA, 20 bp, Artificial Sequence
  Description of Artificial Sequence: Synthetic oligonucleotide
  Target: SCN10A; (-) strand; PAM type: NRG; PAM sequence: GAG
catttgagccagatgccaag

SEQ ID NO: 14666 - DNA, 20 bp, Artificial Sequence
  Description of Artificial Sequence: Synthetic oligonucleotide
  Target: SCN10A; (-) strand; PAM type: NRG; PAM sequence: AGG
cacatttgagccagatgcca

SEQ ID NO: 14667 - DNA, 20 bp, Artificial Sequence
  Description of Artificial Sequence: Synthetic oligonucleotide
  Target: SCN10A; (-) strand; PAM type: NRG; PAM sequence: AAG
ccacatttgagccagatgcc

SEQ ID NO: 14668 - DNA, 20 bp, Artificial Sequence
  Description of Artificial Sequence: Synthetic oligonucleotide
  Target: SCN10A; (-) strand; PAM type: NRG; PAM sequence: CAG
gattgaatccacatttgagc

SEQ ID NO: 14669 - DNA, 20 bp, Artificial Sequence
  Description of Artificial Sequence: Synthetic oligonucleotide
  Target: SCN10A; (-) strand; PAM type: NRG; PAM sequence: GAG
gtaagattgaatccacattt

SEQ ID NO: 14670 - DNA, 20 bp, Artificial Sequence
  Description of Artificial Sequence: Synthetic oligonucleotide
  Target: SCN10A; (-) strand; PAM type: NRG; PAM sequence: AAG
cctttacttgtggctggagt

SEQ ID NO: 14671 - DNA, 20 bp, Artificial Sequence
  Description of Artificial Sequence: Synthetic oligonucleotide
  Target: SCN10A; (-) strand; PAM type: NRG; PAM sequence: GAG
ctggcctttacttgtggctg

SEQ ID NO: 14672 - DNA, 20 bp, Artificial Sequence
  Description of Artificial Sequence: Synthetic oligonucleotide
  Target: SCN10A; (-) strand; PAM type: NRG; PAM sequence: TGG
cactggcctttacttgtggc

SEQ ID NO: 14673 - DNA, 20 bp, Artificial Sequence
  Description of Artificial Sequence: Synthetic oligonucleotide
  Target: SCN10A; (-) strand; PAM type: NRG; PAM sequence: TGG
tccacactggcctttacttg

SEQ ID NO: 14674 - DNA, 20 bp, Artificial Sequence
  Description of Artificial Sequence: Synthetic oligonucleotide
  Target: SCN10A; (-) strand; PAM type: NRG; PAM sequence: TGG
gcaagcagctgagtccacac

SEQ ID NO: 14675 - DNA, 20 bp, Artificial Sequence
  Description of Artificial Sequence: Synthetic oligonucleotide
  Target: SCN10A; (-) strand; PAM type: NRG; PAM sequence: GAG
ttactgagaagcaagcagct

SEQ ID NO: 14676 - DNA, 20 bp, Artificial Sequence
  Description of Artificial Sequence: Synthetic oligonucleotide
  Target: SCN10A; (-) strand; PAM type: NRG; PAM sequence: CAG
aagacttactgagaagcaag

SEQ ID NO: 14677 - DNA, 20 bp, Artificial Sequence
  Description of Artificial Sequence: Synthetic oligonucleotide
  Target: SCN10A; (-) strand; PAM type: NRG; PAM sequence: AAG
cctaagacttactgagaagc

SEQ ID NO: 14678 - DNA, 20 bp, Artificial Sequence
  Description of Artificial Sequence: Synthetic oligonucleotide
  Target: SCN10A; (-) strand; PAM type: NRG; PAM sequence: AAG
ggaccctaagacttactgag

SEQ ID NO: 14679 - DNA, 20 bp, Artificial Sequence
  Description of Artificial Sequence: Synthetic oligonucleotide
  Target: SCN10A; (-) strand; PAM type: NRG; PAM sequence: GAG
ggaggaccctaagacttact

SEQ ID NO: 14680 - DNA, 20 bp, Artificial Sequence
  Description of Artificial Sequence: Synthetic oligonucleotide
  Target: SCN10A; (-) strand; PAM type: NRG; PAM sequence: AAG
ggtaatgagaggaggaccct

SEQ ID NO: 14681 - DNA, 20 bp, Artificial Sequence
  Description of Artificial Sequence: Synthetic oligonucleotide
  Target: SCN10A; (-) strand; PAM type: NRG; PAM sequence: AGG
aagtcatgggtaatgagagg

SEQ ID NO: 14682 - DNA, 20 bp, Artificial Sequence
  Description of Artificial Sequence: Synthetic oligonucleotide
  Target: SCN10A; (-) strand; PAM type: NRG; PAM sequence: GAG
caagtcatgggtaatgagag

SEQ ID NO: 14683 - DNA, 20 bp, Artificial Sequence
  Description of Artificial Sequence: Synthetic oligonucleotide
  Target: SCN10A; (-) strand; PAM type: NRG; PAM sequence: AGG
ttcaagtcatgggtaatgag

SEQ ID NO: 14684 - DNA, 20 bp, Artificial Sequence
  Description of Artificial Sequence: Synthetic oligonucleotide
  Target: SCN10A; (-) strand; PAM type: NRG; PAM sequence: GAG
attcaagtcatgggtaatga

SEQ ID NO: 14685 - DNA, 20 bp, Artificial Sequence
  Description of Artificial Sequence: Synthetic oligonucleotide
  Target: SCN10A; (-) strand; PAM type: NRG; PAM sequence: GAG
acattcaagtcatgggtaat

SEQ ID NO: 14686 - DNA, 20 bp, Artificial Sequence
  Description of Artificial Sequence: Synthetic oligonucleotide
  Target: SCN10A; (-) strand; PAM type: NRG; PAM sequence: GGG
cccaaccacattcaagtcat

SEQ ID NO: 14687 - DNA, 20 bp, Artificial Sequence
  Description of Artificial Sequence: Synthetic oligonucleotide
  Target: SCN10A; (-) strand; PAM type: NRG; PAM sequence: TGG
tcccaaccacattcaagtca

SEQ ID NO: 14688 - DNA, 20 bp, Artificial Sequence
  Description of Artificial Sequence: Synthetic oligonucleotide
  Target: SCN10A; (-) strand; PAM type: NRG; PAM sequence: AAG
gctgagtcccaaccacattc

SEQ ID NO: 14689 - DNA, 20 bp, Artificial Sequence
  Description of Artificial Sequence: Synthetic oligonucleotide
  Target: SCN10A; (-) strand; PAM type: NRG; PAM sequence: GAG
ttaaaattaggtgaaaggct

SEQ ID NO: 14690 - DNA, 20 bp, Artificial Sequence
  Description of Artificial Sequence: Synthetic oligonucleotide
  Target: SCN10A; (-) strand; PAM type: NRG; PAM sequence: AGG
caaaattaaaattaggtgaa

SEQ ID NO: 14691 - DNA, 20 bp, Artificial Sequence
  Description of Artificial Sequence: Synthetic oligonucleotide
  Target: SCN10A; (-) strand; PAM type: NRG; PAM sequence: AAG
tcaaaattaaaattaggtga

SEQ ID NO: 14692 - DNA, 20 bp, Artificial Sequence
  Description of Artificial Sequence: Synthetic oligonucleotide
  Target: SCN10A; (-) strand; PAM type: NRG; PAM sequence: AGG
gcaggctcaaaattaaaatt

SEQ ID NO: 14693 - DNA, 20 bp, Artificial Sequence
  Description of Artificial Sequence: Synthetic oligonucleotide
  Target: SCN10A; (-) strand; PAM type: NRG; PAM sequence: TAG
agcaggctcaaaattaaaat

SEQ ID NO: 14694 - DNA, 20 bp, Artificial Sequence
  Description of Artificial Sequence: Synthetic oligonucleotide
  Target: SCN10A; (-) strand; PAM type: NRG; PAM sequence: AGG
caagttcagtggagaggagc

SEQ ID NO: 14695 - DNA, 20 bp, Artificial Sequence
  Description of Artificial Sequence: Synthetic oligonucleotide
  Target: SCN10A; (-) strand; PAM type: NRG; PAM sequence: CAG
acaagttcagtggagaggag

SEQ ID NO: 14696 - DNA, 20 bp, Artificial Sequence
  Description of Artificial Sequence: Synthetic oligonucleotide
  Target: SCN10A; (-) strand; PAM type: NRG; PAM sequence: GAG
tcaacaagttcagtggagag

SEQ ID NO: 14697 - DNA, 20 bp, Artificial Sequence
  Description of Artificial Sequence: Synthetic oligonucleotide
  Target: SCN10A; (-) strand; PAM type: NRG; PAM sequence: AGG
catcaacaagttcagtggag

SEQ ID NO: 14698 - DNA, 20 bp, Artificial Sequence
  Description of Artificial Sequence: Synthetic oligonucleotide
  Target: SCN10A; (-) strand; PAM type: NRG; PAM sequence: GAG
ccatcaacaagttcagtgga

SEQ ID NO: 14699 - DNA, 20 bp, Artificial Sequence
  Description of Artificial Sequence: Synthetic oligonucleotide
  Target: SCN10A; (-) strand; PAM type: NRG; PAM sequence: GAG
ctccatcaacaagttcagtg

SEQ ID NO: 14700 - DNA, 20 bp, Artificial Sequence
  Description of Artificial Sequence: Synthetic oligonucleotide
  Target: SCN10A; (-) strand; PAM type: NRG; PAM sequence: TGG
ccctccatcaacaagttcag

SEQ ID NO: 14701 - DNA, 20 bp, Artificial Sequence
  Description of Artificial Sequence: Synthetic oligonucleotide
  Target: SCN10A; (-) strand; PAM type: NRG; PAM sequence: CAG
tatccctccatcaacaagtt

SEQ ID NO: 14702 - DNA, 20 bp, Artificial Sequence
  Description of Artificial Sequence: Synthetic oligonucleotide
  Target: SCN10A; (-) strand; PAM type: NRG; PAM sequence: AAG
ttgagtatccctccatcaac

SEQ ID NO: 14703 - DNA, 20 bp, Artificial Sequence
  Description of Artificial Sequence: Synthetic oligonucleotide
  Target: SCN10A; (-) strand; PAM type: NRG; PAM sequence: GAG
caaaagtccttaggctcatt

SEQ ID NO: 14704 - DNA, 20 bp, Artificial Sequence
  Description of Artificial Sequence: Synthetic oligonucleotide
  Target: SCN10A; (-) strand; PAM type: NRG; PAM sequence: AGG
gaacctgagcaaaagtcctt

SEQ ID NO: 14705 - DNA, 20 bp, Artificial Sequence
  Description of Artificial Sequence: Synthetic oligonucleotide
  Target: SCN10A; (-) strand; PAM type: NRG; PAM sequence: TAG
tgaacctgagcaaaagtcct

SEQ ID NO: 14706 - DNA, 20 bp, Artificial Sequence
  Description of Artificial Sequence: Synthetic oligonucleotide
  Target: SCN10A; (-) strand; PAM type: NRG; PAM sequence: AAG
atttgagtgaacctgagcaa

SEQ ID NO: 14707 - DNA, 20 bp, Artificial Sequence
  Description of Artificial Sequence: Synthetic oligonucleotide
  Target: SCN10A; (-) strand; PAM type: NRG; PAM sequence: GAG
aactggatttgagtgaacct

SEQ ID NO: 14708 - DNA, 20 bp, Artificial Sequence
  Description of Artificial Sequence: Synthetic oligonucleotide
  Target: SCN10A; (-) strand; PAM type: NRG; PAM sequence: GAG
caatcaagataactggattt

SEQ ID NO: 14709 - DNA, 20 bp, Artificial Sequence
  Description of Artificial Sequence: Synthetic oligonucleotide
  Target: SCN10A; (-) strand; PAM type: NRG; PAM sequence: TGG
acccatacaatcaagataac

SEQ ID NO: 14710 - DNA, 20 bp, Artificial Sequence
  Description of Artificial Sequence: Synthetic oligonucleotide
  Target: SCN10A; (-) strand; PAM type: NRG; PAM sequence: AAG
cctaaatcacccatacaatc

SEQ ID NO: 14711 - DNA, 20 bp, Artificial Sequence
  Description of Artificial Sequence: Synthetic oligonucleotide
  Target: SCN10A; (-) strand; PAM type: NRG; PAM sequence: CAG
ttcagacctctgtaggggca

SEQ ID NO: 14712 - DNA, 20 bp, Artificial Sequence
  Description of Artificial Sequence: Synthetic oligonucleotide
  Target: SCN10A; (-) strand; PAM type: NRG; PAM sequence: GGG
ggaggttcagacctctgtag

SEQ ID NO: 14713 - DNA, 20 bp, Artificial Sequence
  Description of Artificial Sequence: Synthetic oligonucleotide
  Target: SCN10A; (-) strand; PAM type: NRG; PAM sequence: GGG
aggaggttcagacctctgta

SEQ ID NO: 14714 - DNA, 20 bp, Artificial Sequence
  Description of Artificial Sequence: Synthetic oligonucleotide
  Target: SCN10A; (-) strand; PAM type: NRG; PAM sequence: AGG
taggaggttcagacctctgt

SEQ ID NO: 14715 - DNA, 20 bp, Artificial Sequence
  Description of Artificial Sequence: Synthetic oligonucleotide
  Target: SCN10A; (-) strand; PAM type: NRG; PAM sequence: TAG
ataggaggttcagacctctg

SEQ ID NO: 14716 - DNA, 20 bp, Artificial Sequence
  Description of Artificial Sequence: Synthetic oligonucleotide
  Target: SCN10A; (-) strand; PAM type: NRG; PAM sequence: CAG
gtggggagtgataggaggtt

SEQ ID NO: 14717 - DNA, 20 bp, Artificial Sequence
  Description of Artificial Sequence: Synthetic oligonucleotide
  Target: SCN10A; (-) strand; PAM type: NRG; PAM sequence: AGG
ggggagtggggagtgatagg

SEQ ID NO: 14718 - DNA, 20 bp, Artificial Sequence
  Description of Artificial Sequence: Synthetic oligonucleotide
  Target: SCN10A; (-) strand; PAM type: NRG; PAM sequence: GAG
tggggagtggggagtgatag

SEQ ID NO: 14719 - DNA, 20 bp, Artificial Sequence
  Description of Artificial Sequence: Synthetic oligonucleotide
  Target: SCN10A; (-) strand; PAM type: NRG; PAM sequence: AGG
aatggggagtggggagtgat

SEQ ID NO: 14720 - DNA, 20 bp, Artificial Sequence
  Description of Artificial Sequence: Synthetic oligonucleotide
  Target: SCN10A; (-) strand; PAM type: NRG; PAM sequence: TAG
caatggggagtggggagtga

SEQ ID NO: 14721 - DNA, 20 bp, Artificial Sequence
  Description of Artificial Sequence: Synthetic oligonucleotide
  Target: SCN10A; (-) strand; PAM type: NRG; PAM sequence: GAG
gtattacaatggggagtggg

SEQ ID NO: 14722 - DNA, 20 bp, Artificial Sequence
  Description of Artificial Sequence: Synthetic oligonucleotide
  Target: SCN10A; (-) strand; PAM type: NRG; PAM sequence: GGG
aagtattacaatggggagtg

SEQ ID NO: 14723 - DNA, 20 bp, Artificial Sequence
  Description of Artificial Sequence: Synthetic oligonucleotide
  Target: SCN10A; (-) strand; PAM type: NRG; PAM sequence: GGG
gaagtattacaatggggagt

SEQ ID NO: 14724 - DNA, 20 bp, Artificial Sequence
  Description of Artificial Sequence: Synthetic oligonucleotide
  Target: SCN10A; (-) strand; PAM type: NRG; PAM sequence: TGG
agaagtattacaatggggag

SEQ ID NO: 14725 - DNA, 20 bp, Artificial Sequence
  Description of Artificial Sequence: Synthetic oligonucleotide
  Target: SCN10A; (-) strand; PAM type: NRG; PAM sequence: GAG
ataagaagtattacaatggg

SEQ ID NO: 14726 - DNA, 20 bp, Artificial Sequence
  Description of Artificial Sequence: Synthetic oligonucleotide
  Target: SCN10A; (-) strand; PAM type: NRG; PAM sequence: GGG
tgataagaagtattacaatg

SEQ ID NO: 14727 - DNA, 20 bp, Artificial Sequence
  Description of Artificial Sequence: Synthetic oligonucleotide
  Target: SCN10A; (-) strand; PAM type: NRG; PAM sequence: GGG
ctgataagaagtattacaat

SEQ ID NO: 14728 - DNA, 20 bp, Artificial Sequence
  Description of Artificial Sequence: Synthetic oligonucleotide
  Target: SCN10A; (-) strand; PAM type: NRG; PAM sequence: TGG
tctgataagaagtattacaa

SEQ ID NO: 14729 - DNA, 20 bp, Artificial Sequence
  Description of Artificial Sequence: Synthetic oligonucleotide
  Target: SCN10A; (-) strand; PAM type: NRG; PAM sequence: AAG
ctagtctagattctgataag

SEQ ID NO: 14730 - DNA, 20 bp, Artificial Sequence
  Description of Artificial Sequence: Synthetic oligonucleotide
  Target: SCN10A; (-) strand; PAM type: NRG; PAM sequence: AAG
ttactagtctagattctgat

SEQ ID NO: 14731 - DNA, 20 bp, Artificial Sequence
  Description of Artificial Sequence: Synthetic oligonucleotide
  Target: SCN10A; (-) strand; PAM type: NRG; PAM sequence: TAG
tcatgaatttattactagtc

SEQ ID NO: 14732 - DNA, 20 bp, Artificial Sequence
  Description of Artificial Sequence: Synthetic oligonucleotide
  Target: SCN10A; (-) strand; PAM type: NRG; PAM sequence: TAG
agtggtcatgaatttattac

SEQ ID NO: 14733 - DNA, 20 bp, Artificial Sequence
  Description of Artificial Sequence: Synthetic oligonucleotide
  Target: SCN10A; (-) strand; PAM type: NRG; PAM sequence: TGG
gacactgtattttgaaatag

SEQ ID NO: 14734 - DNA, 20 bp, Artificial Sequence
  Description of Artificial Sequence: Synthetic oligonucleotide
  Target: SCN10A; (-) strand; PAM type: NRG; PAM sequence: TAG
tttgacactgtattttgaaa

SEQ ID NO: 14735 - DNA, 20 bp, Artificial Sequence
  Description of Artificial Sequence: Synthetic oligonucleotide
  Target: SCN10A; (-) strand; PAM type: NRG; PAM sequence: AAG
aaaacatttacaagagaaaa

SEQ ID NO: 14736 - DNA, 20 bp, Artificial Sequence
  Description of Artificial Sequence: Synthetic oligonucleotide
  Target: SCN10A; (-) strand; PAM type: NRG; PAM sequence: GAG
aaagtgaaaaacatttacaa

SEQ ID NO: 14737 - DNA, 20 bp, Artificial Sequence
  Description of Artificial Sequence: Synthetic oligonucleotide
  Target: SCN10A; (-) strand; PAM type: NRG; PAM sequence: AAG
acaaagtgaaaaacatttac

SEQ ID NO: 14738 - DNA, 20 bp, Artificial Sequence
  Description of Artificial Sequence: Synthetic oligonucleotide
  Target: SCN10A; (-) strand; PAM type: NRG; PAM sequence: AAG
cttcaaactttgtcagaaca

SEQ ID NO: 14739 - DNA, 20 bp, Artificial Sequence
  Description of Artificial Sequence: Synthetic oligonucleotide
  Target: SCN10A; (-) strand; PAM type: NRG; PAM sequence: CAG
taatttacttcaaactttgt

SEQ ID NO: 14740 - DNA, 20 bp, Artificial Sequence
  Description of Artificial Sequence: Synthetic oligonucleotide
  Target: SCN10A; (-) strand; PAM type: NRG; PAM sequence: AGG
atttttttaaatcaaggtat

SEQ ID NO: 14741 - DNA, 20 bp, Artificial Sequence
  Description of Artificial Sequence: Synthetic oligonucleotide
  Target: SCN10A; (-) strand; PAM type: NRG; PAM sequence: TAG
gatttttttaaatcaaggta

SEQ ID NO: 14742 - DNA, 20 bp, Artificial Sequence
  Description of Artificial Sequence: Synthetic oligonucleotide
  Target: SCN10A; (-) strand; PAM type: NRG; PAM sequence: AGG
tattagatttttttaaatca

SEQ ID NO: 14743 - DNA, 20 bp, Artificial Sequence
  Description of Artificial Sequence: Synthetic oligonucleotide
  Target: SCN10A; (-) strand; PAM type: NRG; PAM sequence: AAG
ctattagatttttttaaatc

SEQ ID NO: 14744 - DNA, 20 bp, Artificial Sequence
  Description of Artificial Sequence: Synthetic oligonucleotide
  Target: SCN10A; (-) strand; PAM type: NRG; PAM sequence: TAG
cattctgttagccaagctat

SEQ ID NO: 14745 - DNA, 20 bp, Artificial Sequence
  Description of Artificial Sequence: Synthetic oligonucleotide
  Target: SCN10A; (-) strand; PAM type: NRG; PAM sequence: AAG
agacatgcattctgttagcc

SEQ ID NO: 14746 - DNA, 20 bp, Artificial Sequence
  Description of Artificial Sequence: Synthetic oligonucleotide
  Target: SCN10A; (-) strand; PAM type: NRG; PAM sequence: TAG
tatggagacatgcattctgt

SEQ ID NO: 14747 - DNA, 20 bp, Artificial Sequence
  Description of Artificial Sequence: Synthetic oligonucleotide
  Target: SCN10A; (-) strand; PAM type: NRG; PAM sequence: GAG
ctttccctaaatgaattatg

SEQ ID NO: 14748 - DNA, 20 bp, Artificial Sequence
  Description of Artificial Sequence: Synthetic oligonucleotide
  Target: SCN10A; (-) strand; PAM type: NRG; PAM sequence: TGG
gcctttccctaaatgaatta

SEQ ID NO: 14749 - DNA, 20 bp, Artificial Sequence
  Description of Artificial Sequence: Synthetic oligonucleotide
  Target: SCN10A; (-) strand; PAM type: NRG; PAM sequence: AAG
aggacatttaacaaaggaac

SEQ ID NO: 14750 - DNA, 20 bp, Artificial Sequence
  Description of Artificial Sequence: Synthetic oligonucleotide
  Target: SCN10A; (-) strand; PAM type: NRG; PAM sequence: AGG
gtccaaaggacatttaacaa

SEQ ID NO: 14751 - DNA, 20 bp, Artificial Sequence
  Description of Artificial Sequence: Synthetic oligonucleotide
  Target: SCN10A; (-) strand; PAM type: NRG; PAM sequence: AAG
agtccaaaggacatttaaca

SEQ ID NO: 14752 - DNA, 20 bp, Artificial Sequence
  Description of Artificial Sequence: Synthetic oligonucleotide
  Target: SCN10A; (-) strand; PAM type: NRG; PAM sequence: AGG
cacacaagggaaaagtccaa

SEQ ID NO: 14753 - DNA, 20 bp, Artificial Sequence
  Description of Artificial Sequence: Synthetic oligonucleotide
  Target: SCN10A; (-) strand; PAM type: NRG; PAM sequence: AAG
ccacacaagggaaaagtcca

SEQ ID NO: 14754 - DNA, 20 bp, Artificial Sequence
  Description of Artificial Sequence: Synthetic oligonucleotide
  Target: SCN10A; (-) strand; PAM type: NRG; PAM sequence: AAG
cccttccccacacaagggaa

SEQ ID NO: 14755 - DNA, 20 bp, Artificial Sequence
  Description of Artificial Sequence: Synthetic oligonucleotide
  Target: SCN10A; (-) strand; PAM type: NRG; PAM sequence: GGG
attagcccttccccacacaa

SEQ ID NO: 14756 - DNA, 20 bp, Artificial Sequence
  Description of Artificial Sequence: Synthetic oligonucleotide
  Target: SCN10A; (-) strand; PAM type: NRG; PAM sequence: AGG
cattagcccttccccacaca

SEQ ID NO: 14757 - DNA, 20 bp, Artificial Sequence
  Description of Artificial Sequence: Synthetic oligonucleotide
  Target: SCN10A; (-) strand; PAM type: NRG; PAM sequence: AAG
tcattagcccttccccacac

SEQ ID NO: 14758 - DNA, 20 bp, Artificial Sequence
  Description of Artificial Sequence: Synthetic oligonucleotide
  Target: SCN10A; (-) strand; PAM type: NRG; PAM sequence: TAG
tgctgatgacacaatttcat

SEQ ID NO: 14759 - DNA, 20 bp, Artificial Sequence
  Description of Artificial Sequence: Synthetic oligonucleotide
  Target: SCN10A; (-) strand; PAM type: NRG; PAM sequence: AGG
gcattagtgaagaaaatcac

SEQ ID NO: 14760 - DNA, 20 bp, Artificial Sequence
  Description of Artificial Sequence: Synthetic oligonucleotide
  Target: SCN10A; (-) strand; PAM type: NRG; PAM sequence: CAG
agcattagtgaagaaaatca

SEQ ID NO: 14761 - DNA, 20 bp, Artificial Sequence
  Description of Artificial Sequence: Synthetic oligonucleotide
  Target: SCN10A; (-) strand; PAM type: NRG; PAM sequence: AAG
gctaagatgcagcattagtg

SEQ ID NO: 14762 - DNA, 20 bp, Artificial Sequence
  Description of Artificial Sequence: Synthetic oligonucleotide
  Target: SCN10A; (-) strand; PAM type: NRG; PAM sequence: TAG
ctgtggctaagatgcagcat

SEQ ID NO: 14763 - DNA, 20 bp, Artificial Sequence
  Description of Artificial Sequence: Synthetic oligonucleotide
  Target: SCN10A; (-) strand; PAM type: NRG; PAM sequence: CAG
aactttctgtggctaagatg

SEQ ID NO: 14764 - DNA, 20 bp, Artificial Sequence
  Description of Artificial Sequence: Synthetic oligonucleotide
  Target: SCN10A; (-) strand; PAM type: NRG; PAM sequence: AAG
tacataaactttctgtggct

SEQ ID NO: 14765 - DNA, 20 bp, Artificial Sequence
  Description of Artificial Sequence: Synthetic oligonucleotide
  Target: SCN10A; (-) strand; PAM type: NRG; PAM sequence: TGG
ccttctacataaactttctg

SEQ ID NO: 14766 - DNA, 20 bp, Artificial Sequence
  Description of Artificial Sequence: Synthetic oligonucleotide
  Target: SCN10A; (-) strand; PAM type: NRG; PAM sequence: TGG
tccactccagtgaatggaat

SEQ ID NO: 14767 - DNA, 20 bp, Artificial Sequence
  Description of Artificial Sequence: Synthetic oligonucleotide
  Target: SCN10A; (-) strand; PAM type: NRG; PAM sequence: TGG
gagccatccactccagtgaa

SEQ ID NO: 14768 - DNA, 20 bp, Artificial Sequence
  Description of Artificial Sequence: Synthetic oligonucleotide
  Target: SCN10A; (-) strand; PAM type: NRG; PAM sequence: CAG
aatttctgagccatccactc

SEQ ID NO: 14769 - DNA, 20 bp, Artificial Sequence
  Description of Artificial Sequence: Synthetic oligonucleotide
  Target: SCN10A; (-) strand; PAM type: NRG; PAM sequence: GAG
atcgtcttcaaagaatttct

SEQ ID NO: 14770 - DNA, 20 bp, Artificial Sequence
  Description of Artificial Sequence: Synthetic oligonucleotide
  Target: SCN10A; (-) strand; PAM type: NRG; PAM sequence: AAG
attattgttgatcgtcttca

SEQ ID NO: 14771 - DNA, 20 bp, Artificial Sequence
  Description of Artificial Sequence: Synthetic oligonucleotide
  Target: SCN10A; (-) strand; PAM type: NRG; PAM sequence: CAG
gggtgaagatgttgatgtgt

SEQ ID NO: 14772 - DNA, 20 bp, Artificial Sequence
  Description of Artificial Sequence: Synthetic oligonucleotide
  Target: SCN10A; (-) strand; PAM type: NRG; PAM sequence: AAG
gatgaacaggtttgggggtg

SEQ ID NO: 14773 - DNA, 20 bp, Artificial Sequence
  Description of Artificial Sequence: Synthetic oligonucleotide
  Target: SCN10A; (-) strand; PAM type: NRG; PAM sequence: GGG
gaatggatgaacaggtttgg

SEQ ID NO: 14774 - DNA, 20 bp, Artificial Sequence
  Description of Artificial Sequence: Synthetic oligonucleotide
  Target: SCN10A; (-) strand; PAM type: NRG; PAM sequence: GGG
ggaatggatgaacaggtttg

SEQ ID NO: 14775 - DNA, 20 bp, Artificial Sequence
  Description of Artificial Sequence: Synthetic oligonucleotide
  Target: SCN10A; (-) strand; PAM type: NRG; PAM sequence: GGG
gggaatggatgaacaggttt

SEQ ID NO: 14776 - DNA, 20 bp, Artificial Sequence
  Description of Artificial Sequence: Synthetic oligonucleotide
  Target: SCN10A; (-) strand; PAM type: NRG; PAM sequence: TGG
tgggaatggatgaacaggtt

SEQ ID NO: 14777 - DNA, 20 bp, Artificial Sequence
  Description of Artificial Sequence: Synthetic oligonucleotide
  Target: SCN10A; (-) strand; PAM type: NRG; PAM sequence: AGG
ttttttgggaatggatgaac

SEQ ID NO: 14778 - DNA, 20 bp, Artificial Sequence
  Description of Artificial Sequence: Synthetic oligonucleotide
  Target: SCN10A; (-) strand; PAM type: NRG; PAM sequence: CAG
cttttttgggaatggatgaa

SEQ ID NO: 14779 - DNA, 20 bp, Artificial Sequence
  Description of Artificial Sequence: Synthetic oligonucleotide
  Target: SCN10A; (-) strand; PAM type: NRG; PAM sequence: TGG
agatagcacttttttgggaa

SEQ ID NO: 14780 - DNA, 20 bp, Artificial Sequence
  Description of Artificial Sequence: Synthetic oligonucleotide
  Target: SCN10A; (-) strand; PAM type: NRG; PAM sequence: GGG
ccctaagatagcactttttt

SEQ ID NO: 14781 - DNA, 20 bp, Artificial Sequence
  Description of Artificial Sequence: Synthetic oligonucleotide
  Target: SCN10A; (-) strand; PAM type: NRG; PAM sequence: TGG
gccctaagatagcacttttt

SEQ ID NO: 14782 - DNA, 20 bp, Artificial Sequence
  Description of Artificial Sequence: Synthetic oligonucleotide
  Target: SCN10A; (-) strand; PAM type: NRG; PAM sequence: TAG
gcctctgagaggccctaaga

SEQ ID NO: 14783 - DNA, 20 bp, Artificial Sequence
  Description of Artificial Sequence: Synthetic oligonucleotide
  Target: SCN10A; (-) strand; PAM type: NRG; PAM sequence: AAG
tcaagcctctgagaggccct

SEQ ID NO: 14784 - DNA, 20 bp, Artificial Sequence
  Description of Artificial Sequence: Synthetic oligonucleotide
  Target: SCN10A; (-) strand; PAM type: NRG; PAM sequence: AGG
gaaaacatcaagcctctgag

SEQ ID NO: 14785 - DNA, 20 bp, Artificial Sequence
  Description of Artificial Sequence: Synthetic oligonucleotide
  Target: SCN10A; (-) strand; PAM type: NRG; PAM sequence: GAG
agaaaacatcaagcctctga

SEQ ID NO: 14786 - DNA, 20 bp, Artificial Sequence
  Description of Artificial Sequence: Synthetic oligonucleotide
  Target: SCN10A; (-) strand; PAM type: NRG; PAM sequence: GAG
atagaaaacatcaagcctct

SEQ ID NO: 14787 - DNA, 20 bp, Artificial Sequence
  Description of Artificial Sequence: Synthetic oligonucleotide
  Target: SCN10A; (-) strand; PAM type: NRG; PAM sequence: AAG
gccagaagatagaaaacatc

SEQ ID NO: 14788 - DNA, 20 bp, Artificial Sequence
  Description of Artificial Sequence: Synthetic oligonucleotide
  Target: SCN10A; (-) strand; PAM type: NRG; PAM sequence: TAG
ctcagtcttctgccagaaga

SEQ ID NO: 14789 - DNA, 20 bp, Artificial Sequence
  Description of Artificial Sequence: Synthetic oligonucleotide
  Target: SCN10A; (-) strand; PAM type: NRG; PAM sequence: AAG
tcttctcagtcttctgccag

SEQ ID NO: 14790 - DNA, 20 bp, Artificial Sequence
  Description of Artificial Sequence: Synthetic oligonucleotide
  Target: SCN10A; (-) strand; PAM type: NRG; PAM sequence: CAG
agttcttctcagtcttctgc

SEQ ID NO: 14791 - DNA, 20 bp, Artificial Sequence
  Description of Artificial Sequence: Synthetic oligonucleotide
  Target: SCN10A; (-) strand; PAM type: NRG; PAM sequence: CAG
gatatcacctaagttcttct

SEQ ID NO: 14792 - DNA, 20 bp, Artificial Sequence
  Description of Artificial Sequence: Synthetic oligonucleotide
  Target: SCN10A; (-) strand; PAM type: NRG; PAM sequence: AAG
taccacacatgatatcacct

SEQ ID NO: 14793 - DNA, 20 bp, Artificial Sequence
  Description of Artificial Sequence: Synthetic oligonucleotide
  Target: SCN10A; (-) strand; PAM type: NRG; PAM sequence: TGG
cataaagatctcaagagaca

SEQ ID NO: 14794 - DNA, 20 bp, Artificial Sequence
  Description of Artificial Sequence: Synthetic oligonucleotide
  Target: SCN10A; (-) strand; PAM type: NRG; PAM sequence: GAG
ttttttcataaagatctcaa

SEQ ID NO: 14795 - DNA, 20 bp, Artificial Sequence
  Description of Artificial Sequence: Synthetic oligonucleotide
  Target: SCN10A; (-) strand; PAM type: NRG; PAM sequence: AAG
ccttttttcataaagatctc

SEQ ID NO: 14796 - DNA, 20 bp, Artificial Sequence
  Description of Artificial Sequence: Synthetic oligonucleotide
  Target: SCN10A; (-) strand; PAM type: NRG; PAM sequence: AAG
gtttcactccttttttcata

SEQ ID NO: 14797 - DNA, 20 bp, Artificial Sequence
  Description of Artificial Sequence: Synthetic oligonucleotide
  Target: SCN10A; (-) strand; PAM type: NRG; PAM sequence: TAG
caaaaattagggccagactc

SEQ ID NO: 14798 - DNA, 20 bp, Artificial Sequence
  Description of Artificial Sequence: Synthetic oligonucleotide
  Target: SCN10A; (-) strand; PAM type: NRG; PAM sequence: CAG
gattgggcaaaaattagggc

SEQ ID NO: 14799 - DNA, 20 bp, Artificial Sequence
  Description of Artificial Sequence: Synthetic oligonucleotide
  Target: SCN10A; (-) strand; PAM type: NRG; PAM sequence: GGG
taaagattgggcaaaaatta

SEQ ID NO: 14800 - DNA, 20 bp, Artificial Sequence
  Description of Artificial Sequence: Synthetic oligonucleotide
  Target: SCN10A; (-) strand; PAM type: NRG; PAM sequence: AGG
ttaaagattgggcaaaaatt

SEQ ID NO: 14801 - DNA, 20 bp, Artificial Sequence
  Description of Artificial Sequence: Synthetic oligonucleotide
  Target: SCN10A; (-) strand; PAM type: NRG; PAM sequence: TAG
tttaaagattgggcaaaaat

SEQ ID NO: 14802 - DNA, 20 bp, Artificial Sequence
  Description of Artificial Sequence: Synthetic oligonucleotide
  Target: SCN10A; (-) strand; PAM type: NRG; PAM sequence: GGG
cccactcgagtttaaagatt

SEQ ID NO: 14803 - DNA, 20 bp, Artificial Sequence
  Description of Artificial Sequence: Synthetic oligonucleotide
  Target: SCN10A; (-) strand; PAM type: NRG; PAM sequence: TGG
tcccactcgagtttaaagat

SEQ ID NO: 14804 - DNA, 20 bp, Artificial Sequence
  Description of Artificial Sequence: Synthetic oligonucleotide
  Target: SCN10A; (-) strand; PAM type: NRG; PAM sequence: AAG
agttatcccactcgagttta

SEQ ID NO: 14805 - DNA, 20 bp, Artificial Sequence
  Description of Artificial Sequence: Synthetic oligonucleotide
  Target: SCN10A; (-) strand; PAM type: NRG; PAM sequence: GAG
aaccaaaagttatcccactc

SEQ ID NO: 14806 - DNA, 20 bp, Artificial Sequence
  Description of Artificial Sequence: Synthetic oligonucleotide
  Target: SCN10A; (-) strand; PAM type: NRG; PAM sequence: AAG
agtggcccagtaggaaccaa

SEQ ID NO: 14807 - DNA, 20 bp, Artificial Sequence
  Description of Artificial Sequence: Synthetic oligonucleotide
  Target: SCN10A; (-) strand; PAM type: NRG; PAM sequence: AGG
tagtggtcaagtggcccagt

SEQ ID NO: 14808 - DNA, 20 bp, Artificial Sequence
  Description of Artificial Sequence: Synthetic oligonucleotide
  Target: SCN10A; (-) strand; PAM type: NRG; PAM sequence: TAG
gtagtggtcaagtggcccag

SEQ ID NO: 14809 - DNA, 20 bp, Artificial Sequence
  Description of Artificial Sequence: Synthetic oligonucleotide
  Target: SCN10A; (-) strand; PAM type: NRG; PAM sequence: CAG
atggtagtggtcaagtggcc

SEQ ID NO: 14810 - DNA, 20 bp, Artificial Sequence
  Description of Artificial Sequence: Synthetic oligonucleotide
  Target: SCN10A; (-) strand; PAM type: NRG; PAM sequence: TGG
cagtcatggtagtggtcaag

SEQ ID NO: 14811 - DNA, 20 bp, Artificial Sequence
  Description of Artificial Sequence: Synthetic oligonucleotide
  Target: SCN10A; (-) strand; PAM type: NRG; PAM sequence: AAG
atgcagtcatggtagtggtc

SEQ ID NO: 14812 - DNA, 20 bp, Artificial Sequence
  Description of Artificial Sequence: Synthetic oligonucleotide
  Target: SCN10A; (-) strand; PAM type: NRG; PAM sequence: TGG
ccaagatgcagtcatggtag

SEQ ID NO: 14813 - DNA, 20 bp, Artificial Sequence
  Description of Artificial Sequence: Synthetic oligonucleotide
  Target: SCN10A; (-) strand; PAM type: NRG; PAM sequence: TAG
gatccaagatgcagtcatgg

SEQ ID NO: 14814 - DNA, 20 bp, Artificial Sequence
  Description of Artificial Sequence: Synthetic oligonucleotide
  Target: SCN10A; (-) strand; PAM type: NRG; PAM sequence: TGG
caggatccaagatgcagtca

SEQ ID NO: 14815 - DNA, 20 bp, Artificial Sequence
  Description of Artificial Sequence: Synthetic oligonucleotide
  Target: SCN10A; (-) strand; PAM type: NRG; PAM sequence: CAG
ccctgtcaggatccaagatg

SEQ ID NO: 14816 - DNA, 20 bp, Artificial Sequence
  Description of Artificial Sequence: Synthetic oligonucleotide
  Target: SCN10A; (-) strand; PAM type: NRG; PAM sequence: AAG
caactcccctgtcaggatcc

SEQ ID NO: 14817 - DNA, 20 bp, Artificial Sequence
  Description of Artificial Sequence: Synthetic oligonucleotide
  Target: SCN10A; (-) strand; PAM type: NRG; PAM sequence: AGG
aacaacccaactcccctgtc

SEQ ID NO: 14818 - DNA, 20 bp, Artificial Sequence
  Description of Artificial Sequence: Synthetic oligonucleotide
  Target: SCN10A; (-) strand; PAM type: NRG; PAM sequence: CAG
caacaacccaactcccctgt

SEQ ID NO: 14819 - DNA, 20 bp, Artificial Sequence
  Description of Artificial Sequence: Synthetic oligonucleotide
  Target: SCN10A; (-) strand; PAM type: NRG; PAM sequence: AGG
ccacgcctacaggtatagag

SEQ ID NO: 14820 - DNA, 20 bp, Artificial Sequence
  Description of Artificial Sequence: Synthetic oligonucleotide
  Target: SCN10A; (-) strand; PAM type: NRG; PAM sequence: GAG
cccacgcctacaggtataga

SEQ ID NO: 14821 - DNA, 20 bp, Artificial Sequence
  Description of Artificial Sequence: Synthetic oligonucleotide
  Target: SCN10A; (-) strand; PAM type: NRG; PAM sequence: GAG
accccacgcctacaggtata

SEQ ID NO: 14822 - DNA, 20 bp, Artificial Sequence
  Description of Artificial Sequence: Synthetic oligonucleotide
  Target: SCN10A; (-) strand; PAM type: NRG; PAM sequence: TAG
ctaccccacgcctacaggta

SEQ ID NO: 14823 - DNA, 20 bp, Artificial Sequence
  Description of Artificial Sequence: Synthetic oligonucleotide
  Target: SCN10A; (-) strand; PAM type: NRG; PAM sequence: AGG
atattctaccccacgcctac

SEQ ID NO: 14824 - DNA, 20 bp, Artificial Sequence
  Description of Artificial Sequence: Synthetic oligonucleotide
  Target: SCN10A; (-) strand; PAM type: NRG; PAM sequence: CAG
tatattctaccccacgccta

SEQ ID NO: 14825 - DNA, 20 bp, Artificial Sequence
  Description of Artificial Sequence: Synthetic oligonucleotide
  Target: SCN10A; (-) strand; PAM type: NRG; PAM sequence: CAG
tctaggtcgcagtagatctc

SEQ ID NO: 14826 - DNA, 20 bp, Artificial Sequence
  Description of Artificial Sequence: Synthetic oligonucleotide
  Target: SCN10A; (-) strand; PAM type: NRG; PAM sequence: TAG
tatcatggtctaggtcgcag

SEQ ID NO: 14827 - DNA, 20 bp, Artificial Sequence
  Description of Artificial Sequence: Synthetic oligonucleotide
  Target: SCN10A; (-) strand; PAM type: NRG; PAM sequence: CAG
atgtatcatggtctaggtcg

SEQ ID NO: 14828 - DNA, 20 bp, Artificial Sequence
  Description of Artificial Sequence: Synthetic oligonucleotide
  Target: SCN10A; (-) strand; PAM type: NRG; PAM sequence: AGG
gtggttatgtatcatggtct

SEQ ID NO: 14829 - DNA, 20 bp, Artificial Sequence
  Description of Artificial Sequence: Synthetic oligonucleotide
  Target: SCN10A; (-) strand; PAM type: NRG; PAM sequence: TAG
tgtggttatgtatcatggtc

SEQ ID NO: 14830 - DNA, 20 bp, Artificial Sequence
  Description of Artificial Sequence: Synthetic oligonucleotide
  Target: SCN10A; (-) strand; PAM type: NRG; PAM sequence: TGG
acttgtgtggttatgtatca

SEQ ID NO: 14831 - DNA, 20 bp, Artificial Sequence
  Description of Artificial Sequence: Synthetic oligonucleotide
  Target: SCN10A; (-) strand; PAM type: NRG; PAM sequence: TGG
acccagggattaaacttgtg

SEQ ID NO: 14832 - DNA, 20 bp, Artificial Sequence
  Description of Artificial Sequence: Synthetic oligonucleotide
  Target: SCN10A; (-) strand; PAM type: NRG; PAM sequence: GGG
gtaagggtagttagaaccca

SEQ ID NO: 14833 - DNA, 20 bp, Artificial Sequence
  Description of Artificial Sequence: Synthetic oligonucleotide
  Target: SCN10A; (-) strand; PAM type: NRG; PAM sequence: AGG
agtaagggtagttagaaccc

SEQ ID NO: 14834 - DNA, 20 bp, Artificial Sequence
  Description of Artificial Sequence: Synthetic oligonucleotide
  Target: SCN10A; (-) strand; PAM type: NRG; PAM sequence: CAG
cagtaagggtagttagaacc

SEQ ID NO: 14835 - DNA, 20 bp, Artificial Sequence
  Description of Artificial Sequence: Synthetic oligonucleotide
  Target: SCN10A; (-) strand; PAM type: NRG; PAM sequence: TAG
taagtgacagtaagggtagt

SEQ ID NO: 14836 - DNA, 20 bp, Artificial Sequence
  Description of Artificial Sequence: Synthetic oligonucleotide
  Target: SCN10A; (-) strand; PAM type: NRG; PAM sequence: TAG
aagctaagtgacagtaaggg

SEQ ID NO: 14837 - DNA, 20 bp, Artificial Sequence
  Description of Artificial Sequence: Synthetic oligonucleotide
  Target: SCN10A; (-) strand; PAM type: NRG; PAM sequence: GGG
gttaagctaagtgacagtaa

SEQ ID NO: 14838 - DNA, 20 bp, Artificial Sequence
  Description of Artificial Sequence: Synthetic oligonucleotide
  Target: SCN10A; (-) strand; PAM type: NRG; PAM sequence: AGG
ggttaagctaagtgacagta

SEQ ID NO: 14839 - DNA, 20 bp, Artificial Sequence
  Description of Artificial Sequence: Synthetic oligonucleotide
  Target: SCN10A; (-) strand; PAM type: NRG; PAM sequence: AAG
aggttaagctaagtgacagt

SEQ ID NO: 14840 - DNA, 20 bp, Artificial Sequence
  Description of Artificial Sequence: Synthetic oligonucleotide
  Target: SCN10A; (-) strand; PAM type: NRG; PAM sequence: CAG
aggcaggttaagctaagtga

SEQ ID NO: 14841 - DNA, 20 bp, Artificial Sequence
  Description of Artificial Sequence: Synthetic oligonucleotide
  Target: SCN10A; (-) strand; PAM type: NRG; PAM sequence: AAG
gattggaggcaggttaagct

SEQ ID NO: 14842 - DNA, 20 bp, Artificial Sequence
  Description of Artificial Sequence: Synthetic oligonucleotide
  Target: SCN10A; (-) strand; PAM type: NRG; PAM sequence: AAG
tacaggattggaggcaggtt

SEQ ID NO: 14843 - DNA, 20 bp, Artificial Sequence
  Description of Artificial Sequence: Synthetic oligonucleotide
  Target: SCN10A; (-) strand; PAM type: NRG; PAM sequence: AGG
tcaagtacaggattggaggc

SEQ ID NO: 14844 - DNA, 20 bp, Artificial Sequence
  Description of Artificial Sequence: Synthetic oligonucleotide
  Target: SCN10A; (-) strand; PAM type: NRG; PAM sequence: CAG
ttcaagtacaggattggagg

SEQ ID NO: 14845 - DNA, 20 bp, Artificial Sequence
  Description of Artificial Sequence: Synthetic oligonucleotide
  Target: SCN10A; (-) strand; PAM type: NRG; PAM sequence: AGG
gagttcaagtacaggattgg

SEQ ID NO: 14846 - DNA, 20 bp, Artificial Sequence
  Description of Artificial Sequence: Synthetic oligonucleotide
  Target: SCN10A; (-) strand; PAM type: NRG; PAM sequence: GAG
agagttcaagtacaggattg

SEQ ID NO: 14847 - DNA, 20 bp, Artificial Sequence
  Description of Artificial Sequence: Synthetic oligonucleotide
  Target: SCN10A; (-) strand; PAM type: NRG; PAM sequence: TGG
ttagagttcaagtacaggat

SEQ ID NO: 14848 - DNA, 20 bp, Artificial Sequence
  Description of Artificial Sequence: Synthetic oligonucleotide
  Target: SCN10A; (-) strand; PAM type: NRG; PAM sequence: AGG
cagttttagagttcaagtac

SEQ ID NO: 14849 - DNA, 20 bp, Artificial Sequence
  Description of Artificial Sequence: Synthetic oligonucleotide
  Target: SCN10A; (-) strand; PAM type: NRG; PAM sequence: CAG
acagttttagagttcaagta

SEQ ID NO: 14850 - DNA, 20 bp, Artificial Sequence
  Description of Artificial Sequence: Synthetic oligonucleotide
  Target: SCN10A; (-) strand; PAM type: NRG; PAM sequence: AAG
ctccaacagttttagagttc

SEQ ID NO: 14851 - DNA, 20 bp, Artificial Sequence
  Description of Artificial Sequence: Synthetic oligonucleotide
  Target: SCN10A; (-) strand; PAM type: NRG; PAM sequence: GAG
gagtttctccaacagtttta

SEQ ID NO: 14852 - DNA, 20 bp, Artificial Sequence
  Description of Artificial Sequence: Synthetic oligonucleotide
  Target: SCN10A; (-) strand; PAM type: NRG; PAM sequence: TAG
ctgagtttctccaacagttt

SEQ ID NO: 14853 - DNA, 20 bp, Artificial Sequence
  Description of Artificial Sequence: Synthetic oligonucleotide
  Target: SCN10A; (-) strand; PAM type: NRG; PAM sequence: CAG
gaagcactgagtttctccaa

SEQ ID NO: 14854 - DNA, 20 bp, Artificial Sequence
  Description of Artificial Sequence: Synthetic oligonucleotide
  Target: SCN10A; (-) strand; PAM type: NRG; PAM sequence: GAG
aatctgttgggggaagcact

SEQ ID NO: 14855 - DNA, 20 bp, Artificial Sequence
  Description of Artificial Sequence: Synthetic oligonucleotide
  Target: SCN10A; (-) strand; PAM type: NRG; PAM sequence: AAG
tgaaatgaatctgttggggg

SEQ ID NO: 14856 - DNA, 20 bp, Artificial Sequence
  Description of Artificial Sequence: Synthetic oligonucleotide
  Target: SCN10A; (-) strand; PAM type: NRG; PAM sequence: GGG
atttgaaatgaatctgttgg

SEQ ID NO: 14857 - DNA, 20 bp, Artificial Sequence
  Description of Artificial Sequence: Synthetic oligonucleotide
  Target: SCN10A; (-) strand; PAM type: NRG; PAM sequence: GGG
tatttgaaatgaatctgttg

SEQ ID NO: 14858 - DNA, 20 bp, Artificial Sequence
  Description of Artificial Sequence: Synthetic oligonucleotide
  Target: SCN10A; (-) strand; PAM type: NRG; PAM sequence: GGG
ctatttgaaatgaatctgtt

SEQ ID NO: 14859 - DNA, 20 bp, Artificial Sequence
  Description of Artificial Sequence: Synthetic oligonucleotide
  Target: SCN10A; (-) strand; PAM type: NRG; PAM sequence: TGG
gctatttgaaatgaatctgt

SEQ ID NO: 14860 - DNA, 20 bp, Artificial Sequence
  Description of Artificial Sequence: Synthetic oligonucleotide
  Target: SCN10A; (-) strand; PAM type: NRG; PAM sequence: CAG
tggagtaaacatacctttta

SEQ ID NO: 14861 - DNA, 20 bp, Artificial Sequence
  Description of Artificial Sequence: Synthetic oligonucleotide
  Target: SCN10A; (-) strand; PAM type: NRG; PAM sequence: GAG
gaagcaactctggtcttctg

SEQ ID NO: 14862 - DNA, 20 bp, Artificial Sequence
  Description of Artificial Sequence: Synthetic oligonucleotide
  Target: SCN10A; (-) strand; PAM type: NRG; PAM sequence: TGG
aagaagcaactctggtcttc

SEQ ID NO: 14863 - DNA, 20 bp, Artificial Sequence
  Description of Artificial Sequence: Synthetic oligonucleotide
  Target: SCN10A; (-) strand; PAM type: NRG; PAM sequence: TGG
aagttcaaaagaagcaactc

SEQ ID NO: 14864 - DNA, 20 bp, Artificial Sequence
  Description of Artificial Sequence: Synthetic oligonucleotide
  Target: SCN10A; (-) strand; PAM type: NRG; PAM sequence: AAG
aggaatgagaagttcaaaag

SEQ ID NO: 14865 - DNA, 20 bp, Artificial Sequence
  Description of Artificial Sequence: Synthetic oligonucleotide
  Target: SCN10A; (-) strand; PAM type: NRG; PAM sequence: AAG
ccaaggaatgagaagttcaa

SEQ ID NO: 14866 - DNA, 20 bp, Artificial Sequence
  Description of Artificial Sequence: Synthetic oligonucleotide
  Target: SCN10A; (-) strand; PAM type: NRG; PAM sequence: AAG
tcctaggcccaaggaatgag

SEQ ID NO: 14867 - DNA, 20 bp, Artificial Sequence
  Description of Artificial Sequence: Synthetic oligonucleotide
  Target: SCN10A; (-) strand; PAM type: NRG; PAM sequence: GAG
ggttcctaggcccaaggaat

SEQ ID NO: 14868 - DNA, 20 bp, Artificial Sequence
  Description of Artificial Sequence: Synthetic oligonucleotide
  Target: SCN10A; (-) strand; PAM type: NRG; PAM sequence: AGG
gatgagggttcctaggccca

SEQ ID NO: 14869 - DNA, 20 bp, Artificial Sequence
  Description of Artificial Sequence: Synthetic oligonucleotide
  Target: SCN10A; (-) strand; PAM type: NRG; PAM sequence: AAG
tgatgagggttcctaggccc

SEQ ID NO: 14870 - DNA, 20 bp, Artificial Sequence
  Description of Artificial Sequence: Synthetic oligonucleotide
  Target: SCN10A; (-) strand; PAM type: NRG; PAM sequence: AGG
tgagggtgatgagggttcct

SEQ ID NO: 14871 - DNA, 20 bp, Artificial Sequence
  Description of Artificial Sequence: Synthetic oligonucleotide
  Target: SCN10A; (-) strand; PAM type: NRG; PAM sequence: TAG
atgagggtgatgagggttcc

SEQ ID NO: 14872 - DNA, 20 bp, Artificial Sequence
  Description of Artificial Sequence: Synthetic oligonucleotide
  Target: SCN10A; (-) strand; PAM type: NRG; PAM sequence: GGG
cgttgggatgagggtgatga

SEQ ID NO: 14873 - DNA, 20 bp, Artificial Sequence
  Description of Artificial Sequence: Synthetic oligonucleotide
  Target: SCN10A; (-) strand; PAM type: NRG; PAM sequence: AGG
acgttgggatgagggtgatg

SEQ ID NO: 14874 - DNA, 20 bp, Artificial Sequence
  Description of Artificial Sequence: Synthetic oligonucleotide
  Target: SCN10A; (-) strand; PAM type: NRG; PAM sequence: GAG
gacgttgggatgagggtgat

SEQ ID NO: 14875 - DNA, 20 bp, Artificial Sequence
  Description of Artificial Sequence: Synthetic oligonucleotide
  Target: SCN10A; (-) strand; PAM type: NRG; PAM sequence: GGG
ctgggttgacgttgggatga

SEQ ID NO: 14876 - DNA, 20 bp, Artificial Sequence
  Description of Artificial Sequence: Synthetic oligonucleotide
  Target: SCN10A; (-) strand; PAM type: NRG; PAM sequence: AGG
tctgggttgacgttgggatg

SEQ ID NO: 14877 - DNA, 20 bp, Artificial Sequence
  Description of Artificial Sequence: Synthetic oligonucleotide
  Target: SCN10A; (-) strand; PAM type: NRG; PAM sequence: GAG
atctgggttgacgttgggat

SEQ ID NO: 14878 - DNA, 20 bp, Artificial Sequence
  Description of Artificial Sequence: Synthetic oligonucleotide
  Target: SCN10A; (-) strand; PAM type: NRG; PAM sequence: GGG
agaagatctgggttgacgtt

SEQ ID NO: 14879 - DNA, 20 bp, Artificial Sequence
  Description of Artificial Sequence: Synthetic oligonucleotide
  Target: SCN10A; (-) strand; PAM type: NRG; PAM sequence: TGG
gagaagatctgggttgacgt

SEQ ID NO: 14880 - DNA, 20 bp, Artificial Sequence
  Description of Artificial Sequence: Synthetic oligonucleotide
  Target: SCN10A; (-) strand; PAM type: NRG; PAM sequence: GGG
gtttatggaagagaagatct

SEQ ID NO: 14881 - DNA, 20 bp, Artificial Sequence
  Description of Artificial Sequence: Synthetic oligonucleotide
  Target: SCN10A; (-) strand; PAM type: NRG; PAM sequence: TGG
tgtttatggaagagaagatc

SEQ ID NO: 14882 - DNA, 20 bp, Artificial Sequence
  Description of Artificial Sequence: Synthetic oligonucleotide
  Target: SCN10A; (-) strand; PAM type: NRG; PAM sequence: AAG
gagtgctgtttatggaagag

SEQ ID NO: 14883 - DNA, 20 bp, Artificial Sequence
  Description of Artificial Sequence: Synthetic oligonucleotide
  Target: SCN10A; (-) strand; PAM type: NRG; PAM sequence: GAG
agggagtgctgtttatggaa

SEQ ID NO: 14884 - DNA, 20 bp, Artificial Sequence
  Description of Artificial Sequence: Synthetic oligonucleotide
  Target: SCN10A; (-) strand; PAM type: NRG; PAM sequence: AAG
tgagggagtgctgtttatgg

SEQ ID NO: 14885 - DNA, 20 bp, Artificial Sequence
  Description of Artificial Sequence: Synthetic oligonucleotide
  Target: SCN10A; (-) strand; PAM type: NRG; PAM sequence: TGG
gcctgagggagtgctgttta

SEQ ID NO: 14886 - DNA, 20 bp, Artificial Sequence
  Description of Artificial Sequence: Synthetic oligonucleotide
  Target: SCN10A; (-) strand; PAM type: NRG; PAM sequence: GAG
tgtcaggcaggggcctgagg

SEQ ID NO: 14887 - DNA, 20 bp, Artificial Sequence
  Description of Artificial Sequence: Synthetic oligonucleotide
  Target: SCN10A; (-) strand; PAM type: NRG; PAM sequence: GGG
tgtgtcaggcaggggcctga

SEQ ID NO: 14888 - DNA, 20 bp, Artificial Sequence
  Description of Artificial Sequence: Synthetic oligonucleotide
  Target: SCN10A; (-) strand; PAM type: NRG; PAM sequence: AGG
ctgtgtcaggcaggggcctg

SEQ ID NO: 14889 - DNA, 20 bp, Artificial Sequence
  Description of Artificial Sequence: Synthetic oligonucleotide
  Target: SCN10A; (-) strand; PAM type: NRG; PAM sequence: GAG
cctgtgtcaggcaggggcct

SEQ ID NO: 14890 - DNA, 20 bp, Artificial Sequence
  Description of Artificial Sequence: Synthetic oligonucleotide
  Target: SCN10A; (-) strand; PAM type: NRG; PAM sequence: GGG
tctatgcctgtgtcaggcag

SEQ ID NO: 14891 - DNA, 20 bp, Artificial Sequence
  Description of Artificial Sequence: Synthetic oligonucleotide
  Target: SCN10A; (-) strand; PAM type: NRG; PAM sequence: GGG
gtctatgcctgtgtcaggca

SEQ ID NO: 14892 - DNA, 20 bp, Artificial Sequence
  Description of Artificial Sequence: Synthetic oligonucleotide
  Target: SCN10A; (-) strand; PAM type: NRG; PAM sequence: AGG
agtctatgcctgtgtcaggc

SEQ ID NO: 14893 - DNA, 20 bp, Artificial Sequence
  Description of Artificial Sequence: Synthetic oligonucleotide
  Target: SCN10A; (-) strand; PAM type: NRG; PAM sequence: CAG
cagtctatgcctgtgtcagg

SEQ ID NO: 14894 - DNA, 20 bp, Artificial Sequence
  Description of Artificial Sequence: Synthetic oligonucleotide
  Target: SCN10A; (-) strand; PAM type: NRG; PAM sequence: AGG
tgacagtctatgcctgtgtc

SEQ ID NO: 14895 - DNA, 20 bp, Artificial Sequence
  Description of Artificial Sequence: Synthetic oligonucleotide
  Target: SCN10A; (-) strand; PAM type: NRG; PAM sequence: CAG
atgacagtctatgcctgtgt

SEQ ID NO: 14896 - DNA, 20 bp, Artificial Sequence
  Description of Artificial Sequence: Synthetic oligonucleotide
  Target: SCN10A; (-) strand; PAM type: NRG; PAM sequence: CAG
tgtctgtgaatccaacatga

SEQ ID NO: 14897 - DNA, 20 bp, Artificial Sequence
  Description of Artificial Sequence: Synthetic oligonucleotide
  Target: SCN10A; (-) strand; PAM type: NRG; PAM sequence: CAG
cccagaggtttcctctagca

SEQ ID NO: 14898 - DNA, 20 bp, Artificial Sequence
  Description of Artificial Sequence: Synthetic oligonucleotide
  Target: SCN10A; (-) strand; PAM type: NRG; PAM sequence: TAG
tgagccccagaggtttcctc

SEQ ID NO: 14899 - DNA, 20 bp, Artificial Sequence
  Description of Artificial Sequence: Synthetic oligonucleotide
  Target: SCN10A; (-) strand; PAM type: NRG; PAM sequence: AGG
cggcccctggtgagccccag

SEQ ID NO: 14900 - DNA, 20 bp, Artificial Sequence
  Description of Artificial Sequence: Synthetic oligonucleotide
  Target: SCN10A; (-) strand; PAM type: NRG; PAM sequence: GAG
acggcccctggtgagcccca

SEQ ID NO: 14901 - DNA, 20 bp, Artificial Sequence
  Description of Artificial Sequence: Synthetic oligonucleotide
  Target: SCN10A; (-) strand; PAM type: NRG; PAM sequence: CAG
ccacggcccctggtgagccc

SEQ ID NO: 14902 - DNA, 20 bp, Artificial Sequence
  Description of Artificial Sequence: Synthetic oligonucleotide
  Target: SCN10A; (-) strand; PAM type: NRG; PAM sequence: GAG
cccatcccacggcccctggt

SEQ ID NO: 14903 - DNA, 20 bp, Artificial Sequence
  Description of Artificial Sequence: Synthetic oligonucleotide
  Target: SCN10A; (-) strand; PAM type: NRG; PAM sequence: TGG
gaagcccatcccacggcccc

SEQ ID NO: 14904 - DNA, 20 bp, Artificial Sequence
  Description of Artificial Sequence: Synthetic oligonucleotide
  Target: SCN10A; (-) strand; PAM type: NRG; PAM sequence: CGG
agccccagaagcccatccca

SEQ ID NO: 14905 - DNA, 20 bp, Artificial Sequence
  Description of Artificial Sequence: Synthetic oligonucleotide
  Target: SCN10A; (-) strand; PAM type: NRG; PAM sequence: AAG
tgggctccaagaagccccag

SEQ ID NO: 14906 - DNA, 20 bp, Artificial Sequence
  Description of Artificial Sequence: Synthetic oligonucleotide
  Target: SCN10A; (-) strand; PAM type: NRG; PAM sequence: CAG
agttgggctccaagaagccc

SEQ ID NO: 14907 - DNA, 20 bp, Artificial Sequence
  Description of Artificial Sequence: Synthetic oligonucleotide
  Target: SCN10A; (-) strand; PAM type: NRG; PAM sequence: AAG
tgaagaagttgggctccaag

SEQ ID NO: 14908 - DNA, 20 bp, Artificial Sequence
  Description of Artificial Sequence: Synthetic oligonucleotide
  Target: SCN10A; (-) strand; PAM type: NRG; PAM sequence: AAG
ccatgaagaagttgggctcc

SEQ ID NO: 14909 - DNA, 20 bp, Artificial Sequence
  Description of Artificial Sequence: Synthetic oligonucleotide
  Target: SCN10A; (-) strand; PAM type: NRG; PAM sequence: GGG
tacaatgccatgaagaagtt

SEQ ID NO: 14910 - DNA, 20 bp, Artificial Sequence
  Description of Artificial Sequence: Synthetic oligonucleotide
  Target: SCN10A; (-) strand; PAM type: NRG; PAM sequence: TGG
ctacaatgccatgaagaagt

SEQ ID NO: 14911 - DNA, 20 bp, Artificial Sequence
  Description of Artificial Sequence: Synthetic oligonucleotide
  Target: SCN10A; (-) strand; PAM type: NRG; PAM sequence: AAG
aatactacaatgccatgaag

SEQ ID NO: 14912 - DNA, 20 bp, Artificial Sequence
  Description of Artificial Sequence: Synthetic oligonucleotide
  Target: SCN10A; (-) strand; PAM type: NRG; PAM sequence: AAG
agaaatactacaatgccatg

SEQ ID NO: 14913 - DNA, 20 bp, Artificial Sequence
  Description of Artificial Sequence: Synthetic oligonucleotide
  Target: SCN10A; (-) strand; PAM type: NRG; PAM sequence: AAG
tcttcatgacagaggagcag

SEQ ID NO: 14914 - DNA, 20 bp, Artificial Sequence
  Description of Artificial Sequence: Synthetic oligonucleotide
  Target: SCN10A; (-) strand; PAM type: NRG; PAM sequence: CAG
acatcttcatgacagaggag

SEQ ID NO: 14915 - DNA, 20 bp, Artificial Sequence
  Description of Artificial Sequence: Synthetic oligonucleotide
  Target: SCN10A; (-) strand; PAM type: NRG; PAM sequence: GAG
aggacatcttcatgacagag

SEQ ID NO: 14916 - DNA, 20 bp, Artificial Sequence
  Description of Artificial Sequence: Synthetic oligonucleotide
  Target: SCN10A; (-) strand; PAM type: NRG; PAM sequence: AGG
ccaggacatcttcatgacag

SEQ ID NO: 14917 - DNA, 20 bp, Artificial Sequence
  Description of Artificial Sequence: Synthetic oligonucleotide
  Target: SCN10A; (-) strand; PAM type: NRG; PAM sequence: GAG
gccaggacatcttcatgaca

SEQ ID NO: 14918 - DNA, 20 bp, Artificial Sequence
  Description of Artificial Sequence: Synthetic oligonucleotide
  Target: SCN10A; (-) strand; PAM type: NRG; PAM sequence: CAG
gggccaggacatcttcatga

SEQ ID NO: 14919 - DNA, 20 bp, Artificial Sequence
  Description of Artificial Sequence: Synthetic oligonucleotide
  Target: SCN10A; (-) strand; PAM type: NRG; PAM sequence: AGG
ctctctgcacttagggggcc

SEQ ID NO: 14920 - DNA, 20 bp, Artificial Sequence
  Description of Artificial Sequence: Synthetic oligonucleotide
  Target: SCN10A; (-) strand; PAM type: NRG; PAM sequence: CAG
cctctctgcacttagggggc

SEQ ID NO: 14921 - DNA, 20 bp, Artificial Sequence
  Description of Artificial Sequence: Synthetic oligonucleotide
  Target: SCN10A; (-) strand; PAM type: NRG; PAM sequence: GGG
tggccctctctgcacttagg

SEQ ID NO: 14922 - DNA, 20 bp, Artificial Sequence
  Description of Artificial Sequence: Synthetic oligonucleotide
  Target: SCN10A; (-) strand; PAM type: NRG; PAM sequence: GGG
gtggccctctctgcacttag

SEQ ID NO: 14923 - DNA, 20 bp, Artificial Sequence
  Description of Artificial Sequence: Synthetic oligonucleotide
  Target: SCN10A; (-) strand; PAM type: NRG; PAM sequence: GGG
tgtggccctctctgcactta

SEQ ID NO: 14924 - DNA, 20 bp, Artificial Sequence
  Description of Artificial Sequence: Synthetic oligonucleotide
  Target: SCN10A; (-) strand; PAM type: NRG; PAM sequence: AGG
gtgtggccctctctgcactt

SEQ ID NO: 14925 - DNA, 20 bp, Artificial Sequence
  Description of Artificial Sequence: Synthetic oligonucleotide
  Target: SCN10A; (-) strand; PAM type: NRG; PAM sequence: TAG
agtgtggccctctctgcact

SEQ ID NO: 14926 - DNA, 20 bp, Artificial Sequence
  Description of Artificial Sequence: Synthetic oligonucleotide
  Target: SCN10A; (-) strand; PAM type: NRG; PAM sequence: TGG
ctcttgctttagtaacagtg

SEQ ID NO: 14927 - DNA, 20 bp, Artificial Sequence
  Description of Artificial Sequence: Synthetic oligonucleotide
  Target: SCN10A; (-) strand; PAM type: NRG; PAM sequence: CAG
ggttcctcttgctttagtaa

SEQ ID NO: 14928 - DNA, 20 bp, Artificial Sequence
  Description of Artificial Sequence: Synthetic oligonucleotide
  Target: SCN10A; (-) strand; PAM type: NRG; PAM sequence: TAG
gtagggggttcctcttgctt

SEQ ID NO: 14929 - DNA, 20 bp, Artificial Sequence
  Description of Artificial Sequence: Synthetic oligonucleotide
  Target: SCN10A; (-) strand; PAM type: NRG; PAM sequence: GGG
ctgattttggtatccgtagg

SEQ ID NO: 14930 - DNA, 20 bp, Artificial Sequence
  Description of Artificial Sequence: Synthetic oligonucleotide
  Target: SCN10A; (-) strand; PAM type: NRG; PAM sequence: GGG
tctgattttggtatccgtag

SEQ ID NO: 14931 - DNA, 20 bp, Artificial Sequence
  Description of Artificial Sequence: Synthetic oligonucleotide
  Target: SCN10A; (-) strand; PAM type: NRG; PAM sequence: GGG
ttctgattttggtatccgta

SEQ ID NO: 14932 - DNA, 20 bp, Artificial Sequence
  Description of Artificial Sequence: Synthetic oligonucleotide
  Target: SCN10A; (-) strand; PAM type: NRG; PAM sequence: AGG
gttctgattttggtatccgt

SEQ ID NO: 14933 - DNA, 20 bp, Artificial Sequence
  Description of Artificial Sequence: Synthetic oligonucleotide
  Target: SCN10A; (-) strand; PAM type: NRG; PAM sequence: TAG
tgttctgattttggtatccg

SEQ ID NO: 14934 - DNA, 20 bp, Artificial Sequence
  Description of Artificial Sequence: Synthetic oligonucleotide
  Target: SCN10A; (-) strand; PAM type: NRG; PAM sequence: TGG
tctcctgcctgttctgattt

SEQ ID NO: 14935 - DNA, 20 bp, Artificial Sequence
  Description of Artificial Sequence: Synthetic oligonucleotide
  Target: SCN10A; (-) strand; PAM type: NRG; PAM sequence: AGG
tatctgcagaggaggggaga

SEQ ID NO: 14936 - DNA, 20 bp, Artificial Sequence
  Description of Artificial Sequence: Synthetic oligonucleotide
  Target: SCN10A; (-) strand; PAM type: NRG; PAM sequence: AAG
ctatctgcagaggaggggag

SEQ ID NO: 14937 - DNA, 20 bp, Artificial Sequence
  Description of Artificial Sequence: Synthetic oligonucleotide
  Target: SCN10A; (-) strand; PAM type: NRG; PAM sequence: GAG
tgtctatctgcagaggaggg

SEQ ID NO: 14938 - DNA, 20 bp, Artificial Sequence
  Description of Artificial Sequence: Synthetic oligonucleotide
  Target: SCN10A; (-) strand; PAM type: NRG; PAM sequence: GGG
tttgtctatctgcagaggag

SEQ ID NO: 14939 - DNA, 20 bp, Artificial Sequence
  Description of Artificial Sequence: Synthetic oligonucleotide
  Target: SCN10A; (-) strand; PAM type: NRG; PAM sequence: GGG
gtttgtctatctgcagagga

SEQ ID NO: 14940 - DNA, 20 bp, Artificial Sequence
  Description of Artificial Sequence: Synthetic oligonucleotide
  Target: SCN10A; (-) strand; PAM type: NRG; PAM sequence: AGG
ggtttgtctatctgcagagg

SEQ ID NO: 14941 - DNA, 20 bp, Artificial Sequence
  Description of Artificial Sequence: Synthetic oligonucleotide
  Target: SCN10A; (-) strand; PAM type: NRG; PAM sequence: GAG
tggtttgtctatctgcagag

SEQ ID NO: 14942 - DNA, 20 bp, Artificial Sequence
  Description of Artificial Sequence: Synthetic oligonucleotide
  Target: SCN10A; (-) strand; PAM type: NRG; PAM sequence: AGG
cttggtttgtctatctgcag

SEQ ID NO: 14943 - DNA, 20 bp, Artificial Sequence
  Description of Artificial Sequence: Synthetic oligonucleotide
  Target: SCN10A; (-) strand; PAM type: NRG; PAM sequence: GAG
gcttggtttgtctatctgca

SEQ ID NO: 14944 - DNA, 20 bp, Artificial Sequence
  Description of Artificial Sequence: Synthetic oligonucleotide
  Target: SCN10A; (-) strand; PAM type: NRG; PAM sequence: CAG
gggcttggtttgtctatctg

SEQ ID NO: 14945 - DNA, 20 bp, Artificial Sequence
  Description of Artificial Sequence: Synthetic oligonucleotide
  Target: SCN10A; (-) strand; PAM type: NRG; PAM sequence: TGG
acactccttgatgctgggct

SEQ ID NO: 14946 - DNA, 20 bp, Artificial Sequence
  Description of Artificial Sequence: Synthetic oligonucleotide
  Target: SCN10A; (-) strand; PAM type: NRG; PAM sequence: GGG
gcaagacactccttgatgct

SEQ ID NO: 14947 - DNA, 20 bp, Artificial Sequence
  Description of Artificial Sequence: Synthetic oligonucleotide
  Target: SCN10A; (-) strand; PAM type: NRG; PAM sequence: TGG
ggcaagacactccttgatgc

SEQ ID NO: 14948 - DNA, 20 bp, Artificial Sequence
  Description of Artificial Sequence: Synthetic oligonucleotide
  Target: SCN10A; (-) strand; PAM type: NRG; PAM sequence: AAG
gttccgacactggatgtggc

SEQ ID NO: 14949 - DNA, 20 bp, Artificial Sequence
  Description of Artificial Sequence: Synthetic oligonucleotide
  Target: SCN10A; (-) strand; PAM type: NRG; PAM sequence: TGG
caccgttccgacactggatg

SEQ ID NO: 14950 - DNA, 20 bp, Artificial Sequence
  Description of Artificial Sequence: Synthetic oligonucleotide
  Target: SCN10A; (-) strand; PAM type: NRG; PAM sequence: TGG
cagtcccaccgttccgacac

SEQ ID NO: 14951 - DNA, 20 bp, Artificial Sequence
  Description of Artificial Sequence: Synthetic oligonucleotide
  Target: SCN10A; (-) strand; PAM type: NRG; PAM sequence: CAG
agggagtcagcaatggaact

SEQ ID NO: 14952 - DNA, 20 bp, Artificial Sequence
  Description of Artificial Sequence: Synthetic oligonucleotide
  Target: SCN10A; (-) strand; PAM type: NRG; PAM sequence: TGG
cccaggcagggagtcagcaa

SEQ ID NO: 14953 - DNA, 20 bp, Artificial Sequence
  Description of Artificial Sequence: Synthetic oligonucleotide
  Target: SCN10A; (-) strand; PAM type: NRG; PAM sequence: CAG
tagagacccaggcagggagt

SEQ ID NO: 14954 - DNA, 20 bp, Artificial Sequence
  Description of Artificial Sequence: Synthetic oligonucleotide
  Target: SCN10A; (-) strand; PAM type: NRG; PAM sequence: GAG
gctttagagacccaggcagg

SEQ ID NO: 14955 - DNA, 20 bp, Artificial Sequence
  Description of Artificial Sequence: Synthetic oligonucleotide
  Target: SCN10A; (-) strand; PAM type: NRG; PAM sequence: GGG
ttgctttagagacccaggca

SEQ ID NO: 14956 - DNA, 20 bp, Artificial Sequence
  Description of Artificial Sequence: Synthetic oligonucleotide
  Target: SCN10A; (-) strand; PAM type: NRG; PAM sequence: AGG
tttgctttagagacccaggc

SEQ ID NO: 14957 - DNA, 20 bp, Artificial Sequence
  Description of Artificial Sequence: Synthetic oligonucleotide
  Target: SCN10A; (-) strand; PAM type: NRG; PAM sequence: CAG
ctttgctttagagacccagg

SEQ ID NO: 14958 - DNA, 20 bp, Artificial Sequence
  Description of Artificial Sequence: Synthetic oligonucleotide
  Target: SCN10A; (-) strand; PAM type: NRG; PAM sequence: AGG
tggctttgctttagagaccc

SEQ ID NO: 14959 - DNA, 20 bp, Artificial Sequence
  Description of Artificial Sequence: Synthetic oligonucleotide
  Target: SCN10A; (-) strand; PAM type: NRG; PAM sequence: CAG
ctggctttgctttagagacc

SEQ ID NO: 14960 - DNA, 20 bp, Artificial Sequence
  Description of Artificial Sequence: Synthetic oligonucleotide
  Target: SCN10A; (-) strand; PAM type: NRG; PAM sequence: GAG
cagaaactggctttgcttta

SEQ ID NO: 14961 - DNA, 20 bp, Artificial Sequence
  Description of Artificial Sequence: Synthetic oligonucleotide
  Target: SCN10A; (-) strand; PAM type: NRG; PAM sequence: TAG
aacagaaactggctttgctt

SEQ ID NO: 14962 - DNA, 20 bp, Artificial Sequence
  Description of Artificial Sequence: Synthetic oligonucleotide
  Target: SCN10A; (-) strand; PAM type: NRG; PAM sequence: TGG
gatccctggagaacagaaac

SEQ ID NO: 14963 - DNA, 20 bp, Artificial Sequence
  Description of Artificial Sequence: Synthetic oligonucleotide
  Target: SCN10A; (-) strand; PAM type: NRG; PAM sequence: CAG
atctctggatccctggagaa

SEQ ID NO: 14964 - DNA, 20 bp, Artificial Sequence
  Description of Artificial Sequence: Synthetic oligonucleotide
  Target: SCN10A; (-) strand; PAM type: NRG; PAM sequence: GAG
ccagcatctctggatccctg

SEQ ID NO: 14965 - DNA, 20 bp, Artificial Sequence
  Description of Artificial Sequence: Synthetic oligonucleotide
  Target: SCN10A; (-) strand; PAM type: NRG; PAM sequence: TGG
atccagcatctctggatccc

SEQ ID NO: 14966 - DNA, 20 bp, Artificial Sequence
  Description of Artificial Sequence: Synthetic oligonucleotide
  Target: SCN10A; (-) strand; PAM type: NRG; PAM sequence: TGG
caccctttatccagcatctc

SEQ ID NO: 14967 - DNA, 20 bp, Artificial Sequence
  Description of Artificial Sequence: Synthetic oligonucleotide
  Target: SCN10A; (-) strand; PAM type: NRG; PAM sequence: CAG
aaccctccccaccctttatc

SEQ ID NO: 14968 - DNA, 20 bp, Artificial Sequence
  Description of Artificial Sequence: Synthetic oligonucleotide
  Target: SCN10A; (-) strand; PAM type: NRG; PAM sequence: GAG
ccaacatgtaccttctcctt

SEQ ID NO: 14969 - DNA, 20 bp, Artificial Sequence
  Description of Artificial Sequence: Synthetic oligonucleotide
  Target: SCN10A; (-) strand; PAM type: NRG; PAM sequence: CAG
aacaggctagatccaaggct

SEQ ID NO: 14970 - DNA, 20 bp, Artificial Sequence
  Description of Artificial Sequence: Synthetic oligonucleotide
  Target: SCN10A; (-) strand; PAM type: NRG; PAM sequence: AGG
gaatgaacaggctagatcca

SEQ ID NO: 14971 - DNA, 20 bp, Artificial Sequence
  Description of Artificial Sequence: Synthetic oligonucleotide
  Target: SCN10A; (-) strand; PAM type: NRG; PAM sequence: AAG
ggaatgaacaggctagatcc

SEQ ID NO: 14972 - DNA, 20 bp, Artificial Sequence
  Description of Artificial Sequence: Synthetic oligonucleotide
  Target: SCN10A; (-) strand; PAM type: NRG; PAM sequence: TAG
ttttactggaatgaacaggc

SEQ ID NO: 14973 - DNA, 20 bp, Artificial Sequence
  Description of Artificial Sequence: Synthetic oligonucleotide
  Target: SCN10A; (-) strand; PAM type: NRG; PAM sequence: AGG
agaattttactggaatgaac

SEQ ID NO: 14974 - DNA, 20 bp, Artificial Sequence
  Description of Artificial Sequence: Synthetic oligonucleotide
  Target: SCN10A; (-) strand; PAM type: NRG; PAM sequence: CAG
aagaattttactggaatgaa

SEQ ID NO: 14975 - DNA, 20 bp, Artificial Sequence
  Description of Artificial Sequence: Synthetic oligonucleotide
  Target: SCN10A; (-) strand; PAM type: NRG; PAM sequence: TGG
agaagcccaaagaattttac

SEQ ID NO: 14976 - DNA, 20 bp, Artificial Sequence
  Description of Artificial Sequence: Synthetic oligonucleotide
  Target: SCN10A; (-) strand; PAM type: NRG; PAM sequence: AAG
actgtgactctagaagccca

SEQ ID NO: 14977 - DNA, 20 bp, Artificial Sequence
  Description of Artificial Sequence: Synthetic oligonucleotide
  Target: SCN10A; (-) strand; PAM type: NRG; PAM sequence: AAG
gggagggactgtgactctag

SEQ ID NO: 14978 - DNA, 20 bp, Artificial Sequence
  Description of Artificial Sequence: Synthetic oligonucleotide
  Target: SCN10A; (-) strand; PAM type: NRG; PAM sequence: TAG
cctgggagggactgtgactc

SEQ ID NO: 14979 - DNA, 20 bp, Artificial Sequence
  Description of Artificial Sequence: Synthetic oligonucleotide
  Target: SCN10A; (-) strand; PAM type: NRG; PAM sequence: GGG
aaatctcttgccccctggga

SEQ ID NO: 14980 - DNA, 20 bp, Artificial Sequence
  Description of Artificial Sequence: Synthetic oligonucleotide
  Target: SCN10A; (-) strand; PAM type: NRG; PAM sequence: AGG
gaaatctcttgccccctggg

SEQ ID NO: 14981 - DNA, 20 bp, Artificial Sequence
  Description of Artificial Sequence: Synthetic oligonucleotide
  Target: SCN10A; (-) strand; PAM type: NRG; PAM sequence: GAG
ggaaatctcttgccccctgg

SEQ ID NO: 14982 - DNA, 20 bp, Artificial Sequence
  Description of Artificial Sequence: Synthetic oligonucleotide
  Target: SCN10A; (-) strand; PAM type: NRG; PAM sequence: GGG
caggaaatctcttgccccct

SEQ ID NO: 14983 - DNA, 20 bp, Artificial Sequence
  Description of Artificial Sequence: Synthetic oligonucleotide
  Target: SCN10A; (-) strand; PAM type: NRG; PAM sequence: TGG
tcaggaaatctcttgccccc

SEQ ID NO: 14984 - DNA, 20 bp, Artificial Sequence
  Description of Artificial Sequence: Synthetic oligonucleotide
  Target: SCN10A; (-) strand; PAM type: NRG; PAM sequence: AGG
gtctttgcttcaaggtcctc

SEQ ID NO: 14985 - DNA, 20 bp, Artificial Sequence
  Description of Artificial Sequence: Synthetic oligonucleotide
  Target: SCN10A; (-) strand; PAM type: NRG; PAM sequence: CAG
agtctttgcttcaaggtcct

SEQ ID NO: 14986 - DNA, 20 bp, Artificial Sequence
  Description of Artificial Sequence: Synthetic oligonucleotide
  Target: SCN10A; (-) strand; PAM type: NRG; PAM sequence: AGG
ctcccagagtctttgcttca

SEQ ID NO: 14987 - DNA, 20 bp, Artificial Sequence
  Description of Artificial Sequence: Synthetic oligonucleotide
  Target: SCN10A; (-) strand; PAM type: NRG; PAM sequence: AAG
cctcccagagtctttgcttc

SEQ ID NO: 14988 - DNA, 20 bp, Artificial Sequence
  Description of Artificial Sequence: Synthetic oligonucleotide
  Target: SCN10A; (-) strand; PAM type: NRG; PAM sequence: GAG
gagggcttctgtccctccca

SEQ ID NO: 14989 - DNA, 20 bp, Artificial Sequence
  Description of Artificial Sequence: Synthetic oligonucleotide
  Target: SCN10A; (-) strand; PAM type: NRG; PAM sequence: CAG
ttgagggcttctgtccctcc

SEQ ID NO: 14990 - DNA, 20 bp, Artificial Sequence
  Description of Artificial Sequence: Synthetic oligonucleotide
  Target: SCN10A; (-) strand; PAM type: NRG; PAM sequence: GGG
cctctccagaaaagatttga

SEQ ID NO: 14991 - DNA, 20 bp, Artificial Sequence
  Description of Artificial Sequence: Synthetic oligonucleotide
  Target: SCN10A; (-) strand; PAM type: NRG; PAM sequence: AGG
tcctctccagaaaagatttg

SEQ ID NO: 14992 - DNA, 20 bp, Artificial Sequence
  Description of Artificial Sequence: Synthetic oligonucleotide
  Target: SCN10A; (-) strand; PAM type: NRG; PAM sequence: GAG
ctcctctccagaaaagattt

SEQ ID NO: 14993 - DNA, 20 bp, Artificial Sequence
  Description of Artificial Sequence: Synthetic oligonucleotide
  Target: SCN10A; (-) strand; PAM type: NRG; PAM sequence: AAG
tcatctcctcctctccagaa

SEQ ID NO: 14994 - DNA, 20 bp, Artificial Sequence
  Description of Artificial Sequence: Synthetic oligonucleotide
  Target: SCN10A; (-) strand; PAM type: NRG; PAM sequence: CAG
tgtcctcatctcctcctctc

SEQ ID NO: 14995 - DNA, 20 bp, Artificial Sequence
  Description of Artificial Sequence: Synthetic oligonucleotide
  Target: SCN10A; (-) strand; PAM type: NRG; PAM sequence: CAG
ccaaggacccaaggataagg

SEQ ID NO: 14996 - DNA, 20 bp, Artificial Sequence
  Description of Artificial Sequence: Synthetic oligonucleotide
  Target: SCN10A; (-) strand; PAM type: NRG; PAM sequence: AGG
agaccaaggacccaaggata

SEQ ID NO: 14997 - DNA, 20 bp, Artificial Sequence
  Description of Artificial Sequence: Synthetic oligonucleotide
  Target: SCN10A; (-) strand; PAM type: NRG; PAM sequence: AAG
gagaccaaggacccaaggat

SEQ ID NO: 14998 - DNA, 20 bp, Artificial Sequence
  Description of Artificial Sequence: Synthetic oligonucleotide
  Target: SCN10A; (-) strand; PAM type: NRG; PAM sequence: AGG
cctctgagaccaaggaccca

SEQ ID NO: 14999 - DNA, 20 bp, Artificial Sequence
  Description of Artificial Sequence: Synthetic oligonucleotide
  Target: SCN10A; (-) strand; PAM type: NRG; PAM sequence: AAG
ccctctgagaccaaggaccc

SEQ ID NO: 15000 - DNA, 20 bp, Artificial Sequence
  Description of Artificial Sequence: Synthetic oligonucleotide
  Target: SCN10A; (-) strand; PAM type: NRG; PAM sequence: AGG
cagaggtccctctgagacca

SEQ ID NO: 15001 - DNA, 20 bp, Artificial Sequence
  Description of Artificial Sequence: Synthetic oligonucleotide
  Target: SCN10A; (-) strand; PAM type: NRG; PAM sequence: AAG
ccagaggtccctctgagacc

SEQ ID NO: 15002 - DNA, 20 bp, Artificial Sequence
  Description of Artificial Sequence: Synthetic oligonucleotide
  Target: SCN10A; (-) strand; PAM type: NRG; PAM sequence: GAG
agagaaccagaggtccctct

SEQ ID NO: 15003 - DNA, 20 bp, Artificial Sequence
  Description of Artificial Sequence: Synthetic oligonucleotide
  Target: SCN10A; (-) strand; PAM type: NRG; PAM sequence: AGG
cagggcctcaagagaaccag

SEQ ID NO: 15004 - DNA, 20 bp, Artificial Sequence
  Description of Artificial Sequence: Synthetic oligonucleotide
  Target: SCN10A; (-) strand; PAM type: NRG; PAM sequence: GAG
gcagggcctcaagagaacca

SEQ ID NO: 15005 - DNA, 20 bp, Artificial Sequence
  Description of Artificial Sequence: Synthetic oligonucleotide
  Target: SCN10A; (-) strand; PAM type: NRG; PAM sequence: CAG
tggcagggcctcaagagaac

SEQ ID NO: 15006 - DNA, 20 bp, Artificial Sequence
  Description of Artificial Sequence: Synthetic oligonucleotide
  Target: SCN10A; (-) strand; PAM type: NRG; PAM sequence: GAG
tgtgactggcagggcctcaa

SEQ ID NO: 15007 - DNA, 20 bp, Artificial Sequence
  Description of Artificial Sequence: Synthetic oligonucleotide
  Target: SCN10A; (-) strand; PAM type: NRG; PAM sequence: AAG
agtgtgactggcagggcctc

SEQ ID NO: 15008 - DNA, 20 bp, Artificial Sequence
  Description of Artificial Sequence: Synthetic oligonucleotide
  Target: SCN10A; (-) strand; PAM type: NRG; PAM sequence: GGG
agagggcagtgtgactggca

SEQ ID NO: 15009 - DNA, 20 bp, Artificial Sequence
  Description of Artificial Sequence: Synthetic oligonucleotide
  Target: SCN10A; (-) strand; PAM type: NRG; PAM sequence: AGG
cagagggcagtgtgactggc

SEQ ID NO: 15010 - DNA, 20 bp, Artificial Sequence
  Description of Artificial Sequence: Synthetic oligonucleotide
  Target: SCN10A; (-) strand; PAM type: NRG; PAM sequence: CAG
gcagagggcagtgtgactgg

SEQ ID NO: 15011 - DNA, 20 bp, Artificial Sequence
  Description of Artificial Sequence: Synthetic oligonucleotide
  Target: SCN10A; (-) strand; PAM type: NRG; PAM sequence: TGG
acagcagagggcagtgtgac

SEQ ID NO: 15012 - DNA, 20 bp, Artificial Sequence
  Description of Artificial Sequence: Synthetic oligonucleotide
  Target: SCN10A; (-) strand; PAM type: NRG; PAM sequence: CAG
ggcactgtaacagcagaggg

SEQ ID NO: 15013 - DNA, 20 bp, Artificial Sequence
  Description of Artificial Sequence: Synthetic oligonucleotide
  Target: SCN10A; (-) strand; PAM type: NRG; PAM sequence: GGG
tctggcactgtaacagcaga

SEQ ID NO: 15014 - DNA, 20 bp, Artificial Sequence
  Description of Artificial Sequence: Synthetic oligonucleotide
  Target: SCN10A; (-) strand; PAM type: NRG; PAM sequence: AGG
ttctggcactgtaacagcag

SEQ ID NO: 15015 - DNA, 20 bp, Artificial Sequence
  Description of Artificial Sequence: Synthetic oligonucleotide
  Target: SCN10A; (-) strand; PAM type: NRG; PAM sequence: GAG
tttctggcactgtaacagca

SEQ ID NO: 15016 - DNA, 20 bp, Artificial Sequence
  Description of Artificial Sequence: Synthetic oligonucleotide
  Target: SCN10A; (-) strand; PAM type: NRG; PAM sequence: CAG
agtttctggcactgtaacag

SEQ ID NO: 15017 - DNA, 20 bp, Artificial Sequence
  Description of Artificial Sequence: Synthetic oligonucleotide
  Target: SCN10A; (-) strand; PAM type: NRG; PAM sequence: CAG
tgcagtttctggcactgtaa

SEQ ID NO: 15018 - DNA, 20 bp, Artificial Sequence
  Description of Artificial Sequence: Synthetic oligonucleotide
  Target: SCN10A; (-) strand; PAM type: NRG; PAM sequence: TGG
atcttcgttggtgcagtttc

SEQ ID NO: 15019 - DNA, 20 bp, Artificial Sequence
  Description of Artificial Sequence: Synthetic oligonucleotide
  Target: SCN10A; (-) strand; PAM type: NRG; PAM sequence: CAG
ggaaaacatcttcgttggtg

SEQ ID NO: 15020 - DNA, 20 bp, Artificial Sequence
  Description of Artificial Sequence: Synthetic oligonucleotide
  Target: SCN10A; (-) strand; PAM type: NRG; PAM sequence: TGG
agggaggaaaacatcttcgt

SEQ ID NO: 15021 - DNA, 20 bp, Artificial Sequence
  Description of Artificial Sequence: Synthetic oligonucleotide
  Target: SCN10A; (-) strand; PAM type: NRG; PAM sequence: AGG
ctaatacccaatcctaaggg

SEQ ID NO: 15022 - DNA, 20 bp, Artificial Sequence
  Description of Artificial Sequence: Synthetic oligonucleotide
  Target: SCN10A; (-) strand; PAM type: NRG; PAM sequence: GAG
actaatacccaatcctaagg

SEQ ID NO: 15023 - DNA, 20 bp, Artificial Sequence
  Description of Artificial Sequence: Synthetic oligonucleotide
  Target: SCN10A; (-) strand; PAM type: NRG; PAM sequence: GGG
aaactaatacccaatcctaa

SEQ ID NO: 15024 - DNA, 20 bp, Artificial Sequence
  Description of Artificial Sequence: Synthetic oligonucleotide
  Target: SCN10A; (-) strand; PAM type: NRG; PAM sequence: AGG
aaaactaatacccaatccta

SEQ ID NO: 15025 - DNA, 20 bp, Artificial Sequence
  Description of Artificial Sequence: Synthetic oligonucleotide
  Target: SCN10A; (-) strand; PAM type: NRG; PAM sequence: AAG
aaaaactaatacccaatcct

SEQ ID NO: 15026 - DNA, 20 bp, Artificial Sequence
  Description of Artificial Sequence: Synthetic oligonucleotide
  Target: SCN10A; (-) strand; PAM type: NRG; PAM sequence: AAG
gaaaatccaaagggccccta

SEQ ID NO: 15027 - DNA, 20 bp, Artificial Sequence
  Description of Artificial Sequence: Synthetic oligonucleotide
  Target: SCN10A; (-) strand; PAM type: NRG; PAM sequence: GGG
ttgaatgaagaaaatccaaa

SEQ ID NO: 15028 - DNA, 20 bp, Artificial Sequence
  Description of Artificial Sequence: Synthetic oligonucleotide
  Target: SCN10A; (-) strand; PAM type: NRG; PAM sequence: AGG
tttgaatgaagaaaatccaa

SEQ ID NO: 15029 - DNA, 20 bp, Artificial Sequence
  Description of Artificial Sequence: Synthetic oligonucleotide
  Target: SCN10A; (-) strand; PAM type: NRG; PAM sequence: AAG
gtttgaatgaagaaaatcca

SEQ ID NO: 15030 - DNA, 20 bp, Artificial Sequence
  Description of Artificial Sequence: Synthetic oligonucleotide
  Target: SCN10A; (-) strand; PAM type: NRG; PAM sequence: AAG
taaaggtgagagtttgaatg

SEQ ID NO: 15031 - DNA, 20 bp, Artificial Sequence
  Description of Artificial Sequence: Synthetic oligonucleotide
  Target: SCN10A; (-) strand; PAM type: NRG; PAM sequence: GAG
tgtcaggaagctaaaggtga

SEQ ID NO: 15032 - DNA, 20 bp, Artificial Sequence
  Description of Artificial Sequence: Synthetic oligonucleotide
  Target: SCN10A; (-) strand; PAM type: NRG; PAM sequence: GAG
tatgtcaggaagctaaaggt

SEQ ID NO: 15033 - DNA, 20 bp, Artificial Sequence
  Description of Artificial Sequence: Synthetic oligonucleotide
  Target: SCN10A; (-) strand; PAM type: NRG; PAM sequence: AGG
aaattatgtcaggaagctaa

SEQ ID NO: 15034 - DNA, 20 bp, Artificial Sequence
  Description of Artificial Sequence: Synthetic oligonucleotide
  Target: SCN10A; (-) strand; PAM type: NRG; PAM sequence: AAG
caaattatgtcaggaagcta

SEQ ID NO: 15035 - DNA, 20 bp, Artificial Sequence
  Description of Artificial Sequence: Synthetic oligonucleotide
  Target: SCN10A; (-) strand; PAM type: NRG; PAM sequence: AAG
ggctttcaaattatgtcagg

SEQ ID NO: 15036 - DNA, 20 bp, Artificial Sequence
  Description of Artificial Sequence: Synthetic oligonucleotide
  Target: SCN10A; (-) strand; PAM type: NRG; PAM sequence: AGG
ggtggctttcaaattatgtc

SEQ ID NO: 15037 - DNA, 20 bp, Artificial Sequence
  Description of Artificial Sequence: Synthetic oligonucleotide
  Target: SCN10A; (-) strand; PAM type: NRG; PAM sequence: CAG
aggtggctttcaaattatgt

SEQ ID NO: 15038 - DNA, 20 bp, Artificial Sequence
  Description of Artificial Sequence: Synthetic oligonucleotide
  Target: SCN10A; (-) strand; PAM type: NRG; PAM sequence: TGG
aaacatgttattaaaatagg

SEQ ID NO: 15039 - DNA, 20 bp, Artificial Sequence
  Description of Artificial Sequence: Synthetic oligonucleotide
  Target: SCN10A; (-) strand; PAM type: NRG; PAM sequence: AGG
cataaacatgttattaaaat

SEQ ID NO: 15040 - DNA, 20 bp, Artificial Sequence
  Description of Artificial Sequence: Synthetic oligonucleotide
  Target: SCN10A; (-) strand; PAM type: NRG; PAM sequence: TAG
acataaacatgttattaaaa

SEQ ID NO: 15041 - DNA, 20 bp, Artificial Sequence
  Description of Artificial Sequence: Synthetic oligonucleotide
  Target: SCN10A; (-) strand; PAM type: NRG; PAM sequence: GGG
ccagtttcccagcatttgca

SEQ ID NO: 15042 - DNA, 20 bp, Artificial Sequence
  Description of Artificial Sequence: Synthetic oligonucleotide
  Target: SCN10A; (-) strand; PAM type: NRG; PAM sequence: AGG
cccagtttcccagcatttgc

SEQ ID NO: 15043 - DNA, 20 bp, Artificial Sequence
  Description of Artificial Sequence: Synthetic oligonucleotide
  Target: SCN10A; (-) strand; PAM type: NRG; PAM sequence: CAG
gcccagtttcccagcatttg

SEQ ID NO: 15044 - DNA, 20 bp, Artificial Sequence
  Description of Artificial Sequence: Synthetic oligonucleotide
  Target: SCN10A; (-) strand; PAM type: NRG; PAM sequence: CAG
cagatctcagcccagtttcc

SEQ ID NO: 15045 - DNA, 20 bp, Artificial Sequence
  Description of Artificial Sequence: Synthetic oligonucleotide
  Target: SCN10A; (-) strand; PAM type: NRG; PAM sequence: CAG
aaattccacagatctcagcc

SEQ ID NO: 15046 - DNA, 20 bp, Artificial Sequence
  Description of Artificial Sequence: Synthetic oligonucleotide
  Target: SCN10A; (-) strand; PAM type: NRG; PAM sequence: CAG
ctttcaaattccacagatct

SEQ ID NO: 15047 - DNA, 20 bp, Artificial Sequence
  Description of Artificial Sequence: Synthetic oligonucleotide
  Target: SCN10A; (-) strand; PAM type: NRG; PAM sequence: CAG
agatctcctttcaaattcca

SEQ ID NO: 15048 - DNA, 20 bp, Artificial Sequence
  Description of Artificial Sequence: Synthetic oligonucleotide
  Target: SCN10A; (-) strand; PAM type: NRG; PAM sequence: CAG
tttgtgtccacagatcttct

SEQ ID NO: 15049 - DNA, 20 bp, Artificial Sequence
  Description of Artificial Sequence: Synthetic oligonucleotide
  Target: SCN10A; (-) strand; PAM type: NRG; PAM sequence: CAG
caggaagccctttgtgtcca

SEQ ID NO: 15050 - DNA, 20 bp, Artificial Sequence
  Description of Artificial Sequence: Synthetic oligonucleotide
  Target: SCN10A; (-) strand; PAM type: NRG; PAM sequence: AAG
ataaagatggtcctcccagg

SEQ ID NO: 15051 - DNA, 20 bp, Artificial Sequence
  Description of Artificial Sequence: Synthetic oligonucleotide
  Target: SCN10A; (-) strand; PAM type: NRG; PAM sequence: AGG
cccataaagatggtcctccc

SEQ ID NO: 15052 - DNA, 20 bp, Artificial Sequence
  Description of Artificial Sequence: Synthetic oligonucleotide
  Target: SCN10A; (-) strand; PAM type: NRG; PAM sequence: CAG
ccccataaagatggtcctcc

SEQ ID NO: 15053 - DNA, 20 bp, Artificial Sequence
  Description of Artificial Sequence: Synthetic oligonucleotide
  Target: SCN10A; (-) strand; PAM type: NRG; PAM sequence: TGG
cttctctccccccataaaga

SEQ ID NO: 15054 - DNA, 20 bp, Artificial Sequence
  Description of Artificial Sequence: Synthetic oligonucleotide
  Target: SCN10A; (-) strand; PAM type: NRG; PAM sequence: AAG
tttccttctctccccccata

SEQ ID NO: 15055 - DNA, 20 bp, Artificial Sequence
  Description of Artificial Sequence: Synthetic oligonucleotide
  Target: SCN10A; (-) strand; PAM type: NRG; PAM sequence: GAG
tctcagcatgacctcacctg

SEQ ID NO: 15056 - DNA, 20 bp, Artificial Sequence
  Description of Artificial Sequence: Synthetic oligonucleotide
  Target: SCN10A; (-) strand; PAM type: NRG; PAM sequence: TGG
gttctcagcatgacctcacc

SEQ ID NO: 15057 - DNA, 20 bp, Artificial Sequence
  Description of Artificial Sequence: Synthetic oligonucleotide
  Target: SCN10A; (-) strand; PAM type: NRG; PAM sequence: CAG
gaatccttggtcagagttct

SEQ ID NO: 15058 - DNA, 20 bp, Artificial Sequence
  Description of Artificial Sequence: Synthetic oligonucleotide
  Target: SCN10A; (-) strand; PAM type: NRG; PAM sequence: GAG
atctactgaatccttggtca

SEQ ID NO: 15059 - DNA, 20 bp, Artificial Sequence
  Description of Artificial Sequence: Synthetic oligonucleotide
  Target: SCN10A; (-) strand; PAM type: NRG; PAM sequence: CAG
gcatctactgaatccttggt

SEQ ID NO: 15060 - DNA, 20 bp, Artificial Sequence
  Description of Artificial Sequence: Synthetic oligonucleotide
  Target: SCN10A; (-) strand; PAM type: NRG; PAM sequence: TGG
aactgcatctactgaatcct

SEQ ID NO: 15061 - DNA, 20 bp, Artificial Sequence
  Description of Artificial Sequence: Synthetic oligonucleotide
  Target: SCN10A; (-) strand; PAM type: NRG; PAM sequence: GAG
gtgaccaggctggggtcact

SEQ ID NO: 15062 - DNA, 20 bp, Artificial Sequence
  Description of Artificial Sequence: Synthetic oligonucleotide
  Target: SCN10A; (-) strand; PAM type: NRG; PAM sequence: GGG
atgagctagtgaccaggctg

SEQ ID NO: 15063 - DNA, 20 bp, Artificial Sequence
  Description of Artificial Sequence: Synthetic oligonucleotide
  Target: SCN10A; (-) strand; PAM type: NRG; PAM sequence: GGG
gatgagctagtgaccaggct

SEQ ID NO: 15064 - DNA, 20 bp, Artificial Sequence
  Description of Artificial Sequence: Synthetic oligonucleotide
  Target: SCN10A; (-) strand; PAM type: NRG; PAM sequence: TGG
agatgagctagtgaccaggc

SEQ ID NO: 15065 - DNA, 20 bp, Artificial Sequence
  Description of Artificial Sequence: Synthetic oligonucleotide
  Target: SCN10A; (-) strand; PAM type: NRG; PAM sequence: AGG
aaggagatgagctagtgacc

SEQ ID NO: 15066 - DNA, 20 bp, Artificial Sequence
  Description of Artificial Sequence: Synthetic oligonucleotide
  Target: SCN10A; (-) strand; PAM type: NRG; PAM sequence: CAG
gaaggagatgagctagtgac

SEQ ID NO: 15067 - DNA, 20 bp, Artificial Sequence
  Description of Artificial Sequence: Synthetic oligonucleotide
  Target: SCN10A; (-) strand; PAM type: NRG; PAM sequence: TAG
ggtaacggaaggagatgagc

SEQ ID NO: 15068 - DNA, 20 bp, Artificial Sequence
  Description of Artificial Sequence: Synthetic oligonucleotide
  Target: SCN10A; (-) strand; PAM type: NRG; PAM sequence: GAG
attaggtaacggaaggagat

SEQ ID NO: 15069 - DNA, 20 bp, Artificial Sequence
  Description of Artificial Sequence: Synthetic oligonucleotide
  Target: SCN10A; (-) strand; PAM type: NRG; PAM sequence: GAG
gagatattaggtaacggaag

SEQ ID NO: 15070 - DNA, 20 bp, Artificial Sequence
  Description of Artificial Sequence: Synthetic oligonucleotide
  Target: SCN10A; (-) strand; PAM type: NRG; PAM sequence: AGG
gggagatattaggtaacgga

SEQ ID NO: 15071 - DNA, 20 bp, Artificial Sequence
  Description of Artificial Sequence: Synthetic oligonucleotide
  Target: SCN10A; (-) strand; PAM type: NRG; PAM sequence: AAG
agggagatattaggtaacgg

SEQ ID NO: 15072 - DNA, 20 bp, Artificial Sequence
  Description of Artificial Sequence: Synthetic oligonucleotide
  Target: SCN10A; (-) strand; PAM type: NRG; PAM sequence: CGG
cagagggagatattaggtaa

SEQ ID NO: 15073 - DNA, 20 bp, Artificial Sequence
  Description of Artificial Sequence: Synthetic oligonucleotide
  Target: SCN10A; (-) strand; PAM type: NRG; PAM sequence: AGG
agattacagagggagatatt

SEQ ID NO: 15074 - DNA, 20 bp, Artificial Sequence
  Description of Artificial Sequence: Synthetic oligonucleotide
  Target: SCN10A; (-) strand; PAM type: NRG; PAM sequence: TAG
cagattacagagggagatat

SEQ ID NO: 15075 - DNA, 20 bp, Artificial Sequence
  Description of Artificial Sequence: Synthetic oligonucleotide
  Target: SCN10A; (-) strand; PAM type: NRG; PAM sequence: GAG
caagaaacagattacagagg

SEQ ID NO: 15076 - DNA, 20 bp, Artificial Sequence
  Description of Artificial Sequence: Synthetic oligonucleotide
  Target: SCN10A; (-) strand; PAM type: NRG; PAM sequence: GGG
gtcaagaaacagattacaga

SEQ ID NO: 15077 - DNA, 20 bp, Artificial Sequence
  Description of Artificial Sequence: Synthetic oligonucleotide
  Target: SCN10A; (-) strand; PAM type: NRG; PAM sequence: AGG
ggtcaagaaacagattacag

SEQ ID NO: 15078 - DNA, 20 bp, Artificial Sequence
  Description of Artificial Sequence: Synthetic oligonucleotide
  Target: SCN10A; (-) strand; PAM type: NRG; PAM sequence: GAG
aggtcaagaaacagattaca

SEQ ID NO: 15079 - DNA, 20 bp, Artificial Sequence
  Description of Artificial Sequence: Synthetic oligonucleotide
  Target: SCN10A; (-) strand; PAM type: NRG; PAM sequence: CAG
tgaggtcaagaaacagatta

SEQ ID NO: 15080 - DNA, 20 bp, Artificial Sequence
  Description of Artificial Sequence: Synthetic oligonucleotide
  Target: SCN10A; (-) strand; PAM type: NRG; PAM sequence: CAG
agaaaactgaggtcaagaaa

SEQ ID NO: 15081 - DNA, 20 bp, Artificial Sequence
  Description of Artificial Sequence: Synthetic oligonucleotide
  Target: SCN10A; (-) strand; PAM type: NRG; PAM sequence: AAG
cagatgagaaaactgaggtc

SEQ ID NO: 15082 - DNA, 20 bp, Artificial Sequence
  Description of Artificial Sequence: Synthetic oligonucleotide
  Target: SCN10A; (-) strand; PAM type: NRG; PAM sequence: AGG
ttttacagatgagaaaactg

SEQ ID NO: 15083 - DNA, 20 bp, Artificial Sequence
  Description of Artificial Sequence: Synthetic oligonucleotide
  Target: SCN10A; (-) strand; PAM type: NRG; PAM sequence: GAG
attttacagatgagaaaact

SEQ ID NO: 15084 - DNA, 20 bp, Artificial Sequence
  Description of Artificial Sequence: Synthetic oligonucleotide
  Target: SCN10A; (-) strand; PAM type: NRG; PAM sequence: GAG
atttctctcattttacagat

SEQ ID NO: 15085 - DNA, 20 bp, Artificial Sequence
  Description of Artificial Sequence: Synthetic oligonucleotide
  Target: SCN10A; (-) strand; PAM type: NRG; PAM sequence: CAG
caatcatttctctcatttta

SEQ ID NO: 15086 - DNA, 20 bp, Artificial Sequence
  Description of Artificial Sequence: Synthetic oligonucleotide
  Target: SCN10A; (-) strand; PAM type: NRG; PAM sequence: AAG
ggggaggtttgagattattg

SEQ ID NO: 15087 - DNA, 20 bp, Artificial Sequence
  Description of Artificial Sequence: Synthetic oligonucleotide
  Target: SCN10A; (-) strand; PAM type: NRG; PAM sequence: GAG
ttagtaccctggggaggttt

SEQ ID NO: 15088 - DNA, 20 bp, Artificial Sequence
  Description of Artificial Sequence: Synthetic oligonucleotide
  Target: SCN10A; (-) strand; PAM type: NRG; PAM sequence: AGG
tgctatttagtaccctgggg

SEQ ID NO: 15089 - DNA, 20 bp, Artificial Sequence
  Description of Artificial Sequence: Synthetic oligonucleotide
  Target: SCN10A; (-) strand; PAM type: NRG; PAM sequence: GAG
gtgctatttagtaccctggg

SEQ ID NO: 15090 - DNA, 20 bp, Artificial Sequence
  Description of Artificial Sequence: Synthetic oligonucleotide
  Target: SCN10A; (-) strand; PAM type: NRG; PAM sequence: GGG
cagtgctatttagtaccctg

SEQ ID NO: 15091 - DNA, 20 bp, Artificial Sequence
  Description of Artificial Sequence: Synthetic oligonucleotide
  Target: SCN10A; (-) strand; PAM type: NRG; PAM sequence: GGG
acagtgctatttagtaccct

SEQ ID NO: 15092 - DNA, 20 bp, Artificial Sequence
  Description of Artificial Sequence: Synthetic oligonucleotide
  Target: SCN10A; (-) strand; PAM type: NRG; PAM sequence: TGG
gacagtgctatttagtaccc

SEQ ID NO: 15093 - DNA, 20 bp, Artificial Sequence
  Description of Artificial Sequence: Synthetic oligonucleotide
  Target: SCN10A; (-) strand; PAM type: NRG; PAM sequence: TAG
tgggacaagacagtgctatt

SEQ ID NO: 15094 - DNA, 20 bp, Artificial Sequence
  Description of Artificial Sequence: Synthetic oligonucleotide
  Target: SCN10A; (-) strand; PAM type: NRG; PAM sequence: CAG
aggataggtctgggacaaga

SEQ ID NO: 15095 - DNA, 20 bp, Artificial Sequence
  Description of Artificial Sequence: Synthetic oligonucleotide
  Target: SCN10A; (-) strand; PAM type: NRG; PAM sequence: AAG
ggacaggataggtctgggac

SEQ ID NO: 15096 - DNA, 20 bp, Artificial Sequence
  Description of Artificial Sequence: Synthetic oligonucleotide
  Target: SCN10A; (-) strand; PAM type: NRG; PAM sequence: GGG
gaagaggacaggataggtct

SEQ ID NO: 15097 - DNA, 20 bp, Artificial Sequence
  Description of Artificial Sequence: Synthetic oligonucleotide
  Target: SCN10A; (-) strand; PAM type: NRG; PAM sequence: TGG
agaagaggacaggataggtc

SEQ ID NO: 15098 - DNA, 20 bp, Artificial Sequence
  Description of Artificial Sequence: Synthetic oligonucleotide
  Target: SCN10A; (-) strand; PAM type: NRG; PAM sequence: AGG
gcataagaagaggacaggat

SEQ ID NO: 15099 - DNA, 20 bp, Artificial Sequence
  Description of Artificial Sequence: Synthetic oligonucleotide
  Target: SCN10A; (-) strand; PAM type: NRG; PAM sequence: TAG
agcataagaagaggacagga

SEQ ID NO: 15100 - DNA, 20 bp, Artificial Sequence
  Description of Artificial Sequence: Synthetic oligonucleotide
  Target: SCN10A; (-) strand; PAM type: NRG; PAM sequence: AGG
tctgagcataagaagaggac

SEQ ID NO: 15101 - DNA, 20 bp, Artificial Sequence
  Description of Artificial Sequence: Synthetic oligonucleotide
  Target: SCN10A; (-) strand; PAM type: NRG; PAM sequence: CAG
ttctgagcataagaagagga

SEQ ID NO: 15102 - DNA, 20 bp, Artificial Sequence
  Description of Artificial Sequence: Synthetic oligonucleotide
  Target: SCN10A; (-) strand; PAM type: NRG; PAM sequence: AGG
agggttctgagcataagaag

SEQ ID NO: 15103 - DNA, 20 bp, Artificial Sequence
  Description of Artificial Sequence: Synthetic oligonucleotide
  Target: SCN10A; (-) strand; PAM type: NRG; PAM sequence: GAG
cagggttctgagcataagaa

SEQ ID NO: 15104 - DNA, 20 bp, Artificial Sequence
  Description of Artificial Sequence: Synthetic oligonucleotide
  Target: SCN10A; (-) strand; PAM type: NRG; PAM sequence: AAG
cccagggttctgagcataag

SEQ ID NO: 15105 - DNA, 20 bp, Artificial Sequence
  Description of Artificial Sequence: Synthetic oligonucleotide
  Target: SCN10A; (-) strand; PAM type: NRG; PAM sequence: AAG
ttgcccagggttctgagcat

SEQ ID NO: 15106 - DNA, 20 bp, Artificial Sequence
  Description of Artificial Sequence: Synthetic oligonucleotide
  Target: SCN10A; (-) strand; PAM type: NRG; PAM sequence: GAG
aaatccttgcccagggttct

SEQ ID NO: 15107 - DNA, 20 bp, Artificial Sequence
  Description of Artificial Sequence: Synthetic oligonucleotide
  Target: SCN10A; (-) strand; PAM type: NRG; PAM sequence: GGG
ttacaggaaatccttgccca

SEQ ID NO: 15108 - DNA, 20 bp, Artificial Sequence
  Description of Artificial Sequence: Synthetic oligonucleotide
  Target: SCN10A; (-) strand; PAM type: NRG; PAM sequence: AGG
cttacaggaaatccttgccc

SEQ ID NO: 15109 - DNA, 20 bp, Artificial Sequence
  Description of Artificial Sequence: Synthetic oligonucleotide
  Target: SCN10A; (-) strand; PAM type: NRG; PAM sequence: CAG
acttacaggaaatccttgcc

SEQ ID NO: 15110 - DNA, 20 bp, Artificial Sequence
  Description of Artificial Sequence: Synthetic oligonucleotide
  Target: SCN10A; (-) strand; PAM type: NRG; PAM sequence: AGG
agggcaggcattccacttac

SEQ ID NO: 15111 - DNA, 20 bp, Artificial Sequence
  Description of Artificial Sequence: Synthetic oligonucleotide
  Target: SCN10A; (-) strand; PAM type: NRG; PAM sequence: CAG
tagggcaggcattccactta

SEQ ID NO: 15112 - DNA, 20 bp, Artificial Sequence
  Description of Artificial Sequence: Synthetic oligonucleotide
  Target: SCN10A; (-) strand; PAM type: NRG; PAM sequence: AGG
aaatatatacctactagggc

SEQ ID NO: 15113 - DNA, 20 bp, Artificial Sequence
  Description of Artificial Sequence: Synthetic oligonucleotide
  Target: SCN10A; (-) strand; PAM type: NRG; PAM sequence: CAG
aaaatatatacctactaggg

SEQ ID NO: 15114 - DNA, 20 bp, Artificial Sequence
  Description of Artificial Sequence: Synthetic oligonucleotide
  Target: SCN10A; (-) strand; PAM type: NRG; PAM sequence: GGG
tttaaaatatatacctacta

SEQ ID NO: 15115 - DNA, 20 bp, Artificial Sequence
  Description of Artificial Sequence: Synthetic oligonucleotide
  Target: SCN10A; (-) strand; PAM type: NRG; PAM sequence: AGG
atttaaaatatatacctact

SEQ ID NO: 15116 - DNA, 20 bp, Artificial Sequence
  Description of Artificial Sequence: Synthetic oligonucleotide
  Target: SCN10A; (-) strand; PAM type: NRG; PAM sequence: TAG
aatttaaaatatatacctac

SEQ ID NO: 15117 - DNA, 20 bp, Artificial Sequence
  Description of Artificial Sequence: Synthetic oligonucleotide
  Target: SCN10A; (-) strand; PAM type: NRG; PAM sequence: CAG
tggcagcgcctcaagagcac

SEQ ID NO: 15118 - DNA, 20 bp, Artificial Sequence
  Description of Artificial Sequence: Synthetic oligonucleotide
  Target: SCN10A; (-) strand; PAM type: NRG; PAM sequence: GAG
tgtgactggcagcgcctcaa

SEQ ID NO: 15119 - DNA, 20 bp, Artificial Sequence
  Description of Artificial Sequence: Synthetic oligonucleotide
  Target: SCN10A; (-) strand; PAM type: NRG; PAM sequence: AAG
agtgtgactggcagcgcctc

SEQ ID NO: 15120 - DNA, 20 bp, Artificial Sequence
  Description of Artificial Sequence: Synthetic oligonucleotide
  Target: SCN10A; (-) strand; PAM type: NRG; PAM sequence: CAG
gcagaggggagtgtgactgg

SEQ ID NO: 15121 - DNA, 20 bp, Artificial Sequence
  Description of Artificial Sequence: Synthetic oligonucleotide
  Target: SCN10A; (-) strand; PAM type: NRG; PAM sequence: TGG
acagcagaggggagtgtgac

SEQ ID NO: 15122 - DNA, 20 bp, Artificial Sequence
  Description of Artificial Sequence: Synthetic oligonucleotide
  Target: SCN10A; (-) strand; PAM type: NRG; PAM sequence: GAG
ggcactgtaacagcagaggg

SEQ ID NO: 15123 - DNA, 20 bp, Artificial Sequence
  Description of Artificial Sequence: Synthetic oligonucleotide
  Target: SCN10A; (-) strand; PAM type: NRG; PAM sequence: GGG
ctggcactgtaacagcagag

SEQ ID NO: 15124 - DNA, 20 bp, Artificial Sequence
  Description of Artificial Sequence: Synthetic oligonucleotide
  Target: SCN10A; (-) strand; PAM type: NRG; PAM sequence: GGG
tctggcactgtaacagcaga

SEQ ID NO: 15125 - DNA, 20 bp, Artificial Sequence
  Description of Artificial Sequence: Synthetic oligonucleotide
  Target: SCN10A; (-) strand; PAM type: NRG; PAM sequence: AGG
ttctggcactgtaacagcag

SEQ ID NO: 15126 - DNA, 20 bp, Artificial Sequence
  Description of Artificial Sequence: Synthetic oligonucleotide
  Target: SCN10A; (-) strand; PAM type: NRG; PAM sequence: GAG
tttctggcactgtaacagca

SEQ ID NO: 15127 - DNA, 20 bp, Artificial Sequence
  Description of Artificial Sequence: Synthetic oligonucleotide
  Target: SCN10A; (-) strand; PAM type: NRG; PAM sequence: CAG
agtttctggcactgtaacag

SEQ ID NO: 15128 - DNA, 20 bp, Artificial Sequence
  Description of Artificial Sequence: Synthetic oligonucleotide
  Target: SCN10A; (-) strand; PAM type: NRG; PAM sequence: CAG
tgcagtttctggcactgtaa

SEQ ID NO: 15129 - DNA, 20 bp, Artificial Sequence
  Description of Artificial Sequence: Synthetic oligonucleotide
  Target: SCN10A; (-) strand; PAM type: NRG; PAM sequence: TGG
aactttggtggtgcagtttc

SEQ ID NO: 15130 - DNA, 20 bp, Artificial Sequence
  Description of Artificial Sequence: Synthetic oligonucleotide
  Target: SCN10A; (-) strand; PAM type: NRG; PAM sequence: CAG
ataagacaactttggtggtg

SEQ ID NO: 15131 - DNA, 20 bp, Artificial Sequence
  Description of Artificial Sequence: Synthetic oligonucleotide
  Target: SCN10A; (-) strand; PAM type: NRG; PAM sequence: TGG
tgagcataagacaactttgg

SEQ ID NO: 15132 - DNA, 20 bp, Artificial Sequence
  Description of Artificial Sequence: Synthetic oligonucleotide
  Target: SCN10A; (-) strand; PAM type: NRG; PAM sequence: TGG
cactgagcataagacaactt

SEQ ID NO: 15133 - DNA, 20 bp, Artificial Sequence
  Description of Artificial Sequence: Synthetic oligonucleotide
  Target: SCN10A; (-) strand; PAM type: NRG; PAM sequence: AAG
gaacaaagatcactgagcat

SEQ ID NO: 15134 - DNA, 20 bp, Artificial Sequence
  Description of Artificial Sequence: Synthetic oligonucleotide
  Target: SCN10A; (-) strand; PAM type: NRG; PAM sequence: GAG
aatcctgaacaaagatcact

SEQ ID NO: 15135 - DNA, 20 bp, Artificial Sequence
  Description of Artificial Sequence: Synthetic oligonucleotide
  Target: SCN10A; (-) strand; PAM type: NRG; PAM sequence: AAG
ggtaaacaaaatcctgaaca

SEQ ID NO: 15136 - DNA, 20 bp, Artificial Sequence
  Description of Artificial Sequence: Synthetic oligonucleotide
  Target: SCN10A; (-) strand; PAM type: NRG; PAM sequence: GGG
actctctggattgtggtgag

SEQ ID NO: 15137 - DNA, 20 bp, Artificial Sequence
  Description of Artificial Sequence: Synthetic oligonucleotide
  Target: SCN10A; (-) strand; PAM type: NRG; PAM sequence: GGG
tactctctggattgtggtga

SEQ ID NO: 15138 - DNA, 20 bp, Artificial Sequence
  Description of Artificial Sequence: Synthetic oligonucleotide
  Target: SCN10A; (-) strand; PAM type: NRG; PAM sequence: AGG
ctactctctggattgtggtg

SEQ ID NO: 15139 - DNA, 20 bp, Artificial Sequence
  Description of Artificial Sequence: Synthetic oligonucleotide
  Target: SCN10A; (-) strand; PAM type: NRG; PAM sequence: GAG
cctactctctggattgtggt

SEQ ID NO: 15140 - DNA, 20 bp, Artificial Sequence
  Description of Artificial Sequence: Synthetic oligonucleotide
  Target: SCN10A; (-) strand; PAM type: NRG; PAM sequence: TGG
aatacctactctctggattg

SEQ ID NO: 15141 - DNA, 20 bp, Artificial Sequence
  Description of Artificial Sequence: Synthetic oligonucleotide
  Target: SCN10A; (-) strand; PAM type: NRG; PAM sequence: TGG
ggctaataatacctactctc

SEQ ID NO: 15142 - DNA, 20 bp, Artificial Sequence
  Description of Artificial Sequence: Synthetic oligonucleotide
  Target: SCN10A; (-) strand; PAM type: NRG; PAM sequence: GGG
gttttctcattcattcaatg

SEQ ID NO: 15143 - DNA, 20 bp, Artificial Sequence
  Description of Artificial Sequence: Synthetic oligonucleotide
  Target: SCN10A; (-) strand; PAM type: NRG; PAM sequence: GGG
agttttctcattcattcaat

SEQ ID NO: 15144 - DNA, 20 bp, Artificial Sequence
  Description of Artificial Sequence: Synthetic oligonucleotide
  Target: SCN10A; (-) strand; PAM type: NRG; PAM sequence: TGG
cagttttctcattcattcaa

SEQ ID NO: 15145 - DNA, 20 bp, Artificial Sequence
  Description of Artificial Sequence: Synthetic oligonucleotide
  Target: SCN10A; (-) strand; PAM type: NRG; PAM sequence: CAG
ttttaaacccctctgagtct

SEQ ID NO: 15146 - DNA, 20 bp, Artificial Sequence
  Description of Artificial Sequence: Synthetic oligonucleotide
  Target: SCN10A; (-) strand; PAM type: NRG; PAM sequence: GAG
gcaatattttaaacccctct

SEQ ID NO: 15147 - DNA, 20 bp, Artificial Sequence
  Description of Artificial Sequence: Synthetic oligonucleotide
  Target: SCN10A; (-) strand; PAM type: NRG; PAM sequence: TGG
tacttgtggatggctcatgc

SEQ ID NO: 15148 - DNA, 20 bp, Artificial Sequence
  Description of Artificial Sequence: Synthetic oligonucleotide
  Target: SCN10A; (-) strand; PAM type: NRG; PAM sequence: TGG
ctgactcaactacttgtgga

SEQ ID NO: 15149 - DNA, 20 bp, Artificial Sequence
  Description of Artificial Sequence: Synthetic oligonucleotide
  Target: SCN10A; (-) strand; PAM type: NRG; PAM sequence: TGG
attcctgactcaactacttg

SEQ ID NO: 15150 - DNA, 20 bp, Artificial Sequence
  Description of Artificial Sequence: Synthetic oligonucleotide
  Target: SCN10A; (-) strand; PAM type: NRG; PAM sequence: GGG
cacagagtacatgcaaacct

SEQ ID NO: 15151 - DNA, 20 bp, Artificial Sequence
  Description of Artificial Sequence: Synthetic oligonucleotide
  Target: SCN10A; (-) strand; PAM type: NRG; PAM sequence: TGG
tcacagagtacatgcaaacc

SEQ ID NO: 15152 - DNA, 20 bp, Artificial Sequence
  Description of Artificial Sequence: Synthetic oligonucleotide
  Target: SCN10A; (-) strand; PAM type: NRG; PAM sequence: GAG
ggctacatggataagtcaca

SEQ ID NO: 15153 - DNA, 20 bp, Artificial Sequence
  Description of Artificial Sequence: Synthetic oligonucleotide
  Target: SCN10A; (-) strand; PAM type: NRG; PAM sequence: CAG
ggggctacatggataagtca

SEQ ID NO: 15154 - DNA, 20 bp, Artificial Sequence
  Description of Artificial Sequence: Synthetic oligonucleotide
  Target: SCN10A; (-) strand; PAM type: NRG; PAM sequence: AAG
agaaaaggggctacatggat

SEQ ID NO: 15155 - DNA, 20 bp, Artificial Sequence
  Description of Artificial Sequence: Synthetic oligonucleotide
  Target: SCN10A; (-) strand; PAM type: NRG; PAM sequence: TGG
ccgagagaaaaggggctaca

SEQ ID NO: 15156 - DNA, 20 bp, Artificial Sequence
  Description of Artificial Sequence: Synthetic oligonucleotide
  Target: SCN10A; (-) strand; PAM type: NRG; PAM sequence: GGG
ctgagatcccgagagaaaag

SEQ ID NO: 15157 - DNA, 20 bp, Artificial Sequence
  Description of Artificial Sequence: Synthetic oligonucleotide
  Target: SCN10A; (-) strand; PAM type: NRG; PAM sequence: GGG
actgagatcccgagagaaaa

SEQ ID NO: 15158 - DNA, 20 bp, Artificial Sequence
  Description of Artificial Sequence: Synthetic oligonucleotide
  Target: SCN10A; (-) strand; PAM type: NRG; PAM sequence: AGG
aactgagatcccgagagaaa

SEQ ID NO: 15159 - DNA, 20 bp, Artificial Sequence
  Description of Artificial Sequence: Synthetic oligonucleotide
  Target: SCN10A; (-) strand; PAM type: NRG; PAM sequence: AAG
taactgagatcccgagagaa

SEQ ID NO: 15160 - DNA, 20 bp, Artificial Sequence
  Description of Artificial Sequence: Synthetic oligonucleotide
  Target: SCN10A; (-) strand; PAM type: NRG; PAM sequence: GAG
ttgcgtaactgagatcccga

SEQ ID NO: 15161 - DNA, 20 bp, Artificial Sequence
  Description of Artificial Sequence: Synthetic oligonucleotide
  Target: SCN10A; (-) strand; PAM type: NRG; PAM sequence: GAG
atttgcgtaactgagatccc

SEQ ID NO: 15162 - DNA, 20 bp, Artificial Sequence
  Description of Artificial Sequence: Synthetic oligonucleotide
  Target: SCN10A; (-) strand; PAM type: NRG; PAM sequence: GAG
tgttctagatttgcgtaact

SEQ ID NO: 15163 - DNA, 20 bp, Artificial Sequence
  Description of Artificial Sequence: Synthetic oligonucleotide
  Target: SCN10A; (-) strand; PAM type: NRG; PAM sequence: TAG
gaggtagataggcgctgttc

SEQ ID NO: 15164 - DNA, 20 bp, Artificial Sequence
  Description of Artificial Sequence: Synthetic oligonucleotide
  Target: SCN10A; (-) strand; PAM type: NRG; PAM sequence: AGG
tccatacccctgaggtagat

SEQ ID NO: 15165 - DNA, 20 bp, Artificial Sequence
  Description of Artificial Sequence: Synthetic oligonucleotide
  Target: SCN10A; (-) strand; PAM type: NRG; PAM sequence: TAG
ttccatacccctgaggtaga

SEQ ID NO: 15166 - DNA, 20 bp, Artificial Sequence
  Description of Artificial Sequence: Synthetic oligonucleotide
  Target: SCN10A; (-) strand; PAM type: NRG; PAM sequence: TAG
tgccttccatacccctgagg

SEQ ID NO: 15167 - DNA, 20 bp, Artificial Sequence
  Description of Artificial Sequence: Synthetic oligonucleotide
  Target: SCN10A; (-) strand; PAM type: NRG; PAM sequence: AGG
taatgccttccatacccctg

SEQ ID NO: 15168 - DNA, 20 bp, Artificial Sequence
  Description of Artificial Sequence: Synthetic oligonucleotide
  Target: SCN10A; (-) strand; PAM type: NRG; PAM sequence: GAG
ttaatgccttccatacccct

SEQ ID NO: 15169 - DNA, 20 bp, Artificial Sequence
  Description of Artificial Sequence: Synthetic oligonucleotide
  Target: SCN10A; (-) strand; PAM type: NRG; PAM sequence: AAG
gtcagggcaataaaggtata

SEQ ID NO: 15170 - DNA, 20 bp, Artificial Sequence
  Description of Artificial Sequence: Synthetic oligonucleotide
  Target: SCN10A; (-) strand; PAM type: NRG; PAM sequence: AGG
agaaaatgtcagggcaataa

SEQ ID NO: 15171 - DNA, 20 bp, Artificial Sequence
  Description of Artificial Sequence: Synthetic oligonucleotide
  Target: SCN10A; (-) strand; PAM type: NRG; PAM sequence: AAG
aagaaaatgtcagggcaata

SEQ ID NO: 15172 - DNA, 20 bp, Artificial Sequence
  Description of Artificial Sequence: Synthetic oligonucleotide
  Target: SCN10A; (-) strand; PAM type: NRG; PAM sequence: GGG
atgtttataagaaaatgtca

SEQ ID NO: 15173 - DNA, 20 bp, Artificial Sequence
  Description of Artificial Sequence: Synthetic oligonucleotide
  Target: SCN10A; (-) strand; PAM type: NRG; PAM sequence: AGG
catgtttataagaaaatgtc

SEQ ID NO: 15174 - DNA, 20 bp, Artificial Sequence
  Description of Artificial Sequence: Synthetic oligonucleotide
  Target: SCN10A; (-) strand; PAM type: NRG; PAM sequence: CAG
tcatgtttataagaaaatgt

SEQ ID NO: 15175 - DNA, 20 bp, Artificial Sequence
  Description of Artificial Sequence: Synthetic oligonucleotide
  Target: SCN10A; (-) strand; PAM type: NRG; PAM sequence: AAG
agataacctctcatgtttat

SEQ ID NO: 15176 - DNA, 20 bp, Artificial Sequence
  Description of Artificial Sequence: Synthetic oligonucleotide
  Target: SCN10A; (-) strand; PAM type: NRG; PAM sequence: CAG
gattaataggaatcgaatcc

SEQ ID NO: 15177 - DNA, 20 bp, Artificial Sequence
  Description of Artificial Sequence: Synthetic oligonucleotide
  Target: SCN10A; (-) strand; PAM type: NRG; PAM sequence: AGG
gggtgccgactctgattaat

SEQ ID NO: 15178 - DNA, 20 bp, Artificial Sequence
  Description of Artificial Sequence: Synthetic oligonucleotide
  Target: SCN10A; (-) strand; PAM type: NRG; PAM sequence: TAG
agggtgccgactctgattaa

SEQ ID NO: 15179 - DNA, 20 bp, Artificial Sequence
  Description of Artificial Sequence: Synthetic oligonucleotide
  Target: SCN10A; (-) strand; PAM type: NRG; PAM sequence: GGG
aggaaggcttgtgcctccaa

SEQ ID NO: 15180 - DNA, 20 bp, Artificial Sequence
  Description of Artificial Sequence: Synthetic oligonucleotide
  Target: SCN10A; (-) strand; PAM type: NRG; PAM sequence: AGG
gaggaaggcttgtgcctcca

SEQ ID NO: 15181 - DNA, 20 bp, Artificial Sequence
  Description of Artificial Sequence: Synthetic oligonucleotide
  Target: SCN10A; (-) strand; PAM type: NRG; PAM sequence: AAG
ggaggaaggcttgtgcctcc

SEQ ID NO: 15182 - DNA, 20 bp, Artificial Sequence
  Description of Artificial Sequence: Synthetic oligonucleotide
  Target: SCN10A; (-) strand; PAM type: NRG; PAM sequence: AGG
cctccttgggatggggagga

SEQ ID NO: 15183 - DNA, 20 bp, Artificial Sequence
  Description of Artificial Sequence: Synthetic oligonucleotide
  Target: SCN10A; (-) strand; PAM type: NRG; PAM sequence: AAG
ccctccttgggatggggagg

SEQ ID NO: 15184 - DNA, 20 bp, Artificial Sequence
  Description of Artificial Sequence: Synthetic oligonucleotide
  Target: SCN10A; (-) strand; PAM type: NRG; PAM sequence: AGG
caaccctccttgggatgggg

SEQ ID NO: 15185 - DNA, 20 bp, Artificial Sequence
  Description of Artificial Sequence: Synthetic oligonucleotide
  Target: SCN10A; (-) strand; PAM type: NRG; PAM sequence: GAG
ccaaccctccttgggatggg

SEQ ID NO: 15186 - DNA, 20 bp, Artificial Sequence
  Description of Artificial Sequence: Synthetic oligonucleotide
  Target: SCN10A; (-) strand; PAM type: NRG; PAM sequence: GGG
tcccaaccctccttgggatg

SEQ ID NO: 15187 - DNA, 20 bp, Artificial Sequence
  Description of Artificial Sequence: Synthetic oligonucleotide
  Target: SCN10A; (-) strand; PAM type: NRG; PAM sequence: GGG
atcccaaccctccttgggat

SEQ ID NO: 15188 - DNA, 20 bp, Artificial Sequence
  Description of Artificial Sequence: Synthetic oligonucleotide
  Target: SCN10A; (-) strand; PAM type: NRG; PAM sequence: TGG
aatcccaaccctccttggga

SEQ ID NO: 15189 - DNA, 20 bp, Artificial Sequence
  Description of Artificial Sequence: Synthetic oligonucleotide
  Target: SCN10A; (-) strand; PAM type: NRG; PAM sequence: GGG
gcagaatcccaaccctcctt

SEQ ID NO: 15190 - DNA, 20 bp, Artificial Sequence
  Description of Artificial Sequence: Synthetic oligonucleotide
  Target: SCN10A; (-) strand; PAM type: NRG; PAM sequence: TGG
ggcagaatcccaaccctcct

SEQ ID NO: 15191 - DNA, 20 bp, Artificial Sequence
  Description of Artificial Sequence: Synthetic oligonucleotide
  Target: SCN10A; (-) strand; PAM type: NRG; PAM sequence: CAG
aggccatggcccagcactgg

SEQ ID NO: 15192 - DNA, 20 bp, Artificial Sequence
  Description of Artificial Sequence: Synthetic oligonucleotide
  Target: SCN10A; (-) strand; PAM type: NRG; PAM sequence: TGG
gaaaggccatggcccagcac

SEQ ID NO: 15193 - DNA, 20 bp, Artificial Sequence
  Description of Artificial Sequence: Synthetic oligonucleotide
  Target: SCN10A; (-) strand; PAM type: NRG; PAM sequence: CAG
cctcaggaaaggccatggcc

SEQ ID NO: 15194 - DNA, 20 bp, Artificial Sequence
  Description of Artificial Sequence: Synthetic oligonucleotide
  Target: SCN10A; (-) strand; PAM type: NRG; PAM sequence: TGG
gggcacctcaggaaaggcca

SEQ ID NO: 15195 - DNA, 20 bp, Artificial Sequence
  Description of Artificial Sequence: Synthetic oligonucleotide
  Target: SCN10A; (-) strand; PAM type: NRG; PAM sequence: AGG
gagtcagggcacctcaggaa

SEQ ID NO: 15196 - DNA, 20 bp, Artificial Sequence
  Description of Artificial Sequence: Synthetic oligonucleotide
  Target: SCN10A; (-) strand; PAM type: NRG; PAM sequence: AAG
tgagtcagggcacctcagga

SEQ ID NO: 15197 - DNA, 20 bp, Artificial Sequence
  Description of Artificial Sequence: Synthetic oligonucleotide
  Target: SCN10A; (-) strand; PAM type: NRG; PAM sequence: AGG
ggactgagtcagggcacctc

SEQ ID NO: 15198 - DNA, 20 bp, Artificial Sequence
  Description of Artificial Sequence: Synthetic oligonucleotide
  Target: SCN10A; (-) strand; PAM type: NRG; PAM sequence: CAG
aggactgagtcagggcacct

SEQ ID NO: 15199 - DNA, 20 bp, Artificial Sequence
  Description of Artificial Sequence: Synthetic oligonucleotide
  Target: SCN10A; (-) strand; PAM type: NRG; PAM sequence: GGG
ccccacaaaggactgagtca

SEQ ID NO: 15200 - DNA, 20 bp, Artificial Sequence
  Description of Artificial Sequence: Synthetic oligonucleotide
  Target: SCN10A; (-) strand; PAM type: NRG; PAM sequence: AGG
tccccacaaaggactgagtc

SEQ ID NO: 15201 - DNA, 20 bp, Artificial Sequence
  Description of Artificial Sequence: Synthetic oligonucleotide
  Target: SCN10A; (-) strand; PAM type: NRG; PAM sequence: CAG
atccccacaaaggactgagt

SEQ ID NO: 15202 - DNA, 20 bp, Artificial Sequence
  Description of Artificial Sequence: Synthetic oligonucleotide
  Target: SCN10A; (-) strand; PAM type: NRG; PAM sequence: GAG
tatgatccccacaaaggact

SEQ ID NO: 15203 - DNA, 20 bp, Artificial Sequence
  Description of Artificial Sequence: Synthetic oligonucleotide
  Target: SCN10A; (-) strand; PAM type: NRG; PAM sequence: AGG
gggggatatgatccccacaa

SEQ ID NO: 15204 - DNA, 20 bp, Artificial Sequence
  Description of Artificial Sequence: Synthetic oligonucleotide
  Target: SCN10A; (-) strand; PAM type: NRG; PAM sequence: AAG
tgggggatatgatccccaca

SEQ ID NO: 15205 - DNA, 20 bp, Artificial Sequence
  Description of Artificial Sequence: Synthetic oligonucleotide
  Target: SCN10A; (-) strand; PAM type: NRG; PAM sequence: GGG
agaacttgctgacctgttgg

SEQ ID NO: 15206 - DNA, 20 bp, Artificial Sequence
  Description of Artificial Sequence: Synthetic oligonucleotide
  Target: SCN10A; (-) strand; PAM type: NRG; PAM sequence: GGG
tagaacttgctgacctgttg

SEQ ID NO: 15207 - DNA, 20 bp, Artificial Sequence
  Description of Artificial Sequence: Synthetic oligonucleotide
  Target: SCN10A; (-) strand; PAM type: NRG; PAM sequence: GGG
ctagaacttgctgacctgtt

SEQ ID NO: 15208 - DNA, 20 bp, Artificial Sequence
  Description of Artificial Sequence: Synthetic oligonucleotide
  Target: SCN10A; (-) strand; PAM type: NRG; PAM sequence: TGG
tctagaacttgctgacctgt

SEQ ID NO: 15209 - DNA, 20 bp, Artificial Sequence
  Description of Artificial Sequence: Synthetic oligonucleotide
  Target: SCN10A; (-) strand; PAM type: NRG; PAM sequence: TAG
agcagggaaagaaagggatc

SEQ ID NO: 15210 - DNA, 20 bp, Artificial Sequence
  Description of Artificial Sequence: Synthetic oligonucleotide
  Target: SCN10A; (-) strand; PAM type: NRG; PAM sequence: GGG
aatacaagcagggaaagaaa

SEQ ID NO: 15211 - DNA, 20 bp, Artificial Sequence
  Description of Artificial Sequence: Synthetic oligonucleotide
  Target: SCN10A; (-) strand; PAM type: NRG; PAM sequence: AGG
gaatacaagcagggaaagaa

SEQ ID NO: 15212 - DNA, 20 bp, Artificial Sequence
  Description of Artificial Sequence: Synthetic oligonucleotide
  Target: SCN10A; (-) strand; PAM type: NRG; PAM sequence: AAG
agaatacaagcagggaaaga

SEQ ID NO: 15213 - DNA, 20 bp, Artificial Sequence
  Description of Artificial Sequence: Synthetic oligonucleotide
  Target: SCN10A; (-) strand; PAM type: NRG; PAM sequence: AAG
tgggagaatacaagcaggga

SEQ ID NO: 15214 - DNA, 20 bp, Artificial Sequence
  Description of Artificial Sequence: Synthetic oligonucleotide
  Target: SCN10A; (-) strand; PAM type: NRG; PAM sequence: GGG
gccctgggagaatacaagca

SEQ ID NO: 15215 - DNA, 20 bp, Artificial Sequence
  Description of Artificial Sequence: Synthetic oligonucleotide
  Target: SCN10A; (-) strand; PAM type: NRG; PAM sequence: AGG
agccctgggagaatacaagc

SEQ ID NO: 15216 - DNA, 20 bp, Artificial Sequence
  Description of Artificial Sequence: Synthetic oligonucleotide
  Target: SCN10A; (-) strand; PAM type: NRG; PAM sequence: CAG
gagccctgggagaatacaag

SEQ ID NO: 15217 - DNA, 20 bp, Artificial Sequence
  Description of Artificial Sequence: Synthetic oligonucleotide
  Target: SCN10A; (-) strand; PAM type: NRG; PAM sequence: AAG
agtgagccctgggagaatac

SEQ ID NO: 15218 - DNA, 20 bp, Artificial Sequence
  Description of Artificial Sequence: Synthetic oligonucleotide
  Target: SCN10A; (-) strand; PAM type: NRG; PAM sequence: GAG
gtgttccaagtgagccctgg

SEQ ID NO: 15219 - DNA, 20 bp, Artificial Sequence
  Description of Artificial Sequence: Synthetic oligonucleotide
  Target: SCN10A; (-) strand; PAM type: NRG; PAM sequence: GGG
atgtgttccaagtgagccct

SEQ ID NO: 15220 - DNA, 20 bp, Artificial Sequence
  Description of Artificial Sequence: Synthetic oligonucleotide
  Target: SCN10A; (-) strand; PAM type: NRG; PAM sequence: TGG
gatgtgttccaagtgagccc

SEQ ID NO: 15221 - DNA, 20 bp, Artificial Sequence
  Description of Artificial Sequence: Synthetic oligonucleotide
  Target: SCN10A; (-) strand; PAM type: NRG; PAM sequence: GAG
gtgttagatgtgttccaagt

SEQ ID NO: 15222 - DNA, 20 bp, Artificial Sequence
  Description of Artificial Sequence: Synthetic oligonucleotide
  Target: SCN10A; (-) strand; PAM type: NRG; PAM sequence: AAG
aggtgtgttagatgtgttcc

SEQ ID NO: 15223 - DNA, 20 bp, Artificial Sequence
  Description of Artificial Sequence: Synthetic oligonucleotide
  Target: SCN10A; (-) strand; PAM type: NRG; PAM sequence: TAG
ccaactggaaccaggtgtgt

SEQ ID NO: 15224 - DNA, 20 bp, Artificial Sequence
  Description of Artificial Sequence: Synthetic oligonucleotide
  Target: SCN10A; (-) strand; PAM type: NRG; PAM sequence: AGG
tggtcttcccaactggaacc

SEQ ID NO: 15225 - DNA, 20 bp, Artificial Sequence
  Description of Artificial Sequence: Synthetic oligonucleotide
  Target: SCN10A; (-) strand; PAM type: NRG; PAM sequence: CAG
ttggtcttcccaactggaac

SEQ ID NO: 15226 - DNA, 20 bp, Artificial Sequence
  Description of Artificial Sequence: Synthetic oligonucleotide
  Target: SCN10A; (-) strand; PAM type: NRG; PAM sequence: TGG
gggatcttggtcttcccaac

SEQ ID NO: 15227 - DNA, 20 bp, Artificial Sequence
  Description of Artificial Sequence: Synthetic oligonucleotide
  Target: SCN10A; (-) strand; PAM type: NRG; PAM sequence: TGG
ttcacatctcaaagggatct

SEQ ID NO: 15228 - DNA, 20 bp, Artificial Sequence
  Description of Artificial Sequence: Synthetic oligonucleotide
  Target: SCN10A; (-) strand; PAM type: NRG; PAM sequence: GGG
ctcaggattcacatctcaaa

SEQ ID NO: 15229 - DNA, 20 bp, Artificial Sequence
  Description of Artificial Sequence: Synthetic oligonucleotide
  Target: SCN10A; (-) strand; PAM type: NRG; PAM sequence: AGG
actcaggattcacatctcaa

SEQ ID NO: 15230 - DNA, 20 bp, Artificial Sequence
  Description of Artificial Sequence: Synthetic oligonucleotide
  Target: SCN10A; (-) strand; PAM type: NRG; PAM sequence: AAG
cactcaggattcacatctca

SEQ ID NO: 15231 - DNA, 20 bp, Artificial Sequence
  Description of Artificial Sequence: Synthetic oligonucleotide
  Target: SCN10A; (-) strand; PAM type: NRG; PAM sequence: AGG
ccccactaacatcctcactc

SEQ ID NO: 15232 - DNA, 20 bp, Artificial Sequence
  Description of Artificial Sequence: Synthetic oligonucleotide
  Target: SCN10A; (-) strand; PAM type: NRG; PAM sequence: CAG
gccccactaacatcctcact

SEQ ID NO: 15233 - DNA, 20 bp, Artificial Sequence
  Description of Artificial Sequence: Synthetic oligonucleotide
  Target: SCN10A; (-) strand; PAM type: NRG; PAM sequence: CAG
agagttgcatttctctctgt

SEQ ID NO: 15234 - DNA, 20 bp, Artificial Sequence
  Description of Artificial Sequence: Synthetic oligonucleotide
  Target: SCN10A; (-) strand; PAM type: NRG; PAM sequence: GAG
tgtgattgctgttgcaggaa

SEQ ID NO: 15235 - DNA, 20 bp, Artificial Sequence
  Description of Artificial Sequence: Synthetic oligonucleotide
  Target: SCN10A; (-) strand; PAM type: NRG; PAM sequence: AAG
cctgtgattgctgttgcagg

SEQ ID NO: 15236 - DNA, 20 bp, Artificial Sequence
  Description of Artificial Sequence: Synthetic oligonucleotide
  Target: SCN10A; (-) strand; PAM type: NRG; PAM sequence: AGG
tgccctgtgattgctgttgc

SEQ ID NO: 15237 - DNA, 20 bp, Artificial Sequence
  Description of Artificial Sequence: Synthetic oligonucleotide
  Target: SCN10A; (-) strand; PAM type: NRG; PAM sequence: CAG
ttgccctgtgattgctgttg

SEQ ID NO: 15238 - DNA, 20 bp, Artificial Sequence
  Description of Artificial Sequence: Synthetic oligonucleotide
  Target: SCN10A; (-) strand; PAM type: NRG; PAM sequence: CAG
acagcccatcactttaatat

SEQ ID NO: 15239 - DNA, 20 bp, Artificial Sequence
  Description of Artificial Sequence: Synthetic oligonucleotide
  Target: SCN10A; (-) strand; PAM type: NRG; PAM sequence: CAG
acaaaagccaacactactca

SEQ ID NO: 15240 - DNA, 20 bp, Artificial Sequence
  Description of Artificial Sequence: Synthetic oligonucleotide
  Target: SCN10A; (-) strand; PAM type: NRG; PAM sequence: AAG
cagctctggcctcctgacaa

SEQ ID NO: 15241 - DNA, 20 bp, Artificial Sequence
  Description of Artificial Sequence: Synthetic oligonucleotide
  Target: SCN10A; (-) strand; PAM type: NRG; PAM sequence: TGG
tcctgttccctgcccagctc

SEQ ID NO: 15242 - DNA, 20 bp, Artificial Sequence
  Description of Artificial Sequence: Synthetic oligonucleotide
  Target: SCN10A; (-) strand; PAM type: NRG; PAM sequence: CAG
tatatttcctgttccctgcc

SEQ ID NO: 15243 - DNA, 20 bp, Artificial Sequence
  Description of Artificial Sequence: Synthetic oligonucleotide
  Target: SCN10A; (-) strand; PAM type: NRG; PAM sequence: AAG
ctggtttctgctgtagtggt

SEQ ID NO: 15244 - DNA, 20 bp, Artificial Sequence
  Description of Artificial Sequence: Synthetic oligonucleotide
  Target: SCN10A; (-) strand; PAM type: NRG; PAM sequence: TGG
gtttctggtttctgctgtag

SEQ ID NO: 15245 - DNA, 20 bp, Artificial Sequence
  Description of Artificial Sequence: Synthetic oligonucleotide
  Target: SCN10A; (-) strand; PAM type: NRG; PAM sequence: TAG
ggagtttctggtttctgctg

SEQ ID NO: 15246 - DNA, 20 bp, Artificial Sequence
  Description of Artificial Sequence: Synthetic oligonucleotide
  Target: SCN10A; (-) strand; PAM type: NRG; PAM sequence: TGG
aagtggtgctcaggagtttc

SEQ ID NO: 15247 - DNA, 20 bp, Artificial Sequence
  Description of Artificial Sequence: Synthetic oligonucleotide
  Target: SCN10A; (-) strand; PAM type: NRG; PAM sequence: GAG
aaaagataagtggtgctcag

SEQ ID NO: 15248 - DNA, 20 bp, Artificial Sequence
  Description of Artificial Sequence: Synthetic oligonucleotide
  Target: SCN10A; (-) strand; PAM type: NRG; PAM sequence: AGG
aaaaaagataagtggtgctc

SEQ ID NO: 15249 - DNA, 20 bp, Artificial Sequence
  Description of Artificial Sequence: Synthetic oligonucleotide
  Target: SCN10A; (-) strand; PAM type: NRG; PAM sequence: CAG
aaaaaaagataagtggtgct

SEQ ID NO: 15250 - DNA, 20 bp, Artificial Sequence
  Description of Artificial Sequence: Synthetic oligonucleotide
  Target: SCN10A; (-) strand; PAM type: NRG; PAM sequence: TGG
caacagaaaaaaaagataag

SEQ ID NO: 15251 - DNA, 20 bp, Artificial Sequence
  Description of Artificial Sequence: Synthetic oligonucleotide
  Target: SCN10A; (-) strand; PAM type: NRG; PAM sequence: AAG
aatcaacagaaaaaaaagat

SEQ ID NO: 15252 - DNA, 20 bp, Artificial Sequence
  Description of Artificial Sequence: Synthetic oligonucleotide
  Target: SCN10A; (-) strand; PAM type: NRG; PAM sequence: AAG
acttcaatcaacagaaaaaa

SEQ ID NO: 15253 - DNA, 20 bp, Artificial Sequence
  Description of Artificial Sequence: Synthetic oligonucleotide
  Target: SCN10A; (-) strand; PAM type: NRG; PAM sequence: CAG
taattgacaacttcaatcaa

SEQ ID NO: 15254 - DNA, 20 bp, Artificial Sequence
  Description of Artificial Sequence: Synthetic oligonucleotide
  Target: SCN10A; (-) strand; PAM type: NRG; PAM sequence: GGG
cacactgaatctctttgttg

SEQ ID NO: 15255 - DNA, 20 bp, Artificial Sequence
  Description of Artificial Sequence: Synthetic oligonucleotide
  Target: SCN10A; (-) strand; PAM type: NRG; PAM sequence: GGG
tcacactgaatctctttgtt

SEQ ID NO: 15256 - DNA, 20 bp, Artificial Sequence
  Description of Artificial Sequence: Synthetic oligonucleotide
  Target: SCN10A; (-) strand; PAM type: NRG; PAM sequence: TGG
ttcacactgaatctctttgt

SEQ ID NO: 15257 - DNA, 20 bp, Artificial Sequence
  Description of Artificial Sequence: Synthetic oligonucleotide
  Target: SCN10A; (-) strand; PAM type: NRG; PAM sequence: AGG
gtcatcttcatcatttttgg

SEQ ID NO: 15258 - DNA, 20 bp, Artificial Sequence
  Description of Artificial Sequence: Synthetic oligonucleotide
  Target: SCN10A; (-) strand; PAM type: NRG; PAM sequence: GAG
tgtcatcttcatcatttttg

SEQ ID NO: 15259 - DNA, 20 bp, Artificial Sequence
  Description of Artificial Sequence: Synthetic oligonucleotide
  Target: SCN10A; (-) strand; PAM type: NRG; PAM sequence: TGG
tttgtcatcttcatcatttt

SEQ ID NO: 15260 - DNA, 20 bp, Artificial Sequence
  Description of Artificial Sequence: Synthetic oligonucleotide
  Target: SCN10A; (-) strand; PAM type: NRG; PAM sequence: AGG
caacatgcaacccaagtggg

SEQ ID NO: 15261 - DNA, 20 bp, Artificial Sequence
  Description of Artificial Sequence: Synthetic oligonucleotide
  Target: SCN10A; (-) strand; PAM type: NRG; PAM sequence: GAG
tcaacatgcaacccaagtgg

SEQ ID NO: 15262 - DNA, 20 bp, Artificial Sequence
  Description of Artificial Sequence: Synthetic oligonucleotide
  Target: SCN10A; (-) strand; PAM type: NRG; PAM sequence: GGG
ggtcaacatgcaacccaagt

SEQ ID NO: 15263 - DNA, 20 bp, Artificial Sequence
  Description of Artificial Sequence: Synthetic oligonucleotide
  Target: SCN10A; (-) strand; PAM type: NRG; PAM sequence: TGG
aggtcaacatgcaacccaag

SEQ ID NO: 15264 - DNA, 20 bp, Artificial Sequence
  Description of Artificial Sequence: Synthetic oligonucleotide
  Target: SCN10A; (-) strand; PAM type: NRG; PAM sequence: AAG
cacaggtcaacatgcaaccc

SEQ ID NO: 15265 - DNA, 20 bp, Artificial Sequence
  Description of Artificial Sequence: Synthetic oligonucleotide
  Target: SCN10A; (-) strand; PAM type: NRG; PAM sequence: AGG
actctcccttgtctggtcac

SEQ ID NO: 15266 - DNA, 20 bp, Artificial Sequence
  Description of Artificial Sequence: Synthetic oligonucleotide
  Target: SCN10A; (-) strand; PAM type: NRG; PAM sequence: CAG
cactctcccttgtctggtca

SEQ ID NO: 15267 - DNA, 20 bp, Artificial Sequence
  Description of Artificial Sequence: Synthetic oligonucleotide
  Target: SCN10A; (-) strand; PAM type: NRG; PAM sequence: TGG
ccttcccactctcccttgtc

SEQ ID NO: 15268 - DNA, 20 bp, Artificial Sequence
  Description of Artificial Sequence: Synthetic oligonucleotide
  Target: SCN10A; (-) strand; PAM type: NRG; PAM sequence: AAG
tttcagagtgaacctgaact

SEQ ID NO: 15269 - DNA, 20 bp, Artificial Sequence
  Description of Artificial Sequence: Synthetic oligonucleotide
  Target: SCN10A; (-) strand; PAM type: NRG; PAM sequence: GAG
tgtcttaggcttggctttca

SEQ ID NO: 15270 - DNA, 20 bp, Artificial Sequence
  Description of Artificial Sequence: Synthetic oligonucleotide
  Target: SCN10A; (-) strand; PAM type: NRG; PAM sequence: CAG
catgtcttaggcttggcttt

SEQ ID NO: 15271 - DNA, 20 bp, Artificial Sequence
  Description of Artificial Sequence: Synthetic oligonucleotide
  Target: SCN10A; (-) strand; PAM type: NRG; PAM sequence: TGG
ccaggtccatgtcttaggct

SEQ ID NO: 15272 - DNA, 20 bp, Artificial Sequence
  Description of Artificial Sequence: Synthetic oligonucleotide
  Target: SCN10A; (-) strand; PAM type: NRG; PAM sequence: AGG
tgcacccaggtccatgtctt

SEQ ID NO: 15273 - DNA, 20 bp, Artificial Sequence
  Description of Artificial Sequence: Synthetic oligonucleotide
  Target: SCN10A; (-) strand; PAM type: NRG; PAM sequence: TAG
ctgcacccaggtccatgtct

SEQ ID NO: 15274 - DNA, 20 bp, Artificial Sequence
  Description of Artificial Sequence: Synthetic oligonucleotide
  Target: SCN10A; (-) strand; PAM type: NRG; PAM sequence: AGG
cagataaatcacctgcaccc

SEQ ID NO: 15275 - DNA, 20 bp, Artificial Sequence
  Description of Artificial Sequence: Synthetic oligonucleotide
  Target: SCN10A; (-) strand; PAM type: NRG; PAM sequence: CAG
ccagataaatcacctgcacc

SEQ ID NO: 15276 - DNA, 20 bp, Artificial Sequence
  Description of Artificial Sequence: Synthetic oligonucleotide
  Target: SCN10A; (-) strand; PAM type: NRG; PAM sequence: CAG
tgcttccttggatcacctcc

SEQ ID NO: 15277 - DNA, 20 bp, Artificial Sequence
  Description of Artificial Sequence: Synthetic oligonucleotide
  Target: SCN10A; (-) strand; PAM type: NRG; PAM sequence: TGG
ctccctcattcctgcttcct

SEQ ID NO: 15278 - DNA, 20 bp, Artificial Sequence
  Description of Artificial Sequence: Synthetic oligonucleotide
  Target: SCN10A; (-) strand; PAM type: NRG; PAM sequence: AGG
cttaacaacatcctcttcac

SEQ ID NO: 15279 - DNA, 20 bp, Artificial Sequence
  Description of Artificial Sequence: Synthetic oligonucleotide
  Target: SCN10A; (-) strand; PAM type: NRG; PAM sequence: CAG
gcttaacaacatcctcttca

SEQ ID NO: 15280 - DNA, 20 bp, Artificial Sequence
  Description of Artificial Sequence: Synthetic oligonucleotide
  Target: SCN10A; (-) strand; PAM type: NRG; PAM sequence: CAG
accccagtaggattgcgctt

SEQ ID NO: 15281 - DNA, 20 bp, Artificial Sequence
  Description of Artificial Sequence: Synthetic oligonucleotide
  Target: SCN10A; (-) strand; PAM type: NRG; PAM sequence: AGG
gttactcagaggaccccagt

SEQ ID NO: 15282 - DNA, 20 bp, Artificial Sequence
  Description of Artificial Sequence: Synthetic oligonucleotide
  Target: SCN10A; (-) strand; PAM type: NRG; PAM sequence: TAG
agttactcagaggaccccag

SEQ ID NO: 15283 - DNA, 20 bp, Artificial Sequence
  Description of Artificial Sequence: Synthetic oligonucleotide
  Target: SCN10A; (-) strand; PAM type: NRG; PAM sequence: CAG
cacagttactcagaggaccc

SEQ ID NO: 15284 - DNA, 20 bp, Artificial Sequence
  Description of Artificial Sequence: Synthetic oligonucleotide
  Target: SCN10A; (-) strand; PAM type: NRG; PAM sequence: AGG
tgctctacacagttactcag

SEQ ID NO: 15285 - DNA, 20 bp, Artificial Sequence
  Description of Artificial Sequence: Synthetic oligonucleotide
  Target: SCN10A; (-) strand; PAM type: NRG; PAM sequence: GAG
gtgctctacacagttactca

SEQ ID NO: 15286 - DNA, 20 bp, Artificial Sequence
  Description of Artificial Sequence: Synthetic oligonucleotide
  Target: SCN10A; (-) strand; PAM type: NRG; PAM sequence: CAG
atgtgctctacacagttact

SEQ ID NO: 15287 - DNA, 20 bp, Artificial Sequence
  Description of Artificial Sequence: Synthetic oligonucleotide
  Target: SCN10A; (-) strand; PAM type: NRG; PAM sequence: CAG
aatcctgcatgtgctctaca

SEQ ID NO: 15288 - DNA, 20 bp, Artificial Sequence
  Description of Artificial Sequence: Synthetic oligonucleotide
  Target: SCN10A; (-) strand; PAM type: NRG; PAM sequence: TGG
actccagtttccctgtccct

SEQ ID NO: 15289 - DNA, 20 bp, Artificial Sequence
  Description of Artificial Sequence: Synthetic oligonucleotide
  Target: SCN10A; (-) strand; PAM type: NRG; PAM sequence: CAG
gagtctgaggataaatactc

SEQ ID NO: 15290 - DNA, 20 bp, Artificial Sequence
  Description of Artificial Sequence: Synthetic oligonucleotide
  Target: SCN10A; (-) strand; PAM type: NRG; PAM sequence: AGG
caataagttttgggagtctg

SEQ ID NO: 15291 - DNA, 20 bp, Artificial Sequence
  Description of Artificial Sequence: Synthetic oligonucleotide
  Target: SCN10A; (-) strand; PAM type: NRG; PAM sequence: GAG
ccaataagttttgggagtct

SEQ ID NO: 15292 - DNA, 20 bp, Artificial Sequence
  Description of Artificial Sequence: Synthetic oligonucleotide
  Target: SCN10A; (-) strand; PAM type: NRG; PAM sequence: GAG
cccttaccaataagttttgg

SEQ ID NO: 15293 - DNA, 20 bp, Artificial Sequence
  Description of Artificial Sequence: Synthetic oligonucleotide
  Target: SCN10A; (-) strand; PAM type: NRG; PAM sequence: GGG
aacccttaccaataagtttt

SEQ ID NO: 15294 - DNA, 20 bp, Artificial Sequence
  Description of Artificial Sequence: Synthetic oligonucleotide
  Target: SCN10A; (-) strand; PAM type: NRG; PAM sequence: TGG
caacccttaccaataagttt

SEQ ID NO: 15295 - DNA, 20 bp, Artificial Sequence
  Description of Artificial Sequence: Synthetic oligonucleotide
  Target: SCN10A; (-) strand; PAM type: NRG; PAM sequence: AAG
taggggcaacccttaccaat

SEQ ID NO: 15296 - DNA, 20 bp, Artificial Sequence
  Description of Artificial Sequence: Synthetic oligonucleotide
  Target: SCN10A; (-) strand; PAM type: NRG; PAM sequence: GGG
cagggatttaatgtccctag

SEQ ID NO: 15297 - DNA, 20 bp, Artificial Sequence
  Description of Artificial Sequence: Synthetic oligonucleotide
  Target: SCN10A; (-) strand; PAM type: NRG; PAM sequence: GGG
ccagggatttaatgtcccta

SEQ ID NO: 15298 - DNA, 20 bp, Artificial Sequence
  Description of Artificial Sequence: Synthetic oligonucleotide
  Target: SCN10A; (-) strand; PAM type: NRG; PAM sequence: AGG
accagggatttaatgtccct

SEQ ID NO: 15299 - DNA, 20 bp, Artificial Sequence
  Description of Artificial Sequence: Synthetic oligonucleotide
  Target: SCN10A; (-) strand; PAM type: NRG; PAM sequence: TAG
taccagggatttaatgtccc

SEQ ID NO: 15300 - DNA, 20 bp, Artificial Sequence
  Description of Artificial Sequence: Synthetic oligonucleotide
  Target: SCN10A; (-) strand; PAM type: NRG; PAM sequence: GGG
aacttctcccccaagtacca

SEQ ID NO: 15301 - DNA, 20 bp, Artificial Sequence
  Description of Artificial Sequence: Synthetic oligonucleotide
  Target: SCN10A; (-) strand; PAM type: NRG; PAM sequence: AGG
caacttctcccccaagtacc

SEQ ID NO: 15302 - DNA, 20 bp, Artificial Sequence
  Description of Artificial Sequence: Synthetic oligonucleotide
  Target: SCN10A; (-) strand; PAM type: NRG; PAM sequence: CAG
gcaacttctcccccaagtac

SEQ ID NO: 15303 - DNA, 20 bp, Artificial Sequence
  Description of Artificial Sequence: Synthetic oligonucleotide
  Target: SCN10A; (-) strand; PAM type: NRG; PAM sequence: AAG
tgtgcagcaacttctccccc

SEQ ID NO: 15304 - DNA, 20 bp, Artificial Sequence
  Description of Artificial Sequence: Synthetic oligonucleotide
  Target: SCN10A; (-) strand; PAM type: NRG; PAM sequence: CAG
ccagggcttaggagcttgtg

SEQ ID NO: 15305 - DNA, 20 bp, Artificial Sequence
  Description of Artificial Sequence: Synthetic oligonucleotide
  Target: SCN10A; (-) strand; PAM type: NRG; PAM sequence: GAG
ataaagactccagggcttag

SEQ ID NO: 15306 - DNA, 20 bp, Artificial Sequence
  Description of Artificial Sequence: Synthetic oligonucleotide
  Target: SCN10A; (-) strand; PAM type: NRG; PAM sequence: AGG
gtataaagactccagggctt

SEQ ID NO: 15307 - DNA, 20 bp, Artificial Sequence
  Description of Artificial Sequence: Synthetic oligonucleotide
  Target: SCN10A; (-) strand; PAM type: NRG; PAM sequence: TAG
tgtataaagactccagggct

SEQ ID NO: 15308 - DNA, 20 bp, Artificial Sequence
  Description of Artificial Sequence: Synthetic oligonucleotide
  Target: SCN10A; (-) strand; PAM type: NRG; PAM sequence: GGG
ttctctgtataaagactcca

SEQ ID NO: 15309 - DNA, 20 bp, Artificial Sequence
  Description of Artificial Sequence: Synthetic oligonucleotide
  Target: SCN10A; (-) strand; PAM type: NRG; PAM sequence: AGG
attctctgtataaagactcc

SEQ ID NO: 15310 - DNA, 20 bp, Artificial Sequence
  Description of Artificial Sequence: Synthetic oligonucleotide
  Target: SCN10A; (-) strand; PAM type: NRG; PAM sequence: CAG
gattctctgtataaagactc

SEQ ID NO: 15311 - DNA, 20 bp, Artificial Sequence
  Description of Artificial Sequence: Synthetic oligonucleotide
  Target: SCN10A; (-) strand; PAM type: NRG; PAM sequence: AAG
cacttctgattctctgtata

SEQ ID NO: 15312 - DNA, 20 bp, Artificial Sequence
  Description of Artificial Sequence: Synthetic oligonucleotide
  Target: SCN10A; (-) strand; PAM type: NRG; PAM sequence: AGG
ccacttctgatttcacctgc

SEQ ID NO: 15313 - DNA, 20 bp, Artificial Sequence
  Description of Artificial Sequence: Synthetic oligonucleotide
  Target: SCN10A; (-) strand; PAM type: NRG; PAM sequence: CAG
cccacttctgatttcacctg

SEQ ID NO: 15314 - DNA, 20 bp, Artificial Sequence
  Description of Artificial Sequence: Synthetic oligonucleotide
  Target: SCN10A; (-) strand; PAM type: NRG; PAM sequence: TAG
ttccctgccacctcttccct

SEQ ID NO: 15315 - DNA, 20 bp, Artificial Sequence
  Description of Artificial Sequence: Synthetic oligonucleotide
  Target: SCN10A; (-) strand; PAM type: NRG; PAM sequence: AGG
tgaccacttcctgctgtggc

SEQ ID NO: 15316 - DNA, 20 bp, Artificial Sequence
  Description of Artificial Sequence: Synthetic oligonucleotide
  Target: SCN10A; (-) strand; PAM type: NRG; PAM sequence: CAG
atgaccacttcctgctgtgg

SEQ ID NO: 15317 - DNA, 20 bp, Artificial Sequence
  Description of Artificial Sequence: Synthetic oligonucleotide
  Target: SCN10A; (-) strand; PAM type: NRG; PAM sequence: TGG
ggaatgaccacttcctgctg

SEQ ID NO: 15318 - DNA, 20 bp, Artificial Sequence
  Description of Artificial Sequence: Synthetic oligonucleotide
  Target: SCN10A; (-) strand; PAM type: NRG; PAM sequence: GGG
aggctggggagacactattg

SEQ ID NO: 15319 - DNA, 20 bp, Artificial Sequence
  Description of Artificial Sequence: Synthetic oligonucleotide
  Target: SCN10A; (-) strand; PAM type: NRG; PAM sequence: GGG
caggctggggagacactatt

SEQ ID NO: 15320 - DNA, 20 bp, Artificial Sequence
  Description of Artificial Sequence: Synthetic oligonucleotide
  Target: SCN10A; (-) strand; PAM type: NRG; PAM sequence: TGG
ccaggctggggagacactat

SEQ ID NO: 15321 - DNA, 20 bp, Artificial Sequence
  Description of Artificial Sequence: Synthetic oligonucleotide
  Target: SCN10A; (-) strand; PAM type: NRG; PAM sequence: GAG
aaagaaaaagccaggctggg

SEQ ID NO: 15322 - DNA, 20 bp, Artificial Sequence
  Description of Artificial Sequence: Synthetic oligonucleotide
  Target: SCN10A; (-) strand; PAM type: NRG; PAM sequence: GGG
gaaaagaaaaagccaggctg

SEQ ID NO: 15323 - DNA, 20 bp, Artificial Sequence
  Description of Artificial Sequence: Synthetic oligonucleotide
  Target: SCN10A; (-) strand; PAM type: NRG; PAM sequence: GGG
agaaaagaaaaagccaggct

SEQ ID NO: 15324 - DNA, 20 bp, Artificial Sequence
  Description of Artificial Sequence: Synthetic oligonucleotide
  Target: SCN10A; (-) strand; PAM type: NRG; PAM sequence: TGG
aagaaaagaaaaagccaggc

SEQ ID NO: 15325 - DNA, 20 bp, Artificial Sequence
  Description of Artificial Sequence: Synthetic oligonucleotide
  Target: SCN10A; (-) strand; PAM type: NRG; PAM sequence: AGG
agaaaagaaaagaaaaagcc

SEQ ID NO: 15326 - DNA, 20 bp, Artificial Sequence
  Description of Artificial Sequence: Synthetic oligonucleotide
  Target: SCN10A; (-) strand; PAM type: NRG; PAM sequence: CAG
aagaaaagaaaagaaaaagc

SEQ ID NO: 15327 - DNA, 20 bp, Artificial Sequence
  Description of Artificial Sequence: Synthetic oligonucleotide
  Target: SCN10A; (-) strand; PAM type: NRG; PAM sequence: AAG
aaaaaagaaaagaaaagaaa

SEQ ID NO: 15328 - DNA, 20 bp, Artificial Sequence
  Description of Artificial Sequence: Synthetic oligonucleotide
  Target: SCN10A; (-) strand; PAM type: NRG; PAM sequence: AAG
ctcaaaaaaaaagaaaagaa

SEQ ID NO: 15329 - DNA, 20 bp, Artificial Sequence
  Description of Artificial Sequence: Synthetic oligonucleotide
  Target: SCN10A; (-) strand; PAM type: NRG; PAM sequence: AAG
tcaatctcaaaaaaaaagaa

SEQ ID NO: 15330 - DNA, 20 bp, Artificial Sequence
  Description of Artificial Sequence: Synthetic oligonucleotide
  Target: SCN10A; (-) strand; PAM type: NRG; PAM sequence: AAG
gagactcaatctcaaaaaaa

SEQ ID NO: 15331 - DNA, 20 bp, Artificial Sequence
  Description of Artificial Sequence: Synthetic oligonucleotide
  Target: SCN10A; (-) strand; PAM type: NRG; PAM sequence: GAG
tccagcttgggcgagacagc

SEQ ID NO: 15332 - DNA, 20 bp, Artificial Sequence
  Description of Artificial Sequence: Synthetic oligonucleotide
  Target: SCN10A; (-) strand; PAM type: NRG; PAM sequence: CAG
gcactccagcttgggcgaga

SEQ ID NO: 15333 - DNA, 20 bp, Artificial Sequence
  Description of Artificial Sequence: Synthetic oligonucleotide
  Target: SCN10A; (-) strand; PAM type: NRG; PAM sequence: GAG
cactgcactccagcttgggc

SEQ ID NO: 15334 - DNA, 20 bp, Artificial Sequence
  Description of Artificial Sequence: Synthetic oligonucleotide
  Target: SCN10A; (-) strand; PAM type: NRG; PAM sequence: GGG
gcgtcactgcactccagctt

SEQ ID NO: 15335 - DNA, 20 bp, Artificial Sequence
  Description of Artificial Sequence: Synthetic oligonucleotide
  Target: SCN10A; (-) strand; PAM type: NRG; PAM sequence: TGG
tgcgtcactgcactccagct

SEQ ID NO: 15336 - DNA, 20 bp, Artificial Sequence
  Description of Artificial Sequence: Synthetic oligonucleotide
  Target: SCN10A; (-) strand; PAM type: NRG; PAM sequence: CAG
gagattgcgtcactgcactc

SEQ ID NO: 15337 - DNA, 20 bp, Artificial Sequence
  Description of Artificial Sequence: Synthetic oligonucleotide
  Target: SCN10A; (-) strand; PAM type: NRG; PAM sequence: GAG
ggcagaagttgcagtgagct

SEQ ID NO: 15338 - DNA, 20 bp, Artificial Sequence
  Description of Artificial Sequence: Synthetic oligonucleotide
  Target: SCN10A; (-) strand; PAM type: NRG; PAM sequence: GAG
cgggaggcagaagttgcagt

SEQ ID NO: 15339 - DNA, 20 bp, Artificial Sequence
  Description of Artificial Sequence: Synthetic oligonucleotide
  Target: SCN10A; (-) strand; PAM type: NRG; PAM sequence: CAG
aacccgggaggcagaagttg

SEQ ID NO: 15340 - DNA, 20 bp, Artificial Sequence
  Description of Artificial Sequence: Synthetic oligonucleotide
  Target: SCN10A; (-) strand; PAM type: NRG; PAM sequence: AAG
ctcttgaacccgggaggcag

SEQ ID NO: 15341 - DNA, 20 bp, Artificial Sequence
  Description of Artificial Sequence: Synthetic oligonucleotide
  Target: SCN10A; (-) strand; PAM type: NRG; PAM sequence: CAG
aatctcttgaacccgggagg

SEQ ID NO: 15342 - DNA, 20 bp, Artificial Sequence
  Description of Artificial Sequence: Synthetic oligonucleotide
  Target: SCN10A; (-) strand; PAM type: NRG; PAM sequence: AGG
gagaatctcttgaacccggg

SEQ ID NO: 15343 - DNA, 20 bp, Artificial Sequence
  Description of Artificial Sequence: Synthetic oligonucleotide
  Target: SCN10A; (-) strand; PAM type: NRG; PAM sequence: GAG
ggagaatctcttgaacccgg

SEQ ID NO: 15344 - DNA, 20 bp, Artificial Sequence
  Description of Artificial Sequence: Synthetic oligonucleotide
  Target: SCN10A; (-) strand; PAM type: NRG; PAM sequence: GGG
caggagaatctcttgaaccc

SEQ ID NO: 15345 - DNA, 20 bp, Artificial Sequence
  Description of Artificial Sequence: Synthetic oligonucleotide
  Target: SCN10A; (-) strand; PAM type: NRG; PAM sequence: CGG
acaggagaatctcttgaacc

SEQ ID NO: 15346 - DNA, 20 bp, Artificial Sequence
  Description of Artificial Sequence: Synthetic oligonucleotide
  Target: SCN10A; (-) strand; PAM type: NRG; PAM sequence: GAG
tgctcgggagactgagacag

SEQ ID NO: 15347 - DNA, 20 bp, Artificial Sequence
  Description of Artificial Sequence: Synthetic oligonucleotide
  Target: SCN10A; (-) strand; PAM type: NRG; PAM sequence: AGG
gctgctcgggagactgagac

SEQ ID NO: 15348 - DNA, 20 bp, Artificial Sequence
  Description of Artificial Sequence: Synthetic oligonucleotide
  Target: SCN10A; (-) strand; PAM type: NRG; PAM sequence: CAG
agctgctcgggagactgaga

SEQ ID NO: 15349 - DNA, 20 bp, Artificial Sequence
  Description of Artificial Sequence: Synthetic oligonucleotide
  Target: SCN10A; (-) strand; PAM type: NRG; PAM sequence: GAG
tcccagctgctcgggagact

SEQ ID NO: 15350 - DNA, 20 bp, Artificial Sequence
  Description of Artificial Sequence: Synthetic oligonucleotide
  Target: SCN10A; (-) strand; PAM type: NRG; PAM sequence: GAG
ctgtagtcccagctgctcgg

SEQ ID NO: 15351 - DNA, 20 bp, Artificial Sequence
  Description of Artificial Sequence: Synthetic oligonucleotide
  Target: SCN10A; (-) strand; PAM type: NRG; PAM sequence: GGG
gcctgtagtcccagctgctc

SEQ ID NO: 15352 - DNA, 20 bp, Artificial Sequence
  Description of Artificial Sequence: Synthetic oligonucleotide
  Target: SCN10A; (-) strand; PAM type: NRG; PAM sequence: CGG
tgcctgtagtcccagctgct

SEQ ID NO: 15353 - DNA, 20 bp, Artificial Sequence
  Description of Artificial Sequence: Synthetic oligonucleotide
  Target: SCN10A; (-) strand; PAM type: NRG; PAM sequence: CAG
gcggcttgtgcctgtagtcc

SEQ ID NO: 15354 - DNA, 20 bp, Artificial Sequence
  Description of Artificial Sequence: Synthetic oligonucleotide
  Target: SCN10A; (-) strand; PAM type: NRG; PAM sequence: TAG
ggcatggcggcttgtgcctg

SEQ ID NO: 15355 - DNA, 20 bp, Artificial Sequence
  Description of Artificial Sequence: Synthetic oligonucleotide
  Target: SCN10A; (-) strand; PAM type: NRG; PAM sequence: CGG
aagaaattagcagggcatgg

SEQ ID NO: 15356 - DNA, 20 bp, Artificial Sequence
  Description of Artificial Sequence: Synthetic oligonucleotide
  Target: SCN10A; (-) strand; PAM type: NRG; PAM sequence: TGG
tgaaagaaattagcagggca

SEQ ID NO: 15357 - DNA, 20 bp, Artificial Sequence
  Description of Artificial Sequence: Synthetic oligonucleotide
  Target: SCN10A; (-) strand; PAM type: NRG; PAM sequence: GGG
aaatatgaaagaaattagca

SEQ ID NO: 15358 - DNA, 20 bp, Artificial Sequence
  Description of Artificial Sequence: Synthetic oligonucleotide
  Target: SCN10A; (-) strand; PAM type: NRG; PAM sequence: AGG
aaaatatgaaagaaattagc

SEQ ID NO: 15359 - DNA, 20 bp, Artificial Sequence
  Description of Artificial Sequence: Synthetic oligonucleotide
  Target: SCN10A; (-) strand; PAM type: NRG; PAM sequence: CAG
taaaatatgaaagaaattag

SEQ ID NO: 15360 - DNA, 20 bp, Artificial Sequence
  Description of Artificial Sequence: Synthetic oligonucleotide
  Target: SCN10A; (-) strand; PAM type: NRG; PAM sequence: TAG
tactaaaatatgaaagaaat

SEQ ID NO: 15361 - DNA, 20 bp, Artificial Sequence
  Description of Artificial Sequence: Synthetic oligonucleotide
  Target: SCN10A; (-) strand; PAM type: NRG; PAM sequence: AAG
ccatctctactaaaatatga

SEQ ID NO: 15362 - DNA, 20 bp, Artificial Sequence
  Description of Artificial Sequence: Synthetic oligonucleotide
  Target: SCN10A; (-) strand; PAM type: NRG; PAM sequence: CGG
ggagaccagcctgggcaata

SEQ ID NO: 15363 - DNA, 20 bp, Artificial Sequence
  Description of Artificial Sequence: Synthetic oligonucleotide
  Target: SCN10A; (-) strand; PAM type: NRG; PAM sequence: GGG
tgagctcaggagaccagcct

SEQ ID NO: 15364 - DNA, 20 bp, Artificial Sequence
  Description of Artificial Sequence: Synthetic oligonucleotide
  Target: SCN10A; (-) strand; PAM type: NRG; PAM sequence: TGG
ctgagctcaggagaccagcc

SEQ ID NO: 15365 - DNA, 20 bp, Artificial Sequence
  Description of Artificial Sequence: Synthetic oligonucleotide
  Target: SCN10A; (-) strand; PAM type: NRG; PAM sequence: CAG
attgcctgagctcaggagac

SEQ ID NO: 15366 - DNA, 20 bp, Artificial Sequence
  Description of Artificial Sequence: Synthetic oligonucleotide
  Target: SCN10A; (-) strand; PAM type: NRG; PAM sequence: GAG
ggcagattgcctgagctcag

SEQ ID NO: 15367 - DNA, 20 bp, Artificial Sequence
  Description of Artificial Sequence: Synthetic oligonucleotide
  Target: SCN10A; (-) strand; PAM type: NRG; PAM sequence: AGG
tgggcagattgcctgagctc

SEQ ID NO: 15368 - DNA, 20 bp, Artificial Sequence
  Description of Artificial Sequence: Synthetic oligonucleotide
  Target: SCN10A; (-) strand; PAM type: NRG; PAM sequence: CAG
gtgggcagattgcctgagct

SEQ ID NO: 15369 - DNA, 20 bp, Artificial Sequence
  Description of Artificial Sequence: Synthetic oligonucleotide
  Target: SCN10A; (-) strand; PAM type: NRG; PAM sequence: GAG
ccgaggtgggcagattgcct

SEQ ID NO: 15370 - DNA, 20 bp, Artificial Sequence
  Description of Artificial Sequence: Synthetic oligonucleotide
  Target: SCN10A; (-) strand; PAM type: NRG; PAM sequence: CAG
ctttgggaggccgaggtggg

SEQ ID NO: 15371 - DNA, 20 bp, Artificial Sequence
  Description of Artificial Sequence: Synthetic oligonucleotide
  Target: SCN10A; (-) strand; PAM type: NRG; PAM sequence: GGG
gcactttgggaggccgaggt

SEQ ID NO: 15372 - DNA, 20 bp, Artificial Sequence
  Description of Artificial Sequence: Synthetic oligonucleotide
  Target: SCN10A; (-) strand; PAM type: NRG; PAM sequence: TGG
agcactttgggaggccgagg

SEQ ID NO: 15373 - DNA, 20 bp, Artificial Sequence
  Description of Artificial Sequence: Synthetic oligonucleotide
  Target: SCN10A; (-) strand; PAM type: NRG; PAM sequence: AGG
cctagcactttgggaggccg

SEQ ID NO: 15374 - DNA, 20 bp, Artificial Sequence
  Description of Artificial Sequence: Synthetic oligonucleotide
  Target: SCN10A; (-) strand; PAM type: NRG; PAM sequence: GAG
tcctagcactttgggaggcc

SEQ ID NO: 15375 - DNA, 20 bp, Artificial Sequence
  Description of Artificial Sequence: Synthetic oligonucleotide
  Target: SCN10A; (-) strand; PAM type: NRG; PAM sequence: AGG
tgtaatcctagcactttggg

SEQ ID NO: 15376 - DNA, 20 bp, Artificial Sequence
  Description of Artificial Sequence: Synthetic oligonucleotide
  Target: SCN10A; (-) strand; PAM type: NRG; PAM sequence: GAG
ctgtaatcctagcactttgg

SEQ ID NO: 15377 - DNA, 20 bp, Artificial Sequence
  Description of Artificial Sequence: Synthetic oligonucleotide
  Target: SCN10A; (-) strand; PAM type: NRG; PAM sequence: GGG
gcctgtaatcctagcacttt

SEQ ID NO: 15378 - DNA, 20 bp, Artificial Sequence
  Description of Artificial Sequence: Synthetic oligonucleotide
  Target: SCN10A; (-) strand; PAM type: NRG; PAM sequence: TGG
tgcctgtaatcctagcactt

SEQ ID NO: 15379 - DNA, 20 bp, Artificial Sequence
  Description of Artificial Sequence: Synthetic oligonucleotide
  Target: SCN10A; (-) strand; PAM type: NRG; PAM sequence: TAG
gtggttcatgcctgtaatcc

SEQ ID NO: 15380 - DNA, 20 bp, Artificial Sequence
  Description of Artificial Sequence: Synthetic oligonucleotide
  Target: SCN10A; (-) strand; PAM type: NRG; PAM sequence: TGG
ccaggatgggccaggcgcag

SEQ ID NO: 15381 - DNA, 20 bp, Artificial Sequence
  Description of Artificial Sequence: Synthetic oligonucleotide
  Target: SCN10A; (-) strand; PAM type: NRG; PAM sequence: CAG
aacccaggatgggccaggcg

SEQ ID NO: 15382 - DNA, 20 bp, Artificial Sequence
  Description of Artificial Sequence: Synthetic oligonucleotide
  Target: SCN10A; (-) strand; PAM type: NRG; PAM sequence: AGG
cataaaacccaggatgggcc

SEQ ID NO: 15383 - DNA, 20 bp, Artificial Sequence
  Description of Artificial Sequence: Synthetic oligonucleotide
  Target: SCN10A; (-) strand; PAM type: NRG; PAM sequence: CAG
tcataaaacccaggatgggc

SEQ ID NO: 15384 - DNA, 20 bp, Artificial Sequence
  Description of Artificial Sequence: Synthetic oligonucleotide
  Target: SCN10A; (-) strand; PAM type: NRG; PAM sequence: GGG
actatcataaaacccaggat

SEQ ID NO: 15385 - DNA, 20 bp, Artificial Sequence
  Description of Artificial Sequence: Synthetic oligonucleotide
  Target: SCN10A; (-) strand; PAM type: NRG; PAM sequence: TGG
aactatcataaaacccagga

SEQ ID NO: 15386 - DNA, 20 bp, Artificial Sequence
  Description of Artificial Sequence: Synthetic oligonucleotide
  Target: SCN10A; (-) strand; PAM type: NRG; PAM sequence: AGG
caggaactatcataaaaccc

SEQ ID NO: 15387 - DNA, 20 bp, Artificial Sequence
  Description of Artificial Sequence: Synthetic oligonucleotide
  Target: SCN10A; (-) strand; PAM type: NRG; PAM sequence: CAG
tcaggaactatcataaaacc

SEQ ID NO: 15388 - DNA, 20 bp, Artificial Sequence
  Description of Artificial Sequence: Synthetic oligonucleotide
  Target: SCN10A; (-) strand; PAM type: NRG; PAM sequence: AGG
gaggaatgaggtagaatctc

SEQ ID NO: 15389 - DNA, 20 bp, Artificial Sequence
  Description of Artificial Sequence: Synthetic oligonucleotide
  Target: SCN10A; (-) strand; PAM type: NRG; PAM sequence: CAG
ggaggaatgaggtagaatct

SEQ ID NO: 15390 - DNA, 20 bp, Artificial Sequence
  Description of Artificial Sequence: Synthetic oligonucleotide
  Target: SCN10A; (-) strand; PAM type: NRG; PAM sequence: TAG
gtgcatagggaggaatgagg

SEQ ID NO: 15391 - DNA, 20 bp, Artificial Sequence
  Description of Artificial Sequence: Synthetic oligonucleotide
  Target: SCN10A; (-) strand; PAM type: NRG; PAM sequence: AGG
aaggtgcatagggaggaatg

SEQ ID NO: 15392 - DNA, 20 bp, Artificial Sequence
  Description of Artificial Sequence: Synthetic oligonucleotide
  Target: SCN10A; (-) strand; PAM type: NRG; PAM sequence: GAG
caaggtgcatagggaggaat

SEQ ID NO: 15393 - DNA, 20 bp, Artificial Sequence
  Description of Artificial Sequence: Synthetic oligonucleotide
  Target: SCN10A; (-) strand; PAM type: NRG; PAM sequence: AGG
ctaaatcaaggtgcataggg

SEQ ID NO: 15394 - DNA, 20 bp, Artificial Sequence
  Description of Artificial Sequence: Synthetic oligonucleotide
  Target: SCN10A; (-) strand; PAM type: NRG; PAM sequence: GAG
gctaaatcaaggtgcatagg

SEQ ID NO: 15395 - DNA, 20 bp, Artificial Sequence
  Description of Artificial Sequence: Synthetic oligonucleotide
  Target: SCN10A; (-) strand; PAM type: NRG; PAM sequence: GGG
tagctaaatcaaggtgcata

SEQ ID NO: 15396 - DNA, 20 bp, Artificial Sequence
  Description of Artificial Sequence: Synthetic oligonucleotide
  Target: SCN10A; (-) strand; PAM type: NRG; PAM sequence: AGG
gtagctaaatcaaggtgcat

SEQ ID NO: 15397 - DNA, 20 bp, Artificial Sequence
  Description of Artificial Sequence: Synthetic oligonucleotide
  Target: SCN10A; (-) strand; PAM type: NRG; PAM sequence: TAG
agtagctaaatcaaggtgca

SEQ ID NO: 15398 - DNA, 20 bp, Artificial Sequence
  Description of Artificial Sequence: Synthetic oligonucleotide
  Target: SCN10A; (-) strand; PAM type: NRG; PAM sequence: AGG
caagggtagtagctaaatca

SEQ ID NO: 15399 - DNA, 20 bp, Artificial Sequence
  Description of Artificial Sequence: Synthetic oligonucleotide
  Target: SCN10A; (-) strand; PAM type: NRG; PAM sequence: AAG
gcaagggtagtagctaaatc

SEQ ID NO: 15400 - DNA, 20 bp, Artificial Sequence
  Description of Artificial Sequence: Synthetic oligonucleotide
  Target: SCN10A; (-) strand; PAM type: NRG; PAM sequence: TAG
tgggagcaaagcaagggtag

SEQ ID NO: 15401 - DNA, 20 bp, Artificial Sequence
  Description of Artificial Sequence: Synthetic oligonucleotide
  Target: SCN10A; (-) strand; PAM type: NRG; PAM sequence: TAG
gggtgggagcaaagcaaggg

SEQ ID NO: 15402 - DNA, 20 bp, Artificial Sequence
  Description of Artificial Sequence: Synthetic oligonucleotide
  Target: SCN10A; (-) strand; PAM type: NRG; PAM sequence: GGG
caagggtgggagcaaagcaa

SEQ ID NO: 15403 - DNA, 20 bp, Artificial Sequence
  Description of Artificial Sequence: Synthetic oligonucleotide
  Target: SCN10A; (-) strand; PAM type: NRG; PAM sequence: AGG
acaagggtgggagcaaagca

SEQ ID NO: 15404 - DNA, 20 bp, Artificial Sequence
  Description of Artificial Sequence: Synthetic oligonucleotide
  Target: SCN10A; (-) strand; PAM type: NRG; PAM sequence: AAG
gacaagggtgggagcaaagc

SEQ ID NO: 15405 - DNA, 20 bp, Artificial Sequence
  Description of Artificial Sequence: Synthetic oligonucleotide
  Target: SCN10A; (-) strand; PAM type: NRG; PAM sequence: AAG
cctggacaagggtgggagca

SEQ ID NO: 15406 - DNA, 20 bp, Artificial Sequence
  Description of Artificial Sequence: Synthetic oligonucleotide
  Target: SCN10A; (-) strand; PAM type: NRG; PAM sequence: GAG
cactccctggacaagggtgg

SEQ ID NO: 15407 - DNA, 20 bp, Artificial Sequence
  Description of Artificial Sequence: Synthetic oligonucleotide
  Target: SCN10A; (-) strand; PAM type: NRG; PAM sequence: GGG
gccactccctggacaagggt

SEQ ID NO: 15408 - DNA, 20 bp, Artificial Sequence
  Description of Artificial Sequence: Synthetic oligonucleotide
  Target: SCN10A; (-) strand; PAM type: NRG; PAM sequence: TGG
agccactccctggacaaggg

SEQ ID NO: 15409 - DNA, 20 bp, Artificial Sequence
  Description of Artificial Sequence: Synthetic oligonucleotide
  Target: SCN10A; (-) strand; PAM type: NRG; PAM sequence: GGG
gtgagccactccctggacaa

SEQ ID NO: 15410 - DNA, 20 bp, Artificial Sequence
  Description of Artificial Sequence: Synthetic oligonucleotide
  Target: SCN10A; (-) strand; PAM type: NRG; PAM sequence: AGG
tgtgagccactccctggaca

SEQ ID NO: 15411 - DNA, 20 bp, Artificial Sequence
  Description of Artificial Sequence: Synthetic oligonucleotide
  Target: SCN10A; (-) strand; PAM type: NRG; PAM sequence: AAG
atgtgagccactccctggac

SEQ ID NO: 15412 - DNA, 20 bp, Artificial Sequence
  Description of Artificial Sequence: Synthetic oligonucleotide
  Target: SCN10A; (-) strand; PAM type: NRG; PAM sequence: TGG
agttcatgtgagccactccc

SEQ ID NO: 15413 - DNA, 20 bp, Artificial Sequence
  Description of Artificial Sequence: Synthetic oligonucleotide
  Target: SCN10A; (-) strand; PAM type: NRG; PAM sequence: GAG
ctctaagagacagttcatgt

SEQ ID NO: 15414 - DNA, 20 bp, Artificial Sequence
  Description of Artificial Sequence: Synthetic oligonucleotide
  Target: SCN10A; (-) strand; PAM type: NRG; PAM sequence: CAG
atcagataacctctaagaga

SEQ ID NO: 15415 - DNA, 20 bp, Artificial Sequence
  Description of Artificial Sequence: Synthetic oligonucleotide
  Target: SCN10A; (-) strand; PAM type: NRG; PAM sequence: GAG
aagcatcagataacctctaa

SEQ ID NO: 15416 - DNA, 20 bp, Artificial Sequence
  Description of Artificial Sequence: Synthetic oligonucleotide
  Target: SCN10A; (-) strand; PAM type: NRG; PAM sequence: AAG
gaaagcatcagataacctct

SEQ ID NO: 15417 - DNA, 20 bp, Artificial Sequence
  Description of Artificial Sequence: Synthetic oligonucleotide
  Target: SCN10A; (-) strand; PAM type: NRG; PAM sequence: CAG
ttcactgttgaggaaagcat

SEQ ID NO: 15418 - DNA, 20 bp, Artificial Sequence
  Description of Artificial Sequence: Synthetic oligonucleotide
  Target: SCN10A; (-) strand; PAM type: NRG; PAM sequence: AAG
cctctgttcactgttgagga

SEQ ID NO: 15419 - DNA, 20 bp, Artificial Sequence
  Description of Artificial Sequence: Synthetic oligonucleotide
  Target: SCN10A; (-) strand; PAM type: NRG; PAM sequence: AGG
ttttcctctgttcactgttg

SEQ ID NO: 15420 - DNA, 20 bp, Artificial Sequence
  Description of Artificial Sequence: Synthetic oligonucleotide
  Target: SCN10A; (-) strand; PAM type: NRG; PAM sequence: GAG
gttttcctctgttcactgtt

SEQ ID NO: 15421 - DNA, 20 bp, Artificial Sequence
  Description of Artificial Sequence: Synthetic oligonucleotide
  Target: SCN10A; (-) strand; PAM type: NRG; PAM sequence: AGG
tacactccccaggcttctcg

SEQ ID NO: 15422 - DNA, 20 bp, Artificial Sequence
  Description of Artificial Sequence: Synthetic oligonucleotide
  Target: SCN10A; (-) strand; PAM type: NRG; PAM sequence: GAG
ctacactccccaggcttctc

SEQ ID NO: 15423 - DNA, 20 bp, Artificial Sequence
  Description of Artificial Sequence: Synthetic oligonucleotide
  Target: SCN10A; (-) strand; PAM type: NRG; PAM sequence: AGG
ccctttcatctacactcccc

SEQ ID NO: 15424 - DNA, 20 bp, Artificial Sequence
  Description of Artificial Sequence: Synthetic oligonucleotide
  Target: SCN10A; (-) strand; PAM type: NRG; PAM sequence: CAG
cccctttcatctacactccc

SEQ ID NO: 15425 - DNA, 20 bp, Artificial Sequence
  Description of Artificial Sequence: Synthetic oligonucleotide
  Target: SCN10A; (-) strand; PAM type: NRG; PAM sequence: AGG
gttgagtgtttcagccaccg

SEQ ID NO: 15426 - DNA, 20 bp, Artificial Sequence
  Description of Artificial Sequence: Synthetic oligonucleotide
  Target: SCN10A; (-) strand; PAM type: NRG; PAM sequence: GAG
tgttgagtgtttcagccacc

SEQ ID NO: 15427 - DNA, 20 bp, Artificial Sequence
  Description of Artificial Sequence: Synthetic oligonucleotide
  Target: SCN10A; (-) strand; PAM type: NRG; PAM sequence: CAG
tggctctctgttgagtgttt

SEQ ID NO: 15428 - DNA, 20 bp, Artificial Sequence
  Description of Artificial Sequence: Synthetic oligonucleotide
  Target: SCN10A; (-) strand; PAM type: NRG; PAM sequence: GAG
tgtccagctggctctctgtt

SEQ ID NO: 15429 - DNA, 20 bp, Artificial Sequence
  Description of Artificial Sequence: Synthetic oligonucleotide
  Target: SCN10A; (-) strand; PAM type: NRG; PAM sequence: TGG
tccttgcagcagtgtccagc

SEQ ID NO: 15430 - DNA, 20 bp, Artificial Sequence
  Description of Artificial Sequence: Synthetic oligonucleotide
  Target: SCN10A; (-) strand; PAM type: NRG; PAM sequence: CAG
tccctccttgcagcagtgtc

SEQ ID NO: 15431 - DNA, 20 bp, Artificial Sequence
  Description of Artificial Sequence: Synthetic oligonucleotide
  Target: SCN10A; (-) strand; PAM type: NRG; PAM sequence: CAG
cacactgtccctccttgcag

SEQ ID NO: 15432 - DNA, 20 bp, Artificial Sequence
  Description of Artificial Sequence: Synthetic oligonucleotide
  Target: SCN10A; (-) strand; PAM type: NRG; PAM sequence: CAG
cctcacactgtccctccttg

SEQ ID NO: 15433 - DNA, 20 bp, Artificial Sequence
  Description of Artificial Sequence: Synthetic oligonucleotide
  Target: SCN10A; (-) strand; PAM type: NRG; PAM sequence: CAG
tactggaagaggcgatcacc

SEQ ID NO: 15434 - DNA, 20 bp, Artificial Sequence
  Description of Artificial Sequence: Synthetic oligonucleotide
  Target: SCN10A; (-) strand; PAM type: NRG; PAM sequence: AGG
gatgaccctggtactggaag

SEQ ID NO: 15435 - DNA, 20 bp, Artificial Sequence
  Description of Artificial Sequence: Synthetic oligonucleotide
  Target: SCN10A; (-) strand; PAM type: NRG; PAM sequence: GAG
cgatgaccctggtactggaa

SEQ ID NO: 15436 - DNA, 20 bp, Artificial Sequence
  Description of Artificial Sequence: Synthetic oligonucleotide
  Target: SCN10A; (-) strand; PAM type: NRG; PAM sequence: AAG
gacgatgaccctggtactgg

SEQ ID NO: 15437 - DNA, 20 bp, Artificial Sequence
  Description of Artificial Sequence: Synthetic oligonucleotide
  Target: SCN10A; (-) strand; PAM type: NRG; PAM sequence: TGG
agtgacgatgaccctggtac

SEQ ID NO: 15438 - DNA, 20 bp, Artificial Sequence
  Description of Artificial Sequence: Synthetic oligonucleotide
  Target: SCN10A; (-) strand; PAM type: NRG; PAM sequence: TGG
aaatgaagtgacgatgaccc

SEQ ID NO: 15439 - DNA, 20 bp, Artificial Sequence
  Description of Artificial Sequence: Synthetic oligonucleotide
  Target: SCN10A; (-) strand; PAM type: NRG; PAM sequence: AAG
atcagtctgcatttgaaatg

SEQ ID NO: 15440 - DNA, 20 bp, Artificial Sequence
  Description of Artificial Sequence: Synthetic oligonucleotide
  Target: SCN10A; (-) strand; PAM type: NRG; PAM sequence: CAG
tctgtgcattctacccatat

SEQ ID NO: 15441 - DNA, 20 bp, Artificial Sequence
  Description of Artificial Sequence: Synthetic oligonucleotide
  Target: SCN10A; (-) strand; PAM type: NRG; PAM sequence: CAG
gtctcagcccactgtcccta

SEQ ID NO: 15442 - DNA, 20 bp, Artificial Sequence
  Description of Artificial Sequence: Synthetic oligonucleotide
  Target: SCN10A; (-) strand; PAM type: NRG; PAM sequence: CAG
gattcccgggaggtgagtct

SEQ ID NO: 15443 - DNA, 20 bp, Artificial Sequence
  Description of Artificial Sequence: Synthetic oligonucleotide
  Target: SCN10A; (-) strand; PAM type: NRG; PAM sequence: GAG
gctgttgattcccgggaggt

SEQ ID NO: 15444 - DNA, 20 bp, Artificial Sequence
  Description of Artificial Sequence: Synthetic oligonucleotide
  Target: SCN10A; (-) strand; PAM type: NRG; PAM sequence: AGG
tgcagctgttgattcccggg

SEQ ID NO: 15445 - DNA, 20 bp, Artificial Sequence
  Description of Artificial Sequence: Synthetic oligonucleotide
  Target: SCN10A; (-) strand; PAM type: NRG; PAM sequence: GAG
atgcagctgttgattcccgg

SEQ ID NO: 15446 - DNA, 20 bp, Artificial Sequence
  Description of Artificial Sequence: Synthetic oligonucleotide
  Target: SCN10A; (-) strand; PAM type: NRG; PAM sequence: GGG
gtatgcagctgttgattccc

SEQ ID NO: 15447 - DNA, 20 bp, Artificial Sequence
  Description of Artificial Sequence: Synthetic oligonucleotide
  Target: SCN10A; (-) strand; PAM type: NRG; PAM sequence: CGG
tgtatgcagctgttgattcc

SEQ ID NO: 15448 - DNA, 20 bp, Artificial Sequence
  Description of Artificial Sequence: Synthetic oligonucleotide
  Target: SCN10A; (-) strand; PAM type: NRG; PAM sequence: CAG
ctggatggacattatgtatg

SEQ ID NO: 15449 - DNA, 20 bp, Artificial Sequence
  Description of Artificial Sequence: Synthetic oligonucleotide
  Target: SCN10A; (-) strand; PAM type: NRG; PAM sequence: TGG
ggcaacctttaaaggctgga

SEQ ID NO: 15450 - DNA, 20 bp, Artificial Sequence
  Description of Artificial Sequence: Synthetic oligonucleotide
  Target: SCN10A; (-) strand; PAM type: NRG; PAM sequence: TGG
tccaggcaacctttaaaggc

SEQ ID NO: 15451 - DNA, 20 bp, Artificial Sequence
  Description of Artificial Sequence: Synthetic oligonucleotide
  Target: SCN10A; (-) strand; PAM type: NRG; PAM sequence: AGG
tgtctccaggcaacctttaa

SEQ ID NO: 15452 - DNA, 20 bp, Artificial Sequence
  Description of Artificial Sequence: Synthetic oligonucleotide
  Target: SCN10A; (-) strand; PAM type: NRG; PAM sequence: AAG
ttgtctccaggcaaccttta

SEQ ID NO: 15453 - DNA, 20 bp, Artificial Sequence
  Description of Artificial Sequence: Synthetic oligonucleotide
  Target: SCN10A; (-) strand; PAM type: NRG; PAM sequence: AGG
ggcctctgctccttgtctcc

SEQ ID NO: 15454 - DNA, 20 bp, Artificial Sequence
  Description of Artificial Sequence: Synthetic oligonucleotide
  Target: SCN10A; (-) strand; PAM type: NRG; PAM sequence: CAG
tggcctctgctccttgtctc

SEQ ID NO: 15455 - DNA, 20 bp, Artificial Sequence
  Description of Artificial Sequence: Synthetic oligonucleotide
  Target: SCN10A; (-) strand; PAM type: NRG; PAM sequence: TGG
atggatgggcagacactgag

SEQ ID NO: 15456 - DNA, 20 bp, Artificial Sequence
  Description of Artificial Sequence: Synthetic oligonucleotide
  Target: SCN10A; (-) strand; PAM type: NRG; PAM sequence: GAG
tagatggatgggcagacact

SEQ ID NO: 15457 - DNA, 20 bp, Artificial Sequence
  Description of Artificial Sequence: Synthetic oligonucleotide
  Target: SCN10A; (-) strand; PAM type: NRG; PAM sequence: CAG
gtccagtatagatggatggg

SEQ ID NO: 15458 - DNA, 20 bp, Artificial Sequence
  Description of Artificial Sequence: Synthetic oligonucleotide
  Target: SCN10A; (-) strand; PAM type: NRG; PAM sequence: GGG
agggtccagtatagatggat

SEQ ID NO: 15459 - DNA, 20 bp, Artificial Sequence
  Description of Artificial Sequence: Synthetic oligonucleotide
  Target: SCN10A; (-) strand; PAM type: NRG; PAM sequence: TGG
aagggtccagtatagatgga

SEQ ID NO: 15460 - DNA, 20 bp, Artificial Sequence
  Description of Artificial Sequence: Synthetic oligonucleotide
  Target: SCN10A; (-) strand; PAM type: NRG; PAM sequence: TGG
tgggaagggtccagtataga

SEQ ID NO: 15461 - DNA, 20 bp, Artificial Sequence
  Description of Artificial Sequence: Synthetic oligonucleotide
  Target: SCN10A; (-) strand; PAM type: NRG; PAM sequence: TAG
ggcttgggaagggtccagta

SEQ ID NO: 15462 - DNA, 20 bp, Artificial Sequence
  Description of Artificial Sequence: Synthetic oligonucleotide
  Target: SCN10A; (-) strand; PAM type: NRG; PAM sequence: CAG
accatggcttgggaagggtc

SEQ ID NO: 15463 - DNA, 20 bp, Artificial Sequence
  Description of Artificial Sequence: Synthetic oligonucleotide
  Target: SCN10A; (-) strand; PAM type: NRG; PAM sequence: GGG
gggccaccatggcttgggaa

SEQ ID NO: 15464 - DNA, 20 bp, Artificial Sequence
  Description of Artificial Sequence: Synthetic oligonucleotide
  Target: SCN10A; (-) strand; PAM type: NRG; PAM sequence: AGG
tgggccaccatggcttggga

SEQ ID NO: 15465 - DNA, 20 bp, Artificial Sequence
  Description of Artificial Sequence: Synthetic oligonucleotide
  Target: SCN10A; (-) strand; PAM type: NRG; PAM sequence: AAG
ctgggccaccatggcttggg

SEQ ID NO: 15466 - DNA, 20 bp, Artificial Sequence
  Description of Artificial Sequence: Synthetic oligonucleotide
  Target: SCN10A; (-) strand; PAM type: NRG; PAM sequence: GGG
tcactgggccaccatggctt

SEQ ID NO: 15467 - DNA, 20 bp, Artificial Sequence
  Description of Artificial Sequence: Synthetic oligonucleotide
  Target: SCN10A; (-) strand; PAM type: NRG; PAM sequence: TGG
ctcactgggccaccatggct

SEQ ID NO: 15468 - DNA, 20 bp, Artificial Sequence
  Description of Artificial Sequence: Synthetic oligonucleotide
  Target: SCN10A; (-) strand; PAM type: NRG; PAM sequence: TGG
cctctctcactgggccacca

SEQ ID NO: 15469 - DNA, 20 bp, Artificial Sequence
  Description of Artificial Sequence: Synthetic oligonucleotide
  Target: SCN10A; (-) strand; PAM type: NRG; PAM sequence: GGG
ggactctctcctctctcact

SEQ ID NO: 15470 - DNA, 20 bp, Artificial Sequence
  Description of Artificial Sequence: Synthetic oligonucleotide
  Target: SCN10A; (-) strand; PAM type: NRG; PAM sequence: TGG
aggactctctcctctctcac

SEQ ID NO: 15471 - DNA, 20 bp, Artificial Sequence
  Description of Artificial Sequence: Synthetic oligonucleotide
  Target: SCN10A; (-) strand; PAM type: NRG; PAM sequence: AGG
gcacaagccctttccaacac

SEQ ID NO: 15472 - DNA, 20 bp, Artificial Sequence
  Description of Artificial Sequence: Synthetic oligonucleotide
  Target: SCN10A; (-) strand; PAM type: NRG; PAM sequence: CAG
tgcacaagccctttccaaca

SEQ ID NO: 15473 - DNA, 20 bp, Artificial Sequence
  Description of Artificial Sequence: Synthetic oligonucleotide
  Target: SCN10A; (-) strand; PAM type: NRG; PAM sequence: AAG
tcctttcattctttctgcac

SEQ ID NO: 15474 - DNA, 20 bp, Artificial Sequence
  Description of Artificial Sequence: Synthetic oligonucleotide
  Target: SCN10A; (-) strand; PAM type: NRG; PAM sequence: GGG
agattagtcaagtaacccaa

SEQ ID NO: 15475 - DNA, 20 bp, Artificial Sequence
  Description of Artificial Sequence: Synthetic oligonucleotide
  Target: SCN10A; (-) strand; PAM type: NRG; PAM sequence: AGG
gagattagtcaagtaaccca

SEQ ID NO: 15476 - DNA, 20 bp, Artificial Sequence
  Description of Artificial Sequence: Synthetic oligonucleotide
  Target: SCN10A; (-) strand; PAM type: NRG; PAM sequence: AAG
tgagattagtcaagtaaccc

SEQ ID NO: 15477 - DNA, 20 bp, Artificial Sequence
  Description of Artificial Sequence: Synthetic oligonucleotide
  Target: SCN10A; (-) strand; PAM type: NRG; PAM sequence: AAG
atcatcatatgagattagtc

SEQ ID NO: 15478 - DNA, 20 bp, Artificial Sequence
  Description of Artificial Sequence: Synthetic oligonucleotide
  Target: SCN10A; (-) strand; PAM type: NRG; PAM sequence: TAG
tttaaatcatcatatgagat

SEQ ID NO: 15479 - DNA, 20 bp, Artificial Sequence
  Description of Artificial Sequence: Synthetic oligonucleotide
  Target: SCN10A; (-) strand; PAM type: NRG; PAM sequence: GAG
attactttaaatcatcatat

SEQ ID NO: 15480 - DNA, 20 bp, Artificial Sequence
  Description of Artificial Sequence: Synthetic oligonucleotide
  Target: SCN10A; (-) strand; PAM type: NRG; PAM sequence: GGG
attcttaaacagccacatgt

SEQ ID NO: 15481 - DNA, 20 bp, Artificial Sequence
  Description of Artificial Sequence: Synthetic oligonucleotide
  Target: SCN10A; (-) strand; PAM type: NRG; PAM sequence: TGG
tattcttaaacagccacatg

SEQ ID NO: 15482 - DNA, 20 bp, Artificial Sequence
  Description of Artificial Sequence: Synthetic oligonucleotide
  Target: SCN10A; (-) strand; PAM type: NRG; PAM sequence: CAG
aatgctactctattcttaaa

SEQ ID NO: 15483 - DNA, 20 bp, Artificial Sequence
  Description of Artificial Sequence: Synthetic oligonucleotide
  Target: SCN10A; (-) strand; PAM type: NRG; PAM sequence: AGG
agtccatactacattctgaa

SEQ ID NO: 15484 - DNA, 20 bp, Artificial Sequence
  Description of Artificial Sequence: Synthetic oligonucleotide
  Target: SCN10A; (-) strand; PAM type: NRG; PAM sequence: AAG
cagtccatactacattctga

SEQ ID NO: 15485 - DNA, 20 bp, Artificial Sequence
  Description of Artificial Sequence: Synthetic oligonucleotide
  Target: SCN10A; (-) strand; PAM type: NRG; PAM sequence: CAG
acacctagacactcagtcct

SEQ ID NO: 15486 - DNA, 20 bp, Artificial Sequence
  Description of Artificial Sequence: Synthetic oligonucleotide
  Target: SCN10A; (-) strand; PAM type: NRG; PAM sequence: CAG
gaaccagacacctagacact

SEQ ID NO: 15487 - DNA, 20 bp, Artificial Sequence
  Description of Artificial Sequence: Synthetic oligonucleotide
  Target: SCN10A; (-) strand; PAM type: NRG; PAM sequence: TAG
tggcactagaaccagacacc

SEQ ID NO: 15488 - DNA, 20 bp, Artificial Sequence
  Description of Artificial Sequence: Synthetic oligonucleotide
  Target: SCN10A; (-) strand; PAM type: NRG; PAM sequence: CAG
gtagcaattggcactagaac

SEQ ID NO: 15489 - DNA, 20 bp, Artificial Sequence
  Description of Artificial Sequence: Synthetic oligonucleotide
  Target: SCN10A; (-) strand; PAM type: NRG; PAM sequence: TAG
agacttgtagcaattggcac

SEQ ID NO: 15490 - DNA, 20 bp, Artificial Sequence
  Description of Artificial Sequence: Synthetic oligonucleotide
  Target: SCN10A; (-) strand; PAM type: NRG; PAM sequence: TGG
cagagcagacttgtagcaat

SEQ ID NO: 15491 - DNA, 20 bp, Artificial Sequence
  Description of Artificial Sequence: Synthetic oligonucleotide
  Target: SCN10A; (-) strand; PAM type: NRG; PAM sequence: TAG
aagtgcacagagcagacttg

SEQ ID NO: 15492 - DNA, 20 bp, Artificial Sequence
  Description of Artificial Sequence: Synthetic oligonucleotide
  Target: SCN10A; (-) strand; PAM type: NRG; PAM sequence: CAG
ccttaggcaagtgcacagag

SEQ ID NO: 15493 - DNA, 20 bp, Artificial Sequence
  Description of Artificial Sequence: Synthetic oligonucleotide
  Target: SCN10A; (-) strand; PAM type: NRG; PAM sequence: GAG
aaaccttaggcaagtgcaca

SEQ ID NO: 15494 - DNA, 20 bp, Artificial Sequence
  Description of Artificial Sequence: Synthetic oligonucleotide
  Target: SCN10A; (-) strand; PAM type: NRG; PAM sequence: CAG
ggaaaccttaggcaagtgca

SEQ ID NO: 15495 - DNA, 20 bp, Artificial Sequence
  Description of Artificial Sequence: Synthetic oligonucleotide
  Target: SCN10A; (-) strand; PAM type: NRG; PAM sequence: AAG
tgagaggggaaaccttaggc

SEQ ID NO: 15496 - DNA, 20 bp, Artificial Sequence
  Description of Artificial Sequence: Synthetic oligonucleotide
  Target: SCN10A; (-) strand; PAM type: NRG; PAM sequence: AGG
gccctgagaggggaaacctt

SEQ ID NO: 15497 - DNA, 20 bp, Artificial Sequence
  Description of Artificial Sequence: Synthetic oligonucleotide
  Target: SCN10A; (-) strand; PAM type: NRG; PAM sequence: TAG
agccctgagaggggaaacct

SEQ ID NO: 15498 - DNA, 20 bp, Artificial Sequence
  Description of Artificial Sequence: Synthetic oligonucleotide
  Target: SCN10A; (-) strand; PAM type: NRG; PAM sequence: GGG
gaaaatggcagccctgagag

SEQ ID NO: 15499 - DNA, 20 bp, Artificial Sequence
  Description of Artificial Sequence: Synthetic oligonucleotide
  Target: SCN10A; (-) strand; PAM type: NRG; PAM sequence: GGG
agaaaatggcagccctgaga

SEQ ID NO: 15500 - DNA, 20 bp, Artificial Sequence
  Description of Artificial Sequence: Synthetic oligonucleotide
  Target: SCN10A; (-) strand; PAM type: NRG; PAM sequence: AGG
gagaaaatggcagccctgag

SEQ ID NO: 15501 - DNA, 20 bp, Artificial Sequence
  Description of Artificial Sequence: Synthetic oligonucleotide
  Target: SCN10A; (-) strand; PAM type: NRG; PAM sequence: GAG
tgagaaaatggcagccctga

SEQ ID NO: 15502 - DNA, 20 bp, Artificial Sequence
  Description of Artificial Sequence: Synthetic oligonucleotide
  Target: SCN10A; (-) strand; PAM type: NRG; PAM sequence: GAG
gctgagaaaatggcagccct

SEQ ID NO: 15503 - DNA, 20 bp, Artificial Sequence
  Description of Artificial Sequence: Synthetic oligonucleotide
  Target: SCN10A; (-) strand; PAM type: NRG; PAM sequence: CAG
gaaagtggctgagaaaatgg

SEQ ID NO: 15504 - DNA, 20 bp, Artificial Sequence
  Description of Artificial Sequence: Synthetic oligonucleotide
  Target: SCN10A; (-) strand; PAM type: NRG; PAM sequence: TGG
tgggaaagtggctgagaaaa

SEQ ID NO: 15505 - DNA, 20 bp, Artificial Sequence
  Description of Artificial Sequence: Synthetic oligonucleotide
  Target: SCN10A; (-) strand; PAM type: NRG; PAM sequence: GAG
cataaggtgggaaagtggct

SEQ ID NO: 15506 - DNA, 20 bp, Artificial Sequence
  Description of Artificial Sequence: Synthetic oligonucleotide
  Target: SCN10A; (-) strand; PAM type: NRG; PAM sequence: TGG
atgtgcataaggtgggaaag

SEQ ID NO: 15507 - DNA, 20 bp, Artificial Sequence
  Description of Artificial Sequence: Synthetic oligonucleotide
  Target: SCN10A; (-) strand; PAM type: NRG; PAM sequence: AAG
atcatgtgcataaggtggga

SEQ ID NO: 15508 - DNA, 20 bp, Artificial Sequence
  Description of Artificial Sequence: Synthetic oligonucleotide
  Target: SCN10A; (-) strand; PAM type: NRG; PAM sequence: GGG
ttacatcatgtgcataaggt

SEQ ID NO: 15509 - DNA, 20 bp, Artificial Sequence
  Description of Artificial Sequence: Synthetic oligonucleotide
  Target: SCN10A; (-) strand; PAM type: NRG; PAM sequence: TGG
cttacatcatgtgcataagg

SEQ ID NO: 15510 - DNA, 20 bp, Artificial Sequence
  Description of Artificial Sequence: Synthetic oligonucleotide
  Target: SCN10A; (-) strand; PAM type: NRG; PAM sequence: AGG
attcttacatcatgtgcata

SEQ ID NO: 15511 - DNA, 20 bp, Artificial Sequence
  Description of Artificial Sequence: Synthetic oligonucleotide
  Target: SCN10A; (-) strand; PAM type: NRG; PAM sequence: AAG
cattcttacatcatgtgcat

SEQ ID NO: 15512 - DNA, 20 bp, Artificial Sequence
  Description of Artificial Sequence: Synthetic oligonucleotide
  Target: SCN10A; (-) strand; PAM type: NRG; PAM sequence: AAG
ttctcaacttctccatctgg

SEQ ID NO: 15513 - DNA, 20 bp, Artificial Sequence
  Description of Artificial Sequence: Synthetic oligonucleotide
  Target: SCN10A; (-) strand; PAM type: NRG; PAM sequence: TGG
ctattctcaacttctccatc

SEQ ID NO: 15514 - DNA, 20 bp, Artificial Sequence
  Description of Artificial Sequence: Synthetic oligonucleotide
  Target: SCN10A; (-) strand; PAM type: NRG; PAM sequence: AGG
agctgaaggcaggaacatgg

SEQ ID NO: 15515 - DNA, 20 bp, Artificial Sequence
  Description of Artificial Sequence: Synthetic oligonucleotide
  Target: SCN10A; (-) strand; PAM type: NRG; PAM sequence: GAG
aagctgaaggcaggaacatg

SEQ ID NO: 15516 - DNA, 20 bp, Artificial Sequence
  Description of Artificial Sequence: Synthetic oligonucleotide
  Target: SCN10A; (-) strand; PAM type: NRG; PAM sequence: TGG
taaagctgaaggcaggaaca

SEQ ID NO: 15517 - DNA, 20 bp, Artificial Sequence
  Description of Artificial Sequence: Synthetic oligonucleotide
  Target: SCN10A; (-) strand; PAM type: NRG; PAM sequence: AGG
agaatgctaaagctgaaggc

SEQ ID NO: 15518 - DNA, 20 bp, Artificial Sequence
  Description of Artificial Sequence: Synthetic oligonucleotide
  Target: SCN10A; (-) strand; PAM type: NRG; PAM sequence: CAG
aagaatgctaaagctgaagg

SEQ ID NO: 15519 - DNA, 20 bp, Artificial Sequence
  Description of Artificial Sequence: Synthetic oligonucleotide
  Target: SCN10A; (-) strand; PAM type: NRG; PAM sequence: AGG
ctcaagaatgctaaagctga

SEQ ID NO: 15520 - DNA, 20 bp, Artificial Sequence
  Description of Artificial Sequence: Synthetic oligonucleotide
  Target: SCN10A; (-) strand; PAM type: NRG; PAM sequence: AAG
cctcaagaatgctaaagctg

SEQ ID NO: 15521 - DNA, 20 bp, Artificial Sequence
  Description of Artificial Sequence: Synthetic oligonucleotide
  Target: SCN10A; (-) strand; PAM type: NRG; PAM sequence: AAG
tctagacctcaagaatgcta

SEQ ID NO: 15522 - DNA, 20 bp, Artificial Sequence
  Description of Artificial Sequence: Synthetic oligonucleotide
  Target: SCN10A; (-) strand; PAM type: NRG; PAM sequence: AAG
acacccagtttctagacctc

SEQ ID NO: 15523 - DNA, 20 bp, Artificial Sequence
  Description of Artificial Sequence: Synthetic oligonucleotide
  Target: SCN10A; (-) strand; PAM type: NRG; PAM sequence: TAG
tggaaggcacacccagtttc

SEQ ID NO: 15524 - DNA, 20 bp, Artificial Sequence
  Description of Artificial Sequence: Synthetic oligonucleotide
  Target: SCN10A; (-) strand; PAM type: NRG; PAM sequence: CAG
aacatgctggaaggcacacc

SEQ ID NO: 15525 - DNA, 20 bp, Artificial Sequence
  Description of Artificial Sequence: Synthetic oligonucleotide
  Target: SCN10A; (-) strand; PAM type: NRG; PAM sequence: AGG
catgctctgaacatgctgga

SEQ ID NO: 15526 - DNA, 20 bp, Artificial Sequence
  Description of Artificial Sequence: Synthetic oligonucleotide
  Target: SCN10A; (-) strand; PAM type: NRG; PAM sequence: AAG
gcatgctctgaacatgctgg

SEQ ID NO: 15527 - DNA, 20 bp, Artificial Sequence
  Description of Artificial Sequence: Synthetic oligonucleotide
  Target: SCN10A; (-) strand; PAM type: NRG; PAM sequence: TGG
cttgcatgctctgaacatgc

SEQ ID NO: 15528 - DNA, 20 bp, Artificial Sequence
  Description of Artificial Sequence: Synthetic oligonucleotide
  Target: SCN10A; (-) strand; PAM type: NRG; PAM sequence: AAG
ggcctaggagtgtaagaact

SEQ ID NO: 15529 - DNA, 20 bp, Artificial Sequence
  Description of Artificial Sequence: Synthetic oligonucleotide
  Target: SCN10A; (-) strand; PAM type: NRG; PAM sequence: AAG
tgtaacaggcctaggagtgt

SEQ ID NO: 15530 - DNA, 20 bp, Artificial Sequence
  Description of Artificial Sequence: Synthetic oligonucleotide
  Target: SCN10A; (-) strand; PAM type: NRG; PAM sequence: GAG
aagtgctgtaacaggcctag

SEQ ID NO: 15531 - DNA, 20 bp, Artificial Sequence
  Description of Artificial Sequence: Synthetic oligonucleotide
  Target: SCN10A; (-) strand; PAM type: NRG; PAM sequence: AGG
ttaagtgctgtaacaggcct

SEQ ID NO: 15532 - DNA, 20 bp, Artificial Sequence
  Description of Artificial Sequence: Synthetic oligonucleotide
  Target: SCN10A; (-) strand; PAM type: NRG; PAM sequence: TAG
attaagtgctgtaacaggcc

SEQ ID NO: 15533 - DNA, 20 bp, Artificial Sequence
  Description of Artificial Sequence: Synthetic oligonucleotide
  Target: SCN10A; (-) strand; PAM type: NRG; PAM sequence: AGG
agctcattaagtgctgtaac

SEQ ID NO: 15534 - DNA, 20 bp, Artificial Sequence
  Description of Artificial Sequence: Synthetic oligonucleotide
  Target: SCN10A; (-) strand; PAM type: NRG; PAM sequence: CAG
cagctcattaagtgctgtaa

SEQ ID NO: 15535 - DNA, 20 bp, Artificial Sequence
  Description of Artificial Sequence: Synthetic oligonucleotide
  Target: SCN10A; (-) strand; PAM type: NRG; PAM sequence: AAG
gtgaattaaaacagctcatt

SEQ ID NO: 15536 - DNA, 20 bp, Artificial Sequence
  Description of Artificial Sequence: Synthetic oligonucleotide
  Target: SCN10A; (-) strand; PAM type: NRG; PAM sequence: CAG
gactaataggtgaattaaaa

SEQ ID NO: 15537 - DNA, 20 bp, Artificial Sequence
  Description of Artificial Sequence: Synthetic oligonucleotide
  Target: SCN10A; (-) strand; PAM type: NRG; PAM sequence: AGG
tgtatgagaaacagactaat

SEQ ID NO: 15538 - DNA, 20 bp, Artificial Sequence
  Description of Artificial Sequence: Synthetic oligonucleotide
  Target: SCN10A; (-) strand; PAM type: NRG; PAM sequence: TAG
ctgtatgagaaacagactaa

SEQ ID NO: 15539 - DNA, 20 bp, Artificial Sequence
  Description of Artificial Sequence: Synthetic oligonucleotide
  Target: SCN10A; (-) strand; PAM type: NRG; PAM sequence: CAG
cactgatgctgtatgagaaa

SEQ ID NO: 15540 - DNA, 20 bp, Artificial Sequence
  Description of Artificial Sequence: Synthetic oligonucleotide
  Target: SCN10A; (-) strand; PAM type: NRG; PAM sequence: GAG
cttggacactgatgctgtat

SEQ ID NO: 15541 - DNA, 20 bp, Artificial Sequence
  Description of Artificial Sequence: Synthetic oligonucleotide
  Target: SCN10A; (-) strand; PAM type: NRG; PAM sequence: TGG
gatacagtcagaactgggct

SEQ ID NO: 15542 - DNA, 20 bp, Artificial Sequence
  Description of Artificial Sequence: Synthetic oligonucleotide
  Target: SCN10A; (-) strand; PAM type: NRG; PAM sequence: GGG
tgggagatacagtcagaact

SEQ ID NO: 15543 - DNA, 20 bp, Artificial Sequence
  Description of Artificial Sequence: Synthetic oligonucleotide
  Target: SCN10A; (-) strand; PAM type: NRG; PAM sequence: TGG
ctgggagatacagtcagaac

SEQ ID NO: 15544 - DNA, 20 bp, Artificial Sequence
  Description of Artificial Sequence: Synthetic oligonucleotide
  Target: SCN10A; (-) strand; PAM type: NRG; PAM sequence: CAG
tcagccctgggagatacagt

SEQ ID NO: 15545 - DNA, 20 bp, Artificial Sequence
  Description of Artificial Sequence: Synthetic oligonucleotide
  Target: SCN10A; (-) strand; PAM type: NRG; PAM sequence: CAG
ctactcagccctgggagata

SEQ ID NO: 15546 - DNA, 20 bp, Artificial Sequence
  Description of Artificial Sequence: Synthetic oligonucleotide
  Target: SCN10A; (-) strand; PAM type: NRG; PAM sequence: GAG
atggtactactcagccctgg

SEQ ID NO: 15547 - DNA, 20 bp, Artificial Sequence
  Description of Artificial Sequence: Synthetic oligonucleotide
  Target: SCN10A; (-) strand; PAM type: NRG; PAM sequence: GGG
gcatggtactactcagccct

SEQ ID NO: 15548 - DNA, 20 bp, Artificial Sequence
  Description of Artificial Sequence: Synthetic oligonucleotide
  Target: SCN10A; (-) strand; PAM type: NRG; PAM sequence: TGG
ggcatggtactactcagccc

SEQ ID NO: 15549 - DNA, 20 bp, Artificial Sequence
  Description of Artificial Sequence: Synthetic oligonucleotide
  Target: SCN10A; (-) strand; PAM type: NRG; PAM sequence: CAG
atgccaggcatggtactact

SEQ ID NO: 15550 - DNA, 20 bp, Artificial Sequence
  Description of Artificial Sequence: Synthetic oligonucleotide
  Target: SCN10A; (-) strand; PAM type: NRG; PAM sequence: TGG
tagctctggtatgccaggca

SEQ ID NO: 15551 - DNA, 20 bp, Artificial Sequence
  Description of Artificial Sequence: Synthetic oligonucleotide
  Target: SCN10A; (-) strand; PAM type: NRG; PAM sequence: AGG
ctgagtagctctggtatgcc

SEQ ID NO: 15552 - DNA, 20 bp, Artificial Sequence
  Description of Artificial Sequence: Synthetic oligonucleotide
  Target: SCN10A; (-) strand; PAM type: NRG; PAM sequence: CAG
tctgagtagctctggtatgc

SEQ ID NO: 15553 - DNA, 20 bp, Artificial Sequence
  Description of Artificial Sequence: Synthetic oligonucleotide
  Target: SCN10A; (-) strand; PAM type: NRG; PAM sequence: TGG
aaataatctctgagtagctc

SEQ ID NO: 15554 - DNA, 20 bp, Artificial Sequence
  Description of Artificial Sequence: Synthetic oligonucleotide
  Target: SCN10A; (-) strand; PAM type: NRG; PAM sequence: TAG
ttcaacaaataatctctgag

SEQ ID NO: 15555 - DNA, 20 bp, Artificial Sequence
  Description of Artificial Sequence: Synthetic oligonucleotide
  Target: SCN10A; (-) strand; PAM type: NRG; PAM sequence: GAG
ttattcaacaaataatctct

SEQ ID NO: 15556 - DNA, 20 bp, Artificial Sequence
  Description of Artificial Sequence: Synthetic oligonucleotide
  Target: SCN10A; (-) strand; PAM type: NRG; PAM sequence: TGG
gagtgtctacattccaccat

SEQ ID NO: 15557 - DNA, 20 bp, Artificial Sequence
  Description of Artificial Sequence: Synthetic oligonucleotide
  Target: SCN10A; (-) strand; PAM type: NRG; PAM sequence: GAG
tttgtcatgcagttactctt

SEQ ID NO: 15558 - DNA, 20 bp, Artificial Sequence
  Description of Artificial Sequence: Synthetic oligonucleotide
  Target: SCN10A; (-) strand; PAM type: NRG; PAM sequence: CAG
ttacttatacatttgtcatg

SEQ ID NO: 15559 - DNA, 20 bp, Artificial Sequence
  Description of Artificial Sequence: Synthetic oligonucleotide
  Target: SCN10A; (-) strand; PAM type: NRG; PAM sequence: AAG
attcagtcctctgttcattc

SEQ ID NO: 15560 - DNA, 20 bp, Artificial Sequence
  Description of Artificial Sequence: Synthetic oligonucleotide
  Target: SCN10A; (-) strand; PAM type: NRG; PAM sequence: CAG
ccttcatctacctgttcatt

SEQ ID NO: 15561 - DNA, 20 bp, Artificial Sequence
  Description of Artificial Sequence: Synthetic oligonucleotide
  Target: SCN10A; (-) strand; PAM type: NRG; PAM sequence: CAG
tctttctttctttcatcatc

SEQ ID NO: 15562 - DNA, 20 bp, Artificial Sequence
  Description of Artificial Sequence: Synthetic oligonucleotide
  Target: SCN10A; (-) strand; PAM type: NRG; PAM sequence: CAG
tataatgttggtgataatga

SEQ ID NO: 15563 - DNA, 20 bp, Artificial Sequence
  Description of Artificial Sequence: Synthetic oligonucleotide
  Target: SCN10A; (-) strand; PAM type: NRG; PAM sequence: TGG
attgtaatgatatataatgt

SEQ ID NO: 15564 - DNA, 20 bp, Artificial Sequence
  Description of Artificial Sequence: Synthetic oligonucleotide
  Target: SCN10A; (-) strand; PAM type: NRG; PAM sequence: AGG
gtaataaattatgtctcatt

SEQ ID NO: 15565 - DNA, 20 bp, Artificial Sequence
  Description of Artificial Sequence: Synthetic oligonucleotide
  Target: SCN10A; (-) strand; PAM type: NRG; PAM sequence: TAG
ggtaataaattatgtctcat

SEQ ID NO: 15566 - DNA, 20 bp, Artificial Sequence
  Description of Artificial Sequence: Synthetic oligonucleotide
  Target: SCN10A; (-) strand; PAM type: NRG; PAM sequence: TGG
acttcacatcatttcctaaa

SEQ ID NO: 15567 - DNA, 20 bp, Artificial Sequence
  Description of Artificial Sequence: Synthetic oligonucleotide
  Target: SCN10A; (-) strand; PAM type: NRG; PAM sequence: CAG
acacggcatagccacatgtt

SEQ ID NO: 15568 - DNA, 20 bp, Artificial Sequence
  Description of Artificial Sequence: Synthetic oligonucleotide
  Target: SCN10A; (-) strand; PAM type: NRG; PAM sequence: TAG
tgtacaaaatagacacggca

SEQ ID NO: 15569 - DNA, 20 bp, Artificial Sequence
  Description of Artificial Sequence: Synthetic oligonucleotide
  Target: SCN10A; (-) strand; PAM type: NRG; PAM sequence: CGG
gaacctgtacaaaatagaca

SEQ ID NO: 15570 - DNA, 20 bp, Artificial Sequence
  Description of Artificial Sequence: Synthetic oligonucleotide
  Target: SCN10A; (-) strand; PAM type: NRG; PAM sequence: TAG
aacacagaacctgtacaaaa

SEQ ID NO: 15571 - DNA, 20 bp, Artificial Sequence
  Description of Artificial Sequence: Synthetic oligonucleotide
  Target: SCN10A; (-) strand; PAM type: NRG; PAM sequence: CAG
tcaggtggtgagttaaaaca

SEQ ID NO: 15572 - DNA, 20 bp, Artificial Sequence
  Description of Artificial Sequence: Synthetic oligonucleotide
  Target: SCN10A; (-) strand; PAM type: NRG; PAM sequence: GAG
ccatgggattatcaggtggt

SEQ ID NO: 15573 - DNA, 20 bp, Artificial Sequence
  Description of Artificial Sequence: Synthetic oligonucleotide
  Target: SCN10A; (-) strand; PAM type: NRG; PAM sequence: TGG
cctgccatgggattatcagg

SEQ ID NO: 15574 - DNA, 20 bp, Artificial Sequence
  Description of Artificial Sequence: Synthetic oligonucleotide
  Target: SCN10A; (-) strand; PAM type: NRG; PAM sequence: AGG
gggcctgccatgggattatc

SEQ ID NO: 15575 - DNA, 20 bp, Artificial Sequence
  Description of Artificial Sequence: Synthetic oligonucleotide
  Target: SCN10A; (-) strand; PAM type: NRG; PAM sequence: CAG
tgggcctgccatgggattat

SEQ ID NO: 15576 - DNA, 20 bp, Artificial Sequence
  Description of Artificial Sequence: Synthetic oligonucleotide
  Target: SCN10A; (-) strand; PAM type: NRG; PAM sequence: GGG
taaagggatgggcctgccat

SEQ ID NO: 15577 - DNA, 20 bp, Artificial Sequence
  Description of Artificial Sequence: Synthetic oligonucleotide
  Target: SCN10A; (-) strand; PAM type: NRG; PAM sequence: TGG
ataaagggatgggcctgcca

SEQ ID NO: 15578 - DNA, 20 bp, Artificial Sequence
  Description of Artificial Sequence: Synthetic oligonucleotide
  Target: SCN10A; (-) strand; PAM type: NRG; PAM sequence: GGG
gtagaatagcataaagggat

SEQ ID NO: 15579 - DNA, 20 bp, Artificial Sequence
  Description of Artificial Sequence: Synthetic oligonucleotide
  Target: SCN10A; (-) strand; PAM type: NRG; PAM sequence: TGG
agtagaatagcataaaggga

SEQ ID NO: 15580 - DNA, 20 bp, Artificial Sequence
  Description of Artificial Sequence: Synthetic oligonucleotide
  Target: SCN10A; (-) strand; PAM type: NRG; PAM sequence: GGG
ggctagtagaatagcataaa

SEQ ID NO: 15581 - DNA, 20 bp, Artificial Sequence
  Description of Artificial Sequence: Synthetic oligonucleotide
  Target: SCN10A; (-) strand; PAM type: NRG; PAM sequence: AGG
gggctagtagaatagcataa

SEQ ID NO: 15582 - DNA, 20 bp, Artificial Sequence
  Description of Artificial Sequence: Synthetic oligonucleotide
  Target: SCN10A; (-) strand; PAM type: NRG; PAM sequence: AAG
tgggctagtagaatagcata

SEQ ID NO: 15583 - DNA, 20 bp, Artificial Sequence
  Description of Artificial Sequence: Synthetic oligonucleotide
  Target: SCN10A; (-) strand; PAM type: NRG; PAM sequence: TAG
acaagtgtgggctagtagaa

SEQ ID NO: 15584 - DNA, 20 bp, Artificial Sequence
  Description of Artificial Sequence: Synthetic oligonucleotide
  Target: SCN10A; (-) strand; PAM type: NRG; PAM sequence: TAG
attacacaagtgtgggctag

SEQ ID NO: 15585 - DNA, 20 bp, Artificial Sequence
  Description of Artificial Sequence: Synthetic oligonucleotide
  Target: SCN10A; (-) strand; PAM type: NRG; PAM sequence: TAG
gcaattacacaagtgtgggc

SEQ ID NO: 15586 - DNA, 20 bp, Artificial Sequence
  Description of Artificial Sequence: Synthetic oligonucleotide
  Target: SCN10A; (-) strand; PAM type: NRG; PAM sequence: GGG
tggtgcaattacacaagtgt

SEQ ID NO: 15587 - DNA, 20 bp, Artificial Sequence
  Description of Artificial Sequence: Synthetic oligonucleotide
  Target: SCN10A; (-) strand; PAM type: NRG; PAM sequence: TGG
gtggtgcaattacacaagtg

SEQ ID NO: 15588 - DNA, 20 bp, Artificial Sequence
  Description of Artificial Sequence: Synthetic oligonucleotide
  Target: SCN10A; (-) strand; PAM type: NRG; PAM sequence: AAG
tcacagtggtgcaattacac

SEQ ID NO: 15589 - DNA, 20 bp, Artificial Sequence
  Description of Artificial Sequence: Synthetic oligonucleotide
  Target: SCN10A; (-) strand; PAM type: NRG; PAM sequence: TGG
tagtgaatatgatatcacag

SEQ ID NO: 15590 - DNA, 20 bp, Artificial Sequence
  Description of Artificial Sequence: Synthetic oligonucleotide
  Target: SCN10A; (-) strand; PAM type: NRG; PAM sequence: CAG
tcctagtgaatatgatatca

SEQ ID NO: 15591 - DNA, 20 bp, Artificial Sequence
  Description of Artificial Sequence: Synthetic oligonucleotide
  Target: SCN10A; (-) strand; PAM type: NRG; PAM sequence: TAG
atgaggctagagggccttcc

SEQ ID NO: 15592 - DNA, 20 bp, Artificial Sequence
  Description of Artificial Sequence: Synthetic oligonucleotide
  Target: SCN10A; (-) strand; PAM type: NRG; PAM sequence: GGG
gactacaccatgaggctaga

SEQ ID NO: 15593 - DNA, 20 bp, Artificial Sequence
  Description of Artificial Sequence: Synthetic oligonucleotide
  Target: SCN10A; (-) strand; PAM type: NRG; PAM sequence: AGG
agactacaccatgaggctag

SEQ ID NO: 15594 - DNA, 20 bp, Artificial Sequence
  Description of Artificial Sequence: Synthetic oligonucleotide
  Target: SCN10A; (-) strand; PAM type: NRG; PAM sequence: GAG
cagactacaccatgaggcta

SEQ ID NO: 15595 - DNA, 20 bp, Artificial Sequence
  Description of Artificial Sequence: Synthetic oligonucleotide
  Target: SCN10A; (-) strand; PAM type: NRG; PAM sequence: TAG
tacagactacaccatgaggc

SEQ ID NO: 15596 - DNA, 20 bp, Artificial Sequence
  Description of Artificial Sequence: Synthetic oligonucleotide
  Target: SCN10A; (-) strand; PAM type: NRG; PAM sequence: AGG
ttcctacagactacaccatg

SEQ ID NO: 15597 - DNA, 20 bp, Artificial Sequence
  Description of Artificial Sequence: Synthetic oligonucleotide
  Target: SCN10A; (-) strand; PAM type: NRG; PAM sequence: GAG
attcctacagactacaccat

SEQ ID NO: 15598 - DNA, 20 bp, Artificial Sequence
  Description of Artificial Sequence: Synthetic oligonucleotide
  Target: SCN10A; (-) strand; PAM type: NRG; PAM sequence: CAG
gaggtcattctctattccta

SEQ ID NO: 15599 - DNA, 20 bp, Artificial Sequence
  Description of Artificial Sequence: Synthetic oligonucleotide
  Target: SCN10A; (-) strand; PAM type: NRG; PAM sequence: AGG
gtagcactcagtgtgaactg

SEQ ID NO: 15600 - DNA, 20 bp, Artificial Sequence
  Description of Artificial Sequence: Synthetic oligonucleotide
  Target: SCN10A; (-) strand; PAM type: NRG; PAM sequence: GAG
agtagcactcagtgtgaact

SEQ ID NO: 15601 - DNA, 20 bp, Artificial Sequence
  Description of Artificial Sequence: Synthetic oligonucleotide
  Target: SCN10A; (-) strand; PAM type: NRG; PAM sequence: CAG
actttgcaaggagtagcact

SEQ ID NO: 15602 - DNA, 20 bp, Artificial Sequence
  Description of Artificial Sequence: Synthetic oligonucleotide
  Target: SCN10A; (-) strand; PAM type: NRG; PAM sequence: TAG
tgtggggactttgcaaggag

SEQ ID NO: 15603 - DNA, 20 bp, Artificial Sequence
  Description of Artificial Sequence: Synthetic oligonucleotide
  Target: SCN10A; (-) strand; PAM type: NRG; PAM sequence: GAG
ctatgtggggactttgcaag

SEQ ID NO: 15604 - DNA, 20 bp, Artificial Sequence
  Description of Artificial Sequence: Synthetic oligonucleotide
  Target: SCN10A; (-) strand; PAM type: NRG; PAM sequence: AGG
tgctatgtggggactttgca

SEQ ID NO: 15605 - DNA, 20 bp, Artificial Sequence
  Description of Artificial Sequence: Synthetic oligonucleotide
  Target: SCN10A; (-) strand; PAM type: NRG; PAM sequence: AAG
atgctatgtggggactttgc

SEQ ID NO: 15606 - DNA, 20 bp, Artificial Sequence
  Description of Artificial Sequence: Synthetic oligonucleotide
  Target: SCN10A; (-) strand; PAM type: NRG; PAM sequence: GGG
ttcccagaagatgctatgtg

SEQ ID NO: 15607 - DNA, 20 bp, Artificial Sequence
  Description of Artificial Sequence: Synthetic oligonucleotide
  Target: SCN10A; (-) strand; PAM type: NRG; PAM sequence: GGG
gttcccagaagatgctatgt

SEQ ID NO: 15608 - DNA, 20 bp, Artificial Sequence
  Description of Artificial Sequence: Synthetic oligonucleotide
  Target: SCN10A; (-) strand; PAM type: NRG; PAM sequence: TGG
ggttcccagaagatgctatg

SEQ ID NO: 15609 - DNA, 20 bp, Artificial Sequence
  Description of Artificial Sequence: Synthetic oligonucleotide
  Target: SCN10A; (-) strand; PAM type: NRG; PAM sequence: AAG
tggagagtctaggttcccag

SEQ ID NO: 15610 - DNA, 20 bp, Artificial Sequence
  Description of Artificial Sequence: Synthetic oligonucleotide
  Target: SCN10A; (-) strand; PAM type: NRG; PAM sequence: CAG
aaatggagagtctaggttcc

SEQ ID NO: 15611 - DNA, 20 bp, Artificial Sequence
  Description of Artificial Sequence: Synthetic oligonucleotide
  Target: SCN10A; (-) strand; PAM type: NRG; PAM sequence: AGG
ctcaataaaatggagagtct

SEQ ID NO: 15612 - DNA, 20 bp, Artificial Sequence
  Description of Artificial Sequence: Synthetic oligonucleotide
  Target: SCN10A; (-) strand; PAM type: NRG; PAM sequence: TAG
gctcaataaaatggagagtc

SEQ ID NO: 15613 - DNA, 20 bp, Artificial Sequence
  Description of Artificial Sequence: Synthetic oligonucleotide
  Target: SCN10A; (-) strand; PAM type: NRG; PAM sequence: GAG
tggccgctcaataaaatgga

SEQ ID NO: 15614 - DNA, 20 bp, Artificial Sequence
  Description of Artificial Sequence: Synthetic oligonucleotide
  Target: SCN10A; (-) strand; PAM type: NRG; PAM sequence: GAG
tttggccgctcaataaaatg

SEQ ID NO: 15615 - DNA, 20 bp, Artificial Sequence
  Description of Artificial Sequence: Synthetic oligonucleotide
  Target: SCN10A; (-) strand; PAM type: NRG; PAM sequence: TGG
gctttggccgctcaataaaa

SEQ ID NO: 15616 - DNA, 20 bp, Artificial Sequence
  Description of Artificial Sequence: Synthetic oligonucleotide
  Target: SCN10A; (-) strand; PAM type: NRG; PAM sequence: TGG
atcaaccatatctcttgctt

SEQ ID NO: 15617 - DNA, 20 bp, Artificial Sequence
  Description of Artificial Sequence: Synthetic oligonucleotide
  Target: SCN10A; (-) strand; PAM type: NRG; PAM sequence: GAG
gcaggtggtgagtcaaccat

SEQ ID NO: 15618 - DNA, 20 bp, Artificial Sequence
  Description of Artificial Sequence: Synthetic oligonucleotide
  Target: SCN10A; (-) strand; PAM type: NRG; PAM sequence: GAG
cttgcacttctgcaggtggt

SEQ ID NO: 15619 - DNA, 20 bp, Artificial Sequence
  Description of Artificial Sequence: Synthetic oligonucleotide
  Target: SCN10A; (-) strand; PAM type: NRG; PAM sequence: TGG
ttaccttgcacttctgcagg

SEQ ID NO: 15620 - DNA, 20 bp, Artificial Sequence
  Description of Artificial Sequence: Synthetic oligonucleotide
  Target: SCN10A; (-) strand; PAM type: NRG; PAM sequence: AGG
gggttaccttgcacttctgc

SEQ ID NO: 15621 - DNA, 20 bp, Artificial Sequence
  Description of Artificial Sequence: Synthetic oligonucleotide
  Target: SCN10A; (-) strand; PAM type: NRG; PAM sequence: CAG
tgggttaccttgcacttctg

SEQ ID NO: 15622 - DNA, 20 bp, Artificial Sequence
  Description of Artificial Sequence: Synthetic oligonucleotide
  Target: SCN10A; (-) strand; PAM type: NRG; PAM sequence: GGG
aactttgataatgttgcaat

SEQ ID NO: 15623 - DNA, 20 bp, Artificial Sequence
  Description of Artificial Sequence: Synthetic oligonucleotide
  Target: SCN10A; (-) strand; PAM type: NRG; PAM sequence: TGG
caactttgataatgttgcaa

SEQ ID NO: 15624 - DNA, 20 bp, Artificial Sequence
  Description of Artificial Sequence: Synthetic oligonucleotide
  Target: SCN10A; (-) strand; PAM type: NRG; PAM sequence: AAG
cttcttctgggtcaatgtga

SEQ ID NO: 15625 - DNA, 20 bp, Artificial Sequence
  Description of Artificial Sequence: Synthetic oligonucleotide
  Target: SCN10A; (-) strand; PAM type: NRG; PAM sequence: GGG
ctccactggcagcttcttct

SEQ ID NO: 15626 - DNA, 20 bp, Artificial Sequence
  Description of Artificial Sequence: Synthetic oligonucleotide
  Target: SCN10A; (-) strand; PAM type: NRG; PAM sequence: TGG
actccactggcagcttcttc

SEQ ID NO: 15627 - DNA, 20 bp, Artificial Sequence
  Description of Artificial Sequence: Synthetic oligonucleotide
  Target: SCN10A; (-) strand; PAM type: NRG; PAM sequence: CAG
aagattcaaaactccactgg

SEQ ID NO: 15628 - DNA, 20 bp, Artificial Sequence
  Description of Artificial Sequence: Synthetic oligonucleotide
  Target: SCN10A; (-) strand; PAM type: NRG; PAM sequence: TGG
tgcaagattcaaaactccac

SEQ ID NO: 15629 - DNA, 20 bp, Artificial Sequence
  Description of Artificial Sequence: Synthetic oligonucleotide
  Target: SCN10A; (-) strand; PAM type: NRG; PAM sequence: AAG
tgaataacaagtctgactgc

SEQ ID NO: 15630 - DNA, 20 bp, Artificial Sequence
  Description of Artificial Sequence: Synthetic oligonucleotide
  Target: SCN10A; (-) strand; PAM type: NRG; PAM sequence: AAG
ctttgtcgattgtgaataac

SEQ ID NO: 15631 - DNA, 20 bp, Artificial Sequence
  Description of Artificial Sequence: Synthetic oligonucleotide
  Target: SCN10A; (-) strand; PAM type: NRG; PAM sequence: GAG
gcatcaactataccgatgga

SEQ ID NO: 15632 - DNA, 20 bp, Artificial Sequence
  Description of Artificial Sequence: Synthetic oligonucleotide
  Target: SCN10A; (-) strand; PAM type: NRG; PAM sequence: GAG
gtgcatcaactataccgatg

SEQ ID NO: 15633 - DNA, 20 bp, Artificial Sequence
  Description of Artificial Sequence: Synthetic oligonucleotide
  Target: SCN10A; (-) strand; PAM type: NRG; PAM sequence: TGG
aggtgcatcaactataccga

SEQ ID NO: 15634 - DNA, 20 bp, Artificial Sequence
  Description of Artificial Sequence: Synthetic oligonucleotide
  Target: SCN10A; (-) strand; PAM type: NRG; PAM sequence: AGG
tcttcgcagggaagttttgg

SEQ ID NO: 15635 - DNA, 20 bp, Artificial Sequence
  Description of Artificial Sequence: Synthetic oligonucleotide
  Target: SCN10A; (-) strand; PAM type: NRG; PAM sequence: GAG
ctcttcgcagggaagttttg

SEQ ID NO: 15636 - DNA, 20 bp, Artificial Sequence
  Description of Artificial Sequence: Synthetic oligonucleotide
  Target: SCN10A; (-) strand; PAM type: NRG; PAM sequence: TGG
acctcttcgcagggaagttt

SEQ ID NO: 15637 - DNA, 20 bp, Artificial Sequence
  Description of Artificial Sequence: Synthetic oligonucleotide
  Target: SCN10A; (-) strand; PAM type: NRG; PAM sequence: AAG
gtgtgaacctcttcgcaggg

SEQ ID NO: 15638 - DNA, 20 bp, Artificial Sequence
  Description of Artificial Sequence: Synthetic oligonucleotide
  Target: SCN10A; (-) strand; PAM type: NRG; PAM sequence: GGG
tgggtgtgaacctcttcgca

SEQ ID NO: 15639 - DNA, 20 bp, Artificial Sequence
  Description of Artificial Sequence: Synthetic oligonucleotide
  Target: SCN10A; (-) strand; PAM type: NRG; PAM sequence: AGG
atgggtgtgaacctcttcgc

SEQ ID NO: 15640 - DNA, 20 bp, Artificial Sequence
  Description of Artificial Sequence: Synthetic oligonucleotide
  Target: SCN10A; (-) strand; PAM type: NRG; PAM sequence: CAG
catgggtgtgaacctcttcg

SEQ ID NO: 15641 - DNA, 20 bp, Artificial Sequence
  Description of Artificial Sequence: Synthetic oligonucleotide
  Target: SCN10A; (-) strand; PAM type: NRG; PAM sequence: GGG
tggctcatcttcagcatcat

SEQ ID NO: 15642 - DNA, 20 bp, Artificial Sequence
  Description of Artificial Sequence: Synthetic oligonucleotide
  Target: SCN10A; (-) strand; PAM type: NRG; PAM sequence: TGG
ctggctcatcttcagcatca

SEQ ID NO: 15643 - DNA, 20 bp, Artificial Sequence
  Description of Artificial Sequence: Synthetic oligonucleotide
  Target: SCN10A; (-) strand; PAM type: NRG; PAM sequence: CAG
ctcatcttctggctcatctt

SEQ ID NO: 15644 - DNA, 20 bp, Artificial Sequence
  Description of Artificial Sequence: Synthetic oligonucleotide
  Target: SCN10A; (-) strand; PAM type: NRG; PAM sequence: TGG
tcctcgtctgcctcatcttc

SEQ ID NO: 15645 - DNA, 20 bp, Artificial Sequence
  Description of Artificial Sequence: Synthetic oligonucleotide
  Target: SCN10A; (-) strand; PAM type: NRG; PAM sequence: GGG
gtggtggtggatgccctggt

SEQ ID NO: 15646 - DNA, 20 bp, Artificial Sequence
  Description of Artificial Sequence: Synthetic oligonucleotide
  Target: SCN10A; (-) strand; PAM type: NRG; PAM sequence: TGG
ggtggtggtggatgccctgg

SEQ ID NO: 15647 - DNA, 20 bp, Artificial Sequence
  Description of Artificial Sequence: Synthetic oligonucleotide
  Target: SCN10A; (-) strand; PAM type: NRG; PAM sequence: TGG
ccaggtggtggtggatgccc

SEQ ID NO: 15648 - DNA, 20 bp, Artificial Sequence
  Description of Artificial Sequence: Synthetic oligonucleotide
  Target: SCN10A; (-) strand; PAM type: NRG; PAM sequence: TGG
tatctcccaccaggtggtgg

SEQ ID NO: 15649 - DNA, 20 bp, Artificial Sequence
  Description of Artificial Sequence: Synthetic oligonucleotide
  Target: SCN10A; (-) strand; PAM type: NRG; PAM sequence: TGG
ctctatctcccaccaggtgg

SEQ ID NO: 15650 - DNA, 20 bp, Artificial Sequence
  Description of Artificial Sequence: Synthetic oligonucleotide
  Target: SCN10A; (-) strand; PAM type: NRG; PAM sequence: TGG
tttctctatctcccaccagg

SEQ ID NO: 15651 - DNA, 20 bp, Artificial Sequence
  Description of Artificial Sequence: Synthetic oligonucleotide
  Target: SCN10A; (-) strand; PAM type: NRG; PAM sequence: AGG
gtctttctctatctcccacc

SEQ ID NO: 15652 - DNA, 20 bp, Artificial Sequence
  Description of Artificial Sequence: Synthetic oligonucleotide
  Target: SCN10A; (-) strand; PAM type: NRG; PAM sequence: CAG
ggtctttctctatctcccac

SEQ ID NO: 15653 - DNA, 20 bp, Artificial Sequence
  Description of Artificial Sequence: Synthetic oligonucleotide
  Target: SCN10A; (-) strand; PAM type: NRG; PAM sequence: AGG
gtggggcattgggaggttcc

SEQ ID NO: 15654 - DNA, 20 bp, Artificial Sequence
  Description of Artificial Sequence: Synthetic oligonucleotide
  Target: SCN10A; (-) strand; PAM type: NRG; PAM sequence: CAG
ggtggggcattgggaggttc

SEQ ID NO: 15655 - DNA, 20 bp, Artificial Sequence
  Description of Artificial Sequence: Synthetic oligonucleotide
  Target: SCN10A; (-) strand; PAM type: NRG; PAM sequence: AGG
agagggggtggggcattggg

SEQ ID NO: 15656 - DNA, 20 bp, Artificial Sequence
  Description of Artificial Sequence: Synthetic oligonucleotide
  Target: SCN10A; (-) strand; PAM type: NRG; PAM sequence: GAG
cagagggggtggggcattgg

SEQ ID NO: 15657 - DNA, 20 bp, Artificial Sequence
  Description of Artificial Sequence: Synthetic oligonucleotide
  Target: SCN10A; (-) strand; PAM type: NRG; PAM sequence: GGG
agcagagggggtggggcatt

SEQ ID NO: 15658 - DNA, 20 bp, Artificial Sequence
  Description of Artificial Sequence: Synthetic oligonucleotide
  Target: SCN10A; (-) strand; PAM type: NRG; PAM sequence: TGG
cagcagagggggtggggcat

SEQ ID NO: 15659 - DNA, 20 bp, Artificial Sequence
  Description of Artificial Sequence: Synthetic oligonucleotide
  Target: SCN10A; (-) strand; PAM type: NRG; PAM sequence: GGG
agaatccagcagagggggtg

SEQ ID NO: 15660 - DNA, 20 bp, Artificial Sequence
  Description of Artificial Sequence: Synthetic oligonucleotide
  Target: SCN10A; (-) strand; PAM type: NRG; PAM sequence: GGG
tagaatccagcagagggggt

SEQ ID NO: 15661 - DNA, 20 bp, Artificial Sequence
  Description of Artificial Sequence: Synthetic oligonucleotide
  Target: SCN10A; (-) strand; PAM type: NRG; PAM sequence: TGG
atagaatccagcagaggggg

SEQ ID NO: 15662 - DNA, 20 bp, Artificial Sequence
  Description of Artificial Sequence: Synthetic oligonucleotide
  Target: SCN10A; (-) strand; PAM type: NRG; PAM sequence: GGG
gagatagaatccagcagagg

SEQ ID NO: 15663 - DNA, 20 bp, Artificial Sequence
  Description of Artificial Sequence: Synthetic oligonucleotide
  Target: SCN10A; (-) strand; PAM type: NRG; PAM sequence: GGG
agagatagaatccagcagag

SEQ ID NO: 15664 - DNA, 20 bp, Artificial Sequence
  Description of Artificial Sequence: Synthetic oligonucleotide
  Target: SCN10A; (-) strand; PAM type: NRG; PAM sequence: GGG
aagagatagaatccagcaga

SEQ ID NO: 15665 - DNA, 20 bp, Artificial Sequence
  Description of Artificial Sequence: Synthetic oligonucleotide
  Target: SCN10A; (-) strand; PAM type: NRG; PAM sequence: AGG
aaagagatagaatccagcag

SEQ ID NO: 15666 - DNA, 20 bp, Artificial Sequence
  Description of Artificial Sequence: Synthetic oligonucleotide
  Target: SCN10A; (-) strand; PAM type: NRG; PAM sequence: GAG
gaaagagatagaatccagca

SEQ ID NO: 15667 - DNA, 20 bp, Artificial Sequence
  Description of Artificial Sequence: Synthetic oligonucleotide
  Target: SCN10A; (-) strand; PAM type: NRG; PAM sequence: CAG
tagaaagagatagaatccag

SEQ ID NO: 15668 - DNA, 20 bp, Artificial Sequence
  Description of Artificial Sequence: Synthetic oligonucleotide
  Target: SCN10A; (-) strand; PAM type: NRG; PAM sequence: CAG
gtatagaaagagatagaatc

SEQ ID NO: 15669 - DNA, 20 bp, Artificial Sequence
  Description of Artificial Sequence: Synthetic oligonucleotide
  Target: SCN10A; (-) strand; PAM type: NRG; PAM sequence: TAG
tgaatgagtatagaaagaga

SEQ ID NO: 15670 - DNA, 20 bp, Artificial Sequence
  Description of Artificial Sequence: Synthetic oligonucleotide
  Target: SCN10A; (-) strand; PAM type: NRG; PAM sequence: GAG
agcctgaatgagtatagaaa

SEQ ID NO: 15671 - DNA, 20 bp, Artificial Sequence
  Description of Artificial Sequence: Synthetic oligonucleotide
  Target: SCN10A; (-) strand; PAM type: NRG; PAM sequence: AAG
gcagcctgaatgagtataga

SEQ ID NO: 15672 - DNA, 20 bp, Artificial Sequence
  Description of Artificial Sequence: Synthetic oligonucleotide
  Target: SCN10A; (-) strand; PAM type: NRG; PAM sequence: TAG
tgaagcagcctgaatgagta

SEQ ID NO: 15673 - DNA, 20 bp, Artificial Sequence
  Description of Artificial Sequence: Synthetic oligonucleotide
  Target: SCN10A; (-) strand; PAM type: NRG; PAM sequence: GAG
gctcatgaagcagcctgaat

SEQ ID NO: 15674 - DNA, 20 bp, Artificial Sequence
  Description of Artificial Sequence: Synthetic oligonucleotide
  Target: SCN10A; (-) strand; PAM type: NRG; PAM sequence: CAG
aaggccactggctcatgaag

SEQ ID NO: 15675 - DNA, 20 bp, Artificial Sequence
  Description of Artificial Sequence: Synthetic oligonucleotide
  Target: SCN10A; (-) strand; PAM type: NRG; PAM sequence: AAG
ccaaaggccactggctcatg

SEQ ID NO: 15676 - DNA, 20 bp, Artificial Sequence
  Description of Artificial Sequence: Synthetic oligonucleotide
  Target: SCN10A; (-) strand; PAM type: NRG; PAM sequence: TGG
ttgcttcttccaaaggccac

SEQ ID NO: 15677 - DNA, 20 bp, Artificial Sequence
  Description of Artificial Sequence: Synthetic oligonucleotide
  Target: SCN10A; (-) strand; PAM type: NRG; PAM sequence: AGG
acttctcttgcttcttccaa

SEQ ID NO: 15678 - DNA, 20 bp, Artificial Sequence
  Description of Artificial Sequence: Synthetic oligonucleotide
  Target: SCN10A; (-) strand; PAM type: NRG; PAM sequence: AAG
cacttctcttgcttcttcca

SEQ ID NO: 15679 - DNA, 20 bp, Artificial Sequence
  Description of Artificial Sequence: Synthetic oligonucleotide
  Target: SCN10A; (-) strand; PAM type: NRG; PAM sequence: GAG
ccaatgtctctcagtcttct

SEQ ID NO: 15680 - DNA, 20 bp, Artificial Sequence
  Description of Artificial Sequence: Synthetic oligonucleotide
  Target: SCN10A; (-) strand; PAM type: NRG; PAM sequence: CAG
ttcagctgcccaatgtctct

SEQ ID NO: 15681 - DNA, 20 bp, Artificial Sequence
  Description of Artificial Sequence: Synthetic oligonucleotide
  Target: SCN10A; (-) strand; PAM type: NRG; PAM sequence: CAG
agaaggtctaaatccatctt

SEQ ID NO: 15682 - DNA, 20 bp, Artificial Sequence
  Description of Artificial Sequence: Synthetic oligonucleotide
  Target: SCN10A; (-) strand; PAM type: NRG; PAM sequence: AGG
tgaatgaggttaagggaaga

SEQ ID NO: 15683 - DNA, 20 bp, Artificial Sequence
  Description of Artificial Sequence: Synthetic oligonucleotide
  Target: SCN10A; (-) strand; PAM type: NRG; PAM sequence: AAG
ctgaatgaggttaagggaag

SEQ ID NO: 15684 - DNA, 20 bp, Artificial Sequence
  Description of Artificial Sequence: Synthetic oligonucleotide
  Target: SCN10A; (-) strand; PAM type: NRG; PAM sequence: AAG
accctgaatgaggttaaggg

SEQ ID NO: 15685 - DNA, 20 bp, Artificial Sequence
  Description of Artificial Sequence: Synthetic oligonucleotide
  Target: SCN10A; (-) strand; PAM type: NRG; PAM sequence: GGG
cccaccctgaatgaggttaa

SEQ ID NO: 15686 - DNA, 20 bp, Artificial Sequence
  Description of Artificial Sequence: Synthetic oligonucleotide
  Target: SCN10A; (-) strand; PAM type: NRG; PAM sequence: AGG
acccaccctgaatgaggtta

SEQ ID NO: 15687 - DNA, 20 bp, Artificial Sequence
  Description of Artificial Sequence: Synthetic oligonucleotide
  Target: SCN10A; (-) strand; PAM type: NRG; PAM sequence: AAG
aacccaccctgaatgaggtt

SEQ ID NO: 15688 - DNA, 20 bp, Artificial Sequence
  Description of Artificial Sequence: Synthetic oligonucleotide
  Target: SCN10A; (-) strand; PAM type: NRG; PAM sequence: AGG
actgcaacccaccctgaatg

SEQ ID NO: 15689 - DNA, 20 bp, Artificial Sequence
  Description of Artificial Sequence: Synthetic oligonucleotide
  Target: SCN10A; (-) strand; PAM type: NRG; PAM sequence: GAG
cactgcaacccaccctgaat

SEQ ID NO: 15690 - DNA, 20 bp, Artificial Sequence
  Description of Artificial Sequence: Synthetic oligonucleotide
  Target: SCN10A; (-) strand; PAM type: NRG; PAM sequence: CAG
ctcacacttctaaatgagtg

SEQ ID NO: 15691 - DNA, 20 bp, Artificial Sequence
  Description of Artificial Sequence: Synthetic oligonucleotide
  Target: SCN10A; (-) strand; PAM type: NRG; PAM sequence: GAG
acacactcacacttctaaat

SEQ ID NO: 15692 - DNA, 20 bp, Artificial Sequence
  Description of Artificial Sequence: Synthetic oligonucleotide
  Target: SCN10A; (-) strand; PAM type: NRG; PAM sequence: AAG
ttctagaagtctgtatgtgc

SEQ ID NO: 15693 - DNA, 20 bp, Artificial Sequence
  Description of Artificial Sequence: Synthetic oligonucleotide
  Target: SCN10A; (-) strand; PAM type: NRG; PAM sequence: AAG
agaataagtcaaggttctag

SEQ ID NO: 15694 - DNA, 20 bp, Artificial Sequence
  Description of Artificial Sequence: Synthetic oligonucleotide
  Target: SCN10A; (-) strand; PAM type: NRG; PAM sequence: TAG
aggagaataagtcaaggttc

SEQ ID NO: 15695 - DNA, 20 bp, Artificial Sequence
  Description of Artificial Sequence: Synthetic oligonucleotide
  Target: SCN10A; (-) strand; PAM type: NRG; PAM sequence: AGG
tatttaaggagaataagtca

SEQ ID NO: 15696 - DNA, 20 bp, Artificial Sequence
  Description of Artificial Sequence: Synthetic oligonucleotide
  Target: SCN10A; (-) strand; PAM type: NRG; PAM sequence: AAG
gtatttaaggagaataagtc

SEQ ID NO: 15697 - DNA, 20 bp, Artificial Sequence
  Description of Artificial Sequence: Synthetic oligonucleotide
  Target: SCN10A; (-) strand; PAM type: NRG; PAM sequence: AAG
gtatggtatttaaggagaat

SEQ ID NO: 15698 - DNA, 20 bp, Artificial Sequence
  Description of Artificial Sequence: Synthetic oligonucleotide
  Target: SCN10A; (-) strand; PAM type: NRG; PAM sequence: GAG
ttttatgtatggtatttaag

SEQ ID NO: 15699 - DNA, 20 bp, Artificial Sequence
  Description of Artificial Sequence: Synthetic oligonucleotide
  Target: SCN10A; (-) strand; PAM type: NRG; PAM sequence: AGG
tgttttatgtatggtattta

SEQ ID NO: 15700 - DNA, 20 bp, Artificial Sequence
  Description of Artificial Sequence: Synthetic oligonucleotide
  Target: SCN10A; (-) strand; PAM type: NRG; PAM sequence: AAG
gtgttttatgtatggtattt

SEQ ID NO: 15701 - DNA, 20 bp, Artificial Sequence
  Description of Artificial Sequence: Synthetic oligonucleotide
  Target: SCN10A; (-) strand; PAM type: NRG; PAM sequence: TGG
ttgtgtttgtgttttatgta

SEQ ID NO: 15702 - DNA, 20 bp, Artificial Sequence
  Description of Artificial Sequence: Synthetic oligonucleotide
  Target: SCN10A; (-) strand; PAM type: NRG; PAM sequence: CGG
ttttcactggttcttgacca

SEQ ID NO: 15703 - DNA, 20 bp, Artificial Sequence
  Description of Artificial Sequence: Synthetic oligonucleotide
  Target: SCN10A; (-) strand; PAM type: NRG; PAM sequence: TGG
atatggatttaggttttcac

SEQ ID NO: 15704 - DNA, 20 bp, Artificial Sequence
  Description of Artificial Sequence: Synthetic oligonucleotide
  Target: SCN10A; (-) strand; PAM type: NRG; PAM sequence: AGG
tattttgtgaatatggattt

SEQ ID NO: 15705 - DNA, 20 bp, Artificial Sequence
  Description of Artificial Sequence: Synthetic oligonucleotide
  Target: SCN10A; (-) strand; PAM type: NRG; PAM sequence: TAG
ctattttgtgaatatggatt

SEQ ID NO: 15706 - DNA, 20 bp, Artificial Sequence
  Description of Artificial Sequence: Synthetic oligonucleotide
  Target: SCN10A; (-) strand; PAM type: NRG; PAM sequence: TGG
aataagctattttgtgaata

SEQ ID NO: 15707 - DNA, 20 bp, Artificial Sequence
  Description of Artificial Sequence: Synthetic oligonucleotide
  Target: SCN10A; (-) strand; PAM type: NRG; PAM sequence: AAG
tcatttgcttatttacaaat

SEQ ID NO: 15708 - DNA, 20 bp, Artificial Sequence
  Description of Artificial Sequence: Synthetic oligonucleotide
  Target: SCN10A; (-) strand; PAM type: NRG; PAM sequence: TAG
ttattctattttgtatctaa

SEQ ID NO: 15709 - DNA, 20 bp, Artificial Sequence
  Description of Artificial Sequence: Synthetic oligonucleotide
  Target: SCN10A; (-) strand; PAM type: NRG; PAM sequence: TAG
ctaggacccgaagattgaaa

SEQ ID NO: 15710 - DNA, 20 bp, Artificial Sequence
  Description of Artificial Sequence: Synthetic oligonucleotide
  Target: SCN10A; (-) strand; PAM type: NRG; PAM sequence: AAG
tttacaaacactaggacccg

SEQ ID NO: 15711 - DNA, 20 bp, Artificial Sequence
  Description of Artificial Sequence: Synthetic oligonucleotide
  Target: SCN10A; (-) strand; PAM type: NRG; PAM sequence: AGG
cttgtacctttacaaacact

SEQ ID NO: 15712 - DNA, 20 bp, Artificial Sequence
  Description of Artificial Sequence: Synthetic oligonucleotide
  Target: SCN10A; (-) strand; PAM type: NRG; PAM sequence: TAG
acttgtacctttacaaacac

SEQ ID NO: 15713 - DNA, 20 bp, Artificial Sequence
  Description of Artificial Sequence: Synthetic oligonucleotide
  Target: SCN10A; (-) strand; PAM type: NRG; PAM sequence: GGG
atagcttcaaaaacaaaagt

SEQ ID NO: 15714 - DNA, 20 bp, Artificial Sequence
  Description of Artificial Sequence: Synthetic oligonucleotide
  Target: SCN10A; (-) strand; PAM type: NRG; PAM sequence: TGG
catagcttcaaaaacaaaag

SEQ ID NO: 15715 - DNA, 20 bp, Artificial Sequence
  Description of Artificial Sequence: Synthetic oligonucleotide
  Target: SCN10A; (-) strand; PAM type: NRG; PAM sequence: AAG
catcatagcttcaaaaacaa

SEQ ID NO: 15716 - DNA, 20 bp, Artificial Sequence
  Description of Artificial Sequence: Synthetic oligonucleotide
  Target: SCN10A; (-) strand; PAM type: NRG; PAM sequence: TAG
ttggctggaagtagtcatca

SEQ ID NO: 15717 - DNA, 20 bp, Artificial Sequence
  Description of Artificial Sequence: Synthetic oligonucleotide
  Target: SCN10A; (-) strand; PAM type: NRG; PAM sequence: TAG
ccactatcattggctggaag

SEQ ID NO: 15718 - DNA, 20 bp, Artificial Sequence
  Description of Artificial Sequence: Synthetic oligonucleotide
  Target: SCN10A; (-) strand; PAM type: NRG; PAM sequence: AAG
gctccactatcattggctgg

SEQ ID NO: 15719 - DNA, 20 bp, Artificial Sequence
  Description of Artificial Sequence: Synthetic oligonucleotide
  Target: SCN10A; (-) strand; PAM type: NRG; PAM sequence: TGG
tttgctccactatcattggc

SEQ ID NO: 15720 - DNA, 20 bp, Artificial Sequence
  Description of Artificial Sequence: Synthetic oligonucleotide
  Target: SCN10A; (-) strand; PAM type: NRG; PAM sequence: TGG
ttgctttgctccactatcat

SEQ ID NO: 15721 - DNA, 20 bp, Artificial Sequence
  Description of Artificial Sequence: Synthetic oligonucleotide
  Target: SCN10A; (-) strand; PAM type: NRG; PAM sequence: AGG
tggctccccagcagaaagta

SEQ ID NO: 15722 - DNA, 20 bp, Artificial Sequence
  Description of Artificial Sequence: Synthetic oligonucleotide
  Target: SCN10A; (-) strand; PAM type: NRG; PAM sequence: AAG
atggctccccagcagaaagt

SEQ ID NO: 15723 - DNA, 20 bp, Artificial Sequence
  Description of Artificial Sequence: Synthetic oligonucleotide
  Target: SCN10A; (-) strand; PAM type: NRG; PAM sequence: AAG
acaaatggctccccagcaga

SEQ ID NO: 15724 - DNA, 20 bp, Artificial Sequence
  Description of Artificial Sequence: Synthetic oligonucleotide
  Target: SCN10A; (-) strand; PAM type: NRG; PAM sequence: CAG
aattacaaatggctccccag

SEQ ID NO: 15725 - DNA, 20 bp, Artificial Sequence
  Description of Artificial Sequence: Synthetic oligonucleotide
  Target: SCN10A; (-) strand; PAM type: NRG; PAM sequence: CAG
cataattacaaatggctccc

SEQ ID NO: 15726 - DNA, 20 bp, Artificial Sequence
  Description of Artificial Sequence: Synthetic oligonucleotide
  Target: SCN10A; (-) strand; PAM type: NRG; PAM sequence: TGG
ctcttcctcataattacaaa

SEQ ID NO: 15727 - DNA, 20 bp, Artificial Sequence
  Description of Artificial Sequence: Synthetic oligonucleotide
  Target: SCN10A; (-) strand; PAM type: NRG; PAM sequence: GAG
acagccagagccttgtctta

SEQ ID NO: 15728 - DNA, 20 bp, Artificial Sequence
  Description of Artificial Sequence: Synthetic oligonucleotide
  Target: SCN10A; (-) strand; PAM type: NRG; PAM sequence: TAG
tcacagccagagccttgtct

SEQ ID NO: 15729 - DNA, 20 bp, Artificial Sequence
  Description of Artificial Sequence: Synthetic oligonucleotide
  Target: SCN10A; (-) strand; PAM type: NRG; PAM sequence: GAG
ggacagaatgctcacagcca

SEQ ID NO: 15730 - DNA, 20 bp, Artificial Sequence
  Description of Artificial Sequence: Synthetic oligonucleotide
  Target: SCN10A; (-) strand; PAM type: NRG; PAM sequence: CAG
caggacagaatgctcacagc

SEQ ID NO: 15731 - DNA, 20 bp, Artificial Sequence
  Description of Artificial Sequence: Synthetic oligonucleotide
  Target: SCN10A; (-) strand; PAM type: NRG; PAM sequence: CAG
ccgtcaggacagaatgctca

SEQ ID NO: 15732 - DNA, 20 bp, Artificial Sequence
  Description of Artificial Sequence: Synthetic oligonucleotide
  Target: SCN10A; (-) strand; PAM type: NRG; PAM sequence: CAG
cctaactgcctccgtcagga

SEQ ID NO: 15733 - DNA, 20 bp, Artificial Sequence
  Description of Artificial Sequence: Synthetic oligonucleotide
  Target: SCN10A; (-) strand; PAM type: NRG; PAM sequence: AGG
ttgccctaactgcctccgtc

SEQ ID NO: 15734 - DNA, 20 bp, Artificial Sequence
  Description of Artificial Sequence: Synthetic oligonucleotide
  Target: SCN10A; (-) strand; PAM type: NRG; PAM sequence: CAG
cttgccctaactgcctccgt

SEQ ID NO: 15735 - DNA, 20 bp, Artificial Sequence
  Description of Artificial Sequence: Synthetic oligonucleotide
  Target: SCN10A; (-) strand; PAM type: NRG; PAM sequence: CAG
ctttccttatccaccactgt

SEQ ID NO: 15736 - DNA, 20 bp, Artificial Sequence
  Description of Artificial Sequence: Synthetic oligonucleotide
  Target: SCN10A; (-) strand; PAM type: NRG; PAM sequence: AGG
tcctacttaatgcaatcatc

SEQ ID NO: 15737 - DNA, 20 bp, Artificial Sequence
  Description of Artificial Sequence: Synthetic oligonucleotide
  Target: SCN10A; (-) strand; PAM type: NRG; PAM sequence: CAG
ctcctacttaatgcaatcat

SEQ ID NO: 15738 - DNA, 20 bp, Artificial Sequence
  Description of Artificial Sequence: Synthetic oligonucleotide
  Target: SCN10A; (-) strand; PAM type: NRG; PAM sequence: TGG
ttacctcagctgccacccac

SEQ ID NO: 15739 - DNA, 20 bp, Artificial Sequence
  Description of Artificial Sequence: Synthetic oligonucleotide
  Target: SCN10A; (-) strand; PAM type: NRG; PAM sequence: CAG
acatcatcagctcattacct

SEQ ID NO: 15740 - DNA, 20 bp, Artificial Sequence
  Description of Artificial Sequence: Synthetic oligonucleotide
  Target: SCN10A; (-) strand; PAM type: NRG; PAM sequence: CAG
tactccatgagtgacatcat

SEQ ID NO: 15741 - DNA, 20 bp, Artificial Sequence
  Description of Artificial Sequence: Synthetic oligonucleotide
  Target: SCN10A; (-) strand; PAM type: NRG; PAM sequence: GAG
tctttcctctaatactccat

SEQ ID NO: 15742 - DNA, 20 bp, Artificial Sequence
  Description of Artificial Sequence: Synthetic oligonucleotide
  Target: SCN10A; (-) strand; PAM type: NRG; PAM sequence: GAG
tctgtctttccatgacaaat

SEQ ID NO: 15743 - DNA, 20 bp, Artificial Sequence
  Description of Artificial Sequence: Synthetic oligonucleotide
  Target: SCN10A; (-) strand; PAM type: NRG; PAM sequence: AAG
caacatctccagaacatccc

SEQ ID NO: 15744 - DNA, 20 bp, Artificial Sequence
  Description of Artificial Sequence: Synthetic oligonucleotide
  Target: SCN10A; (-) strand; PAM type: NRG; PAM sequence: CAG
cctcttattgccaacatctc

SEQ ID NO: 15745 - DNA, 20 bp, Artificial Sequence
  Description of Artificial Sequence: Synthetic oligonucleotide
  Target: SCN10A; (-) strand; PAM type: NRG; PAM sequence: AAG
atcctgaatcatcgctccac

SEQ ID NO: 15746 - DNA, 20 bp, Artificial Sequence
  Description of Artificial Sequence: Synthetic oligonucleotide
  Target: SCN10A; (-) strand; PAM type: NRG; PAM sequence: AAG
caccccctttgctcttagtg

SEQ ID NO: 15747 - DNA, 20 bp, Artificial Sequence
  Description of Artificial Sequence: Synthetic oligonucleotide
  Target: SCN10A; (-) strand; PAM type: NRG; PAM sequence: TAG
gacctcaccccctttgctct

SEQ ID NO: 15748 - DNA, 20 bp, Artificial Sequence
  Description of Artificial Sequence: Synthetic oligonucleotide
  Target: SCN10A; (-) strand; PAM type: NRG; PAM sequence: CAG
atattacagccaccaggacc

SEQ ID NO: 15749 - DNA, 20 bp, Artificial Sequence
  Description of Artificial Sequence: Synthetic oligonucleotide
  Target: SCN10A; (-) strand; PAM type: NRG; PAM sequence: AGG
ccataaatattacagccacc

SEQ ID NO: 15750 - DNA, 20 bp, Artificial Sequence
  Description of Artificial Sequence: Synthetic oligonucleotide
  Target: SCN10A; (-) strand; PAM type: NRG; PAM sequence: CAG
cccataaatattacagccac

SEQ ID NO: 15751 - DNA, 20 bp, Artificial Sequence
  Description of Artificial Sequence: Synthetic oligonucleotide
  Target: SCN10A; (-) strand; PAM type: NRG; PAM sequence: CAG
cttgtcacccataaatatta

SEQ ID NO: 15752 - DNA, 20 bp, Artificial Sequence
  Description of Artificial Sequence: Synthetic oligonucleotide
  Target: SCN10A; (-) strand; PAM type: NRG; PAM sequence: GGG
tctctttcaagtctttttgt

SEQ ID NO: 15753 - DNA, 20 bp, Artificial Sequence
  Description of Artificial Sequence: Synthetic oligonucleotide
  Target: SCN10A; (-) strand; PAM type: NRG; PAM sequence: TGG
ttctctttcaagtctttttg

SEQ ID NO: 15754 - DNA, 20 bp, Artificial Sequence
  Description of Artificial Sequence: Synthetic oligonucleotide
  Target: SCN10A; (-) strand; PAM type: NRG; PAM sequence: AAG
aactctcttagttctctttc

SEQ ID NO: 15755 - DNA, 20 bp, Artificial Sequence
  Description of Artificial Sequence: Synthetic oligonucleotide
  Target: SCN10A; (-) strand; PAM type: NRG; PAM sequence: TAG
gctgcatgtcctaactctct

SEQ ID NO: 15756 - DNA, 20 bp, Artificial Sequence
  Description of Artificial Sequence: Synthetic oligonucleotide
  Target: SCN10A; (-) strand; PAM type: NRG; PAM sequence: TGG
acttcctgctctgactttgg

SEQ ID NO: 15757 - DNA, 20 bp, Artificial Sequence
  Description of Artificial Sequence: Synthetic oligonucleotide
  Target: SCN10A; (-) strand; PAM type: NRG; PAM sequence: TGG
ttcacttcctgctctgactt

SEQ ID NO: 15758 - DNA, 20 bp, Artificial Sequence
  Description of Artificial Sequence: Synthetic oligonucleotide
  Target: SCN10A; (-) strand; PAM type: NRG; PAM sequence: GAG
cacctccaaaggtaggctct

SEQ ID NO: 15759 - DNA, 20 bp, Artificial Sequence
  Description of Artificial Sequence: Synthetic oligonucleotide
  Target: SCN10A; (-) strand; PAM type: NRG; PAM sequence: AGG
ggggccccacctccaaaggt

SEQ ID NO: 15760 - DNA, 20 bp, Artificial Sequence
  Description of Artificial Sequence: Synthetic oligonucleotide
  Target: SCN10A; (-) strand; PAM type: NRG; PAM sequence: TAG
cggggccccacctccaaagg

SEQ ID NO: 15761 - DNA, 20 bp, Artificial Sequence
  Description of Artificial Sequence: Synthetic oligonucleotide
  Target: SCN10A; (-) strand; PAM type: NRG; PAM sequence: AGG
ctccggggccccacctccaa

SEQ ID NO: 15762 - DNA, 20 bp, Artificial Sequence
  Description of Artificial Sequence: Synthetic oligonucleotide
  Target: SCN10A; (-) strand; PAM type: NRG; PAM sequence: AAG
gctccggggccccacctcca

SEQ ID NO: 15763 - DNA, 20 bp, Artificial Sequence
  Description of Artificial Sequence: Synthetic oligonucleotide
  Target: SCN10A; (-) strand; PAM type: NRG; PAM sequence: GGG
cccaccaaccctgagctccg

SEQ ID NO: 15764 - DNA, 20 bp, Artificial Sequence
  Description of Artificial Sequence: Synthetic oligonucleotide
  Target: SCN10A; (-) strand; PAM type: NRG; PAM sequence: GGG
tcccaccaaccctgagctcc

SEQ ID NO: 15765 - DNA, 20 bp, Artificial Sequence
  Description of Artificial Sequence: Synthetic oligonucleotide
  Target: SCN10A; (-) strand; PAM type: NRG; PAM sequence: CGG
atcccaccaaccctgagctc

SEQ ID NO: 15766 - DNA, 20 bp, Artificial Sequence
  Description of Artificial Sequence: Synthetic oligonucleotide
  Target: SCN10A; (-) strand; PAM type: NRG; PAM sequence: GAG
ccctccatcccaccaaccct

SEQ ID NO: 15767 - DNA, 20 bp, Artificial Sequence
  Description of Artificial Sequence: Synthetic oligonucleotide
  Target: SCN10A; (-) strand; PAM type: NRG; PAM sequence: TGG
cttctctggtctgcaggttt

SEQ ID NO: 15768 - DNA, 20 bp, Artificial Sequence
  Description of Artificial Sequence: Synthetic oligonucleotide
  Target: SCN10A; (-) strand; PAM type: NRG; PAM sequence: AGG
aaaaaacttctctggtctgc

SEQ ID NO: 15769 - DNA, 20 bp, Artificial Sequence
  Description of Artificial Sequence: Synthetic oligonucleotide
  Target: SCN10A; (-) strand; PAM type: NRG; PAM sequence: CAG
caaaaaacttctctggtctg

SEQ ID NO: 15770 - DNA, 20 bp, Artificial Sequence
  Description of Artificial Sequence: Synthetic oligonucleotide
  Target: SCN10A; (-) strand; PAM type: NRG; PAM sequence: TGG
aaacaaacaaaaaacttctc

SEQ ID NO: 15771 - DNA, 20 bp, Artificial Sequence
  Description of Artificial Sequence: Synthetic oligonucleotide
  Target: SCN10A; (-) strand; PAM type: NRG; PAM sequence: GAG
tccagcctgggtgacagagc

SEQ ID NO: 15772 - DNA, 20 bp, Artificial Sequence
  Description of Artificial Sequence: Synthetic oligonucleotide
  Target: SCN10A; (-) strand; PAM type: NRG; PAM sequence: GAG
atactccagcctgggtgaca

SEQ ID NO: 15773 - DNA, 20 bp, Artificial Sequence
  Description of Artificial Sequence: Synthetic oligonucleotide
  Target: SCN10A; (-) strand; PAM type: NRG; PAM sequence: CAG
ttatactccagcctgggtga

SEQ ID NO: 15774 - DNA, 20 bp, Artificial Sequence
  Description of Artificial Sequence: Synthetic oligonucleotide
  Target: SCN10A; (-) strand; PAM type: NRG; PAM sequence: GGG
gtgccattatactccagcct

SEQ ID NO: 15775 - DNA, 20 bp, Artificial Sequence
  Description of Artificial Sequence: Synthetic oligonucleotide
  Target: SCN10A; (-) strand; PAM type: NRG; PAM sequence: TGG
tgtgccattatactccagcc

SEQ ID NO: 15776 - DNA, 20 bp, Artificial Sequence
  Description of Artificial Sequence: Synthetic oligonucleotide
  Target: SCN10A; (-) strand; PAM type: NRG; PAM sequence: CAG
gagattgtgccattatactc

SEQ ID NO: 15777 - DNA, 20 bp, Artificial Sequence
  Description of Artificial Sequence: Synthetic oligonucleotide
  Target: SCN10A; (-) strand; PAM type: NRG; PAM sequence: GAG
aggtgtggtggtagtgagcc

SEQ ID NO: 15778 - DNA, 20 bp, Artificial Sequence
  Description of Artificial Sequence: Synthetic oligonucleotide
  Target: SCN10A; (-) strand; PAM type: NRG; PAM sequence: GAG
ccacgaggtgtggtggtagt

SEQ ID NO: 15779 - DNA, 20 bp, Artificial Sequence
  Description of Artificial Sequence: Synthetic oligonucleotide
  Target: SCN10A; (-) strand; PAM type: NRG; PAM sequence: TAG
accaccacgaggtgtggtgg

SEQ ID NO: 15780 - DNA, 20 bp, Artificial Sequence
  Description of Artificial Sequence: Synthetic oligonucleotide
  Target: SCN10A; (-) strand; PAM type: NRG; PAM sequence: TGG
actaccaccacgaggtgtgg

SEQ ID NO: 15781 - DNA, 20 bp, Artificial Sequence
  Description of Artificial Sequence: Synthetic oligonucleotide
  Target: SCN10A; (-) strand; PAM type: NRG; PAM sequence: TGG
atcactaccaccacgaggtg

SEQ ID NO: 15782 - DNA, 20 bp, Artificial Sequence
  Description of Artificial Sequence: Synthetic oligonucleotide
  Target: SCN10A; (-) strand; PAM type: NRG; PAM sequence: AGG
caaaaatcactaccaccacg

SEQ ID NO: 15783 - DNA, 20 bp, Artificial Sequence
  Description of Artificial Sequence: Synthetic oligonucleotide
  Target: SCN10A; (-) strand; PAM type: NRG; PAM sequence: GAG
acaaaaatcactaccaccac

SEQ ID NO: 15784 - DNA, 20 bp, Artificial Sequence
  Description of Artificial Sequence: Synthetic oligonucleotide
  Target: SCN10A; (-) strand; PAM type: NRG; PAM sequence: AAG
cgaaaccctgtctctgctaa

SEQ ID NO: 15785 - DNA, 20 bp, Artificial Sequence
  Description of Artificial Sequence: Synthetic oligonucleotide
  Target: SCN10A; (-) strand; PAM type: NRG; PAM sequence: TGG
ttaggagttcaaaaccaccc

SEQ ID NO: 15786 - DNA, 20 bp, Artificial Sequence
  Description of Artificial Sequence: Synthetic oligonucleotide
  Target: SCN10A; (-) strand; PAM type: NRG; PAM sequence: GAG
ggcggatcacctgaggttag

SEQ ID NO: 15787 - DNA, 20 bp, Artificial Sequence
  Description of Artificial Sequence: Synthetic oligonucleotide
  Target: SCN10A; (-) strand; PAM type: NRG; PAM sequence: AGG
cgggcggatcacctgaggtt

SEQ ID NO: 15788 - DNA, 20 bp, Artificial Sequence
  Description of Artificial Sequence: Synthetic oligonucleotide
  Target: SCN10A; (-) strand; PAM type: NRG; PAM sequence: TAG
gcgggcggatcacctgaggt

SEQ ID NO: 15789 - DNA, 20 bp, Artificial Sequence
  Description of Artificial Sequence: Synthetic oligonucleotide
  Target: SCN10A; (-) strand; PAM type: NRG; PAM sequence: AGG
tgaggcgggcggatcacctg

SEQ ID NO: 15790 - DNA, 20 bp, Artificial Sequence
  Description of Artificial Sequence: Synthetic oligonucleotide
  Target: SCN10A; (-) strand; PAM type: NRG; PAM sequence: GAG
ctgaggcgggcggatcacct

SEQ ID NO: 15791 - DNA, 20 bp, Artificial Sequence
  Description of Artificial Sequence: Synthetic oligonucleotide
  Target: SCN10A; (-) strand; PAM type: NRG; PAM sequence: CGG
ctttgggaggctgaggcggg

SEQ ID NO: 15792 - DNA, 20 bp, Artificial Sequence
  Description of Artificial Sequence: Synthetic oligonucleotide
  Target: SCN10A; (-) strand; PAM type: NRG; PAM sequence: GGG
gcactttgggaggctgaggc

SEQ ID NO: 15793 - DNA, 20 bp, Artificial Sequence
  Description of Artificial Sequence: Synthetic oligonucleotide
  Target: SCN10A; (-) strand; PAM type: NRG; PAM sequence: CGG
agcactttgggaggctgagg

SEQ ID NO: 15794 - DNA, 20 bp, Artificial Sequence
  Description of Artificial Sequence: Synthetic oligonucleotide
  Target: SCN10A; (-) strand; PAM type: NRG; PAM sequence: AGG
cccagcactttgggaggctg

SEQ ID NO: 15795 - DNA, 20 bp, Artificial Sequence
  Description of Artificial Sequence: Synthetic oligonucleotide
  Target: SCN10A; (-) strand; PAM type: NRG; PAM sequence: GAG
tcccagcactttgggaggct

SEQ ID NO: 15796 - DNA, 20 bp, Artificial Sequence
  Description of Artificial Sequence: Synthetic oligonucleotide
  Target: SCN10A; (-) strand; PAM type: NRG; PAM sequence: AGG
tgtaatcccagcactttggg

SEQ ID NO: 15797 - DNA, 20 bp, Artificial Sequence
  Description of Artificial Sequence: Synthetic oligonucleotide
  Target: SCN10A; (-) strand; PAM type: NRG; PAM sequence: GAG
ctgtaatcccagcactttgg

SEQ ID NO: 15798 - DNA, 20 bp, Artificial Sequence
  Description of Artificial Sequence: Synthetic oligonucleotide
  Target: SCN10A; (-) strand; PAM type: NRG; PAM sequence: GGG
gcctgtaatcccagcacttt

SEQ ID NO: 15799 - DNA, 20 bp, Artificial Sequence
  Description of Artificial Sequence: Synthetic oligonucleotide
  Target: SCN10A; (-) strand; PAM type: NRG; PAM sequence: TGG
tgcctgtaatcccagcactt

SEQ ID NO: 15800 - DNA, 20 bp, Artificial Sequence
  Description of Artificial Sequence: Synthetic oligonucleotide
  Target: SCN10A; (-) strand; PAM type: NRG; PAM sequence: CAG
gtggttcatgcctgtaatcc

SEQ ID NO: 15801 - DNA, 20 bp, Artificial Sequence
  Description of Artificial Sequence: Synthetic oligonucleotide
  Target: SCN10A; (-) strand; PAM type: NRG; PAM sequence: TGG
tctcatctggccaggcacgg

SEQ ID NO: 15802 - DNA, 20 bp, Artificial Sequence
  Description of Artificial Sequence: Synthetic oligonucleotide
  Target: SCN10A; (-) strand; PAM type: NRG; PAM sequence: CGG
ttctctcatctggccaggca

SEQ ID NO: 15803 - DNA, 20 bp, Artificial Sequence
  Description of Artificial Sequence: Synthetic oligonucleotide
  Target: SCN10A; (-) strand; PAM type: NRG; PAM sequence: AGG
aaaacttctctcatctggcc

SEQ ID NO: 15804 - DNA, 20 bp, Artificial Sequence
  Description of Artificial Sequence: Synthetic oligonucleotide
  Target: SCN10A; (-) strand; PAM type: NRG; PAM sequence: CAG
caaaacttctctcatctggc

SEQ ID NO: 15805 - DNA, 20 bp, Artificial Sequence
  Description of Artificial Sequence: Synthetic oligonucleotide
  Target: SCN10A; (-) strand; PAM type: NRG; PAM sequence: TGG
atctcaaaacttctctcatc

SEQ ID NO: 15806 - DNA, 20 bp, Artificial Sequence
  Description of Artificial Sequence: Synthetic oligonucleotide
  Target: SCN10A; (-) strand; PAM type: NRG; PAM sequence: AAG
cgatttgaaggcatgcgggt

SEQ ID NO: 15807 - DNA, 20 bp, Artificial Sequence
  Description of Artificial Sequence: Synthetic oligonucleotide
  Target: SCN10A; (-) strand; PAM type: NRG; PAM sequence: GGG
ttctcgatttgaaggcatgc

SEQ ID NO: 15808 - DNA, 20 bp, Artificial Sequence
  Description of Artificial Sequence: Synthetic oligonucleotide
  Target: SCN10A; (-) strand; PAM type: NRG; PAM sequence: CGG
tttctcgatttgaaggcatg

SEQ ID NO: 15809 - DNA, 20 bp, Artificial Sequence
  Description of Artificial Sequence: Synthetic oligonucleotide
  Target: SCN10A; (-) strand; PAM type: NRG; PAM sequence: AGG
cgggctctttctcgatttga

SEQ ID NO: 15810 - DNA, 20 bp, Artificial Sequence
  Description of Artificial Sequence: Synthetic oligonucleotide
  Target: SCN10A; (-) strand; PAM type: NRG; PAM sequence: AAG
gcgggctctttctcgatttg

SEQ ID NO: 15811 - DNA, 20 bp, Artificial Sequence
  Description of Artificial Sequence: Synthetic oligonucleotide
  Target: SCN10A; (-) strand; PAM type: NRG; PAM sequence: GGG
tcgcgctctgcggccactgc

SEQ ID NO: 15812 - DNA, 20 bp, Artificial Sequence
  Description of Artificial Sequence: Synthetic oligonucleotide
  Target: SCN10A; (-) strand; PAM type: NRG; PAM sequence: CGG
ttcgcgctctgcggccactg

SEQ ID NO: 15813 - DNA, 20 bp, Artificial Sequence
  Description of Artificial Sequence: Synthetic oligonucleotide
  Target: SCN10A; (-) strand; PAM type: NRG; PAM sequence: CGG
ttcgaacccttcgcgctctg

SEQ ID NO: 15814 - DNA, 20 bp, Artificial Sequence
  Description of Artificial Sequence: Synthetic oligonucleotide
  Target: SCN10A; (-) strand; PAM type: NRG; PAM sequence: AAG
ttctgaagtggctcccatca

SEQ ID NO: 15815 - DNA, 20 bp, Artificial Sequence
  Description of Artificial Sequence: Synthetic oligonucleotide
  Target: SCN10A; (-) strand; PAM type: NRG; PAM sequence: TGG
gattctggaatattctgaag

SEQ ID NO: 15816 - DNA, 20 bp, Artificial Sequence
  Description of Artificial Sequence: Synthetic oligonucleotide
  Target: SCN10A; (-) strand; PAM type: NRG; PAM sequence: AAG
gaagattctggaatattctg

SEQ ID NO: 15817 - DNA, 20 bp, Artificial Sequence
  Description of Artificial Sequence: Synthetic oligonucleotide
  Target: SCN10A; (-) strand; PAM type: NRG; PAM sequence: TGG
aagtctcacagcgaagattc

SEQ ID NO: 15818 - DNA, 20 bp, Artificial Sequence
  Description of Artificial Sequence: Synthetic oligonucleotide
  Target: SCN10A; (-) strand; PAM type: NRG; PAM sequence: AAG
cactgataagtctcacagcg

SEQ ID NO: 15819 - DNA, 20 bp, Artificial Sequence
  Description of Artificial Sequence: Synthetic oligonucleotide
  Target: SCN10A; (-) strand; PAM type: NRG; PAM sequence: CAG
gatctcactgataagtctca

SEQ ID NO: 15820 - DNA, 20 bp, Artificial Sequence
  Description of Artificial Sequence: Synthetic oligonucleotide
  Target: SCN10A; (-) strand; PAM type: NRG; PAM sequence: AAG
tgcactcagatctcactgat

SEQ ID NO: 15821 - DNA, 20 bp, Artificial Sequence
  Description of Artificial Sequence: Synthetic oligonucleotide
  Target: SCN10A; (-) strand; PAM type: NRG; PAM sequence: CAG
tttctgccctctcctgcact

SEQ ID NO: 15822 - DNA, 20 bp, Artificial Sequence
  Description of Artificial Sequence: Synthetic oligonucleotide
  Target: SCN10A; (-) strand; PAM type: NRG; PAM sequence: GAG
actgcctttctggaaaccta

SEQ ID NO: 15823 - DNA, 20 bp, Artificial Sequence
  Description of Artificial Sequence: Synthetic oligonucleotide
  Target: SCN10A; (-) strand; PAM type: NRG; PAM sequence: TAG
ggactgcctttctggaaacc

SEQ ID NO: 15824 - DNA, 20 bp, Artificial Sequence
  Description of Artificial Sequence: Synthetic oligonucleotide
  Target: SCN10A; (-) strand; PAM type: NRG; PAM sequence: TGG
ttccacgaggactgcctttc

SEQ ID NO: 15825 - DNA, 20 bp, Artificial Sequence
  Description of Artificial Sequence: Synthetic oligonucleotide
  Target: SCN10A; (-) strand; PAM type: NRG; PAM sequence: AGG
agttcctgtctccttccacg

SEQ ID NO: 15826 - DNA, 20 bp, Artificial Sequence
  Description of Artificial Sequence: Synthetic oligonucleotide
  Target: SCN10A; (-) strand; PAM type: NRG; PAM sequence: GAG
gagttcctgtctccttccac

SEQ ID NO: 15827 - DNA, 20 bp, Artificial Sequence
  Description of Artificial Sequence: Synthetic oligonucleotide
  Target: SCN10A; (-) strand; PAM type: NRG; PAM sequence: GAG
ggaatgggaggctgggcagg

SEQ ID NO: 15828 - DNA, 20 bp, Artificial Sequence
  Description of Artificial Sequence: Synthetic oligonucleotide
  Target: SCN10A; (-) strand; PAM type: NRG; PAM sequence: GGG
taggaatgggaggctgggca

SEQ ID NO: 15829 - DNA, 20 bp, Artificial Sequence
  Description of Artificial Sequence: Synthetic oligonucleotide
  Target: SCN10A; (-) strand; PAM type: NRG; PAM sequence: AGG
gtaggaatgggaggctgggc

SEQ ID NO: 15830 - DNA, 20 bp, Artificial Sequence
  Description of Artificial Sequence: Synthetic oligonucleotide
  Target: SCN10A; (-) strand; PAM type: NRG; PAM sequence: CAG
tgtaggaatgggaggctggg

SEQ ID NO: 15831 - DNA, 20 bp, Artificial Sequence
  Description of Artificial Sequence: Synthetic oligonucleotide
  Target: SCN10A; (-) strand; PAM type: NRG; PAM sequence: GGG
acgtgtaggaatgggaggct

SEQ ID NO: 15832 - DNA, 20 bp, Artificial Sequence
  Description of Artificial Sequence: Synthetic oligonucleotide
  Target: SCN10A; (-) strand; PAM type: NRG; PAM sequence: TGG
gacgtgtaggaatgggaggc

SEQ ID NO: 15833 - DNA, 20 bp, Artificial Sequence
  Description of Artificial Sequence: Synthetic oligonucleotide
  Target: SCN10A; (-) strand; PAM type: NRG; PAM sequence: AGG
cttagacgtgtaggaatggg

SEQ ID NO: 15834 - DNA, 20 bp, Artificial Sequence
  Description of Artificial Sequence: Synthetic oligonucleotide
  Target: SCN10A; (-) strand; PAM type: NRG; PAM sequence: GAG
gcttagacgtgtaggaatgg

SEQ ID NO: 15835 - DNA, 20 bp, Artificial Sequence
  Description of Artificial Sequence: Synthetic oligonucleotide
  Target: SCN10A; (-) strand; PAM type: NRG; PAM sequence: GGG
tggcttagacgtgtaggaat

SEQ ID NO: 15836 - DNA, 20 bp, Artificial Sequence
  Description of Artificial Sequence: Synthetic oligonucleotide
  Target: SCN10A; (-) strand; PAM type: NRG; PAM sequence: TGG
atggcttagacgtgtaggaa

SEQ ID NO: 15837 - DNA, 20 bp, Artificial Sequence
  Description of Artificial Sequence: Synthetic oligonucleotide
  Target: SCN10A; (-) strand; PAM type: NRG; PAM sequence: AGG
ggatgatggcttagacgtgt

SEQ ID NO: 15838 - DNA, 20 bp, Artificial Sequence
  Description of Artificial Sequence: Synthetic oligonucleotide
  Target: SCN10A; (-) strand; PAM type: NRG; PAM sequence: TAG
aggatgatggcttagacgtg

SEQ ID NO: 15839 - DNA, 20 bp, Artificial Sequence
  Description of Artificial Sequence: Synthetic oligonucleotide
  Target: SCN10A; (-) strand; PAM type: NRG; PAM sequence: TAG
tgggagctaggatgatggct

SEQ ID NO: 15840 - DNA, 20 bp, Artificial Sequence
  Description of Artificial Sequence: Synthetic oligonucleotide
  Target: SCN10A; (-) strand; PAM type: NRG; PAM sequence: TGG
taaggtgggagctaggatga

SEQ ID NO: 15841 - DNA, 20 bp, Artificial Sequence
  Description of Artificial Sequence: Synthetic oligonucleotide
  Target: SCN10A; (-) strand; PAM type: NRG; PAM sequence: AGG
ttccgaataaggtgggagct

SEQ ID NO: 15842 - DNA, 20 bp, Artificial Sequence
  Description of Artificial Sequence: Synthetic oligonucleotide
  Target: SCN10A; (-) strand; PAM type: NRG; PAM sequence: TAG
gttccgaataaggtgggagc

SEQ ID NO: 15843 - DNA, 20 bp, Artificial Sequence
  Description of Artificial Sequence: Synthetic oligonucleotide
  Target: SCN10A; (-) strand; PAM type: NRG; PAM sequence: GAG
tggagttccgaataaggtgg

SEQ ID NO: 15844 - DNA, 20 bp, Artificial Sequence
  Description of Artificial Sequence: Synthetic oligonucleotide
  Target: SCN10A; (-) strand; PAM type: NRG; PAM sequence: GGG
attggagttccgaataaggt

SEQ ID NO: 15845 - DNA, 20 bp, Artificial Sequence
  Description of Artificial Sequence: Synthetic oligonucleotide
  Target: SCN10A; (-) strand; PAM type: NRG; PAM sequence: TGG
cattggagttccgaataagg

SEQ ID NO: 15846 - DNA, 20 bp, Artificial Sequence
  Description of Artificial Sequence: Synthetic oligonucleotide
  Target: SCN10A; (-) strand; PAM type: NRG; PAM sequence: AGG
tctcattggagttccgaata

SEQ ID NO: 15847 - DNA, 20 bp, Artificial Sequence
  Description of Artificial Sequence: Synthetic oligonucleotide
  Target: SCN10A; (-) strand; PAM type: NRG; PAM sequence: AAG
ctctcattggagttccgaat

SEQ ID NO: 15848 - DNA, 20 bp, Artificial Sequence
  Description of Artificial Sequence: Synthetic oligonucleotide
  Target: SCN10A; (-) strand; PAM type: NRG; PAM sequence: GAG
tctttctagacctctcattg

SEQ ID NO: 15849 - DNA, 20 bp, Artificial Sequence
  Description of Artificial Sequence: Synthetic oligonucleotide
  Target: SCN10A; (-) strand; PAM type: NRG; PAM sequence: TGG
actctttctagacctctcat

SEQ ID NO: 15850 - DNA, 20 bp, Artificial Sequence
  Description of Artificial Sequence: Synthetic oligonucleotide
  Target: SCN10A; (-) strand; PAM type: NRG; PAM sequence: TAG
ggaagagacaaaactctttc

SEQ ID NO: 15851 - DNA, 20 bp, Artificial Sequence
  Description of Artificial Sequence: Synthetic oligonucleotide
  Target: SCN10A; (-) strand; PAM type: NRG; PAM sequence: GAG
aaatttttaataaaagggaa

SEQ ID NO: 15852 - DNA, 20 bp, Artificial Sequence
  Description of Artificial Sequence: Synthetic oligonucleotide
  Target: SCN10A; (-) strand; PAM type: NRG; PAM sequence: AAG
taaaatttttaataaaaggg

SEQ ID NO: 15853 - DNA, 20 bp, Artificial Sequence
  Description of Artificial Sequence: Synthetic oligonucleotide
  Target: SCN10A; (-) strand; PAM type: NRG; PAM sequence: GGG
gaataaaatttttaataaaa

SEQ ID NO: 15854 - DNA, 20 bp, Artificial Sequence
  Description of Artificial Sequence: Synthetic oligonucleotide
  Target: SCN10A; (-) strand; PAM type: NRG; PAM sequence: AGG
tgaataaaatttttaataaa

SEQ ID NO: 15855 - DNA, 20 bp, Artificial Sequence
  Description of Artificial Sequence: Synthetic oligonucleotide
  Target: SCN10A; (-) strand; PAM type: NRG; PAM sequence: AAG
gtgaataaaatttttaataa

SEQ ID NO: 15856 - DNA, 20 bp, Artificial Sequence
  Description of Artificial Sequence: Synthetic oligonucleotide
  Target: SCN10A; (-) strand; PAM type: NRG; PAM sequence: TGG
gcccagattgtttaagagag

SEQ ID NO: 15857 - DNA, 20 bp, Artificial Sequence
  Description of Artificial Sequence: Synthetic oligonucleotide
  Target: SCN10A; (-) strand; PAM type: NRG; PAM sequence: GAG
cttgcccagattgtttaaga

SEQ ID NO: 15858 - DNA, 20 bp, Artificial Sequence
  Description of Artificial Sequence: Synthetic oligonucleotide
  Target: SCN10A; (-) strand; PAM type: NRG; PAM sequence: GAG
ttcttgcccagattgtttaa

SEQ ID NO: 15859 - DNA, 20 bp, Artificial Sequence
  Description of Artificial Sequence: Synthetic oligonucleotide
  Target: SCN10A; (-) strand; PAM type: NRG; PAM sequence: AAG
ttttcttgcccagattgttt

SEQ ID NO: 15860 - DNA, 20 bp, Artificial Sequence
  Description of Artificial Sequence: Synthetic oligonucleotide
  Target: SCN10A; (-) strand; PAM type: NRG; PAM sequence: CAG
gagactgagtttttcttgcc

SEQ ID NO: 15861 - DNA, 20 bp, Artificial Sequence
  Description of Artificial Sequence: Synthetic oligonucleotide
  Target: SCN10A; (-) strand; PAM type: NRG; PAM sequence: GAG
ggttggtgatgttagagact

SEQ ID NO: 15862 - DNA, 20 bp, Artificial Sequence
  Description of Artificial Sequence: Synthetic oligonucleotide
  Target: SCN10A; (-) strand; PAM type: NRG; PAM sequence: GAG
accagaggttggtgatgtta

SEQ ID NO: 15863 - DNA, 20 bp, Artificial Sequence
  Description of Artificial Sequence: Synthetic oligonucleotide
  Target: SCN10A; (-) strand; PAM type: NRG; PAM sequence: TAG
gtaccagaggttggtgatgt

SEQ ID NO: 15864 - DNA, 20 bp, Artificial Sequence
  Description of Artificial Sequence: Synthetic oligonucleotide
  Target: SCN10A; (-) strand; PAM type: NRG; PAM sequence: TGG
gccacctacgtaccagaggt

SEQ ID NO: 15865 - DNA, 20 bp, Artificial Sequence
  Description of Artificial Sequence: Synthetic oligonucleotide
  Target: SCN10A; (-) strand; PAM type: NRG; PAM sequence: AGG
cttggccacctacgtaccag

SEQ ID NO: 15866 - DNA, 20 bp, Artificial Sequence
  Description of Artificial Sequence: Synthetic oligonucleotide
  Target: SCN10A; (-) strand; PAM type: NRG; PAM sequence: GAG
gcttggccacctacgtacca

SEQ ID NO: 15867 - DNA, 20 bp, Artificial Sequence
  Description of Artificial Sequence: Synthetic oligonucleotide
  Target: SCN10A; (-) strand; PAM type: NRG; PAM sequence: CAG
aagcttggccacctacgtac

SEQ ID NO: 15868 - DNA, 20 bp, Artificial Sequence
  Description of Artificial Sequence: Synthetic oligonucleotide
  Target: SCN10A; (-) strand; PAM type: NRG; PAM sequence: TGG
gatttaatacactggaagct

SEQ ID NO: 15869 - DNA, 20 bp, Artificial Sequence
  Description of Artificial Sequence: Synthetic oligonucleotide
  Target: SCN10A; (-) strand; PAM type: NRG; PAM sequence: AAG
gagttgatttaatacactgg

SEQ ID NO: 15870 - DNA, 20 bp, Artificial Sequence
  Description of Artificial Sequence: Synthetic oligonucleotide
  Target: SCN10A; (-) strand; PAM type: NRG; PAM sequence: TGG
gaagagttgatttaatacac

SEQ ID NO: 15871 - DNA, 20 bp, Artificial Sequence
  Description of Artificial Sequence: Synthetic oligonucleotide
  Target: SCN10A; (-) strand; PAM type: NRG; PAM sequence: GAG
gcccctagaaggaaaaggaa

SEQ ID NO: 15872 - DNA, 20 bp, Artificial Sequence
  Description of Artificial Sequence: Synthetic oligonucleotide
  Target: SCN10A; (-) strand; PAM type: NRG; PAM sequence: AAG
ctgcccctagaaggaaaagg

SEQ ID NO: 15873 - DNA, 20 bp, Artificial Sequence
  Description of Artificial Sequence: Synthetic oligonucleotide
  Target: SCN10A; (-) strand; PAM type: NRG; PAM sequence: AGG
ctgctgcccctagaaggaaa

SEQ ID NO: 15874 - DNA, 20 bp, Artificial Sequence
  Description of Artificial Sequence: Synthetic oligonucleotide
  Target: SCN10A; (-) strand; PAM type: NRG; PAM sequence: AAG
actgctgcccctagaaggaa

SEQ ID NO: 15875 - DNA, 20 bp, Artificial Sequence
  Description of Artificial Sequence: Synthetic oligonucleotide
  Target: SCN10A; (-) strand; PAM type: NRG; PAM sequence: AGG
gcctgactgctgcccctaga

SEQ ID NO: 15876 - DNA, 20 bp, Artificial Sequence
  Description of Artificial Sequence: Synthetic oligonucleotide
  Target: SCN10A; (-) strand; PAM type: NRG; PAM sequence: AAG
ggcctgactgctgcccctag

SEQ ID NO: 15877 - DNA, 20 bp, Artificial Sequence
  Description of Artificial Sequence: Synthetic oligonucleotide
  Target: SCN10A; (-) strand; PAM type: NRG; PAM sequence: TAG
tgaggcctgactgctgcccc

SEQ ID NO: 15878 - DNA, 20 bp, Artificial Sequence
  Description of Artificial Sequence: Synthetic oligonucleotide
  Target: SCN10A; (-) strand; PAM type: NRG; PAM sequence: AGG
aatcagtttcaaggttgttg

SEQ ID NO: 15879 - DNA, 20 bp, Artificial Sequence
  Description of Artificial Sequence: Synthetic oligonucleotide
  Target: SCN10A; (-) strand; PAM type: NRG; PAM sequence: GAG
aaatcagtttcaaggttgtt

SEQ ID NO: 15880 - DNA, 20 bp, Artificial Sequence
  Description of Artificial Sequence: Synthetic oligonucleotide
  Target: SCN10A; (-) strand; PAM type: NRG; PAM sequence: AGG
gtctctgaaaatcagtttca

SEQ ID NO: 15881 - DNA, 20 bp, Artificial Sequence
  Description of Artificial Sequence: Synthetic oligonucleotide
  Target: SCN10A; (-) strand; PAM type: NRG; PAM sequence: AAG
agtctctgaaaatcagtttc

SEQ ID NO: 15882 - DNA, 20 bp, Artificial Sequence
  Description of Artificial Sequence: Synthetic oligonucleotide
  Target: SCN10A; (-) strand; PAM type: NRG; PAM sequence: CAG
gtctccaagtctctgaaaat

SEQ ID NO: 15883 - DNA, 20 bp, Artificial Sequence
  Description of Artificial Sequence: Synthetic oligonucleotide
  Target: SCN10A; (-) strand; PAM type: NRG; PAM sequence: AAG
ggagggaacatcatgtctcc

SEQ ID NO: 15884 - DNA, 20 bp, Artificial Sequence
  Description of Artificial Sequence: Synthetic oligonucleotide
  Target: SCN10A; (-) strand; PAM type: NRG; PAM sequence: GGG
tctcagcatagcccctagga

SEQ ID NO: 15885 - DNA, 20 bp, Artificial Sequence
  Description of Artificial Sequence: Synthetic oligonucleotide
  Target: SCN10A; (-) strand; PAM type: NRG; PAM sequence: AGG
ctctcagcatagcccctagg

SEQ ID NO: 15886 - DNA, 20 bp, Artificial Sequence
  Description of Artificial Sequence: Synthetic oligonucleotide
  Target: SCN10A; (-) strand; PAM type: NRG; PAM sequence: GAG
actctcagcatagcccctag

SEQ ID NO: 15887 - DNA, 20 bp, Artificial Sequence
  Description of Artificial Sequence: Synthetic oligonucleotide
  Target: SCN10A; (-) strand; PAM type: NRG; PAM sequence: AGG
agactctcagcatagcccct

SEQ ID NO: 15888 - DNA, 20 bp, Artificial Sequence
  Description of Artificial Sequence: Synthetic oligonucleotide
  Target: SCN10A; (-) strand; PAM type: NRG; PAM sequence: TAG
tagactctcagcatagcccc

SEQ ID NO: 15889 - DNA, 20 bp, Artificial Sequence
  Description of Artificial Sequence: Synthetic oligonucleotide
  Target: SCN10A; (-) strand; PAM type: NRG; PAM sequence: TAG
ctcagaatagactctcagca

SEQ ID NO: 15890 - DNA, 20 bp, Artificial Sequence
  Description of Artificial Sequence: Synthetic oligonucleotide
  Target: SCN10A; (-) strand; PAM type: NRG; PAM sequence: CAG
tattcctcagaatagactct

SEQ ID NO: 15891 - DNA, 20 bp, Artificial Sequence
  Description of Artificial Sequence: Synthetic oligonucleotide
  Target: SCN10A; (-) strand; PAM type: NRG; PAM sequence: TAG
gattactatattcctcagaa

SEQ ID NO: 15892 - DNA, 20 bp, Artificial Sequence
  Description of Artificial Sequence: Synthetic oligonucleotide
  Target: SCN10A; (-) strand; PAM type: NRG; PAM sequence: CAG
attcagattactatattcct

SEQ ID NO: 15893 - DNA, 20 bp, Artificial Sequence
  Description of Artificial Sequence: Synthetic oligonucleotide
  Target: SCN10A; (-) strand; PAM type: NRG; PAM sequence: CAG
ttctctgagcaaatataatt

SEQ ID NO: 15894 - DNA, 20 bp, Artificial Sequence
  Description of Artificial Sequence: Synthetic oligonucleotide
  Target: SCN10A; (-) strand; PAM type: NRG; PAM sequence: GAG
tctttccaccccacttctct

SEQ ID NO: 15895 - DNA, 20 bp, Artificial Sequence
  Description of Artificial Sequence: Synthetic oligonucleotide
  Target: SCN10A; (-) strand; PAM type: NRG; PAM sequence: TAG
atcagggttcaaatgggaat

SEQ ID NO: 15896 - DNA, 20 bp, Artificial Sequence
  Description of Artificial Sequence: Synthetic oligonucleotide
  Target: SCN10A; (-) strand; PAM type: NRG; PAM sequence: GGG
caaaaaatcagggttcaaat

SEQ ID NO: 15897 - DNA, 20 bp, Artificial Sequence
  Description of Artificial Sequence: Synthetic oligonucleotide
  Target: SCN10A; (-) strand; PAM type: NRG; PAM sequence: TGG
acaaaaaatcagggttcaaa

SEQ ID NO: 15898 - DNA, 20 bp, Artificial Sequence
  Description of Artificial Sequence: Synthetic oligonucleotide
  Target: SCN10A; (-) strand; PAM type: NRG; PAM sequence: GGG
cccaagctcacaaaaaatca

SEQ ID NO: 15899 - DNA, 20 bp, Artificial Sequence
  Description of Artificial Sequence: Synthetic oligonucleotide
  Target: SCN10A; (-) strand; PAM type: NRG; PAM sequence: AGG
acccaagctcacaaaaaatc

SEQ ID NO: 15900 - DNA, 20 bp, Artificial Sequence
  Description of Artificial Sequence: Synthetic oligonucleotide
  Target: SCN10A; (-) strand; PAM type: NRG; PAM sequence: CAG
aacccaagctcacaaaaaat

SEQ ID NO: 15901 - DNA, 20 bp, Artificial Sequence
  Description of Artificial Sequence: Synthetic oligonucleotide
  Target: SCN10A; (-) strand; PAM type: NRG; PAM sequence: AAG
gactagccaggcactaaccc

SEQ ID NO: 15902 - DNA, 20 bp, Artificial Sequence
  Description of Artificial Sequence: Synthetic oligonucleotide
  Target: SCN10A; (-) strand; PAM type: NRG; PAM sequence: AGG
gaaagtaccctggactagcc

SEQ ID NO: 15903 - DNA, 20 bp, Artificial Sequence
  Description of Artificial Sequence: Synthetic oligonucleotide
  Target: SCN10A; (-) strand; PAM type: NRG; PAM sequence: CAG
tgaaagtaccctggactagc

SEQ ID NO: 15904 - DNA, 20 bp, Artificial Sequence
  Description of Artificial Sequence: Synthetic oligonucleotide
  Target: SCN10A; (-) strand; PAM type: NRG; PAM sequence: TAG
agggtgaaagtaccctggac

SEQ ID NO: 15905 - DNA, 20 bp, Artificial Sequence
  Description of Artificial Sequence: Synthetic oligonucleotide
  Target: SCN10A; (-) strand; PAM type: NRG; PAM sequence: TGG
tacaaagggtgaaagtaccc

SEQ ID NO: 15906 - DNA, 20 bp, Artificial Sequence
  Description of Artificial Sequence: Synthetic oligonucleotide
  Target: SCN10A; (-) strand; PAM type: NRG; PAM sequence: AAG
tttcattttacaaagggtga

SEQ ID NO: 15907 - DNA, 20 bp, Artificial Sequence
  Description of Artificial Sequence: Synthetic oligonucleotide
  Target: SCN10A; (-) strand; PAM type: NRG; PAM sequence: GGG
tgactttttcattttacaaa

SEQ ID NO: 15908 - DNA, 20 bp, Artificial Sequence
  Description of Artificial Sequence: Synthetic oligonucleotide
  Target: SCN10A; (-) strand; PAM type: NRG; PAM sequence: AGG
ctgactttttcattttacaa

SEQ ID NO: 15909 - DNA, 20 bp, Artificial Sequence
  Description of Artificial Sequence: Synthetic oligonucleotide
  Target: SCN10A; (-) strand; PAM type: NRG; PAM sequence: AAG
tctgactttttcattttaca

SEQ ID NO: 15910 - DNA, 20 bp, Artificial Sequence
  Description of Artificial Sequence: Synthetic oligonucleotide
  Target: SCN10A; (-) strand; PAM type: NRG; PAM sequence: TAG
tcagaactttggaattctct

SEQ ID NO: 15911 - DNA, 20 bp, Artificial Sequence
  Description of Artificial Sequence: Synthetic oligonucleotide
  Target: SCN10A; (-) strand; PAM type: NRG; PAM sequence: TGG
ctgcagagctatcagaactt

SEQ ID NO: 15912 - DNA, 20 bp, Artificial Sequence
  Description of Artificial Sequence: Synthetic oligonucleotide
  Target: SCN10A; (-) strand; PAM type: NRG; PAM sequence: CAG
ttgaagaactgcagagctat

SEQ ID NO: 15913 - DNA, 20 bp, Artificial Sequence
  Description of Artificial Sequence: Synthetic oligonucleotide
  Target: SCN10A; (-) strand; PAM type: NRG; PAM sequence: GAG
aaactttttgaagaactgca

SEQ ID NO: 15914 - DNA, 20 bp, Artificial Sequence
  Description of Artificial Sequence: Synthetic oligonucleotide
  Target: SCN10A; (-) strand; PAM type: NRG; PAM sequence: CAG
agaaactttttgaagaactg

SEQ ID NO: 15915 - DNA, 20 bp, Artificial Sequence
  Description of Artificial Sequence: Synthetic oligonucleotide
  Target: SCN10A; (-) strand; PAM type: NRG; PAM sequence: AAG
cccataccagaaactttttg

SEQ ID NO: 15916 - DNA, 20 bp, Artificial Sequence
  Description of Artificial Sequence: Synthetic oligonucleotide
  Target: SCN10A; (-) strand; PAM type: NRG; PAM sequence: CAG
tagatctcatggacccatac

SEQ ID NO: 15917 - DNA, 20 bp, Artificial Sequence
  Description of Artificial Sequence: Synthetic oligonucleotide
  Target: SCN10A; (-) strand; PAM type: NRG; PAM sequence: TGG
tctattgaagctagatctca

SEQ ID NO: 15918 - DNA, 20 bp, Artificial Sequence
  Description of Artificial Sequence: Synthetic oligonucleotide
  Target: SCN10A; (-) strand; PAM type: NRG; PAM sequence: TAG
tctcagatatctattgaagc

SEQ ID NO: 15919 - DNA, 20 bp, Artificial Sequence
  Description of Artificial Sequence: Synthetic oligonucleotide
  Target: SCN10A; (-) strand; PAM type: NRG; PAM sequence: AAG
tatatctcagatatctattg

SEQ ID NO: 15920 - DNA, 20 bp, Artificial Sequence
  Description of Artificial Sequence: Synthetic oligonucleotide
  Target: SCN10A; (-) strand; PAM type: NRG; PAM sequence: CAG
acaagtcagtcattatatct

SEQ ID NO: 15921 - DNA, 20 bp, Artificial Sequence
  Description of Artificial Sequence: Synthetic oligonucleotide
  Target: SCN10A; (-) strand; PAM type: NRG; PAM sequence: CAG
accaaaaggggctcacaagt

SEQ ID NO: 15922 - DNA, 20 bp, Artificial Sequence
  Description of Artificial Sequence: Synthetic oligonucleotide
  Target: SCN10A; (-) strand; PAM type: NRG; PAM sequence: AAG
acagaccaaaaggggctcac

SEQ ID NO: 15923 - DNA, 20 bp, Artificial Sequence
  Description of Artificial Sequence: Synthetic oligonucleotide
  Target: SCN10A; (-) strand; PAM type: NRG; PAM sequence: GGG
gaaaactgacagaccaaaag

SEQ ID NO: 15924 - DNA, 20 bp, Artificial Sequence
  Description of Artificial Sequence: Synthetic oligonucleotide
  Target: SCN10A; (-) strand; PAM type: NRG; PAM sequence: GGG
agaaaactgacagaccaaaa

SEQ ID NO: 15925 - DNA, 20 bp, Artificial Sequence
  Description of Artificial Sequence: Synthetic oligonucleotide
  Target: SCN10A; (-) strand; PAM type: NRG; PAM sequence: AGG
aagaaaactgacagaccaaa

SEQ ID NO: 15926 - DNA, 20 bp, Artificial Sequence
  Description of Artificial Sequence: Synthetic oligonucleotide
  Target: SCN10A; (-) strand; PAM type: NRG; PAM sequence: AAG
aaagaaaactgacagaccaa

SEQ ID NO: 15927 - DNA, 20 bp, Artificial Sequence
  Description of Artificial Sequence: Synthetic oligonucleotide
  Target: SCN10A; (-) strand; PAM type: NRG; PAM sequence: CAG
caccacttaaagaaaactga

SEQ ID NO: 15928 - DNA, 20 bp, Artificial Sequence
  Description of Artificial Sequence: Synthetic oligonucleotide
  Target: SCN10A; (-) strand; PAM type: NRG; PAM sequence: AAG
agtctttggaccaccactta

SEQ ID NO: 15929 - DNA, 20 bp, Artificial Sequence
  Description of Artificial Sequence: Synthetic oligonucleotide
  Target: SCN10A; (-) strand; PAM type: NRG; PAM sequence: TGG
tttctgtcctttgcagtctt

SEQ ID NO: 15930 - DNA, 20 bp, Artificial Sequence
  Description of Artificial Sequence: Synthetic oligonucleotide
  Target: SCN10A; (-) strand; PAM type: NRG; PAM sequence: CAG
atgtaagtttctgtcctttg

SEQ ID NO: 15931 - DNA, 20 bp, Artificial Sequence
  Description of Artificial Sequence: Synthetic oligonucleotide
  Target: SCN10A; (-) strand; PAM type: NRG; PAM sequence: AAG
caggggaacttttttcatgt

SEQ ID NO: 15932 - DNA, 20 bp, Artificial Sequence
  Description of Artificial Sequence: Synthetic oligonucleotide
  Target: SCN10A; (-) strand; PAM type: NRG; PAM sequence: GGG
accttcaaagttcctagcag

SEQ ID NO: 15933 - DNA, 20 bp, Artificial Sequence
  Description of Artificial Sequence: Synthetic oligonucleotide
  Target: SCN10A; (-) strand; PAM type: NRG; PAM sequence: GGG
caccttcaaagttcctagca

SEQ ID NO: 15934 - DNA, 20 bp, Artificial Sequence
  Description of Artificial Sequence: Synthetic oligonucleotide
  Target: SCN10A; (-) strand; PAM type: NRG; PAM sequence: AGG
gcaccttcaaagttcctagc

SEQ ID NO: 15935 - DNA, 20 bp, Artificial Sequence
  Description of Artificial Sequence: Synthetic oligonucleotide
  Target: SCN10A; (-) strand; PAM type: NRG; PAM sequence: CAG
ggcaccttcaaagttcctag

SEQ ID NO: 15936 - DNA, 20 bp, Artificial Sequence
  Description of Artificial Sequence: Synthetic oligonucleotide
  Target: SCN10A; (-) strand; PAM type: NRG; PAM sequence: TAG
cctggcaccttcaaagttcc

SEQ ID NO: 15937 - DNA, 20 bp, Artificial Sequence
  Description of Artificial Sequence: Synthetic oligonucleotide
  Target: SCN10A; (-) strand; PAM type: NRG; PAM sequence: AAG
acatctccctggcaccttca

SEQ ID NO: 15938 - DNA, 20 bp, Artificial Sequence
  Description of Artificial Sequence: Synthetic oligonucleotide
  Target: SCN10A; (-) strand; PAM type: NRG; PAM sequence: TGG
ccgtatctatgacatctccc

SEQ ID NO: 15939 - DNA, 20 bp, Artificial Sequence
  Description of Artificial Sequence: Synthetic oligonucleotide
  Target: SCN10A; (-) strand; PAM type: NRG; PAM sequence: TAG
gatctcacaggacagggtca

SEQ ID NO: 15940 - DNA, 20 bp, Artificial Sequence
  Description of Artificial Sequence: Synthetic oligonucleotide
  Target: SCN10A; (-) strand; PAM type: NRG; PAM sequence: GGG
ggctaagatctcacaggaca

SEQ ID NO: 15941 - DNA, 20 bp, Artificial Sequence
  Description of Artificial Sequence: Synthetic oligonucleotide
  Target: SCN10A; (-) strand; PAM type: NRG; PAM sequence: AGG
tggctaagatctcacaggac

SEQ ID NO: 15942 - DNA, 20 bp, Artificial Sequence
  Description of Artificial Sequence: Synthetic oligonucleotide
  Target: SCN10A; (-) strand; PAM type: NRG; PAM sequence: CAG
gtggctaagatctcacagga

SEQ ID NO: 15943 - DNA, 20 bp, Artificial Sequence
  Description of Artificial Sequence: Synthetic oligonucleotide
  Target: SCN10A; (-) strand; PAM type: NRG; PAM sequence: AGG
tggtgtggctaagatctcac

SEQ ID NO: 15944 - DNA, 20 bp, Artificial Sequence
  Description of Artificial Sequence: Synthetic oligonucleotide
  Target: SCN10A; (-) strand; PAM type: NRG; PAM sequence: CAG
gtggtgtggctaagatctca

SEQ ID NO: 15945 - DNA, 20 bp, Artificial Sequence
  Description of Artificial Sequence: Synthetic oligonucleotide
  Target: SCN10A; (-) strand; PAM type: NRG; PAM sequence: AAG
ccaccatctgtggtgtggct

SEQ ID NO: 15946 - DNA, 20 bp, Artificial Sequence
  Description of Artificial Sequence: Synthetic oligonucleotide
  Target: SCN10A; (-) strand; PAM type: NRG; PAM sequence: TGG
tcagcccaccatctgtggtg

SEQ ID NO: 15947 - DNA, 20 bp, Artificial Sequence
  Description of Artificial Sequence: Synthetic oligonucleotide
  Target: SCN10A; (-) strand; PAM type: NRG; PAM sequence: TGG
tgaattcagcccaccatctg

SEQ ID NO: 15948 - DNA, 20 bp, Artificial Sequence
  Description of Artificial Sequence: Synthetic oligonucleotide
  Target: SCN10A; (-) strand; PAM type: NRG; PAM sequence: CAG
ggataagctgagcctgaatt

SEQ ID NO: 15949 - DNA, 20 bp, Artificial Sequence
  Description of Artificial Sequence: Synthetic oligonucleotide
  Target: SCN10A; (-) strand; PAM type: NRG; PAM sequence: GAG
cctaactgccaggataagct

SEQ ID NO: 15950 - DNA, 20 bp, Artificial Sequence
  Description of Artificial Sequence: Synthetic oligonucleotide
  Target: SCN10A; (-) strand; PAM type: NRG; PAM sequence: AAG
tcccacctaactgccaggat

SEQ ID NO: 15951 - DNA, 20 bp, Artificial Sequence
  Description of Artificial Sequence: Synthetic oligonucleotide
  Target: SCN10A; (-) strand; PAM type: NRG; PAM sequence: AGG
gtgcatcccacctaactgcc

SEQ ID NO: 15952 - DNA, 20 bp, Artificial Sequence
  Description of Artificial Sequence: Synthetic oligonucleotide
  Target: SCN10A; (-) strand; PAM type: NRG; PAM sequence: CAG
tgtgcatcccacctaactgc

SEQ ID NO: 15953 - DNA, 20 bp, Artificial Sequence
  Description of Artificial Sequence: Synthetic oligonucleotide
  Target: SCN10A; (-) strand; PAM type: NRG; PAM sequence: AAG
tataaagcccttcttttctg

SEQ ID NO: 15954 - DNA, 20 bp, Artificial Sequence
  Description of Artificial Sequence: Synthetic oligonucleotide
  Target: SCN10A; (-) strand; PAM type: NRG; PAM sequence: AAG
ggctctgccactcaagtata

SEQ ID NO: 15955 - DNA, 20 bp, Artificial Sequence
  Description of Artificial Sequence: Synthetic oligonucleotide
  Target: SCN10A; (-) strand; PAM type: NRG; PAM sequence: AAG
tgcttggggctctgccactc

SEQ ID NO: 15956 - DNA, 20 bp, Artificial Sequence
  Description of Artificial Sequence: Synthetic oligonucleotide
  Target: SCN10A; (-) strand; PAM type: NRG; PAM sequence: GGG
caaagaatggacattgcttg

SEQ ID NO: 15957 - DNA, 20 bp, Artificial Sequence
  Description of Artificial Sequence: Synthetic oligonucleotide
  Target: SCN10A; (-) strand; PAM type: NRG; PAM sequence: GGG
ccaaagaatggacattgctt

SEQ ID NO: 15958 - DNA, 20 bp, Artificial Sequence
  Description of Artificial Sequence: Synthetic oligonucleotide
  Target: SCN10A; (-) strand; PAM type: NRG; PAM sequence: TGG
tccaaagaatggacattgct

SEQ ID NO: 15959 - DNA, 20 bp, Artificial Sequence
  Description of Artificial Sequence: Synthetic oligonucleotide
  Target: SCN10A; (-) strand; PAM type: NRG; PAM sequence: TGG
taagccactcatccaaagaa

SEQ ID NO: 15960 - DNA, 20 bp, Artificial Sequence
  Description of Artificial Sequence: Synthetic oligonucleotide
  Target: SCN10A; (-) strand; PAM type: NRG; PAM sequence: AAG
tgcaataagccactcatcca

SEQ ID NO: 15961 - DNA, 20 bp, Artificial Sequence
  Description of Artificial Sequence: Synthetic oligonucleotide
  Target: SCN10A; (-) strand; PAM type: NRG; PAM sequence: AAG
gttctttgtcctggtgcaat

SEQ ID NO: 15962 - DNA, 20 bp, Artificial Sequence
  Description of Artificial Sequence: Synthetic oligonucleotide
  Target: SCN10A; (-) strand; PAM type: NRG; PAM sequence: TGG
tccattccggttctttgtcc

SEQ ID NO: 15963 - DNA, 20 bp, Artificial Sequence
  Description of Artificial Sequence: Synthetic oligonucleotide
  Target: SCN10A; (-) strand; PAM type: NRG; PAM sequence: CGG
gaagagggtcccttccattc

SEQ ID NO: 15964 - DNA, 20 bp, Artificial Sequence
  Description of Artificial Sequence: Synthetic oligonucleotide
  Target: SCN10A; (-) strand; PAM type: NRG; PAM sequence: GGG
cttgcatgaatgaaggaaga

SEQ ID NO: 15965 - DNA, 20 bp, Artificial Sequence
  Description of Artificial Sequence: Synthetic oligonucleotide
  Target: SCN10A; (-) strand; PAM type: NRG; PAM sequence: AGG
ccttgcatgaatgaaggaag

SEQ ID NO: 15966 - DNA, 20 bp, Artificial Sequence
  Description of Artificial Sequence: Synthetic oligonucleotide
  Target: SCN10A; (-) strand; PAM type: NRG; PAM sequence: GAG
gccttgcatgaatgaaggaa

SEQ ID NO: 15967 - DNA, 20 bp, Artificial Sequence
  Description of Artificial Sequence: Synthetic oligonucleotide
  Target: SCN10A; (-) strand; PAM type: NRG; PAM sequence: AAG
gagccttgcatgaatgaagg

SEQ ID NO: 15968 - DNA, 20 bp, Artificial Sequence
  Description of Artificial Sequence: Synthetic oligonucleotide
  Target: SCN10A; (-) strand; PAM type: NRG; PAM sequence: AGG
ctggagccttgcatgaatga

SEQ ID NO: 15969 - DNA, 20 bp, Artificial Sequence
  Description of Artificial Sequence: Synthetic oligonucleotide
  Target: SCN10A; (-) strand; PAM type: NRG; PAM sequence: AAG
tctggagccttgcatgaatg

SEQ ID NO: 15970 - DNA, 20 bp, Artificial Sequence
  Description of Artificial Sequence: Synthetic oligonucleotide
  Target: SCN10A; (-) strand; PAM type: NRG; PAM sequence: GAG
gtctcacctgctgatgtctg

SEQ ID NO: 15971 - DNA, 20 bp, Artificial Sequence
  Description of Artificial Sequence: Synthetic oligonucleotide
  Target: SCN10A; (-) strand; PAM type: NRG; PAM sequence: TGG
gggtctcacctgctgatgtc

SEQ ID NO: 15972 - DNA, 20 bp, Artificial Sequence
  Description of Artificial Sequence: Synthetic oligonucleotide
  Target: SCN10A; (-) strand; PAM type: NRG; PAM sequence: GGG
cctcatgcacccaggcagct

SEQ ID NO: 15973 - DNA, 20 bp, Artificial Sequence
  Description of Artificial Sequence: Synthetic oligonucleotide
  Target: SCN10A; (-) strand; PAM type: NRG; PAM sequence: TGG
ccctcatgcacccaggcagc

SEQ ID NO: 15974 - DNA, 20 bp, Artificial Sequence
  Description of Artificial Sequence: Synthetic oligonucleotide
  Target: SCN10A; (-) strand; PAM type: NRG; PAM sequence: CAG
cctaccctcatgcacccagg

SEQ ID NO: 15975 - DNA, 20 bp, Artificial Sequence
  Description of Artificial Sequence: Synthetic oligonucleotide
  Target: SCN10A; (-) strand; PAM type: NRG; PAM sequence: AGG
ctccctaccctcatgcaccc

SEQ ID NO: 15976 - DNA, 20 bp, Artificial Sequence
  Description of Artificial Sequence: Synthetic oligonucleotide
  Target: SCN10A; (-) strand; PAM type: NRG; PAM sequence: CAG
cctccctaccctcatgcacc

SEQ ID NO: 15977 - DNA, 20 bp, Artificial Sequence
  Description of Artificial Sequence: Synthetic oligonucleotide
  Target: SCN10A; (-) strand; PAM type: NRG; PAM sequence: TGG
aatagggttcagcatggaac

SEQ ID NO: 15978 - DNA, 20 bp, Artificial Sequence
  Description of Artificial Sequence: Synthetic oligonucleotide
  Target: SCN10A; (-) strand; PAM type: NRG; PAM sequence: TGG
agactgaatagggttcagca

SEQ ID NO: 15979 - DNA, 20 bp, Artificial Sequence
  Description of Artificial Sequence: Synthetic oligonucleotide
  Target: SCN10A; (-) strand; PAM type: NRG; PAM sequence: CAG
gcaaaagactgaatagggtt

SEQ ID NO: 15980 - DNA, 20 bp, Artificial Sequence
  Description of Artificial Sequence: Synthetic oligonucleotide
  Target: SCN10A; (-) strand; PAM type: NRG; PAM sequence: GGG
gctgagcaaaagactgaata

SEQ ID NO: 15981 - DNA, 20 bp, Artificial Sequence
  Description of Artificial Sequence: Synthetic oligonucleotide
  Target: SCN10A; (-) strand; PAM type: NRG; PAM sequence: AGG
ggctgagcaaaagactgaat

SEQ ID NO: 15982 - DNA, 20 bp, Artificial Sequence
  Description of Artificial Sequence: Synthetic oligonucleotide
  Target: SCN10A; (-) strand; PAM type: NRG; PAM sequence: TAG
gggctgagcaaaagactgaa

SEQ ID NO: 15983 - DNA, 20 bp, Artificial Sequence
  Description of Artificial Sequence: Synthetic oligonucleotide
  Target: SCN10A; (-) strand; PAM type: NRG; PAM sequence: AAG
cttcccagggggctgagcaa

SEQ ID NO: 15984 - DNA, 20 bp, Artificial Sequence
  Description of Artificial Sequence: Synthetic oligonucleotide
  Target: SCN10A; (-) strand; PAM type: NRG; PAM sequence: GAG
ggcagacttcccagggggct

SEQ ID NO: 15985 - DNA, 20 bp, Artificial Sequence
  Description of Artificial Sequence: Synthetic oligonucleotide
  Target: SCN10A; (-) strand; PAM type: NRG; PAM sequence: GGG
tgtgaggcagacttcccagg

SEQ ID NO: 15986 - DNA, 20 bp, Artificial Sequence
  Description of Artificial Sequence: Synthetic oligonucleotide
  Target: SCN10A; (-) strand; PAM type: NRG; PAM sequence: GGG
atgtgaggcagacttcccag

SEQ ID NO: 15987 - DNA, 20 bp, Artificial Sequence
  Description of Artificial Sequence: Synthetic oligonucleotide
  Target: SCN10A; (-) strand; PAM type: NRG; PAM sequence: GGG
catgtgaggcagacttccca

SEQ ID NO: 15988 - DNA, 20 bp, Artificial Sequence
  Description of Artificial Sequence: Synthetic oligonucleotide
  Target: SCN10A; (-) strand; PAM type: NRG; PAM sequence: AGG
ccatgtgaggcagacttccc

SEQ ID NO: 15989 - DNA, 20 bp, Artificial Sequence
  Description of Artificial Sequence: Synthetic oligonucleotide
  Target: SCN10A; (-) strand; PAM type: NRG; PAM sequence: CAG
tccatgtgaggcagacttcc

SEQ ID NO: 15990 - DNA, 20 bp, Artificial Sequence
  Description of Artificial Sequence: Synthetic oligonucleotide
  Target: SCN10A; (-) strand; PAM type: NRG; PAM sequence: CAG
tgcagattatccatgtgagg

SEQ ID NO: 15991 - DNA, 20 bp, Artificial Sequence
  Description of Artificial Sequence: Synthetic oligonucleotide
  Target: SCN10A; (-) strand; PAM type: NRG; PAM sequence: AGG
agctgcagattatccatgtg

SEQ ID NO: 15992 - DNA, 20 bp, Artificial Sequence
  Description of Artificial Sequence: Synthetic oligonucleotide
  Target: SCN10A; (-) strand; PAM type: NRG; PAM sequence: GAG
cagctgcagattatccatgt

SEQ ID NO: 15993 - DNA, 20 bp, Artificial Sequence
  Description of Artificial Sequence: Synthetic oligonucleotide
  Target: SCN10A; (-) strand; PAM type: NRG; PAM sequence: CAG
gcacctgtctgccccagctg

SEQ ID NO: 15994 - DNA, 20 bp, Artificial Sequence
  Description of Artificial Sequence: Synthetic oligonucleotide
  Target: SCN10A; (-) strand; PAM type: NRG; PAM sequence: CAG
ggcacagcacctgtctgccc

SEQ ID NO: 15995 - DNA, 20 bp, Artificial Sequence
  Description of Artificial Sequence: Synthetic oligonucleotide
  Target: SCN10A; (-) strand; PAM type: NRG; PAM sequence: CAG
cagactttgctggagaggca

SEQ ID NO: 15996 - DNA, 20 bp, Artificial Sequence
  Description of Artificial Sequence: Synthetic oligonucleotide
  Target: SCN10A; (-) strand; PAM type: NRG; PAM sequence: AGG
gtggacagactttgctggag

SEQ ID NO: 15997 - DNA, 20 bp, Artificial Sequence
  Description of Artificial Sequence: Synthetic oligonucleotide
  Target: SCN10A; (-) strand; PAM type: NRG; PAM sequence: GAG
ggtggacagactttgctgga

SEQ ID NO: 15998 - DNA, 20 bp, Artificial Sequence
  Description of Artificial Sequence: Synthetic oligonucleotide
  Target: SCN10A; (-) strand; PAM type: NRG; PAM sequence: GAG
tgggtggacagactttgctg

SEQ ID NO: 15999 - DNA, 20 bp, Artificial Sequence
  Description of Artificial Sequence: Synthetic oligonucleotide
  Target: SCN10A; (-) strand; PAM type: NRG; PAM sequence: TGG
cttgggtggacagactttgc

SEQ ID NO: 16000 - DNA, 20 bp, Artificial Sequence
  Description of Artificial Sequence: Synthetic oligonucleotide
  Target: SCN10A; (-) strand; PAM type: NRG; PAM sequence: CAG
tggaggtgggcttgggtgga

SEQ ID NO: 16001 - DNA, 20 bp, Artificial Sequence
  Description of Artificial Sequence: Synthetic oligonucleotide
  Target: SCN10A; (-) strand; PAM type: NRG; PAM sequence: TGG
ggaatggaggtgggcttggg

SEQ ID NO: 16002 - DNA, 20 bp, Artificial Sequence
  Description of Artificial Sequence: Synthetic oligonucleotide
  Target: SCN10A; (-) strand; PAM type: NRG; PAM sequence: GGG
gtgggaatggaggtgggctt

SEQ ID NO: 16003 - DNA, 20 bp, Artificial Sequence
  Description of Artificial Sequence: Synthetic oligonucleotide
  Target: SCN10A; (-) strand; PAM type: NRG; PAM sequence: TGG
agtgggaatggaggtgggct

SEQ ID NO: 16004 - DNA, 20 bp, Artificial Sequence
  Description of Artificial Sequence: Synthetic oligonucleotide
  Target: SCN10A; (-) strand; PAM type: NRG; PAM sequence: GGG
tgagcagtgggaatggaggt

SEQ ID NO: 16005 - DNA, 20 bp, Artificial Sequence
  Description of Artificial Sequence: Synthetic oligonucleotide
  Target: SCN10A; (-) strand; PAM type: NRG; PAM sequence: TGG
ctgagcagtgggaatggagg

SEQ ID NO: 16006 - DNA, 20 bp, Artificial Sequence
  Description of Artificial Sequence: Synthetic oligonucleotide
  Target: SCN10A; (-) strand; PAM type: NRG; PAM sequence: AGG
gggctgagcagtgggaatgg

SEQ ID NO: 16007 - DNA, 20 bp, Artificial Sequence
  Description of Artificial Sequence: Synthetic oligonucleotide
  Target: SCN10A; (-) strand; PAM type: NRG; PAM sequence: GAG
tgggctgagcagtgggaatg

SEQ ID NO: 16008 - DNA, 20 bp, Artificial Sequence
  Description of Artificial Sequence: Synthetic oligonucleotide
  Target: SCN10A; (-) strand; PAM type: NRG; PAM sequence: TGG
agtgggctgagcagtgggaa

SEQ ID NO: 16009 - DNA, 20 bp, Artificial Sequence
  Description of Artificial Sequence: Synthetic oligonucleotide
  Target: SCN10A; (-) strand; PAM type: NRG; PAM sequence: GGG
aggctagtgggctgagcagt

SEQ ID NO: 16010 - DNA, 20 bp, Artificial Sequence
  Description of Artificial Sequence: Synthetic oligonucleotide
  Target: SCN10A; (-) strand; PAM type: NRG; PAM sequence: TGG
gaggctagtgggctgagcag

SEQ ID NO: 16011 - DNA, 20 bp, Artificial Sequence
  Description of Artificial Sequence: Synthetic oligonucleotide
  Target: SCN10A; (-) strand; PAM type: NRG; PAM sequence: CAG
tgggaggctagtgggctgag

SEQ ID NO: 16012 - DNA, 20 bp, Artificial Sequence
  Description of Artificial Sequence: Synthetic oligonucleotide
  Target: SCN10A; (-) strand; PAM type: NRG; PAM sequence: GAG
acttgggaggctagtgggct

SEQ ID NO: 16013 - DNA, 20 bp, Artificial Sequence
  Description of Artificial Sequence: Synthetic oligonucleotide
  Target: SCN10A; (-) strand; PAM type: NRG; PAM sequence: GGG
agactacttgggaggctagt

SEQ ID NO: 16014 - DNA, 20 bp, Artificial Sequence
  Description of Artificial Sequence: Synthetic oligonucleotide
  Target: SCN10A; (-) strand; PAM type: NRG; PAM sequence: TGG
gagactacttgggaggctag

SEQ ID NO: 16015 - DNA, 20 bp, Artificial Sequence
  Description of Artificial Sequence: Synthetic oligonucleotide
  Target: SCN10A; (-) strand; PAM type: NRG; PAM sequence: TAG
ctggagactacttgggaggc

SEQ ID NO: 16016 - DNA, 20 bp, Artificial Sequence
  Description of Artificial Sequence: Synthetic oligonucleotide
  Target: SCN10A; (-) strand; PAM type: NRG; PAM sequence: AGG
gggcctggagactacttggg

SEQ ID NO: 16017 - DNA, 20 bp, Artificial Sequence
  Description of Artificial Sequence: Synthetic oligonucleotide
  Target: SCN10A; (-) strand; PAM type: NRG; PAM sequence: GAG
agggcctggagactacttgg

SEQ ID NO: 16018 - DNA, 20 bp, Artificial Sequence
  Description of Artificial Sequence: Synthetic oligonucleotide
  Target: SCN10A; (-) strand; PAM type: NRG; PAM sequence: GGG
ctagggcctggagactactt

SEQ ID NO: 16019 - DNA, 20 bp, Artificial Sequence
  Description of Artificial Sequence: Synthetic oligonucleotide
  Target: SCN10A; (-) strand; PAM type: NRG; PAM sequence: TGG
actagggcctggagactact

SEQ ID NO: 16020 - DNA, 20 bp, Artificial Sequence
  Description of Artificial Sequence: Synthetic oligonucleotide
  Target: SCN10A; (-) strand; PAM type: NRG; PAM sequence: GAG
tggtgcagtactagggcctg

SEQ ID NO: 16021 - DNA, 20 bp, Artificial Sequence
  Description of Artificial Sequence: Synthetic oligonucleotide
  Target: SCN10A; (-) strand; PAM type: NRG; PAM sequence: TGG
catggtgcagtactagggcc

SEQ ID NO: 16022 - DNA, 20 bp, Artificial Sequence
  Description of Artificial Sequence: Synthetic oligonucleotide
  Target: SCN10A; (-) strand; PAM type: NRG; PAM sequence: GGG
agatgcatggtgcagtacta

SEQ ID NO: 16023 - DNA, 20 bp, Artificial Sequence
  Description of Artificial Sequence: Synthetic oligonucleotide
  Target: SCN10A; (-) strand; PAM type: NRG; PAM sequence: AGG
tagatgcatggtgcagtact

SEQ ID NO: 16024 - DNA, 20 bp, Artificial Sequence
  Description of Artificial Sequence: Synthetic oligonucleotide
  Target: SCN10A; (-) strand; PAM type: NRG; PAM sequence: TAG
atagatgcatggtgcagtac

SEQ ID NO: 16025 - DNA, 20 bp, Artificial Sequence
  Description of Artificial Sequence: Synthetic oligonucleotide
  Target: SCN10A; (-) strand; PAM type: NRG; PAM sequence: CAG
tggagaatagatgcatggtg

SEQ ID NO: 16026 - DNA, 20 bp, Artificial Sequence
  Description of Artificial Sequence: Synthetic oligonucleotide
  Target: SCN10A; (-) strand; PAM type: NRG; PAM sequence: TGG
tgcagtggagaatagatgca

SEQ ID NO: 16027 - DNA, 20 bp, Artificial Sequence
  Description of Artificial Sequence: Synthetic oligonucleotide
  Target: SCN10A; (-) strand; PAM type: NRG; PAM sequence: TAG
atcagatttgcagtggagaa

SEQ ID NO: 16028 - DNA, 20 bp, Artificial Sequence
  Description of Artificial Sequence: Synthetic oligonucleotide
  Target: SCN10A; (-) strand; PAM type: NRG; PAM sequence: GAG
tcataatcagatttgcagtg

SEQ ID NO: 16029 - DNA, 20 bp, Artificial Sequence
  Description of Artificial Sequence: Synthetic oligonucleotide
  Target: SCN10A; (-) strand; PAM type: NRG; PAM sequence: TGG
gatcataatcagatttgcag

SEQ ID NO: 16030 - DNA, 20 bp, Artificial Sequence
  Description of Artificial Sequence: Synthetic oligonucleotide
  Target: SCN10A; (-) strand; PAM type: NRG; PAM sequence: CAG
catgatcataatcagatttg

SEQ ID NO: 16031 - DNA, 20 bp, Artificial Sequence
  Description of Artificial Sequence: Synthetic oligonucleotide
  Target: SCN10A; (-) strand; PAM type: NRG; PAM sequence: CAG
gagaaagacatgatcataat

SEQ ID NO: 16032 - DNA, 20 bp, Artificial Sequence
  Description of Artificial Sequence: Synthetic oligonucleotide
  Target: SCN10A; (-) strand; PAM type: NRG; PAM sequence: AAG
tgatgtttgggagtaagaga

SEQ ID NO: 16033 - DNA, 20 bp, Artificial Sequence
  Description of Artificial Sequence: Synthetic oligonucleotide
  Target: SCN10A; (-) strand; PAM type: NRG; PAM sequence: GAG
ccagtgatgtttgggagtaa

SEQ ID NO: 16034 - DNA, 20 bp, Artificial Sequence
  Description of Artificial Sequence: Synthetic oligonucleotide
  Target: SCN10A; (-) strand; PAM type: NRG; PAM sequence: AAG
taccagtgatgtttgggagt

SEQ ID NO: 16035 - DNA, 20 bp, Artificial Sequence
  Description of Artificial Sequence: Synthetic oligonucleotide
  Target: SCN10A; (-) strand; PAM type: NRG; PAM sequence: GAG
aaagtaccagtgatgtttgg

SEQ ID NO: 16036 - DNA, 20 bp, Artificial Sequence
  Description of Artificial Sequence: Synthetic oligonucleotide
  Target: SCN10A; (-) strand; PAM type: NRG; PAM sequence: GGG
ataaagtaccagtgatgttt

SEQ ID NO: 16037 - DNA, 20 bp, Artificial Sequence
  Description of Artificial Sequence: Synthetic oligonucleotide
  Target: SCN10A; (-) strand; PAM type: NRG; PAM sequence: TGG
gataaagtaccagtgatgtt

SEQ ID NO: 16038 - DNA, 20 bp, Artificial Sequence
  Description of Artificial Sequence: Synthetic oligonucleotide
  Target: SCN10A; (-) strand; PAM type: NRG; PAM sequence: CAG
tcctgagggtgataaagtac

SEQ ID NO: 16039 - DNA, 20 bp, Artificial Sequence
  Description of Artificial Sequence: Synthetic oligonucleotide
  Target: SCN10A; (-) strand; PAM type: NRG; PAM sequence: AAG
agtttatcctgagggtgata

SEQ ID NO: 16040 - DNA, 20 bp, Artificial Sequence
  Description of Artificial Sequence: Synthetic oligonucleotide
  Target: SCN10A; (-) strand; PAM type: NRG; PAM sequence: GGG
gagtatggagtttatcctga

SEQ ID NO: 16041 - DNA, 20 bp, Artificial Sequence
  Description of Artificial Sequence: Synthetic oligonucleotide
  Target: SCN10A; (-) strand; PAM type: NRG; PAM sequence: AGG
agagtatggagtttatcctg

SEQ ID NO: 16042 - DNA, 20 bp, Artificial Sequence
  Description of Artificial Sequence: Synthetic oligonucleotide
  Target: SCN10A; (-) strand; PAM type: NRG; PAM sequence: GAG
cagagtatggagtttatcct

SEQ ID NO: 16043 - DNA, 20 bp, Artificial Sequence
  Description of Artificial Sequence: Synthetic oligonucleotide
  Target: SCN10A; (-) strand; PAM type: NRG; PAM sequence: GAG
gacacaggctacagagtatg

SEQ ID NO: 16044 - DNA, 20 bp, Artificial Sequence
  Description of Artificial Sequence: Synthetic oligonucleotide
  Target: SCN10A; (-) strand; PAM type: NRG; PAM sequence: TGG
atgacacaggctacagagta

SEQ ID NO: 16045 - DNA, 20 bp, Artificial Sequence
  Description of Artificial Sequence: Synthetic oligonucleotide
  Target: SCN10A; (-) strand; PAM type: NRG; PAM sequence: GAG
accatatgacacaggctaca

SEQ ID NO: 16046 - DNA, 20 bp, Artificial Sequence
  Description of Artificial Sequence: Synthetic oligonucleotide
  Target: SCN10A; (-) strand; PAM type: NRG; PAM sequence: CAG
tgaccatatgacacaggcta

SEQ ID NO: 16047 - DNA, 20 bp, Artificial Sequence
  Description of Artificial Sequence: Synthetic oligonucleotide
  Target: SCN10A; (-) strand; PAM type: NRG; PAM sequence: AGG
aggttgtgaccatatgacac

SEQ ID NO: 16048 - DNA, 20 bp, Artificial Sequence
  Description of Artificial Sequence: Synthetic oligonucleotide
  Target: SCN10A; (-) strand; PAM type: NRG; PAM sequence: CAG
taggttgtgaccatatgaca

SEQ ID NO: 16049 - DNA, 20 bp, Artificial Sequence
  Description of Artificial Sequence: Synthetic oligonucleotide
  Target: SCN10A; (-) strand; PAM type: NRG; PAM sequence: AGG
tgaaatatgactggaaaagt

SEQ ID NO: 16050 - DNA, 20 bp, Artificial Sequence
  Description of Artificial Sequence: Synthetic oligonucleotide
  Target: SCN10A; (-) strand; PAM type: NRG; PAM sequence: TAG
gtgaaatatgactggaaaag

SEQ ID NO: 16051 - DNA, 20 bp, Artificial Sequence
  Description of Artificial Sequence: Synthetic oligonucleotide
  Target: SCN10A; (-) strand; PAM type: NRG; PAM sequence: AAG
tgggtgaaatatgactggaa

SEQ ID NO: 16052 - DNA, 20 bp, Artificial Sequence
  Description of Artificial Sequence: Synthetic oligonucleotide
  Target: SCN10A; (-) strand; PAM type: NRG; PAM sequence: TGG
atgtgtgggtgaaatatgac

SEQ ID NO: 16053 - DNA, 20 bp, Artificial Sequence
  Description of Artificial Sequence: Synthetic oligonucleotide
  Target: SCN10A; (-) strand; PAM type: NRG; PAM sequence: GGG
ttgatttgggtagaatgtgt

SEQ ID NO: 16054 - DNA, 20 bp, Artificial Sequence
  Description of Artificial Sequence: Synthetic oligonucleotide
  Target: SCN10A; (-) strand; PAM type: NRG; PAM sequence: TGG
tttgatttgggtagaatgtg

SEQ ID NO: 16055 - DNA, 20 bp, Artificial Sequence
  Description of Artificial Sequence: Synthetic oligonucleotide
  Target: SCN10A; (-) strand; PAM type: NRG; PAM sequence: TAG
agggaacaatttgatttggg

SEQ ID NO: 16056 - DNA, 20 bp, Artificial Sequence
  Description of Artificial Sequence: Synthetic oligonucleotide
  Target: SCN10A; (-) strand; PAM type: NRG; PAM sequence: GGG
ctcagggaacaatttgattt

SEQ ID NO: 16057 - DNA, 20 bp, Artificial Sequence
  Description of Artificial Sequence: Synthetic oligonucleotide
  Target: SCN10A; (-) strand; PAM type: NRG; PAM sequence: TGG
gctcagggaacaatttgatt

SEQ ID NO: 16058 - DNA, 20 bp, Artificial Sequence
  Description of Artificial Sequence: Synthetic oligonucleotide
  Target: SCN10A; (-) strand; PAM type: NRG; PAM sequence: GGG
cacagacacaagtatgctca

SEQ ID NO: 16059 - DNA, 20 bp, Artificial Sequence
  Description of Artificial Sequence: Synthetic oligonucleotide
  Target: SCN10A; (-) strand; PAM type: NRG; PAM sequence: AGG
gcacagacacaagtatgctc

SEQ ID NO: 16060 - DNA, 20 bp, Artificial Sequence
  Description of Artificial Sequence: Synthetic oligonucleotide
  Target: SCN10A; (-) strand; PAM type: NRG; PAM sequence: CAG
ggcacagacacaagtatgct

SEQ ID NO: 16061 - DNA, 20 bp, Artificial Sequence
  Description of Artificial Sequence: Synthetic oligonucleotide
  Target: SCN10A; (-) strand; PAM type: NRG; PAM sequence: AAG
ttgaacaaaggcacagacac

SEQ ID NO: 16062 - DNA, 20 bp, Artificial Sequence
  Description of Artificial Sequence: Synthetic oligonucleotide
  Target: SCN10A; (-) strand; PAM type: NRG; PAM sequence: CAG
gctgaccttgaacaaaggca

SEQ ID NO: 16063 - DNA, 20 bp, Artificial Sequence
  Description of Artificial Sequence: Synthetic oligonucleotide
  Target: SCN10A; (-) strand; PAM type: NRG; PAM sequence: AGG
taaaggctgaccttgaacaa

SEQ ID NO: 16064 - DNA, 20 bp, Artificial Sequence
  Description of Artificial Sequence: Synthetic oligonucleotide
  Target: SCN10A; (-) strand; PAM type: NRG; PAM sequence: AAG
ctaaaggctgaccttgaaca

SEQ ID NO: 16065 - DNA, 20 bp, Artificial Sequence
  Description of Artificial Sequence: Synthetic oligonucleotide
  Target: SCN10A; (-) strand; PAM type: NRG; PAM sequence: AGG
ggaaggcccgtcttagctaa

SEQ ID NO: 16066 - DNA, 20 bp, Artificial Sequence
  Description of Artificial Sequence: Synthetic oligonucleotide
  Target: SCN10A; (-) strand; PAM type: NRG; PAM sequence: AAG
gggaaggcccgtcttagcta

SEQ ID NO: 16067 - DNA, 20 bp, Artificial Sequence
  Description of Artificial Sequence: Synthetic oligonucleotide
  Target: SCN10A; (-) strand; PAM type: NRG; PAM sequence: TAG
ggactggggaaggcccgtct

SEQ ID NO: 16068 - DNA, 20 bp, Artificial Sequence
  Description of Artificial Sequence: Synthetic oligonucleotide
  Target: SCN10A; (-) strand; PAM type: NRG; PAM sequence: AGG
agctgcgagaggactgggga

SEQ ID NO: 16069 - DNA, 20 bp, Artificial Sequence
  Description of Artificial Sequence: Synthetic oligonucleotide
  Target: SCN10A; (-) strand; PAM type: NRG; PAM sequence: AAG
gagctgcgagaggactgggg

SEQ ID NO: 16070 - DNA, 20 bp, Artificial Sequence
  Description of Artificial Sequence: Synthetic oligonucleotide
  Target: SCN10A; (-) strand; PAM type: NRG; PAM sequence: GGG
aaggagctgcgagaggactg

SEQ ID NO: 16071 - DNA, 20 bp, Artificial Sequence
  Description of Artificial Sequence: Synthetic oligonucleotide
  Target: SCN10A; (-) strand; PAM type: NRG; PAM sequence: GGG
caaggagctgcgagaggact

SEQ ID NO: 16072 - DNA, 20 bp, Artificial Sequence
  Description of Artificial Sequence: Synthetic oligonucleotide
  Target: SCN10A; (-) strand; PAM type: NRG; PAM sequence: TGG
ccaaggagctgcgagaggac

SEQ ID NO: 16073 - DNA, 20 bp, Artificial Sequence
  Description of Artificial Sequence: Synthetic oligonucleotide
  Target: SCN10A; (-) strand; PAM type: NRG; PAM sequence: AGG
caggaccaaggagctgcgag

SEQ ID NO: 16074 - DNA, 20 bp, Artificial Sequence
  Description of Artificial Sequence: Synthetic oligonucleotide
  Target: SCN10A; (-) strand; PAM type: NRG; PAM sequence: GAG
gcaggaccaaggagctgcga

SEQ ID NO: 16075 - DNA, 20 bp, Artificial Sequence
  Description of Artificial Sequence: Synthetic oligonucleotide
  Target: SCN10A; (-) strand; PAM type: NRG; PAM sequence: GAG
gagcaggaccaaggagctgc

SEQ ID NO: 16076 - DNA, 20 bp, Artificial Sequence
  Description of Artificial Sequence: Synthetic oligonucleotide
  Target: SCN10A; (-) strand; PAM type: NRG; PAM sequence: GAG
tagaaatgagcaggaccaag

SEQ ID NO: 16077 - DNA, 20 bp, Artificial Sequence
  Description of Artificial Sequence: Synthetic oligonucleotide
  Target: SCN10A; (-) strand; PAM type: NRG; PAM sequence: AGG
catagaaatgagcaggacca

SEQ ID NO: 16078 - DNA, 20 bp, Artificial Sequence
  Description of Artificial Sequence: Synthetic oligonucleotide
  Target: SCN10A; (-) strand; PAM type: NRG; PAM sequence: AAG
gcatagaaatgagcaggacc

SEQ ID NO: 16079 - DNA, 20 bp, Artificial Sequence
  Description of Artificial Sequence: Synthetic oligonucleotide
  Target: SCN10A; (-) strand; PAM type: NRG; PAM sequence: AGG
tgtggggcatagaaatgagc

SEQ ID NO: 16080 - DNA, 20 bp, Artificial Sequence
  Description of Artificial Sequence: Synthetic oligonucleotide
  Target: SCN10A; (-) strand; PAM type: NRG; PAM sequence: CAG
atgtggggcatagaaatgag

SEQ ID NO: 16081 - DNA, 20 bp, Artificial Sequence
  Description of Artificial Sequence: Synthetic oligonucleotide
  Target: SCN10A; (-) strand; PAM type: NRG; PAM sequence: GAG
tagatgtggggcatagaaat

SEQ ID NO: 16082 - DNA, 20 bp, Artificial Sequence
  Description of Artificial Sequence: Synthetic oligonucleotide
  Target: SCN10A; (-) strand; PAM type: NRG; PAM sequence: TAG
gtggcattagatgtggggca

SEQ ID NO: 16083 - DNA, 20 bp, Artificial Sequence
  Description of Artificial Sequence: Synthetic oligonucleotide
  Target: SCN10A; (-) strand; PAM type: NRG; PAM sequence: GGG
gggaggtggcattagatgtg

SEQ ID NO: 16084 - DNA, 20 bp, Artificial Sequence
  Description of Artificial Sequence: Synthetic oligonucleotide
  Target: SCN10A; (-) strand; PAM type: NRG; PAM sequence: GGG
tgggaggtggcattagatgt

SEQ ID NO: 16085 - DNA, 20 bp, Artificial Sequence
  Description of Artificial Sequence: Synthetic oligonucleotide
  Target: SCN10A; (-) strand; PAM type: NRG; PAM sequence: TGG
atgggaggtggcattagatg

SEQ ID NO: 16086 - DNA, 20 bp, Artificial Sequence
  Description of Artificial Sequence: Synthetic oligonucleotide
  Target: SCN10A; (-) strand; PAM type: NRG; PAM sequence: TAG
cttcctatgggaggtggcat

SEQ ID NO: 16087 - DNA, 20 bp, Artificial Sequence
  Description of Artificial Sequence: Synthetic oligonucleotide
  Target: SCN10A; (-) strand; PAM type: NRG; PAM sequence: TGG
agaattcttcctatgggagg

SEQ ID NO: 16088 - DNA, 20 bp, Artificial Sequence
  Description of Artificial Sequence: Synthetic oligonucleotide
  Target: SCN10A; (-) strand; PAM type: NRG; PAM sequence: AGG
ttgagaattcttcctatggg

SEQ ID NO: 16089 - DNA, 20 bp, Artificial Sequence
  Description of Artificial Sequence: Synthetic oligonucleotide
  Target: SCN10A; (-) strand; PAM type: NRG; PAM sequence: GAG
gttgagaattcttcctatgg

SEQ ID NO: 16090 - DNA, 20 bp, Artificial Sequence
  Description of Artificial Sequence: Synthetic oligonucleotide
  Target: SCN10A; (-) strand; PAM type: NRG; PAM sequence: GGG
tggttgagaattcttcctat

SEQ ID NO: 16091 - DNA, 20 bp, Artificial Sequence
  Description of Artificial Sequence: Synthetic oligonucleotide
  Target: SCN10A; (-) strand; PAM type: NRG; PAM sequence: TGG
gtggttgagaattcttccta

SEQ ID NO: 16092 - DNA, 20 bp, Artificial Sequence
  Description of Artificial Sequence: Synthetic oligonucleotide
  Target: SCN10A; (-) strand; PAM type: NRG; PAM sequence: GAG
actcttggggtggggtggtt

SEQ ID NO: 16093 - DNA, 20 bp, Artificial Sequence
  Description of Artificial Sequence: Synthetic oligonucleotide
  Target: SCN10A; (-) strand; PAM type: NRG; PAM sequence: TGG
cttccactcttggggtgggg

SEQ ID NO: 16094 - DNA, 20 bp, Artificial Sequence
  Description of Artificial Sequence: Synthetic oligonucleotide
  Target: SCN10A; (-) strand; PAM type: NRG; PAM sequence: GGG
cttcttccactcttggggtg

SEQ ID NO: 16095 - DNA, 20 bp, Artificial Sequence
  Description of Artificial Sequence: Synthetic oligonucleotide
  Target: SCN10A; (-) strand; PAM type: NRG; PAM sequence: GGG
ccttcttccactcttggggt

SEQ ID NO: 16096 - DNA, 20 bp, Artificial Sequence
  Description of Artificial Sequence: Synthetic oligonucleotide
  Target: SCN10A; (-) strand; PAM type: NRG; PAM sequence: TGG
gccttcttccactcttgggg

SEQ ID NO: 16097 - DNA, 20 bp, Artificial Sequence
  Description of Artificial Sequence: Synthetic oligonucleotide
  Target: SCN10A; (-) strand; PAM type: NRG; PAM sequence: GGG
tgagccttcttccactcttg

SEQ ID NO: 16098 - DNA, 20 bp, Artificial Sequence
  Description of Artificial Sequence: Synthetic oligonucleotide
  Target: SCN10A; (-) strand; PAM type: NRG; PAM sequence: GGG
atgagccttcttccactctt

SEQ ID NO: 16099 - DNA, 20 bp, Artificial Sequence
  Description of Artificial Sequence: Synthetic oligonucleotide
  Target: SCN10A; (-) strand; PAM type: NRG; PAM sequence: TGG
catgagccttcttccactct

SEQ ID NO: 16100 - DNA, 20 bp, Artificial Sequence
  Description of Artificial Sequence: Synthetic oligonucleotide
  Target: SCN10A; (-) strand; PAM type: NRG; PAM sequence: GAG
tcttggagacacagagacat

SEQ ID NO: 16101 - DNA, 20 bp, Artificial Sequence
  Description of Artificial Sequence: Synthetic oligonucleotide
  Target: SCN10A; (-) strand; PAM type: NRG; PAM sequence: GAG
attagtatcttggagacaca

SEQ ID NO: 16102 - DNA, 20 bp, Artificial Sequence
  Description of Artificial Sequence: Synthetic oligonucleotide
  Target: SCN10A; (-) strand; PAM type: NRG; PAM sequence: CAG
caattagtatcttggagaca

SEQ ID NO: 16103 - DNA, 20 bp, Artificial Sequence
  Description of Artificial Sequence: Synthetic oligonucleotide
  Target: SCN10A; (-) strand; PAM type: NRG; PAM sequence: GAG
tgggggcaattagtatcttg

SEQ ID NO: 16104 - DNA, 20 bp, Artificial Sequence
  Description of Artificial Sequence: Synthetic oligonucleotide
  Target: SCN10A; (-) strand; PAM type: NRG; PAM sequence: TGG
gctgggggcaattagtatct

SEQ ID NO: 16105 - DNA, 20 bp, Artificial Sequence
  Description of Artificial Sequence: Synthetic oligonucleotide
  Target: SCN10A; (-) strand; PAM type: NRG; PAM sequence: TAG
tgagcactgctgggggcaat

SEQ ID NO: 16106 - DNA, 20 bp, Artificial Sequence
  Description of Artificial Sequence: Synthetic oligonucleotide
  Target: SCN10A; (-) strand; PAM type: NRG; PAM sequence: GGG
aatgtgttgagcactgctgg

SEQ ID NO: 16107 - DNA, 20 bp, Artificial Sequence
  Description of Artificial Sequence: Synthetic oligonucleotide
  Target: SCN10A; (-) strand; PAM type: NRG; PAM sequence: GGG
gaatgtgttgagcactgctg

SEQ ID NO: 16108 - DNA, 20 bp, Artificial Sequence
  Description of Artificial Sequence: Synthetic oligonucleotide
  Target: SCN10A; (-) strand; PAM type: NRG; PAM sequence: GGG
tgaatgtgttgagcactgct

SEQ ID NO: 16109 - DNA, 20 bp, Artificial Sequence
  Description of Artificial Sequence: Synthetic oligonucleotide
  Target: SCN10A; (-) strand; PAM type: NRG; PAM sequence: TGG
gtgaatgtgttgagcactgc

SEQ ID NO: 16110 - DNA, 20 bp, Artificial Sequence
  Description of Artificial Sequence: Synthetic oligonucleotide
  Target: SCN10A; (-) strand; PAM type: NRG; PAM sequence: GAG
attataagggtgaatgtgtt

SEQ ID NO: 16111 - DNA, 20 bp, Artificial Sequence
  Description of Artificial Sequence: Synthetic oligonucleotide
  Target: SCN10A; (-) strand; PAM type: NRG; PAM sequence: GGG
tggaaataaatgtattataa

SEQ ID NO: 16112 - DNA, 20 bp, Artificial Sequence
  Description of Artificial Sequence: Synthetic oligonucleotide
  Target: SCN10A; (-) strand; PAM type: NRG; PAM sequence: AGG
atggaaataaatgtattata

SEQ ID NO: 16113 - DNA, 20 bp, Artificial Sequence
  Description of Artificial Sequence: Synthetic oligonucleotide
  Target: SCN10A; (-) strand; PAM type: NRG; PAM sequence: AAG
catggaaataaatgtattat

SEQ ID NO: 16114 - DNA, 20 bp, Artificial Sequence
  Description of Artificial Sequence: Synthetic oligonucleotide
  Target: SCN10A; (-) strand; PAM type: NRG; PAM sequence: TGG
ttcagcagacaagacacaca

SEQ ID NO: 16115 - DNA, 20 bp, Artificial Sequence
  Description of Artificial Sequence: Synthetic oligonucleotide
  Target: SCN10A; (-) strand; PAM type: NRG; PAM sequence: AAG
actttagtctttcagcagac

SEQ ID NO: 16116 - DNA, 20 bp, Artificial Sequence
  Description of Artificial Sequence: Synthetic oligonucleotide
  Target: SCN10A; (-) strand; PAM type: NRG; PAM sequence: CAG
cttacactttagtctttcag

SEQ ID NO: 16117 - DNA, 20 bp, Artificial Sequence
  Description of Artificial Sequence: Synthetic oligonucleotide
  Target: SCN10A; (-) strand; PAM type: NRG; PAM sequence: CAG
gatcttacactttagtcttt

SEQ ID NO: 16118 - DNA, 20 bp, Artificial Sequence
  Description of Artificial Sequence: Synthetic oligonucleotide
  Target: SCN10A; (-) strand; PAM type: NRG; PAM sequence: TAG
atctccaggatcttacactt

SEQ ID NO: 16119 - DNA, 20 bp, Artificial Sequence
  Description of Artificial Sequence: Synthetic oligonucleotide
  Target: SCN10A; (-) strand; PAM type: NRG; PAM sequence: AGG
aataaatactcactatctcc

SEQ ID NO: 16120 - DNA, 20 bp, Artificial Sequence
  Description of Artificial Sequence: Synthetic oligonucleotide
  Target: SCN10A; (-) strand; PAM type: NRG; PAM sequence: CAG
gaataaatactcactatctc

SEQ ID NO: 16121 - DNA, 20 bp, Artificial Sequence
  Description of Artificial Sequence: Synthetic oligonucleotide
  Target: SCN10A; (-) strand; PAM type: NRG; PAM sequence: CAG
ctttgtaagaaacagaagca

SEQ ID NO: 16122 - DNA, 20 bp, Artificial Sequence
  Description of Artificial Sequence: Synthetic oligonucleotide
  Target: SCN10A; (-) strand; PAM type: NRG; PAM sequence: AAG
aagtgctttgtaagaaacag

SEQ ID NO: 16123 - DNA, 20 bp, Artificial Sequence
  Description of Artificial Sequence: Synthetic oligonucleotide
  Target: SCN10A; (-) strand; PAM type: NRG; PAM sequence: CAG
atgaagtgctttgtaagaaa

SEQ ID NO: 16124 - DNA, 20 bp, Artificial Sequence
  Description of Artificial Sequence: Synthetic oligonucleotide
  Target: SCN10A; (-) strand; PAM type: NRG; PAM sequence: AAG
tgtcttatgaagtgctttgt

SEQ ID NO: 16125 - DNA, 20 bp, Artificial Sequence
  Description of Artificial Sequence: Synthetic oligonucleotide
  Target: SCN10A; (-) strand; PAM type: NRG; PAM sequence: AAG
gaatacaggattgtcttatg

SEQ ID NO: 16126 - DNA, 20 bp, Artificial Sequence
  Description of Artificial Sequence: Synthetic oligonucleotide
  Target: SCN10A; (-) strand; PAM type: NRG; PAM sequence: AGG
tacatctaactattgaatac

SEQ ID NO: 16127 - DNA, 20 bp, Artificial Sequence
  Description of Artificial Sequence: Synthetic oligonucleotide
  Target: SCN10A; (-) strand; PAM type: NRG; PAM sequence: CAG
atacatctaactattgaata

SEQ ID NO: 16128 - DNA, 20 bp, Artificial Sequence
  Description of Artificial Sequence: Synthetic oligonucleotide
  Target: SCN10A; (-) strand; PAM type: NRG; PAM sequence: TAG
cttctttctttctttccttc

SEQ ID NO: 16129 - DNA, 20 bp, Artificial Sequence
  Description of Artificial Sequence: Synthetic oligonucleotide
  Target: SCN10A; (-) strand; PAM type: NRG; PAM sequence: CAG
tcacccttcaacttttcatc

SEQ ID NO: 16130 - DNA, 20 bp, Artificial Sequence
  Description of Artificial Sequence: Synthetic oligonucleotide
  Target: SCN10A; (-) strand; PAM type: NRG; PAM sequence: TAG
caatatgctattattaacta

SEQ ID NO: 16131 - DNA, 20 bp, Artificial Sequence
  Description of Artificial Sequence: Synthetic oligonucleotide
  Target: SCN10A; (-) strand; PAM type: NRG; PAM sequence: GAG
agcagctataattactcagc

SEQ ID NO: 16132 - DNA, 20 bp, Artificial Sequence
  Description of Artificial Sequence: Synthetic oligonucleotide
  Target: SCN10A; (-) strand; PAM type: NRG; PAM sequence: CAG
caagagcagctataattact

SEQ ID NO: 16133 - DNA, 20 bp, Artificial Sequence
  Description of Artificial Sequence: Synthetic oligonucleotide
  Target: SCN10A; (-) strand; PAM type: NRG; PAM sequence: CAG
ttctccccctgtggcaagag

SEQ ID NO: 16134 - DNA, 20 bp, Artificial Sequence
  Description of Artificial Sequence: Synthetic oligonucleotide
  Target: SCN10A; (-) strand; PAM type: NRG; PAM sequence: GAG
catttctccccctgtggcaa

SEQ ID NO: 16135 - DNA, 20 bp, Artificial Sequence
  Description of Artificial Sequence: Synthetic oligonucleotide
  Target: SCN10A; (-) strand; PAM type: NRG; PAM sequence: AAG
cccatttctccccctgtggc

SEQ ID NO: 16136 - DNA, 20 bp, Artificial Sequence
  Description of Artificial Sequence: Synthetic oligonucleotide
  Target: SCN10A; (-) strand; PAM type: NRG; PAM sequence: TGG
gttacccatttctccccctg

SEQ ID NO: 16137 - DNA, 20 bp, Artificial Sequence
  Description of Artificial Sequence: Synthetic oligonucleotide
  Target: SCN10A; (-) strand; PAM type: NRG; PAM sequence: TAG
aacatatccatcatctcaca

SEQ ID NO: 16138 - DNA, 20 bp, Artificial Sequence
  Description of Artificial Sequence: Synthetic oligonucleotide
  Target: SCN10A; (-) strand; PAM type: NRG; PAM sequence: TGG
tatataaatgattactatag

SEQ ID NO: 16139 - DNA, 20 bp, Artificial Sequence
  Description of Artificial Sequence: Synthetic oligonucleotide
  Target: SCN10A; (-) strand; PAM type: NRG; PAM sequence: TAG
atatatataaatgattacta

SEQ ID NO: 16140 - DNA, 20 bp, Artificial Sequence
  Description of Artificial Sequence: Synthetic oligonucleotide
  Target: SCN10A; (-) strand; PAM type: NRG; PAM sequence: AAG
gggatacaaaatgatgttat

SEQ ID NO: 16141 - DNA, 20 bp, Artificial Sequence
  Description of Artificial Sequence: Synthetic oligonucleotide
  Target: SCN10A; (-) strand; PAM type: NRG; PAM sequence: GGG
caaaccatatcaatttttaa

SEQ ID NO: 16142 - DNA, 20 bp, Artificial Sequence
  Description of Artificial Sequence: Synthetic oligonucleotide
  Target: SCN10A; (-) strand; PAM type: NRG; PAM sequence: AGG
ccaaaccatatcaattttta

SEQ ID NO: 16143 - DNA, 20 bp, Artificial Sequence
  Description of Artificial Sequence: Synthetic oligonucleotide
  Target: SCN10A; (-) strand; PAM type: NRG; PAM sequence: AAG
gccaaaccatatcaattttt

SEQ ID NO: 16144 - DNA, 20 bp, Artificial Sequence
  Description of Artificial Sequence: Synthetic oligonucleotide
  Target: SCN10A; (-) strand; PAM type: NRG; PAM sequence: CAG
ataagatttgggtggggaca

SEQ ID NO: 16145 - DNA, 20 bp, Artificial Sequence
  Description of Artificial Sequence: Synthetic oligonucleotide
  Target: SCN10A; (-) strand; PAM type: NRG; PAM sequence: GGG
ttcaagataagatttgggtg

SEQ ID NO: 16146 - DNA, 20 bp, Artificial Sequence
  Description of Artificial Sequence: Synthetic oligonucleotide
  Target: SCN10A; (-) strand; PAM type: NRG; PAM sequence: GGG
attcaagataagatttgggt

SEQ ID NO: 16147 - DNA, 20 bp, Artificial Sequence
  Description of Artificial Sequence: Synthetic oligonucleotide
  Target: SCN10A; (-) strand; PAM type: NRG; PAM sequence: TGG
aattcaagataagatttggg

SEQ ID NO: 16148 - DNA, 20 bp, Artificial Sequence
  Description of Artificial Sequence: Synthetic oligonucleotide
  Target: SCN10A; (-) strand; PAM type: NRG; PAM sequence: GGG
gggaattcaagataagattt

SEQ ID NO: 16149 - DNA, 20 bp, Artificial Sequence
  Description of Artificial Sequence: Synthetic oligonucleotide
  Target: SCN10A; (-) strand; PAM type: NRG; PAM sequence: TGG
tgggaattcaagataagatt

SEQ ID NO: 16150 - DNA, 20 bp, Artificial Sequence
  Description of Artificial Sequence: Synthetic oligonucleotide
  Target: SCN10A; (-) strand; PAM type: NRG; PAM sequence: AAG
aacacatgggaattcaagat

SEQ ID NO: 16151 - DNA, 20 bp, Artificial Sequence
  Description of Artificial Sequence: Synthetic oligonucleotide
  Target: SCN10A; (-) strand; PAM type: NRG; PAM sequence: AAG
cccacaacacatgggaattc

SEQ ID NO: 16152 - DNA, 20 bp, Artificial Sequence
  Description of Artificial Sequence: Synthetic oligonucleotide
  Target: SCN10A; (-) strand; PAM type: NRG; PAM sequence: GGG
cctcccctcccacaacacat

SEQ ID NO: 16153 - DNA, 20 bp, Artificial Sequence
  Description of Artificial Sequence: Synthetic oligonucleotide
  Target: SCN10A; (-) strand; PAM type: NRG; PAM sequence: TGG
ccctcccctcccacaacaca

SEQ ID NO: 16154 - DNA, 20 bp, Artificial Sequence
  Description of Artificial Sequence: Synthetic oligonucleotide
  Target: SCN10A; (-) strand; PAM type: NRG; PAM sequence: GGG
tgattcacttacctcccaca

SEQ ID NO: 16155 - DNA, 20 bp, Artificial Sequence
  Description of Artificial Sequence: Synthetic oligonucleotide
  Target: SCN10A; (-) strand; PAM type: NRG; PAM sequence: AGG
atgattcacttacctcccac

SEQ ID NO: 16156 - DNA, 20 bp, Artificial Sequence
  Description of Artificial Sequence: Synthetic oligonucleotide
  Target: SCN10A; (-) strand; PAM type: NRG; PAM sequence: CAG
catgattcacttacctccca

SEQ ID NO: 16157 - DNA, 20 bp, Artificial Sequence
  Description of Artificial Sequence: Synthetic oligonucleotide
  Target: SCN10A; (-) strand; PAM type: NRG; PAM sequence: AAG
atcatgagaacagcatggga

SEQ ID NO: 16158 - DNA, 20 bp, Artificial Sequence
  Description of Artificial Sequence: Synthetic oligonucleotide
  Target: SCN10A; (-) strand; PAM type: NRG; PAM sequence: GGG
cactatcatgagaacagcat

SEQ ID NO: 16159 - DNA, 20 bp, Artificial Sequence
  Description of Artificial Sequence: Synthetic oligonucleotide
  Target: SCN10A; (-) strand; PAM type: NRG; PAM sequence: TGG
tcactatcatgagaacagca

SEQ ID NO: 16160 - DNA, 20 bp, Artificial Sequence
  Description of Artificial Sequence: Synthetic oligonucleotide
  Target: SCN10A; (-) strand; PAM type: NRG; PAM sequence: CAG
cttattcactatcatgagaa

SEQ ID NO: 16161 - DNA, 20 bp, Artificial Sequence
  Description of Artificial Sequence: Synthetic oligonucleotide
  Target: SCN10A; (-) strand; PAM type: NRG; PAM sequence: GAG
tgaaacttattcactatcat

SEQ ID NO: 16162 - DNA, 20 bp, Artificial Sequence
  Description of Artificial Sequence: Synthetic oligonucleotide
  Target: SCN10A; (-) strand; PAM type: NRG; PAM sequence: GGG
gcaaagagagaggttgggca

SEQ ID NO: 16163 - DNA, 20 bp, Artificial Sequence
  Description of Artificial Sequence: Synthetic oligonucleotide
  Target: SCN10A; (-) strand; PAM type: NRG; PAM sequence: AGG
ggcaaagagagaggttgggc

SEQ ID NO: 16164 - DNA, 20 bp, Artificial Sequence
  Description of Artificial Sequence: Synthetic oligonucleotide
  Target: SCN10A; (-) strand; PAM type: NRG; PAM sequence: CAG
aggcaaagagagaggttggg

SEQ ID NO: 16165 - DNA, 20 bp, Artificial Sequence
  Description of Artificial Sequence: Synthetic oligonucleotide
  Target: SCN10A; (-) strand; PAM type: NRG; PAM sequence: GGG
agcaggcaaagagagaggtt

SEQ ID NO: 16166 - DNA, 20 bp, Artificial Sequence
  Description of Artificial Sequence: Synthetic oligonucleotide
  Target: SCN10A; (-) strand; PAM type: NRG; PAM sequence: TGG
cagcaggcaaagagagaggt

SEQ ID NO: 16167 - DNA, 20 bp, Artificial Sequence
  Description of Artificial Sequence: Synthetic oligonucleotide
  Target: SCN10A; (-) strand; PAM type: NRG; PAM sequence: AGG
atggcagcaggcaaagagag

SEQ ID NO: 16168 - DNA, 20 bp, Artificial Sequence
  Description of Artificial Sequence: Synthetic oligonucleotide
  Target: SCN10A; (-) strand; PAM type: NRG; PAM sequence: GAG
gatggcagcaggcaaagaga

SEQ ID NO: 16169 - DNA, 20 bp, Artificial Sequence
  Description of Artificial Sequence: Synthetic oligonucleotide
  Target: SCN10A; (-) strand; PAM type: NRG; PAM sequence: GAG
tggatggcagcaggcaaaga

SEQ ID NO: 16170 - DNA, 20 bp, Artificial Sequence
  Description of Artificial Sequence: Synthetic oligonucleotide
  Target: SCN10A; (-) strand; PAM type: NRG; PAM sequence: GAG
tgtggatggcagcaggcaaa

SEQ ID NO: 16171 - DNA, 20 bp, Artificial Sequence
  Description of Artificial Sequence: Synthetic oligonucleotide
  Target: SCN10A; (-) strand; PAM type: NRG; PAM sequence: AAG
tatgtggatggcagcaggca

SEQ ID NO: 16172 - DNA, 20 bp, Artificial Sequence
  Description of Artificial Sequence: Synthetic oligonucleotide
  Target: SCN10A; (-) strand; PAM type: NRG; PAM sequence: AGG
cgtcttatgtggatggcagc

SEQ ID NO: 16173 - DNA, 20 bp, Artificial Sequence
  Description of Artificial Sequence: Synthetic oligonucleotide
  Target: SCN10A; (-) strand; PAM type: NRG; PAM sequence: CAG
acgtcttatgtggatggcag

SEQ ID NO: 16174 - DNA, 20 bp, Artificial Sequence
  Description of Artificial Sequence: Synthetic oligonucleotide
  Target: SCN10A; (-) strand; PAM type: NRG; PAM sequence: CAG
gtcacgtcttatgtggatgg

SEQ ID NO: 16175 - DNA, 20 bp, Artificial Sequence
  Description of Artificial Sequence: Synthetic oligonucleotide
  Target: SCN10A; (-) strand; PAM type: NRG; PAM sequence: TGG
cgagtcacgtcttatgtgga

SEQ ID NO: 16176 - DNA, 20 bp, Artificial Sequence
  Description of Artificial Sequence: Synthetic oligonucleotide
  Target: SCN10A; (-) strand; PAM type: NRG; PAM sequence: TGG
ggtgcgagtcacgtcttatg

SEQ ID NO: 16177 - DNA, 20 bp, Artificial Sequence
  Description of Artificial Sequence: Synthetic oligonucleotide
  Target: SCN10A; (-) strand; PAM type: NRG; PAM sequence: GAG
ggcaaaaggaaaggaggtgc

SEQ ID NO: 16178 - DNA, 20 bp, Artificial Sequence
  Description of Artificial Sequence: Synthetic oligonucleotide
  Target: SCN10A; (-) strand; PAM type: NRG; PAM sequence: AGG
aatcatggcaaaaggaaagg

SEQ ID NO: 16179 - DNA, 20 bp, Artificial Sequence
  Description of Artificial Sequence: Synthetic oligonucleotide
  Target: SCN10A; (-) strand; PAM type: NRG; PAM sequence: GAG
caatcatggcaaaaggaaag

SEQ ID NO: 16180 - DNA, 20 bp, Artificial Sequence
  Description of Artificial Sequence: Synthetic oligonucleotide
  Target: SCN10A; (-) strand; PAM type: NRG; PAM sequence: AGG
tacaatcatggcaaaaggaa

SEQ ID NO: 16181 - DNA, 20 bp, Artificial Sequence
  Description of Artificial Sequence: Synthetic oligonucleotide
  Target: SCN10A; (-) strand; PAM type: NRG; PAM sequence: AAG
ttacaatcatggcaaaagga

SEQ ID NO: 16182 - DNA, 20 bp, Artificial Sequence
  Description of Artificial Sequence: Synthetic oligonucleotide
  Target: SCN10A; (-) strand; PAM type: NRG; PAM sequence: AGG
agccttacaatcatggcaaa

SEQ ID NO: 16183 - DNA, 20 bp, Artificial Sequence
  Description of Artificial Sequence: Synthetic oligonucleotide
  Target: SCN10A; (-) strand; PAM type: NRG; PAM sequence: AAG
aagccttacaatcatggcaa

SEQ ID NO: 16184 - DNA, 20 bp, Artificial Sequence
  Description of Artificial Sequence: Synthetic oligonucleotide
  Target: SCN10A; (-) strand; PAM type: NRG; PAM sequence: TGG
ctggggaagccttacaatca

SEQ ID NO: 16185 - DNA, 20 bp, Artificial Sequence
  Description of Artificial Sequence: Synthetic oligonucleotide
  Target: SCN10A; (-) strand; PAM type: NRG; PAM sequence: AAG
acagcttcacatggctgggg

SEQ ID NO: 16186 - DNA, 20 bp, Artificial Sequence
  Description of Artificial Sequence: Synthetic oligonucleotide
  Target: SCN10A; (-) strand; PAM type: NRG; PAM sequence: GGG
cttacagcttcacatggctg

SEQ ID NO: 16187 - DNA, 20 bp, Artificial Sequence
  Description of Artificial Sequence: Synthetic oligonucleotide
  Target: SCN10A; (-) strand; PAM type: NRG; PAM sequence: GGG
acttacagcttcacatggct

SEQ ID NO: 16188 - DNA, 20 bp, Artificial Sequence
  Description of Artificial Sequence: Synthetic oligonucleotide
  Target: SCN10A; (-) strand; PAM type: NRG; PAM sequence: TGG
gacttacagcttcacatggc

SEQ ID NO: 16189 - DNA, 20 bp, Artificial Sequence
  Description of Artificial Sequence: Synthetic oligonucleotide
  Target: SCN10A; (-) strand; PAM type: NRG; PAM sequence: TGG
attggacttacagcttcaca

SEQ ID NO: 16190 - DNA, 20 bp, Artificial Sequence
  Description of Artificial Sequence: Synthetic oligonucleotide
  Target: SCN10A; (-) strand; PAM type: NRG; PAM sequence: CAG
aagaggtttaattggactta

SEQ ID NO: 16191 - DNA, 20 bp, Artificial Sequence
  Description of Artificial Sequence: Synthetic oligonucleotide
  Target: SCN10A; (-) strand; PAM type: NRG; PAM sequence: TGG
ataaaagaaagaggtttaat

SEQ ID NO: 16192 - DNA, 20 bp, Artificial Sequence
  Description of Artificial Sequence: Synthetic oligonucleotide
  Target: SCN10A; (-) strand; PAM type: NRG; PAM sequence: AGG
gggcaatttataaaagaaag

SEQ ID NO: 16193 - DNA, 20 bp, Artificial Sequence
  Description of Artificial Sequence: Synthetic oligonucleotide
  Target: SCN10A; (-) strand; PAM type: NRG; PAM sequence: GAG
tgggcaatttataaaagaaa

SEQ ID NO: 16194 - DNA, 20 bp, Artificial Sequence
  Description of Artificial Sequence: Synthetic oligonucleotide
  Target: SCN10A; (-) strand; PAM type: NRG; PAM sequence: AAG
actgggcaatttataaaaga

SEQ ID NO: 16195 - DNA, 20 bp, Artificial Sequence
  Description of Artificial Sequence: Synthetic oligonucleotide
  Target: SCN10A; (-) strand; PAM type: NRG; PAM sequence: AAG
taagactgggcaatttataa

SEQ ID NO: 16196 - DNA, 20 bp, Artificial Sequence
  Description of Artificial Sequence: Synthetic oligonucleotide
  Target: SCN10A; (-) strand; PAM type: NRG; PAM sequence: GGG
ataaagacatacctaagact

SEQ ID NO: 16197 - DNA, 20 bp, Artificial Sequence
  Description of Artificial Sequence: Synthetic oligonucleotide
  Target: SCN10A; (-) strand; PAM type: NRG; PAM sequence: TGG
gataaagacatacctaagac

SEQ ID NO: 16198 - DNA, 20 bp, Artificial Sequence
  Description of Artificial Sequence: Synthetic oligonucleotide
  Target: SCN10A; (-) strand; PAM type: NRG; PAM sequence: AAG
ctgctgataaagacatacct

SEQ ID NO: 16199 - DNA, 20 bp, Artificial Sequence
  Description of Artificial Sequence: Synthetic oligonucleotide
  Target: SCN10A; (-) strand; PAM type: NRG; PAM sequence: AAG
ctattttcatgctgctgata

SEQ ID NO: 16200 - DNA, 20 bp, Artificial Sequence
  Description of Artificial Sequence: Synthetic oligonucleotide
  Target: SCN10A; (-) strand; PAM type: NRG; PAM sequence: TAG
tttattgtatatatttgtat

SEQ ID NO: 16201 - DNA, 20 bp, Artificial Sequence
  Description of Artificial Sequence: Synthetic oligonucleotide
  Target: SCN10A; (-) strand; PAM type: NRG; PAM sequence: CAG
catgcattagtcattttacc

SEQ ID NO: 16202 - DNA, 20 bp, Artificial Sequence
  Description of Artificial Sequence: Synthetic oligonucleotide
  Target: SCN10A; (-) strand; PAM type: NRG; PAM sequence: TAG
ccatctttccattcatgcat

SEQ ID NO: 16203 - DNA, 20 bp, Artificial Sequence
  Description of Artificial Sequence: Synthetic oligonucleotide
  Target: SCN10A; (-) strand; PAM type: NRG; PAM sequence: CAG
ttccattcatctattctgtc

SEQ ID NO: 16204 - DNA, 20 bp, Artificial Sequence
  Description of Artificial Sequence: Synthetic oligonucleotide
  Target: SCN10A; (-) strand; PAM type: NRG; PAM sequence: CAG
catccatcctatcaaccttc

SEQ ID NO: 16205 - DNA, 20 bp, Artificial Sequence
  Description of Artificial Sequence: Synthetic oligonucleotide
  Target: SCN10A; (-) strand; PAM type: NRG; PAM sequence: AAG
cattcacgcatcttccatcc

SEQ ID NO: 16206 - DNA, 20 bp, Artificial Sequence
  Description of Artificial Sequence: Synthetic oligonucleotide
  Target: SCN10A; (-) strand; PAM type: NRG; PAM sequence: CAG
ttccagctgtacatcttcat

SEQ ID NO: 16207 - DNA, 20 bp, Artificial Sequence
  Description of Artificial Sequence: Synthetic oligonucleotide
  Target: SCN10A; (-) strand; PAM type: NRG; PAM sequence: CAG
ccatccatctttatttcttc

SEQ ID NO: 16208 - DNA, 20 bp, Artificial Sequence
  Description of Artificial Sequence: Synthetic oligonucleotide
  Target: SCN10A; (-) strand; PAM type: NRG; PAM sequence: CAG
accttttgtatccaaccatt

SEQ ID NO: 16209 - DNA, 20 bp, Artificial Sequence
  Description of Artificial Sequence: Synthetic oligonucleotide
  Target: SCN10A; (-) strand; PAM type: NRG; PAM sequence: CGG
tcagtcctaatcaccttaaa

SEQ ID NO: 16210 - DNA, 20 bp, Artificial Sequence
  Description of Artificial Sequence: Synthetic oligonucleotide
  Target: SCN10A; (-) strand; PAM type: NRG; PAM sequence: CAG
tatgttgatctcaccagtct

SEQ ID NO: 16211 - DNA, 20 bp, Artificial Sequence
  Description of Artificial Sequence: Synthetic oligonucleotide
  Target: SCN10A; (-) strand; PAM type: NRG; PAM sequence: CAG
cctgcttatgttgatctcac

SEQ ID NO: 16212 - DNA, 20 bp, Artificial Sequence
  Description of Artificial Sequence: Synthetic oligonucleotide
  Target: SCN10A; (-) strand; PAM type: NRG; PAM sequence: CAG
gtcccacccctttgggggca

SEQ ID NO: 16213 - DNA, 20 bp, Artificial Sequence
  Description of Artificial Sequence: Synthetic oligonucleotide
  Target: SCN10A; (-) strand; PAM type: NRG; PAM sequence: GGG
ccggtgtcccacccctttgg

SEQ ID NO: 16214 - DNA, 20 bp, Artificial Sequence
  Description of Artificial Sequence: Synthetic oligonucleotide
  Target: SCN10A; (-) strand; PAM type: NRG; PAM sequence: GGG
tccggtgtcccacccctttg

SEQ ID NO: 16215 - DNA, 20 bp, Artificial Sequence
  Description of Artificial Sequence: Synthetic oligonucleotide
  Target: SCN10A; (-) strand; PAM type: NRG; PAM sequence: GGG
ttccggtgtcccaccccttt

SEQ ID NO: 16216 - DNA, 20 bp, Artificial Sequence
  Description of Artificial Sequence: Synthetic oligonucleotide
  Target: SCN10A; (-) strand; PAM type: NRG; PAM sequence: TGG
attccggtgtcccacccctt

SEQ ID NO: 16217 - DNA, 20 bp, Artificial Sequence
  Description of Artificial Sequence: Synthetic oligonucleotide
  Target: SCN10A; (-) strand; PAM type: NRG; PAM sequence: CGG
gaaaggaaaattatttattc

SEQ ID NO: 16218 - DNA, 20 bp, Artificial Sequence
  Description of Artificial Sequence: Synthetic oligonucleotide
  Target: SCN10A; (-) strand; PAM type: NRG; PAM sequence: AGG
aataattattcataaatgaa

SEQ ID NO: 16219 - DNA, 20 bp, Artificial Sequence
  Description of Artificial Sequence: Synthetic oligonucleotide
  Target: SCN10A; (-) strand; PAM type: NRG; PAM sequence: AAG
aaataattattcataaatga

SEQ ID NO: 16220 - DNA, 20 bp, Artificial Sequence
  Description of Artificial Sequence: Synthetic oligonucleotide
  Target: SCN10A; (-) strand; PAM type: NRG; PAM sequence: GGG
aggcctgaaatctgagtcat

SEQ ID NO: 16221 - DNA, 20 bp, Artificial Sequence
  Description of Artificial Sequence: Synthetic oligonucleotide
  Target: SCN10A; (-) strand; PAM type: NRG; PAM sequence: TGG
gaggcctgaaatctgagtca

SEQ ID NO: 16222 - DNA, 20 bp, Artificial Sequence
  Description of Artificial Sequence: Synthetic oligonucleotide
  Target: SCN10A; (-) strand; PAM type: NRG; PAM sequence: GAG
agctgtgaggcctgaaatct

SEQ ID NO: 16223 - DNA, 20 bp, Artificial Sequence
  Description of Artificial Sequence: Synthetic oligonucleotide
  Target: SCN10A; (-) strand; PAM type: NRG; PAM sequence: AGG
taccacaaggattagctgtg

SEQ ID NO: 16224 - DNA, 20 bp, Artificial Sequence
  Description of Artificial Sequence: Synthetic oligonucleotide
  Target: SCN10A; (-) strand; PAM type: NRG; PAM sequence: GAG
gtaccacaaggattagctgt

SEQ ID NO: 16225 - DNA, 20 bp, Artificial Sequence
  Description of Artificial Sequence: Synthetic oligonucleotide
  Target: SCN10A; (-) strand; PAM type: NRG; PAM sequence: TAG
ggccactgtaccacaaggat

SEQ ID NO: 16226 - DNA, 20 bp, Artificial Sequence
  Description of Artificial Sequence: Synthetic oligonucleotide
  Target: SCN10A; (-) strand; PAM type: NRG; PAM sequence: AGG
cttcaggccactgtaccaca

SEQ ID NO: 16227 - DNA, 20 bp, Artificial Sequence
  Description of Artificial Sequence: Synthetic oligonucleotide
  Target: SCN10A; (-) strand; PAM type: NRG; PAM sequence: AAG
gcttcaggccactgtaccac

SEQ ID NO: 16228 - DNA, 20 bp, Artificial Sequence
  Description of Artificial Sequence: Synthetic oligonucleotide
  Target: SCN10A; (-) strand; PAM type: NRG; PAM sequence: AGG
gccaatgcactagcagcttc

SEQ ID NO: 16229 - DNA, 20 bp, Artificial Sequence
  Description of Artificial Sequence: Synthetic oligonucleotide
  Target: SCN10A; (-) strand; PAM type: NRG; PAM sequence: CAG
tgccaatgcactagcagctt

SEQ ID NO: 16230 - DNA, 20 bp, Artificial Sequence
  Description of Artificial Sequence: Synthetic oligonucleotide
  Target: SCN10A; (-) strand; PAM type: NRG; PAM sequence: CAG
ccctgatgccaatgcactag

SEQ ID NO: 16231 - DNA, 20 bp, Artificial Sequence
  Description of Artificial Sequence: Synthetic oligonucleotide
  Target: SCN10A; (-) strand; PAM type: NRG; PAM sequence: TAG
cttccctgatgccaatgcac

SEQ ID NO: 16232 - DNA, 20 bp, Artificial Sequence
  Description of Artificial Sequence: Synthetic oligonucleotide
  Target: SCN10A; (-) strand; PAM type: NRG; PAM sequence: AGG
gctggcaggtcctccatagc

SEQ ID NO: 16233 - DNA, 20 bp, Artificial Sequence
  Description of Artificial Sequence: Synthetic oligonucleotide
  Target: SCN10A; (-) strand; PAM type: NRG; PAM sequence: CAG
tgctggcaggtcctccatag

SEQ ID NO: 16234 - DNA, 20 bp, Artificial Sequence
  Description of Artificial Sequence: Synthetic oligonucleotide
  Target: SCN10A; (-) strand; PAM type: NRG; PAM sequence: TAG
ctgtgctggcaggtcctcca

SEQ ID NO: 16235 - DNA, 20 bp, Artificial Sequence
  Description of Artificial Sequence: Synthetic oligonucleotide
  Target: SCN10A; (-) strand; PAM type: NRG; PAM sequence: AGG
gtccagcctcctgtgctggc

SEQ ID NO: 16236 - DNA, 20 bp, Artificial Sequence
  Description of Artificial Sequence: Synthetic oligonucleotide
  Target: SCN10A; (-) strand; PAM type: NRG; PAM sequence: CAG
tgtccagcctcctgtgctgg

SEQ ID NO: 16237 - DNA, 20 bp, Artificial Sequence
  Description of Artificial Sequence: Synthetic oligonucleotide
  Target: SCN10A; (-) strand; PAM type: NRG; PAM sequence: TGG
ttctgtccagcctcctgtgc

SEQ ID NO: 16238 - DNA, 20 bp, Artificial Sequence
  Description of Artificial Sequence: Synthetic oligonucleotide
  Target: SCN10A; (-) strand; PAM type: NRG; PAM sequence: CAG
tcagcacagaacattctgtc

SEQ ID NO: 16239 - DNA, 20 bp, Artificial Sequence
  Description of Artificial Sequence: Synthetic oligonucleotide
  Target: SCN10A; (-) strand; PAM type: NRG; PAM sequence: CAG
aagctggatgaggttcagca

SEQ ID NO: 16240 - DNA, 20 bp, Artificial Sequence
  Description of Artificial Sequence: Synthetic oligonucleotide
  Target: SCN10A; (-) strand; PAM type: NRG; PAM sequence: CAG
tcctgaagctggatgaggtt

SEQ ID NO: 16241 - DNA, 20 bp, Artificial Sequence
  Description of Artificial Sequence: Synthetic oligonucleotide
  Target: SCN10A; (-) strand; PAM type: NRG; PAM sequence: AGG
ttgcctcctgaagctggatg

SEQ ID NO: 16242 - DNA, 20 bp, Artificial Sequence
  Description of Artificial Sequence: Synthetic oligonucleotide
  Target: SCN10A; (-) strand; PAM type: NRG; PAM sequence: GAG
cttgcctcctgaagctggat

SEQ ID NO: 16243 - DNA, 20 bp, Artificial Sequence
  Description of Artificial Sequence: Synthetic oligonucleotide
  Target: SCN10A; (-) strand; PAM type: NRG; PAM sequence: TGG
tggtgcttgcctcctgaagc

SEQ ID NO: 16244 - DNA, 20 bp, Artificial Sequence
  Description of Artificial Sequence: Synthetic oligonucleotide
  Target: SCN10A; (-) strand; PAM type: NRG; PAM sequence: AAG
tatttggtgcttgcctcctg

SEQ ID NO: 16245 - DNA, 20 bp, Artificial Sequence
  Description of Artificial Sequence: Synthetic oligonucleotide
  Target: SCN10A; (-) strand; PAM type: NRG; PAM sequence: TGG
tcaggaaatgtgtctgtatt

SEQ ID NO: 16246 - DNA, 20 bp, Artificial Sequence
  Description of Artificial Sequence: Synthetic oligonucleotide
  Target: SCN10A; (-) strand; PAM type: NRG; PAM sequence: AGG
gtctgcccagcagaggtgtc

SEQ ID NO: 16247 - DNA, 20 bp, Artificial Sequence
  Description of Artificial Sequence: Synthetic oligonucleotide
  Target: SCN10A; (-) strand; PAM type: NRG; PAM sequence: CAG
ggtctgcccagcagaggtgt

SEQ ID NO: 16248 - DNA, 20 bp, Artificial Sequence
  Description of Artificial Sequence: Synthetic oligonucleotide
  Target: SCN10A; (-) strand; PAM type: NRG; PAM sequence: AGG
cagcaaggtctgcccagcag

SEQ ID NO: 16249 - DNA, 20 bp, Artificial Sequence
  Description of Artificial Sequence: Synthetic oligonucleotide
  Target: SCN10A; (-) strand; PAM type: NRG; PAM sequence: GAG
gcagcaaggtctgcccagca

SEQ ID NO: 16250 - DNA, 20 bp, Artificial Sequence
  Description of Artificial Sequence: Synthetic oligonucleotide
  Target: SCN10A; (-) strand; PAM type: NRG; PAM sequence: CAG
cagcagcaaggtctgcccag

SEQ ID NO: 16251 - DNA, 20 bp, Artificial Sequence
  Description of Artificial Sequence: Synthetic oligonucleotide
  Target: SCN10A; (-) strand; PAM type: NRG; PAM sequence: CAG
tgccagcagcaaggtctgcc

SEQ ID NO: 16252 - DNA, 20 bp, Artificial Sequence
  Description of Artificial Sequence: Synthetic oligonucleotide
  Target: SCN10A; (-) strand; PAM type: NRG; PAM sequence: AGG
tcaagcagctgccagcagca

SEQ ID NO: 16253 - DNA, 20 bp, Artificial Sequence
  Description of Artificial Sequence: Synthetic oligonucleotide
  Target: SCN10A; (-) strand; PAM type: NRG; PAM sequence: AAG
ctcaagcagctgccagcagc

SEQ ID NO: 16254 - DNA, 20 bp, Artificial Sequence
  Description of Artificial Sequence: Synthetic oligonucleotide
  Target: SCN10A; (-) strand; PAM type: NRG; PAM sequence: CAG
cccactcaagcagctgccag

SEQ ID NO: 16255 - DNA, 20 bp, Artificial Sequence
  Description of Artificial Sequence: Synthetic oligonucleotide
  Target: SCN10A; (-) strand; PAM type: NRG; PAM sequence: CAG
tgccccactcaagcagctgc

SEQ ID NO: 16256 - DNA, 20 bp, Artificial Sequence
  Description of Artificial Sequence: Synthetic oligonucleotide
  Target: SCN10A; (-) strand; PAM type: NRG; PAM sequence: CAG
ctctgcctgccccactcaag

SEQ ID NO: 16257 - DNA, 20 bp, Artificial Sequence
  Description of Artificial Sequence: Synthetic oligonucleotide
  Target: SCN10A; (-) strand; PAM type: NRG; PAM sequence: AAG
ggtctctgcctgccccactc

SEQ ID NO: 16258 - DNA, 20 bp, Artificial Sequence
  Description of Artificial Sequence: Synthetic oligonucleotide
  Target: SCN10A; (-) strand; PAM type: NRG; PAM sequence: TGG
gggtgaggcatgtgctgtgt

SEQ ID NO: 16259 - DNA, 20 bp, Artificial Sequence
  Description of Artificial Sequence: Synthetic oligonucleotide
  Target: SCN10A; (-) strand; PAM type: NRG; PAM sequence: AGG
gggtttctgcaagcagggtg

SEQ ID NO: 16260 - DNA, 20 bp, Artificial Sequence
  Description of Artificial Sequence: Synthetic oligonucleotide
  Target: SCN10A; (-) strand; PAM type: NRG; PAM sequence: GAG
agggtttctgcaagcagggt

SEQ ID NO: 16261 - DNA, 20 bp, Artificial Sequence
  Description of Artificial Sequence: Synthetic oligonucleotide
  Target: SCN10A; (-) strand; PAM type: NRG; PAM sequence: GGG
gctgagggtttctgcaagca

SEQ ID NO: 16262 - DNA, 20 bp, Artificial Sequence
  Description of Artificial Sequence: Synthetic oligonucleotide
  Target: SCN10A; (-) strand; PAM type: NRG; PAM sequence: AGG
agctgagggtttctgcaagc

SEQ ID NO: 16263 - DNA, 20 bp, Artificial Sequence
  Description of Artificial Sequence: Synthetic oligonucleotide
  Target: SCN10A; (-) strand; PAM type: NRG; PAM sequence: CAG
tagctgagggtttctgcaag

SEQ ID NO: 16264 - DNA, 20 bp, Artificial Sequence
  Description of Artificial Sequence: Synthetic oligonucleotide
  Target: SCN10A; (-) strand; PAM type: NRG; PAM sequence: AAG
gcatagctgagggtttctgc

SEQ ID NO: 16265 - DNA, 20 bp, Artificial Sequence
  Description of Artificial Sequence: Synthetic oligonucleotide
  Target: SCN10A; (-) strand; PAM type: NRG; PAM sequence: GGG
gttcactgccgcatagctga

SEQ ID NO: 16266 - DNA, 20 bp, Artificial Sequence
  Description of Artificial Sequence: Synthetic oligonucleotide
  Target: SCN10A; (-) strand; PAM type: NRG; PAM sequence: AGG
tgttcactgccgcatagctg

SEQ ID NO: 16267 - DNA, 20 bp, Artificial Sequence
  Description of Artificial Sequence: Synthetic oligonucleotide
  Target: SCN10A; (-) strand; PAM type: NRG; PAM sequence: GAG
ctgttcactgccgcatagct

SEQ ID NO: 16268 - DNA, 20 bp, Artificial Sequence
  Description of Artificial Sequence: Synthetic oligonucleotide
  Target: SCN10A; (-) strand; PAM type: NRG; PAM sequence: TAG
gttatctgttcactgccgca

SEQ ID NO: 16269 - DNA, 20 bp, Artificial Sequence
  Description of Artificial Sequence: Synthetic oligonucleotide
  Target: SCN10A; (-) strand; PAM type: NRG; PAM sequence: GAG
gctttgcagcatggttaact

SEQ ID NO: 16270 - DNA, 20 bp, Artificial Sequence
  Description of Artificial Sequence: Synthetic oligonucleotide
  Target: SCN10A; (-) strand; PAM type: NRG; PAM sequence: TGG
accttctttgctttgcagca

SEQ ID NO: 16271 - DNA, 20 bp, Artificial Sequence
  Description of Artificial Sequence: Synthetic oligonucleotide
  Target: SCN10A; (-) strand; PAM type: NRG; PAM sequence: CAG
ccactaccttctttgctttg

SEQ ID NO: 16272 - DNA, 20 bp, Artificial Sequence
  Description of Artificial Sequence: Synthetic oligonucleotide
  Target: SCN10A; (-) strand; PAM type: NRG; PAM sequence: AGG
acattgcactatcactgtct

SEQ ID NO: 16273 - DNA, 20 bp, Artificial Sequence
  Description of Artificial Sequence: Synthetic oligonucleotide
  Target: SCN10A; (-) strand; PAM type: NRG; PAM sequence: TAG
cacattgcactatcactgtc

SEQ ID NO: 16274 - DNA, 20 bp, Artificial Sequence
  Description of Artificial Sequence: Synthetic oligonucleotide
  Target: SCN10A; (-) strand; PAM type: NRG; PAM sequence: CAG
acatcagacatgtgattcct

SEQ ID NO: 16275 - DNA, 20 bp, Artificial Sequence
  Description of Artificial Sequence: Synthetic oligonucleotide
  Target: SCN10A; (-) strand; PAM type: NRG; PAM sequence: CAG
actgtgtgcttctcacacat

SEQ ID NO: 16276 - DNA, 20 bp, Artificial Sequence
  Description of Artificial Sequence: Synthetic oligonucleotide
  Target: SCN10A; (-) strand; PAM type: NRG; PAM sequence: GAG
ggccagtaatccctgcatta

SEQ ID NO: 16277 - DNA, 20 bp, Artificial Sequence
  Description of Artificial Sequence: Synthetic oligonucleotide
  Target: SCN10A; (-) strand; PAM type: NRG; PAM sequence: TAG
gtggccagtaatccctgcat

SEQ ID NO: 16278 - DNA, 20 bp, Artificial Sequence
  Description of Artificial Sequence: Synthetic oligonucleotide
  Target: SCN10A; (-) strand; PAM type: NRG; PAM sequence: CAG
cactcatggtaacctgtggc

SEQ ID NO: 16279 - DNA, 20 bp, Artificial Sequence
  Description of Artificial Sequence: Synthetic oligonucleotide
  Target: SCN10A; (-) strand; PAM type: NRG; PAM sequence: TGG
ttcacactcatggtaacctg

SEQ ID NO: 16280 - DNA, 20 bp, Artificial Sequence
  Description of Artificial Sequence: Synthetic oligonucleotide
  Target: SCN10A; (-) strand; PAM type: NRG; PAM sequence: TGG
agttcatgtgttcacactca

SEQ ID NO: 16281 - DNA, 20 bp, Artificial Sequence
  Description of Artificial Sequence: Synthetic oligonucleotide
  Target: SCN10A; (-) strand; PAM type: NRG; PAM sequence: GAG
tttggagaggtaatgagctg

SEQ ID NO: 16282 - DNA, 20 bp, Artificial Sequence
  Description of Artificial Sequence: Synthetic oligonucleotide
  Target: SCN10A; (-) strand; PAM type: NRG; PAM sequence: TGG
catttggagaggtaatgagc

SEQ ID NO: 16283 - DNA, 20 bp, Artificial Sequence
  Description of Artificial Sequence: Synthetic oligonucleotide
  Target: SCN10A; (-) strand; PAM type: NRG; PAM sequence: GAG
ggcgcatttggagaggtaat

SEQ ID NO: 16284 - DNA, 20 bp, Artificial Sequence
  Description of Artificial Sequence: Synthetic oligonucleotide
  Target: SCN10A; (-) strand; PAM type: NRG; PAM sequence: AGG
aacagagggcgcatttggag

SEQ ID NO: 16285 - DNA, 20 bp, Artificial Sequence
  Description of Artificial Sequence: Synthetic oligonucleotide
  Target: SCN10A; (-) strand; PAM type: NRG; PAM sequence: GAG
gaacagagggcgcatttgga

SEQ ID NO: 16286 - DNA, 20 bp, Artificial Sequence
  Description of Artificial Sequence: Synthetic oligonucleotide
  Target: SCN10A; (-) strand; PAM type: NRG; PAM sequence: GAG
aagaacagagggcgcatttg

SEQ ID NO: 16287 - DNA, 20 bp, Artificial Sequence
  Description of Artificial Sequence: Synthetic oligonucleotide
  Target: SCN10A; (-) strand; PAM type: NRG; PAM sequence: TGG
aaaagaacagagggcgcatt

SEQ ID NO: 16288 - DNA, 20 bp, Artificial Sequence
  Description of Artificial Sequence: Synthetic oligonucleotide
  Target: SCN10A; (-) strand; PAM type: NRG; PAM sequence: GGG
gtggcattgaaaagaacaga

SEQ ID NO: 16289 - DNA, 20 bp, Artificial Sequence
  Description of Artificial Sequence: Synthetic oligonucleotide
  Target: SCN10A; (-) strand; PAM type: NRG; PAM sequence: AGG
agtggcattgaaaagaacag

SEQ ID NO: 16290 - DNA, 20 bp, Artificial Sequence
  Description of Artificial Sequence: Synthetic oligonucleotide
  Target: SCN10A; (-) strand; PAM type: NRG; PAM sequence: GAG
cagtggcattgaaaagaaca

SEQ ID NO: 16291 - DNA, 20 bp, Artificial Sequence
  Description of Artificial Sequence: Synthetic oligonucleotide
  Target: SCN10A; (-) strand; PAM type: NRG; PAM sequence: CAG
cccagtggcattgaaaagaa

SEQ ID NO: 16292 - DNA, 20 bp, Artificial Sequence
  Description of Artificial Sequence: Synthetic oligonucleotide
  Target: SCN10A; (-) strand; PAM type: NRG; PAM sequence: AAG
tcctccccagtggcattgaa

SEQ ID NO: 16293 - DNA, 20 bp, Artificial Sequence
  Description of Artificial Sequence: Synthetic oligonucleotide
  Target: SCN10A; (-) strand; PAM type: NRG; PAM sequence: TGG
tactgctgcctcctccccag

SEQ ID NO: 16294 - DNA, 20 bp, Artificial Sequence
  Description of Artificial Sequence: Synthetic oligonucleotide
  Target: SCN10A; (-) strand; PAM type: NRG; PAM sequence: CAG
ttatactgctgcctcctccc

SEQ ID NO: 16295 - DNA, 20 bp, Artificial Sequence
  Description of Artificial Sequence: Synthetic oligonucleotide
  Target: SCN10A; (-) strand; PAM type: NRG; PAM sequence: GAG
agccatggcttagaaccact

SEQ ID NO: 16296 - DNA, 20 bp, Artificial Sequence
  Description of Artificial Sequence: Synthetic oligonucleotide
  Target: SCN10A; (-) strand; PAM type: NRG; PAM sequence: TAG
tccaaggtgcagccatggct

SEQ ID NO: 16297 - DNA, 20 bp, Artificial Sequence
  Description of Artificial Sequence: Synthetic oligonucleotide
  Target: SCN10A; (-) strand; PAM type: NRG; PAM sequence: TGG
gcatttccaaggtgcagcca

SEQ ID NO: 16298 - DNA, 20 bp, Artificial Sequence
  Description of Artificial Sequence: Synthetic oligonucleotide
  Target: SCN10A; (-) strand; PAM type: NRG; PAM sequence: CAG
tcccaggcatttccaaggtg

SEQ ID NO: 16299 - DNA, 20 bp, Artificial Sequence
  Description of Artificial Sequence: Synthetic oligonucleotide
  Target: SCN10A; (-) strand; PAM type: NRG; PAM sequence: AGG
aatgctcccaggcatttcca

SEQ ID NO: 16300 - DNA, 20 bp, Artificial Sequence
  Description of Artificial Sequence: Synthetic oligonucleotide
  Target: SCN10A; (-) strand; PAM type: NRG; PAM sequence: AAG
aaatgctcccaggcatttcc

SEQ ID NO: 16301 - DNA, 20 bp, Artificial Sequence
  Description of Artificial Sequence: Synthetic oligonucleotide
  Target: SCN10A; (-) strand; PAM type: NRG; PAM sequence: AGG
tgtattttataaatgctccc

SEQ ID NO: 16302 - DNA, 20 bp, Artificial Sequence
  Description of Artificial Sequence: Synthetic oligonucleotide
  Target: SCN10A; (-) strand; PAM type: NRG; PAM sequence: CAG
ctgtattttataaatgctcc

SEQ ID NO: 16303 - DNA, 20 bp, Artificial Sequence
  Description of Artificial Sequence: Synthetic oligonucleotide
  Target: SCN10A; (-) strand; PAM type: NRG; PAM sequence: AGG
attggtcttgggtggtgccc

SEQ ID NO: 16304 - DNA, 20 bp, Artificial Sequence
  Description of Artificial Sequence: Synthetic oligonucleotide
  Target: SCN10A; (-) strand; PAM type: NRG; PAM sequence: CAG
tattggtcttgggtggtgcc

SEQ ID NO: 16305 - DNA, 20 bp, Artificial Sequence
  Description of Artificial Sequence: Synthetic oligonucleotide
  Target: SCN10A; (-) strand; PAM type: NRG; PAM sequence: TGG
ctgatcttattggtcttggg

SEQ ID NO: 16306 - DNA, 20 bp, Artificial Sequence
  Description of Artificial Sequence: Synthetic oligonucleotide
  Target: SCN10A; (-) strand; PAM type: NRG; PAM sequence: GGG
attctgatcttattggtctt

SEQ ID NO: 16307 - DNA, 20 bp, Artificial Sequence
  Description of Artificial Sequence: Synthetic oligonucleotide
  Target: SCN10A; (-) strand; PAM type: NRG; PAM sequence: TGG
gattctgatcttattggtct

SEQ ID NO: 16308 - DNA, 20 bp, Artificial Sequence
  Description of Artificial Sequence: Synthetic oligonucleotide
  Target: SCN10A; (-) strand; PAM type: NRG; PAM sequence: TGG
cccagagattctgatcttat

SEQ ID NO: 16309 - DNA, 20 bp, Artificial Sequence
  Description of Artificial Sequence: Synthetic oligonucleotide
  Target: SCN10A; (-) strand; PAM type: NRG; PAM sequence: GAG
gaccgaccaccactacccca

SEQ ID NO: 16310 - DNA, 20 bp, Artificial Sequence
  Description of Artificial Sequence: Synthetic oligonucleotide
  Target: SCN10A; (-) strand; PAM type: NRG; PAM sequence: CAG
gtgaccgaccaccactaccc

SEQ ID NO: 16311 - DNA, 20 bp, Artificial Sequence
  Description of Artificial Sequence: Synthetic oligonucleotide
  Target: SCN10A; (-) strand; PAM type: NRG; PAM sequence: CAG
ctggggagctatgaaatatg

SEQ ID NO: 16312 - DNA, 20 bp, Artificial Sequence
  Description of Artificial Sequence: Synthetic oligonucleotide
  Target: SCN10A; (-) strand; PAM type: NRG; PAM sequence: GAG
gcacttgagaatcacctggg

SEQ ID NO: 16313 - DNA, 20 bp, Artificial Sequence
  Description of Artificial Sequence: Synthetic oligonucleotide
  Target: SCN10A; (-) strand; PAM type: NRG; PAM sequence: GGG
ctgcacttgagaatcacctg

SEQ ID NO: 16314 - DNA, 20 bp, Artificial Sequence
  Description of Artificial Sequence: Synthetic oligonucleotide
  Target: SCN10A; (-) strand; PAM type: NRG; PAM sequence: GGG
gctgcacttgagaatcacct

SEQ ID NO: 16315 - DNA, 20 bp, Artificial Sequence
  Description of Artificial Sequence: Synthetic oligonucleotide
  Target: SCN10A; (-) strand; PAM type: NRG; PAM sequence: TGG
ggctgcacttgagaatcacc

SEQ ID NO: 16316 - DNA, 20 bp, Artificial Sequence
  Description of Artificial Sequence: Synthetic oligonucleotide
  Target: SCN10A; (-) strand; PAM type: NRG; PAM sequence: GAG
cctcacacctggctgcactt

SEQ ID NO: 16317 - DNA, 20 bp, Artificial Sequence
  Description of Artificial Sequence: Synthetic oligonucleotide
  Target: SCN10A; (-) strand; PAM type: NRG; PAM sequence: TGG
ggttctgtggtcctcacacc

SEQ ID NO: 16318 - DNA, 20 bp, Artificial Sequence
  Description of Artificial Sequence: Synthetic oligonucleotide
  Target: SCN10A; (-) strand; PAM type: NRG; PAM sequence: TGG
tcttcccacctgcggttctg

SEQ ID NO: 16319 - DNA, 20 bp, Artificial Sequence
  Description of Artificial Sequence: Synthetic oligonucleotide
  Target: SCN10A; (-) strand; PAM type: NRG; PAM sequence: CGG
acagagaatcttcccacctg

SEQ ID NO: 16320 - DNA, 20 bp, Artificial Sequence
  Description of Artificial Sequence: Synthetic oligonucleotide
  Target: SCN10A; (-) strand; PAM type: NRG; PAM sequence: GAG
agccatgaactgtgagcaca

SEQ ID NO: 16321 - DNA, 20 bp, Artificial Sequence
  Description of Artificial Sequence: Synthetic oligonucleotide
  Target: SCN10A; (-) strand; PAM type: NRG; PAM sequence: CAG
ggagccatgaactgtgagca

SEQ ID NO: 16322 - DNA, 20 bp, Artificial Sequence
  Description of Artificial Sequence: Synthetic oligonucleotide
  Target: SCN10A; (-) strand; PAM type: NRG; PAM sequence: GAG
cttggggagccatgaactgt

SEQ ID NO: 16323 - DNA, 20 bp, Artificial Sequence
  Description of Artificial Sequence: Synthetic oligonucleotide
  Target: SCN10A; (-) strand; PAM type: NRG; PAM sequence: GAG
tgggtcttctggaccttggg

SEQ ID NO: 16324 - DNA, 20 bp, Artificial Sequence
  Description of Artificial Sequence: Synthetic oligonucleotide
  Target: SCN10A; (-) strand; PAM type: NRG; PAM sequence: GGG
gatgggtcttctggaccttg

SEQ ID NO: 16325 - DNA, 20 bp, Artificial Sequence
  Description of Artificial Sequence: Synthetic oligonucleotide
  Target: SCN10A; (-) strand; PAM type: NRG; PAM sequence: GGG
agatgggtcttctggacctt

SEQ ID NO: 16326 - DNA, 20 bp, Artificial Sequence
  Description of Artificial Sequence: Synthetic oligonucleotide
  Target: SCN10A; (-) strand; PAM type: NRG; PAM sequence: TGG
tagatgggtcttctggacct

SEQ ID NO: 16327 - DNA, 20 bp, Artificial Sequence
  Description of Artificial Sequence: Synthetic oligonucleotide
  Target: SCN10A; (-) strand; PAM type: NRG; PAM sequence: TGG
gcatccatagatgggtcttc

SEQ ID NO: 16328 - DNA, 20 bp, Artificial Sequence
  Description of Artificial Sequence: Synthetic oligonucleotide
  Target: SCN10A; (-) strand; PAM type: NRG; PAM sequence: GGG
atggccctgcatccatagat

SEQ ID NO: 16329 - DNA, 20 bp, Artificial Sequence
  Description of Artificial Sequence: Synthetic oligonucleotide
  Target: SCN10A; (-) strand; PAM type: NRG; PAM sequence: TGG
tatggccctgcatccataga

SEQ ID NO: 16330 - DNA, 20 bp, Artificial Sequence
  Description of Artificial Sequence: Synthetic oligonucleotide
  Target: SCN10A; (-) strand; PAM type: NRG; PAM sequence: TAG
gtcttatggccctgcatcca

SEQ ID NO: 16331 - DNA, 20 bp, Artificial Sequence
  Description of Artificial Sequence: Synthetic oligonucleotide
  Target: SCN10A; (-) strand; PAM type: NRG; PAM sequence: TGG
tgcagctctcagaggtctta

SEQ ID NO: 16332 - DNA, 20 bp, Artificial Sequence
  Description of Artificial Sequence: Synthetic oligonucleotide
  Target: SCN10A; (-) strand; PAM type: NRG; PAM sequence: AGG
atgacacatgcagctctcag

SEQ ID NO: 16333 - DNA, 20 bp, Artificial Sequence
  Description of Artificial Sequence: Synthetic oligonucleotide
  Target: SCN10A; (-) strand; PAM type: NRG; PAM sequence: GAG
gatgacacatgcagctctca

SEQ ID NO: 16334 - DNA, 20 bp, Artificial Sequence
  Description of Artificial Sequence: Synthetic oligonucleotide
  Target: SCN10A; (-) strand; PAM type: NRG; PAM sequence: CAG
gagatgacacatgcagctct

SEQ ID NO: 16335 - DNA, 20 bp, Artificial Sequence
  Description of Artificial Sequence: Synthetic oligonucleotide
  Target: SCN10A; (-) strand; PAM type: NRG; PAM sequence: CAG
ccaaagtgagatgacacatg

SEQ ID NO: 16336 - DNA, 20 bp, Artificial Sequence
  Description of Artificial Sequence: Synthetic oligonucleotide
  Target: SCN10A; (-) strand; PAM type: NRG; PAM sequence: GAG
tgcatttttacatccaaagt

SEQ ID NO: 16337 - DNA, 20 bp, Artificial Sequence
  Description of Artificial Sequence: Synthetic oligonucleotide
  Target: SCN10A; (-) strand; PAM type: NRG; PAM sequence: AAG
cctctgcatttttacatcca

SEQ ID NO: 16338 - DNA, 20 bp, Artificial Sequence
  Description of Artificial Sequence: Synthetic oligonucleotide
  Target: SCN10A; (-) strand; PAM type: NRG; PAM sequence: AAG
ttattaggtctccattcaga

SEQ ID NO: 16339 - DNA, 20 bp, Artificial Sequence
  Description of Artificial Sequence: Synthetic oligonucleotide
  Target: SCN10A; (-) strand; PAM type: NRG; PAM sequence: CAG
tgagttattaggtctccatt

SEQ ID NO: 16340 - DNA, 20 bp, Artificial Sequence
  Description of Artificial Sequence: Synthetic oligonucleotide
  Target: SCN10A; (-) strand; PAM type: NRG; PAM sequence: AGG
tgactgttaggtgagttatt

SEQ ID NO: 16341 - DNA, 20 bp, Artificial Sequence
  Description of Artificial Sequence: Synthetic oligonucleotide
  Target: SCN10A; (-) strand; PAM type: NRG; PAM sequence: TAG
gtgactgttaggtgagttat

SEQ ID NO: 16342 - DNA, 20 bp, Artificial Sequence
  Description of Artificial Sequence: Synthetic oligonucleotide
  Target: SCN10A; (-) strand; PAM type: NRG; PAM sequence: GAG
cacaatagtgactgttaggt

SEQ ID NO: 16343 - DNA, 20 bp, Artificial Sequence
  Description of Artificial Sequence: Synthetic oligonucleotide
  Target: SCN10A; (-) strand; PAM type: NRG; PAM sequence: AGG
gtgacacaatagtgactgtt

SEQ ID NO: 16344 - DNA, 20 bp, Artificial Sequence
  Description of Artificial Sequence: Synthetic oligonucleotide
  Target: SCN10A; (-) strand; PAM type: NRG; PAM sequence: TAG
tgtgacacaatagtgactgt

SEQ ID NO: 16345 - DNA, 20 bp, Artificial Sequence
  Description of Artificial Sequence: Synthetic oligonucleotide
  Target: SCN10A; (-) strand; PAM type: NRG; PAM sequence: TAG
agtatgtgactgtgacacaa

SEQ ID NO: 16346 - DNA, 20 bp, Artificial Sequence
  Description of Artificial Sequence: Synthetic oligonucleotide
  Target: SCN10A; (-) strand; PAM type: NRG; PAM sequence: CAG
catgagtggtaaagtccagg

SEQ ID NO: 16347 - DNA, 20 bp, Artificial Sequence
  Description of Artificial Sequence: Synthetic oligonucleotide
  Target: SCN10A; (-) strand; PAM type: NRG; PAM sequence: AGG
acccatgagtggtaaagtcc

SEQ ID NO: 16348 - DNA, 20 bp, Artificial Sequence
  Description of Artificial Sequence: Synthetic oligonucleotide
  Target: SCN10A; (-) strand; PAM type: NRG; PAM sequence: CAG
cacccatgagtggtaaagtc

SEQ ID NO: 16349 - DNA, 20 bp, Artificial Sequence
  Description of Artificial Sequence: Synthetic oligonucleotide
  Target: SCN10A; (-) strand; PAM type: NRG; PAM sequence: AAG
cctgacacccatgagtggta

SEQ ID NO: 16350 - DNA, 20 bp, Artificial Sequence
  Description of Artificial Sequence: Synthetic oligonucleotide
  Target: SCN10A; (-) strand; PAM type: NRG; PAM sequence: TGG
atagccctgacacccatgag

SEQ ID NO: 16351 - DNA, 20 bp, Artificial Sequence
  Description of Artificial Sequence: Synthetic oligonucleotide
  Target: SCN10A; (-) strand; PAM type: NRG; PAM sequence: GAG
agaatagccctgacacccat

SEQ ID NO: 16352 - DNA, 20 bp, Artificial Sequence
  Description of Artificial Sequence: Synthetic oligonucleotide
  Target: SCN10A; (-) strand; PAM type: NRG; PAM sequence: TAG
tttagtgaggagtctgagaa

SEQ ID NO: 16353 - DNA, 20 bp, Artificial Sequence
  Description of Artificial Sequence: Synthetic oligonucleotide
  Target: SCN10A; (-) strand; PAM type: NRG; PAM sequence: GAG
gagcatttagtgaggagtct

SEQ ID NO: 16354 - DNA, 20 bp, Artificial Sequence
  Description of Artificial Sequence: Synthetic oligonucleotide
  Target: SCN10A; (-) strand; PAM type: NRG; PAM sequence: GAG
agttttgagcatttagtgag

SEQ ID NO: 16355 - DNA, 20 bp, Artificial Sequence
  Description of Artificial Sequence: Synthetic oligonucleotide
  Target: SCN10A; (-) strand; PAM type: NRG; PAM sequence: AGG
aaagttttgagcatttagtg

SEQ ID NO: 16356 - DNA, 20 bp, Artificial Sequence
  Description of Artificial Sequence: Synthetic oligonucleotide
  Target: SCN10A; (-) strand; PAM type: NRG; PAM sequence: GAG
aaaagttttgagcatttagt

SEQ ID NO: 16357 - DNA, 20 bp, Artificial Sequence
  Description of Artificial Sequence: Synthetic oligonucleotide
  Target: SCN10A; (-) strand; PAM type: NRG; PAM sequence: TAG
aaagaaaagttttgagcatt

SEQ ID NO: 16358 - DNA, 20 bp, Artificial Sequence
  Description of Artificial Sequence: Synthetic oligonucleotide
  Target: SCN10A; (-) strand; PAM type: NRG; PAM sequence: GAG
ctactccaaagaaaagtttt

SEQ ID NO: 16359 - DNA, 20 bp, Artificial Sequence
  Description of Artificial Sequence: Synthetic oligonucleotide
  Target: SCN10A; (-) strand; PAM type: NRG; PAM sequence: AAG
tcaagggctactccaaagaa

SEQ ID NO: 16360 - DNA, 20 bp, Artificial Sequence
  Description of Artificial Sequence: Synthetic oligonucleotide
  Target: SCN10A; (-) strand; PAM type: NRG; PAM sequence: AAG
ggccctcaagggctactcca

SEQ ID NO: 16361 - DNA, 20 bp, Artificial Sequence
  Description of Artificial Sequence: Synthetic oligonucleotide
  Target: SCN10A; (-) strand; PAM type: NRG; PAM sequence: GGG
ctcagagacctggccctcaa

SEQ ID NO: 16362 - DNA, 20 bp, Artificial Sequence
  Description of Artificial Sequence: Synthetic oligonucleotide
  Target: SCN10A; (-) strand; PAM type: NRG; PAM sequence: AGG
gctcagagacctggccctca

SEQ ID NO: 16363 - DNA, 20 bp, Artificial Sequence
  Description of Artificial Sequence: Synthetic oligonucleotide
  Target: SCN10A; (-) strand; PAM type: NRG; PAM sequence: AAG
agctcagagacctggccctc

SEQ ID NO: 16364 - DNA, 20 bp, Artificial Sequence
  Description of Artificial Sequence: Synthetic oligonucleotide
  Target: SCN10A; (-) strand; PAM type: NRG; PAM sequence: TGG
gcaaaggaagctcagagacc

SEQ ID NO: 16365 - DNA, 20 bp, Artificial Sequence
  Description of Artificial Sequence: Synthetic oligonucleotide
  Target: SCN10A; (-) strand; PAM type: NRG; PAM sequence: GAG
gctagggcaaaggaagctca

SEQ ID NO: 16366 - DNA, 20 bp, Artificial Sequence
  Description of Artificial Sequence: Synthetic oligonucleotide
  Target: SCN10A; (-) strand; PAM type: NRG; PAM sequence: CAG
cagctagggcaaaggaagct

SEQ ID NO: 16367 - DNA, 20 bp, Artificial Sequence
  Description of Artificial Sequence: Synthetic oligonucleotide
  Target: SCN10A; (-) strand; PAM type: NRG; PAM sequence: AAG
ggctacagctagggcaaagg

SEQ ID NO: 16368 - DNA, 20 bp, Artificial Sequence
  Description of Artificial Sequence: Synthetic oligonucleotide
  Target: SCN10A; (-) strand; PAM type: NRG; PAM sequence: AGG
cctggctacagctagggcaa

SEQ ID NO: 16369 - DNA, 20 bp, Artificial Sequence
  Description of Artificial Sequence: Synthetic oligonucleotide
  Target: SCN10A; (-) strand; PAM type: NRG; PAM sequence: AAG
tcctggctacagctagggca

SEQ ID NO: 16370 - DNA, 20 bp, Artificial Sequence
  Description of Artificial Sequence: Synthetic oligonucleotide
  Target: SCN10A; (-) strand; PAM type: NRG; PAM sequence: GGG
ctgactcctggctacagcta

SEQ ID NO: 16371 - DNA, 20 bp, Artificial Sequence
  Description of Artificial Sequence: Synthetic oligonucleotide
  Target: SCN10A; (-) strand; PAM type: NRG; PAM sequence: AGG
tctgactcctggctacagct

SEQ ID NO: 16372 - DNA, 20 bp, Artificial Sequence
  Description of Artificial Sequence: Synthetic oligonucleotide
  Target: SCN10A; (-) strand; PAM type: NRG; PAM sequence: TAG
ctctgactcctggctacagc

SEQ ID NO: 16373 - DNA, 20 bp, Artificial Sequence
  Description of Artificial Sequence: Synthetic oligonucleotide
  Target: SCN10A; (-) strand; PAM type: NRG; PAM sequence: CAG
tcccctctgactcctggcta

SEQ ID NO: 16374 - DNA, 20 bp, Artificial Sequence
  Description of Artificial Sequence: Synthetic oligonucleotide
  Target: SCN10A; (-) strand; PAM type: NRG; PAM sequence: TGG
gggtcctcccctctgactcc

SEQ ID NO: 16375 - DNA, 20 bp, Artificial Sequence
  Description of Artificial Sequence: Synthetic oligonucleotide
  Target: SCN10A; (-) strand; PAM type: NRG; PAM sequence: GGG
gtgggaacacgtggggtttg

SEQ ID NO: 16376 - DNA, 20 bp, Artificial Sequence
  Description of Artificial Sequence: Synthetic oligonucleotide
  Target: SCN10A; (-) strand; PAM type: NRG; PAM sequence: GGG
agtgggaacacgtggggttt

SEQ ID NO: 16377 - DNA, 20 bp, Artificial Sequence
  Description of Artificial Sequence: Synthetic oligonucleotide
  Target: SCN10A; (-) strand; PAM type: NRG; PAM sequence: TGG
cagtgggaacacgtggggtt

SEQ ID NO: 16378 - DNA, 20 bp, Artificial Sequence
  Description of Artificial Sequence: Synthetic oligonucleotide
  Target: SCN10A; (-) strand; PAM type: NRG; PAM sequence: GGG
tggctcagtgggaacacgtg

SEQ ID NO: 16379 - DNA, 20 bp, Artificial Sequence
  Description of Artificial Sequence: Synthetic oligonucleotide
  Target: SCN10A; (-) strand; PAM type: NRG; PAM sequence: GGG
gtggctcagtgggaacacgt

SEQ ID NO: 16380 - DNA, 20 bp, Artificial Sequence
  Description of Artificial Sequence: Synthetic oligonucleotide
  Target: SCN10A; (-) strand; PAM type: NRG; PAM sequence: TGG
agtggctcagtgggaacacg

SEQ ID NO: 16381 - DNA, 20 bp, Artificial Sequence
  Description of Artificial Sequence: Synthetic oligonucleotide
  Target: SCN10A; (-) strand; PAM type: NRG; PAM sequence: GGG
gtgaatgtgagtggctcagt

SEQ ID NO: 16382 - DNA, 20 bp, Artificial Sequence
  Description of Artificial Sequence: Synthetic oligonucleotide
  Target: SCN10A; (-) strand; PAM type: NRG; PAM sequence: TGG
tgtgaatgtgagtggctcag

SEQ ID NO: 16383 - DNA, 20 bp, Artificial Sequence
  Description of Artificial Sequence: Synthetic oligonucleotide
  Target: SCN10A; (-) strand; PAM type: NRG; PAM sequence: CAG
cattgtgaatgtgagtggct

SEQ ID NO: 16384 - DNA, 20 bp, Artificial Sequence
  Description of Artificial Sequence: Synthetic oligonucleotide
  Target: SCN10A; (-) strand; PAM type: NRG; PAM sequence: TGG
ttcctcattgtgaatgtgag

SEQ ID NO: 16385 - DNA, 20 bp, Artificial Sequence
  Description of Artificial Sequence: Synthetic oligonucleotide
  Target: SCN10A; (-) strand; PAM type: NRG; PAM sequence: GAG
gacttcctcattgtgaatgt

SEQ ID NO: 16386 - DNA, 20 bp, Artificial Sequence
  Description of Artificial Sequence: Synthetic oligonucleotide
  Target: SCN10A; (-) strand; PAM type: NRG; PAM sequence: TGG
caccaatgcctggtgctggc

SEQ ID NO: 16387 - DNA, 20 bp, Artificial Sequence
  Description of Artificial Sequence: Synthetic oligonucleotide
  Target: SCN10A; (-) strand; PAM type: NRG; PAM sequence: TGG
acttcaccaatgcctggtgc

SEQ ID NO: 16388 - DNA, 20 bp, Artificial Sequence
  Description of Artificial Sequence: Synthetic oligonucleotide
  Target: SCN10A; (-) strand; PAM type: NRG; PAM sequence: TGG
aaaagtacttcaccaatgcc

SEQ ID NO: 16389 - DNA, 20 bp, Artificial Sequence
  Description of Artificial Sequence: Synthetic oligonucleotide
  Target: SCN10A; (-) strand; PAM type: NRG; PAM sequence: AAG
gggtggcctatggcttcaaa

SEQ ID NO: 16390 - DNA, 20 bp, Artificial Sequence
  Description of Artificial Sequence: Synthetic oligonucleotide
  Target: SCN10A; (-) strand; PAM type: NRG; PAM sequence: TGG
ctgcttaagtgggtggccta

SEQ ID NO: 16391 - DNA, 20 bp, Artificial Sequence
  Description of Artificial Sequence: Synthetic oligonucleotide
  Target: SCN10A; (-) strand; PAM type: NRG; PAM sequence: TGG
cgagatgctgcttaagtggg

SEQ ID NO: 16392 - DNA, 20 bp, Artificial Sequence
  Description of Artificial Sequence: Synthetic oligonucleotide
  Target: SCN10A; (-) strand; PAM type: NRG; PAM sequence: GGG
gttcgagatgctgcttaagt

SEQ ID NO: 16393 - DNA, 20 bp, Artificial Sequence
  Description of Artificial Sequence: Synthetic oligonucleotide
  Target: SCN10A; (-) strand; PAM type: NRG; PAM sequence: TGG
tgttcgagatgctgcttaag

SEQ ID NO: 16394 - DNA, 20 bp, Artificial Sequence
  Description of Artificial Sequence: Synthetic oligonucleotide
  Target: SCN10A; (-) strand; PAM type: NRG; PAM sequence: AAG
ttgtgttcgagatgctgctt

SEQ ID NO: 16395 - DNA, 20 bp, Artificial Sequence
  Description of Artificial Sequence: Synthetic oligonucleotide
  Target: SCN10A; (-) strand; PAM type: NRG; PAM sequence: GAG
tcacctttatctttgtgttc

SEQ ID NO: 16396 - DNA, 20 bp, Artificial Sequence
  Description of Artificial Sequence: Synthetic oligonucleotide
  Target: SCN10A; (-) strand; PAM type: NRG; PAM sequence: GGG
tttgctggagtacactgaca

SEQ ID NO: 16397 - DNA, 20 bp, Artificial Sequence
  Description of Artificial Sequence: Synthetic oligonucleotide
  Target: SCN10A; (-) strand; PAM type: NRG; PAM sequence: AGG
ctttgctggagtacactgac

SEQ ID NO: 16398 - DNA, 20 bp, Artificial Sequence
  Description of Artificial Sequence: Synthetic oligonucleotide
  Target: SCN10A; (-) strand; PAM type: NRG; PAM sequence: CAG
gctttgctggagtacactga

SEQ ID NO: 16399 - DNA, 20 bp, Artificial Sequence
  Description of Artificial Sequence: Synthetic oligonucleotide
  Target: SCN10A; (-) strand; PAM type: NRG; PAM sequence: GAG
ccacggtgaaagctttgctg

SEQ ID NO: 16400 - DNA, 20 bp, Artificial Sequence
  Description of Artificial Sequence: Synthetic oligonucleotide
  Target: SCN10A; (-) strand; PAM type: NRG; PAM sequence: TGG
gcccacggtgaaagctttgc

SEQ ID NO: 16401 - DNA, 20 bp, Artificial Sequence
  Description of Artificial Sequence: Synthetic oligonucleotide
  Target: SCN10A; (-) strand; PAM type: NRG; PAM sequence: AAG
ggaccagaagcccacggtga

SEQ ID NO: 16402 - DNA, 20 bp, Artificial Sequence
  Description of Artificial Sequence: Synthetic oligonucleotide
  Target: SCN10A; (-) strand; PAM type: NRG; PAM sequence: CGG
ttacctggaccagaagccca

SEQ ID NO: 16403 - DNA, 20 bp, Artificial Sequence
  Description of Artificial Sequence: Synthetic oligonucleotide
  Target: SCN10A; (-) strand; PAM type: NRG; PAM sequence: AAG
aagactattacctggaccag

SEQ ID NO: 16404 - DNA, 20 bp, Artificial Sequence
  Description of Artificial Sequence: Synthetic oligonucleotide
  Target: SCN10A; (-) strand; PAM type: NRG; PAM sequence: CAG
ttgaagactattacctggac

SEQ ID NO: 16405 - DNA, 20 bp, Artificial Sequence
  Description of Artificial Sequence: Synthetic oligonucleotide
  Target: SCN10A; (-) strand; PAM type: NRG; PAM sequence: TGG
ggcctttgaagactattacc

SEQ ID NO: 16406 - DNA, 20 bp, Artificial Sequence
  Description of Artificial Sequence: Synthetic oligonucleotide
  Target: SCN10A; (-) strand; PAM type: NRG; PAM sequence: AAG
ttcttccttccaggcctttg

SEQ ID NO: 16407 - DNA, 20 bp, Artificial Sequence
  Description of Artificial Sequence: Synthetic oligonucleotide
  Target: SCN10A; (-) strand; PAM type: NRG; PAM sequence: AGG
ctgcatcctttcttccttcc

SEQ ID NO: 16408 - DNA, 20 bp, Artificial Sequence
  Description of Artificial Sequence: Synthetic oligonucleotide
  Target: SCN10A; (-) strand; PAM type: NRG; PAM sequence: CAG
tctgcatcctttcttccttc

SEQ ID NO: 16409 - DNA, 20 bp, Artificial Sequence
  Description of Artificial Sequence: Synthetic oligonucleotide
  Target: SCN10A; (-) strand; PAM type: NRG; PAM sequence: CAG
cccagtgctgtgggtccagg

SEQ ID NO: 16410 - DNA, 20 bp, Artificial Sequence
  Description of Artificial Sequence: Synthetic oligonucleotide
  Target: SCN10A; (-) strand; PAM type: NRG; PAM sequence: AGG
ggccccagtgctgtgggtcc

SEQ ID NO: 16411 - DNA, 20 bp, Artificial Sequence
  Description of Artificial Sequence: Synthetic oligonucleotide
  Target: SCN10A; (-) strand; PAM type: NRG; PAM sequence: CAG
gggccccagtgctgtgggtc

SEQ ID NO: 16412 - DNA, 20 bp, Artificial Sequence
  Description of Artificial Sequence: Synthetic oligonucleotide
  Target: SCN10A; (-) strand; PAM type: NRG; PAM sequence: GGG
agtctgggccccagtgctgt

SEQ ID NO: 16413 - DNA, 20 bp, Artificial Sequence
  Description of Artificial Sequence: Synthetic oligonucleotide
  Target: SCN10A; (-) strand; PAM type: NRG; PAM sequence: TGG
cagtctgggccccagtgctg

SEQ ID NO: 16414 - DNA, 20 bp, Artificial Sequence
  Description of Artificial Sequence: Synthetic oligonucleotide
  Target: SCN10A; (-) strand; PAM type: NRG; PAM sequence: CAG
ttccctatcagtctgggccc

SEQ ID NO: 16415 - DNA, 20 bp, Artificial Sequence
  Description of Artificial Sequence: Synthetic oligonucleotide
  Target: SCN10A; (-) strand; PAM type: NRG; PAM sequence: GGG
gggtccttccctatcagtct

SEQ ID NO: 16416 - DNA, 20 bp, Artificial Sequence
  Description of Artificial Sequence: Synthetic oligonucleotide
  Target: SCN10A; (-) strand; PAM type: NRG; PAM sequence: TGG
tgggtccttccctatcagtc

SEQ ID NO: 16417 - DNA, 20 bp, Artificial Sequence
  Description of Artificial Sequence: Synthetic oligonucleotide
  Target: SCN10A; (-) strand; PAM type: NRG; PAM sequence: CAG
ctggctgggtccttccctat

SEQ ID NO: 16418 - DNA, 20 bp, Artificial Sequence
  Description of Artificial Sequence: Synthetic oligonucleotide
  Target: SCN10A; (-) strand; PAM type: NRG; PAM sequence: GGG
gactgtggtcagggctggct

SEQ ID NO: 16419 - DNA, 20 bp, Artificial Sequence
  Description of Artificial Sequence: Synthetic oligonucleotide
  Target: SCN10A; (-) strand; PAM type: NRG; PAM sequence: TGG
ggactgtggtcagggctggc

SEQ ID NO: 16420 - DNA, 20 bp, Artificial Sequence
  Description of Artificial Sequence: Synthetic oligonucleotide
  Target: SCN10A; (-) strand; PAM type: NRG; PAM sequence: TGG
ccagggactgtggtcagggc

SEQ ID NO: 16421 - DNA, 20 bp, Artificial Sequence
  Description of Artificial Sequence: Synthetic oligonucleotide
  Target: SCN10A; (-) strand; PAM type: NRG; PAM sequence: GGG
ccttccagggactgtggtca

SEQ ID NO: 16422 - DNA, 20 bp, Artificial Sequence
  Description of Artificial Sequence: Synthetic oligonucleotide
  Target: SCN10A; (-) strand; PAM type: NRG; PAM sequence: AGG
cccttccagggactgtggtc

SEQ ID NO: 16423 - DNA, 20 bp, Artificial Sequence
  Description of Artificial Sequence: Synthetic oligonucleotide
  Target: SCN10A; (-) strand; PAM type: NRG; PAM sequence: CAG
ccccttccagggactgtggt

SEQ ID NO: 16424 - DNA, 20 bp, Artificial Sequence
  Description of Artificial Sequence: Synthetic oligonucleotide
  Target: SCN10A; (-) strand; PAM type: NRG; PAM sequence: TGG
aaatccccttccagggactg

SEQ ID NO: 16425 - DNA, 20 bp, Artificial Sequence
  Description of Artificial Sequence: Synthetic oligonucleotide
  Target: SCN10A; (-) strand; PAM type: NRG; PAM sequence: GGG
gactaccaaatccccttcca

SEQ ID NO: 16426 - DNA, 20 bp, Artificial Sequence
  Description of Artificial Sequence: Synthetic oligonucleotide
  Target: SCN10A; (-) strand; PAM type: NRG; PAM sequence: AGG
tgactaccaaatccccttcc

SEQ ID NO: 16427 - DNA, 20 bp, Artificial Sequence
  Description of Artificial Sequence: Synthetic oligonucleotide
  Target: SCN10A; (-) strand; PAM type: NRG; PAM sequence: CAG
ctgactaccaaatccccttc

SEQ ID NO: 16428 - DNA, 20 bp, Artificial Sequence
  Description of Artificial Sequence: Synthetic oligonucleotide
  Target: SCN10A; (-) strand; PAM type: NRG; PAM sequence: AAG
gcaaacaaaatgctactggc

SEQ ID NO: 16429 - DNA, 20 bp, Artificial Sequence
  Description of Artificial Sequence: Synthetic oligonucleotide
  Target: SCN10A; (-) strand; PAM type: NRG; PAM sequence: TGG
cacagcaaacaaaatgctac

SEQ ID NO: 16430 - DNA, 20 bp, Artificial Sequence
  Description of Artificial Sequence: Synthetic oligonucleotide
  Target: SCN10A; (-) strand; PAM type: NRG; PAM sequence: CAG
tatcccactttacctcccca

SEQ ID NO: 16431 - DNA, 20 bp, Artificial Sequence
  Description of Artificial Sequence: Synthetic oligonucleotide
  Target: SCN10A; (-) strand; PAM type: NRG; PAM sequence: CAG
aagtcatgctttggatctca

SEQ ID NO: 16432 - DNA, 20 bp, Artificial Sequence
  Description of Artificial Sequence: Synthetic oligonucleotide
  Target: SCN10A; (-) strand; PAM type: NRG; PAM sequence: TGG
gccctgaagaagtcatgctt

SEQ ID NO: 16433 - DNA, 20 bp, Artificial Sequence
  Description of Artificial Sequence: Synthetic oligonucleotide
  Target: SCN10A; (-) strand; PAM type: NRG; PAM sequence: AAG
tgtccccattggccctgaag

SEQ ID NO: 16434 - DNA, 20 bp, Artificial Sequence
  Description of Artificial Sequence: Synthetic oligonucleotide
  Target: SCN10A; (-) strand; PAM type: NRG; PAM sequence: AAG
gtttgtccccattggccctg

SEQ ID NO: 16435 - DNA, 20 bp, Artificial Sequence
  Description of Artificial Sequence: Synthetic oligonucleotide
  Target: SCN10A; (-) strand; PAM type: NRG; PAM sequence: TGG
gcagggctgtttgtccccat

SEQ ID NO: 16436 - DNA, 20 bp, Artificial Sequence
  Description of Artificial Sequence: Synthetic oligonucleotide
  Target: SCN10A; (-) strand; PAM type: NRG; PAM sequence: GGG
catccctgcaagtatcagca

SEQ ID NO: 16437 - DNA, 20 bp, Artificial Sequence
  Description of Artificial Sequence: Synthetic oligonucleotide
  Target: SCN10A; (-) strand; PAM type: NRG; PAM sequence: AGG
gcatccctgcaagtatcagc

SEQ ID NO: 16438 - DNA, 20 bp, Artificial Sequence
  Description of Artificial Sequence: Synthetic oligonucleotide
  Target: SCN10A; (-) strand; PAM type: NRG; PAM sequence: CAG
agcatccctgcaagtatcag

SEQ ID NO: 16439 - DNA, 20 bp, Artificial Sequence
  Description of Artificial Sequence: Synthetic oligonucleotide
  Target: SCN10A; (-) strand; PAM type: NRG; PAM sequence: CAG
ttcagcatccctgcaagtat

SEQ ID NO: 16440 - DNA, 20 bp, Artificial Sequence
  Description of Artificial Sequence: Synthetic oligonucleotide
  Target: SCN10A; (-) strand; PAM type: NRG; PAM sequence: AAG
cttgcattcagcatccctgc

SEQ ID NO: 16441 - DNA, 20 bp, Artificial Sequence
  Description of Artificial Sequence: Synthetic oligonucleotide
  Target: SCN10A; (-) strand; PAM type: NRG; PAM sequence: CAG
ttttctttctcccttgcatt

SEQ ID NO: 16442 - DNA, 20 bp, Artificial Sequence
  Description of Artificial Sequence: Synthetic oligonucleotide
  Target: SCN10A; (-) strand; PAM type: NRG; PAM sequence: AGG
ttccaaaatccaatttgaga

SEQ ID NO: 16443 - DNA, 20 bp, Artificial Sequence
  Description of Artificial Sequence: Synthetic oligonucleotide
  Target: SCN10A; (-) strand; PAM type: NRG; PAM sequence: AAG
cttccaaaatccaatttgag

SEQ ID NO: 16444 - DNA, 20 bp, Artificial Sequence
  Description of Artificial Sequence: Synthetic oligonucleotide
  Target: SCN10A; (-) strand; PAM type: NRG; PAM sequence: GAG
tcacttccaaaatccaattt

SEQ ID NO: 16445 - DNA, 20 bp, Artificial Sequence
  Description of Artificial Sequence: Synthetic oligonucleotide
  Target: SCN10A; (-) strand; PAM type: NRG; PAM sequence: TGG
agtcactgttagcatccctt

SEQ ID NO: 16446 - DNA, 20 bp, Artificial Sequence
  Description of Artificial Sequence: Synthetic oligonucleotide
  Target: SCN10A; (-) strand; PAM type: NRG; PAM sequence: TAG
tttttaaacaaagtcactgt

SEQ ID NO: 16447 - DNA, 20 bp, Artificial Sequence
  Description of Artificial Sequence: Synthetic oligonucleotide
  Target: SCN10A; (-) strand; PAM type: NRG; PAM sequence: AAG
gatgcttttatttttaaaca

SEQ ID NO: 16448 - DNA, 20 bp, Artificial Sequence
  Description of Artificial Sequence: Synthetic oligonucleotide
  Target: SCN10A; (-) strand; PAM type: NRG; PAM sequence: TGG
attctttttcagaggtgtgt

SEQ ID NO: 16449 - DNA, 20 bp, Artificial Sequence
  Description of Artificial Sequence: Synthetic oligonucleotide
  Target: SCN10A; (-) strand; PAM type: NRG; PAM sequence: AGG
gatagaacattctttttcag

SEQ ID NO: 16450 - DNA, 20 bp, Artificial Sequence
  Description of Artificial Sequence: Synthetic oligonucleotide
  Target: SCN10A; (-) strand; PAM type: NRG; PAM sequence: GAG
agatagaacattctttttca

SEQ ID NO: 16451 - DNA, 20 bp, Artificial Sequence
  Description of Artificial Sequence: Synthetic oligonucleotide
  Target: SCN10A; (-) strand; PAM type: NRG; PAM sequence: CAG
tgagatagaacattcttttt

SEQ ID NO: 16452 - DNA, 20 bp, Artificial Sequence
  Description of Artificial Sequence: Synthetic oligonucleotide
  Target: SCN10A; (-) strand; PAM type: NRG; PAM sequence: TAG
ttccttgattaccagtgaga

SEQ ID NO: 16453 - DNA, 20 bp, Artificial Sequence
  Description of Artificial Sequence: Synthetic oligonucleotide
  Target: SCN10A; (-) strand; PAM type: NRG; PAM sequence: GAG
gaatttccttgattaccagt

SEQ ID NO: 16454 - DNA, 20 bp, Artificial Sequence
  Description of Artificial Sequence: Synthetic oligonucleotide
  Target: SCN10A; (-) strand; PAM type: NRG; PAM sequence: CAG
atttgaatttccttgattac

SEQ ID NO: 16455 - DNA, 20 bp, Artificial Sequence
  Description of Artificial Sequence: Synthetic oligonucleotide
  Target: SCN10A; (-) strand; PAM type: NRG; PAM sequence: CAG
ccagtctgataaaagaaaaa

SEQ ID NO: 16456 - DNA, 20 bp, Artificial Sequence
  Description of Artificial Sequence: Synthetic oligonucleotide
  Target: SCN10A; (-) strand; PAM type: NRG; PAM sequence: AAG
catctccaccagtctgataa

SEQ ID NO: 16457 - DNA, 20 bp, Artificial Sequence
  Description of Artificial Sequence: Synthetic oligonucleotide
  Target: SCN10A; (-) strand; PAM type: NRG; PAM sequence: CAG
ctattcttttccatctccac

SEQ ID NO: 16458 - DNA, 20 bp, Artificial Sequence
  Description of Artificial Sequence: Synthetic oligonucleotide
  Target: SCN10A; (-) strand; PAM type: NRG; PAM sequence: GGG
cccacagccacagcatccta

SEQ ID NO: 16459 - DNA, 20 bp, Artificial Sequence
  Description of Artificial Sequence: Synthetic oligonucleotide
  Target: SCN10A; (-) strand; PAM type: NRG; PAM sequence: AGG
ccccacagccacagcatcct

SEQ ID NO: 16460 - DNA, 20 bp, Artificial Sequence
  Description of Artificial Sequence: Synthetic oligonucleotide
  Target: SCN10A; (-) strand; PAM type: NRG; PAM sequence: TAG
cccccacagccacagcatcc

SEQ ID NO: 16461 - DNA, 20 bp, Artificial Sequence
  Description of Artificial Sequence: Synthetic oligonucleotide
  Target: SCN10A; (-) strand; PAM type: NRG; PAM sequence: CAG
gtggcagccccccacagcca

SEQ ID NO: 16462 - DNA, 20 bp, Artificial Sequence
  Description of Artificial Sequence: Synthetic oligonucleotide
  Target: SCN10A; (-) strand; PAM type: NRG; PAM sequence: CAG
aaaagagtggcagcccccca

SEQ ID NO: 16463 - DNA, 20 bp, Artificial Sequence
  Description of Artificial Sequence: Synthetic oligonucleotide
  Target: SCN10A; (-) strand; PAM type: NRG; PAM sequence: CAG
aaaaaaaaaaaaaagagtgg

SEQ ID NO: 16464 - DNA, 20 bp, Artificial Sequence
  Description of Artificial Sequence: Synthetic oligonucleotide
  Target: SCN10A; (-) strand; PAM type: NRG; PAM sequence: TGG
aaaaaaaaaaaaaaaaagag

SEQ ID NO: 16465 - DNA, 20 bp, Artificial Sequence
  Description of Artificial Sequence: Synthetic oligonucleotide
  Target: SCN10A; (-) strand; PAM type: NRG; PAM sequence: GAG
aaaaaaaaaaaaaaaaaaaa

SEQ ID NO: 16466 - DNA, 20 bp, Artificial Sequence
  Description of Artificial Sequence: Synthetic oligonucleotide
  Target: SCN10A; (-) strand; PAM type: NRG; PAM sequence: AAG
aaaaaaaaaaaaaaaaaaaa

SEQ ID NO: 16467 - DNA, 20 bp, Artificial Sequence
  Description of Artificial Sequence: Synthetic oligonucleotide
  Target: SCN10A; (-) strand; PAM type: NRG; PAM sequence: GAG
tccagcctgggcgacagagc

SEQ ID NO: 16468 - DNA, 20 bp, Artificial Sequence
  Description of Artificial Sequence: Synthetic oligonucleotide
  Target: SCN10A; (-) strand; PAM type: NRG; PAM sequence: GAG
gcactccagcctgggcgaca

SEQ ID NO: 16469 - DNA, 20 bp, Artificial Sequence
  Description of Artificial Sequence: Synthetic oligonucleotide
  Target: SCN10A; (-) strand; PAM type: NRG; PAM sequence: CAG
ctgcactccagcctgggcga

SEQ ID NO: 16470 - DNA, 20 bp, Artificial Sequence
  Description of Artificial Sequence: Synthetic oligonucleotide
  Target: SCN10A; (-) strand; PAM type: NRG; PAM sequence: GGG
ccgctactgcactccagcct

SEQ ID NO: 16471 - DNA, 20 bp, Artificial Sequence
  Description of Artificial Sequence: Synthetic oligonucleotide
  Target: SCN10A; (-) strand; PAM type: NRG; PAM sequence: TGG
cccgctactgcactccagcc

SEQ ID NO: 16472 - DNA, 20 bp, Artificial Sequence
  Description of Artificial Sequence: Synthetic oligonucleotide
  Target: SCN10A; (-) strand; PAM type: NRG; PAM sequence: CAG
gagatcccgctactgcactc

SEQ ID NO: 16473 - DNA, 20 bp, Artificial Sequence
  Description of Artificial Sequence: Synthetic oligonucleotide
  Target: SCN10A; (-) strand; PAM type: NRG; PAM sequence: GAG
ggcagagcttgcagtgagcc

SEQ ID NO: 16474 - DNA, 20 bp, Artificial Sequence
  Description of Artificial Sequence: Synthetic oligonucleotide
  Target: SCN10A; (-) strand; PAM type: NRG; PAM sequence: GAG
tgggaggcagagcttgcagt

SEQ ID NO: 16475 - DNA, 20 bp, Artificial Sequence
  Description of Artificial Sequence: Synthetic oligonucleotide
  Target: SCN10A; (-) strand; PAM type: NRG; PAM sequence: CAG
aacctgggaggcagagcttg

SEQ ID NO: 16476 - DNA, 20 bp, Artificial Sequence
  Description of Artificial Sequence: Synthetic oligonucleotide
  Target: SCN10A; (-) strand; PAM type: NRG; PAM sequence: GAG
tggcgtgaacctgggaggca

SEQ ID NO: 16477 - DNA, 20 bp, Artificial Sequence
  Description of Artificial Sequence: Synthetic oligonucleotide
  Target: SCN10A; (-) strand; PAM type: NRG; PAM sequence: CAG
aatggcgtgaacctgggagg

SEQ ID NO: 16478 - DNA, 20 bp, Artificial Sequence
  Description of Artificial Sequence: Synthetic oligonucleotide
  Target: SCN10A; (-) strand; PAM type: NRG; PAM sequence: AGG
gagaatggcgtgaacctggg

SEQ ID NO: 16479 - DNA, 20 bp, Artificial Sequence
  Description of Artificial Sequence: Synthetic oligonucleotide
  Target: SCN10A; (-) strand; PAM type: NRG; PAM sequence: GAG
ggagaatggcgtgaacctgg

SEQ ID NO: 16480 - DNA, 20 bp, Artificial Sequence
  Description of Artificial Sequence: Synthetic oligonucleotide
  Target: SCN10A; (-) strand; PAM type: NRG; PAM sequence: GGG
caggagaatggcgtgaacct

SEQ ID NO: 16481 - DNA, 20 bp, Artificial Sequence
  Description of Artificial Sequence: Synthetic oligonucleotide
  Target: SCN10A; (-) strand; PAM type: NRG; PAM sequence: TGG
gcaggagaatggcgtgaacc

SEQ ID NO: 16482 - DNA, 20 bp, Artificial Sequence
  Description of Artificial Sequence: Synthetic oligonucleotide
  Target: SCN10A; (-) strand; PAM type: NRG; PAM sequence: TGG
gggaggctgaggcaggagaa

SEQ ID NO: 16483 - DNA, 20 bp, Artificial Sequence
  Description of Artificial Sequence: Synthetic oligonucleotide
  Target: SCN10A; (-) strand; PAM type: NRG; PAM sequence: GAG
tacttgggaggctgaggcag

SEQ ID NO: 16484 - DNA, 20 bp, Artificial Sequence
  Description of Artificial Sequence: Synthetic oligonucleotide
  Target: SCN10A; (-) strand; PAM type: NRG; PAM sequence: AGG
gctacttgggaggctgaggc

SEQ ID NO: 16485 - DNA, 20 bp, Artificial Sequence
  Description of Artificial Sequence: Synthetic oligonucleotide
  Target: SCN10A; (-) strand; PAM type: NRG; PAM sequence: CAG
agctacttgggaggctgagg

SEQ ID NO: 16486 - DNA, 20 bp, Artificial Sequence
  Description of Artificial Sequence: Synthetic oligonucleotide
  Target: SCN10A; (-) strand; PAM type: NRG; PAM sequence: AGG
cccagctacttgggaggctg

SEQ ID NO: 16487 - DNA, 20 bp, Artificial Sequence
  Description of Artificial Sequence: Synthetic oligonucleotide
  Target: SCN10A; (-) strand; PAM type: NRG; PAM sequence: GAG
tcccagctacttgggaggct

SEQ ID NO: 16488 - DNA, 20 bp, Artificial Sequence
  Description of Artificial Sequence: Synthetic oligonucleotide
  Target: SCN10A; (-) strand; PAM type: NRG; PAM sequence: AGG
tgtagtcccagctacttggg

SEQ ID NO: 16489 - DNA, 20 bp, Artificial Sequence
  Description of Artificial Sequence: Synthetic oligonucleotide
  Target: SCN10A; (-) strand; PAM type: NRG; PAM sequence: GAG
ctgtagtcccagctacttgg

SEQ ID NO: 16490 - DNA, 20 bp, Artificial Sequence
  Description of Artificial Sequence: Synthetic oligonucleotide
  Target: SCN10A; (-) strand; PAM type: NRG; PAM sequence: GGG
gcctgtagtcccagctactt

SEQ ID NO: 16491 - DNA, 20 bp, Artificial Sequence
  Description of Artificial Sequence: Synthetic oligonucleotide
  Target: SCN10A; (-) strand; PAM type: NRG; PAM sequence: TGG
cgcctgtagtcccagctact

SEQ ID NO: 16492 - DNA, 20 bp, Artificial Sequence
  Description of Artificial Sequence: Synthetic oligonucleotide
  Target: SCN10A; (-) strand; PAM type: NRG; PAM sequence: CAG
gtggcgggcgcctgtagtcc

SEQ ID NO: 16493 - DNA, 20 bp, Artificial Sequence
  Description of Artificial Sequence: Synthetic oligonucleotide
  Target: SCN10A; (-) strand; PAM type: NRG; PAM sequence: TAG
ggcgtagtggcgggcgcctg

SEQ ID NO: 16494 - DNA, 20 bp, Artificial Sequence
  Description of Artificial Sequence: Synthetic oligonucleotide
  Target: SCN10A; (-) strand; PAM type: NRG; PAM sequence: GGG
aattagccgggcgtagtggc

SEQ ID NO: 16495 - DNA, 20 bp, Artificial Sequence
  Description of Artificial Sequence: Synthetic oligonucleotide
  Target: SCN10A; (-) strand; PAM type: NRG; PAM sequence: CGG
aaattagccgggcgtagtgg

SEQ ID NO: 16496 - DNA, 20 bp, Artificial Sequence
  Description of Artificial Sequence: Synthetic oligonucleotide
  Target: SCN10A; (-) strand; PAM type: NRG; PAM sequence: TGG
aaaaaattagccgggcgtag

SEQ ID NO: 16497 - DNA, 20 bp, Artificial Sequence
  Description of Artificial Sequence: Synthetic oligonucleotide
  Target: SCN10A; (-) strand; PAM type: NRG; PAM sequence: TAG
tacaaaaaattagccgggcg

SEQ ID NO: 16498 - DNA, 20 bp, Artificial Sequence
  Description of Artificial Sequence: Synthetic oligonucleotide
  Target: SCN10A; (-) strand; PAM type: NRG; PAM sequence: GGG
aaaaatacaaaaaattagcc

SEQ ID NO: 16499 - DNA, 20 bp, Artificial Sequence
  Description of Artificial Sequence: Synthetic oligonucleotide
  Target: SCN10A; (-) strand; PAM type: NRG; PAM sequence: CGG
taaaaatacaaaaaattagc

SEQ ID NO: 16500 - DNA, 20 bp, Artificial Sequence
  Description of Artificial Sequence: Synthetic oligonucleotide
  Target: SCN10A; (-) strand; PAM type: NRG; PAM sequence: TAG
ctactaaaaatacaaaaaat

SEQ ID NO: 16501 - DNA, 20 bp, Artificial Sequence
  Description of Artificial Sequence: Synthetic oligonucleotide
  Target: SCN10A; (-) strand; PAM type: NRG; PAM sequence: CGG
cgagaccatcccggctaaaa

SEQ ID NO: 16502 - DNA, 20 bp, Artificial Sequence
  Description of Artificial Sequence: Synthetic oligonucleotide
  Target: SCN10A; (-) strand; PAM type: NRG; PAM sequence: CGG
tcaggagatcgagaccatcc

SEQ ID NO: 16503 - DNA, 20 bp, Artificial Sequence
  Description of Artificial Sequence: Synthetic oligonucleotide
  Target: SCN10A; (-) strand; PAM type: NRG; PAM sequence: GAG
gatcatgaggtcaggagatc

SEQ ID NO: 16504 - DNA, 20 bp, Artificial Sequence
  Description of Artificial Sequence: Synthetic oligonucleotide
  Target: SCN10A; (-) strand; PAM type: NRG; PAM sequence: GAG
cgggcggatcatgaggtcag

SEQ ID NO: 16505 - DNA, 20 bp, Artificial Sequence
  Description of Artificial Sequence: Synthetic oligonucleotide
  Target: SCN10A; (-) strand; PAM type: NRG; PAM sequence: AGG
ggcgggcggatcatgaggtc

SEQ ID NO: 16506 - DNA, 20 bp, Artificial Sequence
  Description of Artificial Sequence: Synthetic oligonucleotide
  Target: SCN10A; (-) strand; PAM type: NRG; PAM sequence: CAG
aggcgggcggatcatgaggt

SEQ ID NO: 16507 - DNA, 20 bp, Artificial Sequence
  Description of Artificial Sequence: Synthetic oligonucleotide
  Target: SCN10A; (-) strand; PAM type: NRG; PAM sequence: AGG
gctgaggcgggcggatcatg

SEQ ID NO: 16508 - DNA, 20 bp, Artificial Sequence
  Description of Artificial Sequence: Synthetic oligonucleotide
  Target: SCN10A; (-) strand; PAM type: NRG; PAM sequence: GAG
ggctgaggcgggcggatcat

SEQ ID NO: 16509 - DNA, 20 bp, Artificial Sequence
  Description of Artificial Sequence: Synthetic oligonucleotide
  Target: SCN10A; (-) strand; PAM type: NRG; PAM sequence: CGG
ctttgggaggctgaggcggg

SEQ ID NO: 16510 - DNA, 20 bp, Artificial Sequence
  Description of Artificial Sequence: Synthetic oligonucleotide
  Target: SCN10A; (-) strand; PAM type: NRG; PAM sequence: GGG
gcactttgggaggctgaggc

SEQ ID NO: 16511 - DNA, 20 bp, Artificial Sequence
  Description of Artificial Sequence: Synthetic oligonucleotide
  Target: SCN10A; (-) strand; PAM type: NRG; PAM sequence: CGG
agcactttgggaggctgagg

SEQ ID NO: 16512 - DNA, 20 bp, Artificial Sequence
  Description of Artificial Sequence: Synthetic oligonucleotide
  Target: SCN10A; (-) strand; PAM type: NRG; PAM sequence: AGG
cccagcactttgggaggctg

SEQ ID NO: 16513 - DNA, 20 bp, Artificial Sequence
  Description of Artificial Sequence: Synthetic oligonucleotide
  Target: SCN10A; (-) strand; PAM type: NRG; PAM sequence: GAG
tcccagcactttgggaggct

SEQ ID NO: 16514 - DNA, 20 bp, Artificial Sequence
  Description of Artificial Sequence: Synthetic oligonucleotide
  Target: SCN10A; (-) strand; PAM type: NRG; PAM sequence: AGG
tgtaatcccagcactttggg

SEQ ID NO: 16515 - DNA, 20 bp, Artificial Sequence
  Description of Artificial Sequence: Synthetic oligonucleotide
  Target: SCN10A; (-) strand; PAM type: NRG; PAM sequence: GAG
ctgtaatcccagcactttgg

SEQ ID NO: 16516 - DNA, 20 bp, Artificial Sequence
  Description of Artificial Sequence: Synthetic oligonucleotide
  Target: SCN10A; (-) strand; PAM type: NRG; PAM sequence: GGG
gcctgtaatcccagcacttt

SEQ ID NO: 16517 - DNA, 20 bp, Artificial Sequence
  Description of Artificial Sequence: Synthetic oligonucleotide
  Target: SCN10A; (-) strand; PAM type: NRG; PAM sequence: TGG
cgcctgtaatcccagcactt

SEQ ID NO: 16518 - DNA, 20 bp, Artificial Sequence
  Description of Artificial Sequence: Synthetic oligonucleotide
  Target: SCN10A; (-) strand; PAM type: NRG; PAM sequence: CAG
gtggctcacgcctgtaatcc

SEQ ID NO: 16519 - DNA, 20 bp, Artificial Sequence
  Description of Artificial Sequence: Synthetic oligonucleotide
  Target: SCN10A; (-) strand; PAM type: NRG; PAM sequence: TGG
gtaagagtggccgggcgcgg

SEQ ID NO: 16520 - DNA, 20 bp, Artificial Sequence
  Description of Artificial Sequence: Synthetic oligonucleotide
  Target: SCN10A; (-) strand; PAM type: NRG; PAM sequence: CGG
cttgtaagagtggccgggcg

SEQ ID NO: 16521 - DNA, 20 bp, Artificial Sequence
  Description of Artificial Sequence: Synthetic oligonucleotide
  Target: SCN10A; (-) strand; PAM type: NRG; PAM sequence: GGG
agtcacttgtaagagtggcc

SEQ ID NO: 16522 - DNA, 20 bp, Artificial Sequence
  Description of Artificial Sequence: Synthetic oligonucleotide
  Target: SCN10A; (-) strand; PAM type: NRG; PAM sequence: CGG
cagtcacttgtaagagtggc

SEQ ID NO: 16523 - DNA, 20 bp, Artificial Sequence
  Description of Artificial Sequence: Synthetic oligonucleotide
  Target: SCN10A; (-) strand; PAM type: NRG; PAM sequence: TGG
ctgccagtcacttgtaagag

SEQ ID NO: 16524 - DNA, 20 bp, Artificial Sequence
  Description of Artificial Sequence: Synthetic oligonucleotide
  Target: SCN10A; (-) strand; PAM type: NRG; PAM sequence: GAG
ctcctgccagtcacttgtaa

SEQ ID NO: 16525 - DNA, 20 bp, Artificial Sequence
  Description of Artificial Sequence: Synthetic oligonucleotide
  Target: SCN10A; (-) strand; PAM type: NRG; PAM sequence: AAG
cactcctgccagtcacttgt

SEQ ID NO: 16526 - DNA, 20 bp, Artificial Sequence
  Description of Artificial Sequence: Synthetic oligonucleotide
  Target: SCN10A; (-) strand; PAM type: NRG; PAM sequence: CAG
ggccaggttttcactcctgc

SEQ ID NO: 16527 - DNA, 20 bp, Artificial Sequence
  Description of Artificial Sequence: Synthetic oligonucleotide
  Target: SCN10A; (-) strand; PAM type: NRG; PAM sequence: AGG
ggcttcacacaggactggcc

SEQ ID NO: 16528 - DNA, 20 bp, Artificial Sequence
  Description of Artificial Sequence: Synthetic oligonucleotide
  Target: SCN10A; (-) strand; PAM type: NRG; PAM sequence: CAG
tggcttcacacaggactggc

SEQ ID NO: 16529 - DNA, 20 bp, Artificial Sequence
  Description of Artificial Sequence: Synthetic oligonucleotide
  Target: SCN10A; (-) strand; PAM type: NRG; PAM sequence: TGG
aatttggcttcacacaggac

SEQ ID NO: 16530 - DNA, 20 bp, Artificial Sequence
  Description of Artificial Sequence: Synthetic oligonucleotide
  Target: SCN10A; (-) strand; PAM type: NRG; PAM sequence: AGG
ttgccaatttggcttcacac

SEQ ID NO: 16531 - DNA, 20 bp, Artificial Sequence
  Description of Artificial Sequence: Synthetic oligonucleotide
  Target: SCN10A; (-) strand; PAM type: NRG; PAM sequence: CAG
attgccaatttggcttcaca

SEQ ID NO: 16532 - DNA, 20 bp, Artificial Sequence
  Description of Artificial Sequence: Synthetic oligonucleotide
  Target: SCN10A; (-) strand; PAM type: NRG; PAM sequence: TGG
tctgagtcacattgccaatt

SEQ ID NO: 16533 - DNA, 20 bp, Artificial Sequence
  Description of Artificial Sequence: Synthetic oligonucleotide
  Target: SCN10A; (-) strand; PAM type: NRG; PAM sequence: GAG
gctaggttcctgaaacctct

SEQ ID NO: 16534 - DNA, 20 bp, Artificial Sequence
  Description of Artificial Sequence: Synthetic oligonucleotide
  Target: SCN10A; (-) strand; PAM type: NRG; PAM sequence: AGG
tgcttgaaggaggaattgct

SEQ ID NO: 16535 - DNA, 20 bp, Artificial Sequence
  Description of Artificial Sequence: Synthetic oligonucleotide
  Target: SCN10A; (-) strand; PAM type: NRG; PAM sequence: TAG
gtgcttgaaggaggaattgc

SEQ ID NO: 16536 - DNA, 20 bp, Artificial Sequence
  Description of Artificial Sequence: Synthetic oligonucleotide
  Target: SCN10A; (-) strand; PAM type: NRG; PAM sequence: AGG
ttaggattagtgcttgaagg

SEQ ID NO: 16537 - DNA, 20 bp, Artificial Sequence
  Description of Artificial Sequence: Synthetic oligonucleotide
  Target: SCN10A; (-) strand; PAM type: NRG; PAM sequence: GAG
cttaggattagtgcttgaag

SEQ ID NO: 16538 - DNA, 20 bp, Artificial Sequence
  Description of Artificial Sequence: Synthetic oligonucleotide
  Target: SCN10A; (-) strand; PAM type: NRG; PAM sequence: AGG
tccttaggattagtgcttga

SEQ ID NO: 16539 - DNA, 20 bp, Artificial Sequence
  Description of Artificial Sequence: Synthetic oligonucleotide
  Target: SCN10A; (-) strand; PAM type: NRG; PAM sequence: AAG
gtccttaggattagtgcttg

SEQ ID NO: 16540 - DNA, 20 bp, Artificial Sequence
  Description of Artificial Sequence: Synthetic oligonucleotide
  Target: SCN10A; (-) strand; PAM type: NRG; PAM sequence: TAG
gcctccagtgtccttaggat

SEQ ID NO: 16541 - DNA, 20 bp, Artificial Sequence
  Description of Artificial Sequence: Synthetic oligonucleotide
  Target: SCN10A; (-) strand; PAM type: NRG; PAM sequence: AGG
caacagcctccagtgtcctt

SEQ ID NO: 16542 - DNA, 20 bp, Artificial Sequence
  Description of Artificial Sequence: Synthetic oligonucleotide
  Target: SCN10A; (-) strand; PAM type: NRG; PAM sequence: TAG
ccaacagcctccagtgtcct

SEQ ID NO: 16543 - DNA, 20 bp, Artificial Sequence
  Description of Artificial Sequence: Synthetic oligonucleotide
  Target: SCN10A; (-) strand; PAM type: NRG; PAM sequence: CAG
gagtgggcaccaacagcctc

SEQ ID NO: 16544 - DNA, 20 bp, Artificial Sequence
  Description of Artificial Sequence: Synthetic oligonucleotide
  Target: SCN10A; (-) strand; PAM type: NRG; PAM sequence: CAG
aggacctgagtgggcaccaa

SEQ ID NO: 16545 - DNA, 20 bp, Artificial Sequence
  Description of Artificial Sequence: Synthetic oligonucleotide
  Target: SCN10A; (-) strand; PAM type: NRG; PAM sequence: GGG
cccttaaagaggacctgagt

SEQ ID NO: 16546 - DNA, 20 bp, Artificial Sequence
  Description of Artificial Sequence: Synthetic oligonucleotide
  Target: SCN10A; (-) strand; PAM type: NRG; PAM sequence: TGG
ccccttaaagaggacctgag

SEQ ID NO: 16547 - DNA, 20 bp, Artificial Sequence
  Description of Artificial Sequence: Synthetic oligonucleotide
  Target: SCN10A; (-) strand; PAM type: NRG; PAM sequence: GAG
tggccccttaaagaggacct

SEQ ID NO: 16548 - DNA, 20 bp, Artificial Sequence
  Description of Artificial Sequence: Synthetic oligonucleotide
  Target: SCN10A; (-) strand; PAM type: NRG; PAM sequence: AGG
ggggcactggccccttaaag

SEQ ID NO: 16549 - DNA, 20 bp, Artificial Sequence
  Description of Artificial Sequence: Synthetic oligonucleotide
  Target: SCN10A; (-) strand; PAM type: NRG; PAM sequence: GAG
aggggcactggccccttaaa

SEQ ID NO: 16550 - DNA, 20 bp, Artificial Sequence
  Description of Artificial Sequence: Synthetic oligonucleotide
  Target: SCN10A; (-) strand; PAM type: NRG; PAM sequence: AAG
ataggggcactggcccctta

SEQ ID NO: 16551 - DNA, 20 bp, Artificial Sequence
  Description of Artificial Sequence: Synthetic oligonucleotide
  Target: SCN10A; (-) strand; PAM type: NRG; PAM sequence: TGG
cagatgaaggataggggcac

SEQ ID NO: 16552 - DNA, 20 bp, Artificial Sequence
  Description of Artificial Sequence: Synthetic oligonucleotide
  Target: SCN10A; (-) strand; PAM type: NRG; PAM sequence: GGG
tcccagcagatgaaggatag

SEQ ID NO: 16553 - DNA, 20 bp, Artificial Sequence
  Description of Artificial Sequence: Synthetic oligonucleotide
  Target: SCN10A; (-) strand; PAM type: NRG; PAM sequence: GGG
ctcccagcagatgaaggata

SEQ ID NO: 16554 - DNA, 20 bp, Artificial Sequence
  Description of Artificial Sequence: Synthetic oligonucleotide
  Target: SCN10A; (-) strand; PAM type: NRG; PAM sequence: AGG
actcccagcagatgaaggat

SEQ ID NO: 16555 - DNA, 20 bp, Artificial Sequence
  Description of Artificial Sequence: Synthetic oligonucleotide
  Target: SCN10A; (-) strand; PAM type: NRG; PAM sequence: TAG
cactcccagcagatgaagga

SEQ ID NO: 16556 - DNA, 20 bp, Artificial Sequence
  Description of Artificial Sequence: Synthetic oligonucleotide
  Target: SCN10A; (-) strand; PAM type: NRG; PAM sequence: AGG
ccgacactcccagcagatga

SEQ ID NO: 16557 - DNA, 20 bp, Artificial Sequence
  Description of Artificial Sequence: Synthetic oligonucleotide
  Target: SCN10A; (-) strand; PAM type: NRG; PAM sequence: AAG
gccgacactcccagcagatg

SEQ ID NO: 16558 - DNA, 20 bp, Artificial Sequence
  Description of Artificial Sequence: Synthetic oligonucleotide
  Target: SCN10A; (-) strand; PAM type: NRG; PAM sequence: CAG
ttagcagccgacactcccag

SEQ ID NO: 16559 - DNA, 20 bp, Artificial Sequence
  Description of Artificial Sequence: Synthetic oligonucleotide
  Target: SCN10A; (-) strand; PAM type: NRG; PAM sequence: CAG
ctattagcagccgacactcc

SEQ ID NO: 16560 - DNA, 20 bp, Artificial Sequence
  Description of Artificial Sequence: Synthetic oligonucleotide
  Target: SCN10A; (-) strand; PAM type: NRG; PAM sequence: CAG
ctgcatccatgaactattag

SEQ ID NO: 16561 - DNA, 20 bp, Artificial Sequence
  Description of Artificial Sequence: Synthetic oligonucleotide
  Target: SCN10A; (-) strand; PAM type: NRG; PAM sequence: TAG
tgtctgcatccatgaactat

SEQ ID NO: 16562 - DNA, 20 bp, Artificial Sequence
  Description of Artificial Sequence: Synthetic oligonucleotide
  Target: SCN10A; (-) strand; PAM type: NRG; PAM sequence: GGG
cagcgaagccatcaggaagg

SEQ ID NO: 16563 - DNA, 20 bp, Artificial Sequence
  Description of Artificial Sequence: Synthetic oligonucleotide
  Target: SCN10A; (-) strand; PAM type: NRG; PAM sequence: GGG
ccagcgaagccatcaggaag

SEQ ID NO: 16564 - DNA, 20 bp, Artificial Sequence
  Description of Artificial Sequence: Synthetic oligonucleotide
  Target: SCN10A; (-) strand; PAM type: NRG; PAM sequence: GGG
cccagcgaagccatcaggaa

SEQ ID NO: 16565 - DNA, 20 bp, Artificial Sequence
  Description of Artificial Sequence: Synthetic oligonucleotide
  Target: SCN10A; (-) strand; PAM type: NRG; PAM sequence: AGG
gcccagcgaagccatcagga

SEQ ID NO: 16566 - DNA, 20 bp, Artificial Sequence
  Description of Artificial Sequence: Synthetic oligonucleotide
  Target: SCN10A; (-) strand; PAM type: NRG; PAM sequence: AAG
agcccagcgaagccatcagg

SEQ ID NO: 16567 - DNA, 20 bp, Artificial Sequence
  Description of Artificial Sequence: Synthetic oligonucleotide
  Target: SCN10A; (-) strand; PAM type: NRG; PAM sequence: AGG
tccagcccagcgaagccatc

SEQ ID NO: 16568 - DNA, 20 bp, Artificial Sequence
  Description of Artificial Sequence: Synthetic oligonucleotide
  Target: SCN10A; (-) strand; PAM type: NRG; PAM sequence: CAG
ctccagcccagcgaagccat

SEQ ID NO: 16569 - DNA, 20 bp, Artificial Sequence
  Description of Artificial Sequence: Synthetic oligonucleotide
  Target: SCN10A; (-) strand; PAM type: NRG; PAM sequence: AAG
cagtttcctccagcccagcg

SEQ ID NO: 16570 - DNA, 20 bp, Artificial Sequence
  Description of Artificial Sequence: Synthetic oligonucleotide
  Target: SCN10A; (-) strand; PAM type: NRG; PAM sequence: CAG
ggacacagtttcctccagcc

SEQ ID NO: 16571 - DNA, 20 bp, Artificial Sequence
  Description of Artificial Sequence: Synthetic oligonucleotide
  Target: SCN10A; (-) strand; PAM type: NRG; PAM sequence: CAG
aaggtggacacagtttcctc

SEQ ID NO: 16572 - DNA, 20 bp, Artificial Sequence
  Description of Artificial Sequence: Synthetic oligonucleotide
  Target: SCN10A; (-) strand; PAM type: NRG; PAM sequence: CAG
agcatttcccaaggtggaca

SEQ ID NO: 16573 - DNA, 20 bp, Artificial Sequence
  Description of Artificial Sequence: Synthetic oligonucleotide
  Target: SCN10A; (-) strand; PAM type: NRG; PAM sequence: TGG
aggataagcatttcccaagg

SEQ ID NO: 16574 - DNA, 20 bp, Artificial Sequence
  Description of Artificial Sequence: Synthetic oligonucleotide
  Target: SCN10A; (-) strand; PAM type: NRG; PAM sequence: AGG
gggaggataagcatttccca

SEQ ID NO: 16575 - DNA, 20 bp, Artificial Sequence
  Description of Artificial Sequence: Synthetic oligonucleotide
  Target: SCN10A; (-) strand; PAM type: NRG; PAM sequence: AAG
ggggaggataagcatttccc

SEQ ID NO: 16576 - DNA, 20 bp, Artificial Sequence
  Description of Artificial Sequence: Synthetic oligonucleotide
  Target: SCN10A; (-) strand; PAM type: NRG; PAM sequence: AAG
gctgccccagcggggaggat

SEQ ID NO: 16577 - DNA, 20 bp, Artificial Sequence
  Description of Artificial Sequence: Synthetic oligonucleotide
  Target: SCN10A; (-) strand; PAM type: NRG; PAM sequence: AGG
tgagggctgccccagcgggg

SEQ ID NO: 16578 - DNA, 20 bp, Artificial Sequence
  Description of Artificial Sequence: Synthetic oligonucleotide
  Target: SCN10A; (-) strand; PAM type: NRG; PAM sequence: GAG
ctgagggctgccccagcggg

SEQ ID NO: 16579 - DNA, 20 bp, Artificial Sequence
  Description of Artificial Sequence: Synthetic oligonucleotide
  Target: SCN10A; (-) strand; PAM type: NRG; PAM sequence: GGG
ggctgagggctgccccagcg

SEQ ID NO: 16580 - DNA, 20 bp, Artificial Sequence
  Description of Artificial Sequence: Synthetic oligonucleotide
  Target: SCN10A; (-) strand; PAM type: NRG; PAM sequence: GGG
tggctgagggctgccccagc

SEQ ID NO: 16581 - DNA, 20 bp, Artificial Sequence
  Description of Artificial Sequence: Synthetic oligonucleotide
  Target: SCN10A; (-) strand; PAM type: NRG; PAM sequence: CGG
ctggctgagggctgccccag

SEQ ID NO: 16582 - DNA, 20 bp, Artificial Sequence
  Description of Artificial Sequence: Synthetic oligonucleotide
  Target: SCN10A; (-) strand; PAM type: NRG; PAM sequence: CAG
tccctggctgagggctgccc

SEQ ID NO: 16583 - DNA, 20 bp, Artificial Sequence
  Description of Artificial Sequence: Synthetic oligonucleotide
  Target: SCN10A; (-) strand; PAM type: NRG; PAM sequence: GGG
ctgtcactgtccctggctga

SEQ ID NO: 16584 - DNA, 20 bp, Artificial Sequence
  Description of Artificial Sequence: Synthetic oligonucleotide
  Target: SCN10A; (-) strand; PAM type: NRG; PAM sequence: AGG
cctgtcactgtccctggctg

SEQ ID NO: 16585 - DNA, 20 bp, Artificial Sequence
  Description of Artificial Sequence: Synthetic oligonucleotide
  Target: SCN10A; (-) strand; PAM type: NRG; PAM sequence: GAG
ccctgtcactgtccctggct

SEQ ID NO: 16586 - DNA, 20 bp, Artificial Sequence
  Description of Artificial Sequence: Synthetic oligonucleotide
  Target: SCN10A; (-) strand; PAM type: NRG; PAM sequence: TGG
aatccccctgtcactgtccc

SEQ ID NO: 16587 - DNA, 20 bp, Artificial Sequence
  Description of Artificial Sequence: Synthetic oligonucleotide
  Target: SCN10A; (-) strand; PAM type: NRG; PAM sequence: CAG
ccaccttgaggcaaagaaga

SEQ ID NO: 16588 - DNA, 20 bp, Artificial Sequence
  Description of Artificial Sequence: Synthetic oligonucleotide
  Target: SCN10A; (-) strand; PAM type: NRG; PAM sequence: AAG
tgtcccaccttgaggcaaag

SEQ ID NO: 16589 - DNA, 20 bp, Artificial Sequence
  Description of Artificial Sequence: Synthetic oligonucleotide
  Target: SCN10A; (-) strand; PAM type: NRG; PAM sequence: AAG
agctgtcccaccttgaggca

SEQ ID NO: 16590 - DNA, 20 bp, Artificial Sequence
  Description of Artificial Sequence: Synthetic oligonucleotide
  Target: SCN10A; (-) strand; PAM type: NRG; PAM sequence: AGG
caaagagctgtcccaccttg

SEQ ID NO: 16591 - DNA, 20 bp, Artificial Sequence
  Description of Artificial Sequence: Synthetic oligonucleotide
  Target: SCN10A; (-) strand; PAM type: NRG; PAM sequence: GAG
ccaaagagctgtcccacctt

SEQ ID NO: 16592 - DNA, 20 bp, Artificial Sequence
  Description of Artificial Sequence: Synthetic oligonucleotide
  Target: SCN10A; (-) strand; PAM type: NRG; PAM sequence: GAG
gaagcacaaaggacaccaaa

SEQ ID NO: 16593 - DNA, 20 bp, Artificial Sequence
  Description of Artificial Sequence: Synthetic oligonucleotide
  Target: SCN10A; (-) strand; PAM type: NRG; PAM sequence: AAG
ctgaagcacaaaggacacca

SEQ ID NO: 16594 - DNA, 20 bp, Artificial Sequence
  Description of Artificial Sequence: Synthetic oligonucleotide
  Target: SCN10A; (-) strand; PAM type: NRG; PAM sequence: AGG
tggaaagccctgaagcacaa

SEQ ID NO: 16595 - DNA, 20 bp, Artificial Sequence
  Description of Artificial Sequence: Synthetic oligonucleotide
  Target: SCN10A; (-) strand; PAM type: NRG; PAM sequence: AAG
atggaaagccctgaagcaca

SEQ ID NO: 16596 - DNA, 20 bp, Artificial Sequence
  Description of Artificial Sequence: Synthetic oligonucleotide
  Target: SCN10A; (-) strand; PAM type: NRG; PAM sequence: AAG
tgatcccatggaaagccctg

SEQ ID NO: 16597 - DNA, 20 bp, Artificial Sequence
  Description of Artificial Sequence: Synthetic oligonucleotide
  Target: SCN10A; (-) strand; PAM type: NRG; PAM sequence: AAG
gcttcagctgatcccatgga

SEQ ID NO: 16598 - DNA, 20 bp, Artificial Sequence
  Description of Artificial Sequence: Synthetic oligonucleotide
  Target: SCN10A; (-) strand; PAM type: NRG; PAM sequence: TGG
tccggcttcagctgatccca

SEQ ID NO: 16599 - DNA, 20 bp, Artificial Sequence
  Description of Artificial Sequence: Synthetic oligonucleotide
  Target: SCN10A; (-) strand; PAM type: NRG; PAM sequence: CAG
gttcagttgaaatccggctt

SEQ ID NO: 16600 - DNA, 20 bp, Artificial Sequence
  Description of Artificial Sequence: Synthetic oligonucleotide
  Target: SCN10A; (-) strand; PAM type: NRG; PAM sequence: CGG
atgtgggttcagttgaaatc

SEQ ID NO: 16601 - DNA, 20 bp, Artificial Sequence
  Description of Artificial Sequence: Synthetic oligonucleotide
  Target: SCN10A; (-) strand; PAM type: NRG; PAM sequence: CAG
gctgagaaaagatgtgggtt

SEQ ID NO: 16602 - DNA, 20 bp, Artificial Sequence
  Description of Artificial Sequence: Synthetic oligonucleotide
  Target: SCN10A; (-) strand; PAM type: NRG; PAM sequence: GGG
cggaagctgagaaaagatgt

SEQ ID NO: 16603 - DNA, 20 bp, Artificial Sequence
  Description of Artificial Sequence: Synthetic oligonucleotide
  Target: SCN10A; (-) strand; PAM type: NRG; PAM sequence: TGG
tcggaagctgagaaaagatg

SEQ ID NO: 16604 - DNA, 20 bp, Artificial Sequence
  Description of Artificial Sequence: Synthetic oligonucleotide
  Target: SCN10A; (-) strand; PAM type: NRG; PAM sequence: AAG
acagaatcggaagctgagaa

SEQ ID NO: 16605 - DNA, 20 bp, Artificial Sequence
  Description of Artificial Sequence: Synthetic oligonucleotide
  Target: SCN10A; (-) strand; PAM type: NRG; PAM sequence: GAG
tagacacagaatcggaagct

SEQ ID NO: 16606 - DNA, 20 bp, Artificial Sequence
  Description of Artificial Sequence: Synthetic oligonucleotide
  Target: SCN10A; (-) strand; PAM type: NRG; PAM sequence: AAG
cgtcctagacacagaatcgg

SEQ ID NO: 16607 - DNA, 20 bp, Artificial Sequence
  Description of Artificial Sequence: Synthetic oligonucleotide
  Target: SCN10A; (-) strand; PAM type: NRG; PAM sequence: CGG
cctcgtcctagacacagaat

SEQ ID NO: 16608 - DNA, 20 bp, Artificial Sequence
  Description of Artificial Sequence: Synthetic oligonucleotide
  Target: SCN10A; (-) strand; PAM type: NRG; PAM sequence: CAG
cttagtcctcgtcctagaca

SEQ ID NO: 16609 - DNA, 20 bp, Artificial Sequence
  Description of Artificial Sequence: Synthetic oligonucleotide
  Target: SCN10A; (-) strand; PAM type: NRG; PAM sequence: TAG
tcccatcttagtcctcgtcc

SEQ ID NO: 16610 - DNA, 20 bp, Artificial Sequence
  Description of Artificial Sequence: Synthetic oligonucleotide
  Target: SCN10A; (-) strand; PAM type: NRG; PAM sequence: TAG
cgttggataatctcccatct

SEQ ID NO: 16611 - DNA, 20 bp, Artificial Sequence
  Description of Artificial Sequence: Synthetic oligonucleotide
  Target: SCN10A; (-) strand; PAM type: NRG; PAM sequence: TGG
gtgtactcccttagagacgt

SEQ ID NO: 16612 - DNA, 20 bp, Artificial Sequence
  Description of Artificial Sequence: Synthetic oligonucleotide
  Target: SCN10A; (-) strand; PAM type: NRG; PAM sequence: GAG
tccctgtgtgtactccctta

SEQ ID NO: 16613 - DNA, 20 bp, Artificial Sequence
  Description of Artificial Sequence: Synthetic oligonucleotide
  Target: SCN10A; (-) strand; PAM type: NRG; PAM sequence: TAG
attccctgtgtgtactccct

SEQ ID NO: 16614 - DNA, 20 bp, Artificial Sequence
  Description of Artificial Sequence: Synthetic oligonucleotide
  Target: SCN10A; (-) strand; PAM type: NRG; PAM sequence: TGG
tctcatattatctcatttaa

SEQ ID NO: 16615 - DNA, 20 bp, Artificial Sequence
  Description of Artificial Sequence: Synthetic oligonucleotide
  Target: SCN10A; (-) strand; PAM type: NRG; PAM sequence: TAG
agtacatttttctcagtaaa

SEQ ID NO: 16616 - DNA, 20 bp, Artificial Sequence
  Description of Artificial Sequence: Synthetic oligonucleotide
  Target: SCN10A; (-) strand; PAM type: NRG; PAM sequence: CAG
taacctcagtacatttttct

SEQ ID NO: 16617 - DNA, 20 bp, Artificial Sequence
  Description of Artificial Sequence: Synthetic oligonucleotide
  Target: SCN10A; (-) strand; PAM type: NRG; PAM sequence: CAG
atttatgcattctataacct

SEQ ID NO: 16618 - DNA, 20 bp, Artificial Sequence
  Description of Artificial Sequence: Synthetic oligonucleotide
  Target: SCN10A; (-) strand; PAM type: NRG; PAM sequence: TGG
aaactcacttgaaaacatgc

SEQ ID NO: 16619 - DNA, 20 bp, Artificial Sequence
  Description of Artificial Sequence: Synthetic oligonucleotide
  Target: SCN10A; (-) strand; PAM type: NRG; PAM sequence: GAG
ccatttccctatcactcaaa

SEQ ID NO: 16620 - DNA, 20 bp, Artificial Sequence
  Description of Artificial Sequence: Synthetic oligonucleotide
  Target: SCN10A; (-) strand; PAM type: NRG; PAM sequence: AAG
atccatttccctatcactca

SEQ ID NO: 16621 - DNA, 20 bp, Artificial Sequence
  Description of Artificial Sequence: Synthetic oligonucleotide
  Target: SCN10A; (-) strand; PAM type: NRG; PAM sequence: AAG
ggaaattatagaaaaaggta

SEQ ID NO: 16622 - DNA, 20 bp, Artificial Sequence
  Description of Artificial Sequence: Synthetic oligonucleotide
  Target: SCN10A; (-) strand; PAM type: NRG; PAM sequence: AGG
tacttggaaattatagaaaa

SEQ ID NO: 16623 - DNA, 20 bp, Artificial Sequence
  Description of Artificial Sequence: Synthetic oligonucleotide
  Target: SCN10A; (-) strand; PAM type: NRG; PAM sequence: AAG
atacttggaaattatagaaa

SEQ ID NO: 16624 - DNA, 20 bp, Artificial Sequence
  Description of Artificial Sequence: Synthetic oligonucleotide
  Target: SCN10A; (-) strand; PAM type: NRG; PAM sequence: TAG
aaaaaaatacttggaaatta

SEQ ID NO: 16625 - DNA, 20 bp, Artificial Sequence
  Description of Artificial Sequence: Synthetic oligonucleotide
  Target: SCN10A; (-) strand; PAM type: NRG; PAM sequence: TGG
taaagtaccaaaaaaatact

SEQ ID NO: 16626 - DNA, 20 bp, Artificial Sequence
  Description of Artificial Sequence: Synthetic oligonucleotide
  Target: SCN10A; (-) strand; PAM type: NRG; PAM sequence: AAG
cattttcatctgacaaagta

SEQ ID NO: 16627 - DNA, 20 bp, Artificial Sequence
  Description of Artificial Sequence: Synthetic oligonucleotide
  Target: SCN10A; (-) strand; PAM type: NRG; PAM sequence: AAG
acatgcattttcatctgaca

SEQ ID NO: 16628 - DNA, 20 bp, Artificial Sequence
  Description of Artificial Sequence: Synthetic oligonucleotide
  Target: SCN10A; (-) strand; PAM type: NRG; PAM sequence: GAG
cttctttaggctttcacttt

SEQ ID NO: 16629 - DNA, 20 bp, Artificial Sequence
  Description of Artificial Sequence: Synthetic oligonucleotide
  Target: SCN10A; (-) strand; PAM type: NRG; PAM sequence: AGG
caccaaatttagccttcttt

SEQ ID NO: 16630 - DNA, 20 bp, Artificial Sequence
  Description of Artificial Sequence: Synthetic oligonucleotide
  Target: SCN10A; (-) strand; PAM type: NRG; PAM sequence: TAG
gcaccaaatttagccttctt

SEQ ID NO: 16631 - DNA, 20 bp, Artificial Sequence
  Description of Artificial Sequence: Synthetic oligonucleotide
  Target: SCN10A; (-) strand; PAM type: NRG; PAM sequence: TAG
gaacaggctggcaccaaatt

SEQ ID NO: 16632 - DNA, 20 bp, Artificial Sequence
  Description of Artificial Sequence: Synthetic oligonucleotide
  Target: SCN10A; (-) strand; PAM type: NRG; PAM sequence: TGG
tcccctgggactgaacaggc

SEQ ID NO: 16633 - DNA, 20 bp, Artificial Sequence
  Description of Artificial Sequence: Synthetic oligonucleotide
  Target: SCN10A; (-) strand; PAM type: NRG; PAM sequence: AGG
tccttcccctgggactgaac

SEQ ID NO: 16634 - DNA, 20 bp, Artificial Sequence
  Description of Artificial Sequence: Synthetic oligonucleotide
  Target: SCN10A; (-) strand; PAM type: NRG; PAM sequence: CAG
ctccttcccctgggactgaa

SEQ ID NO: 16635 - DNA, 20 bp, Artificial Sequence
  Description of Artificial Sequence: Synthetic oligonucleotide
  Target: SCN10A; (-) strand; PAM type: NRG; PAM sequence: GGG
ccctcccatctccttcccct

SEQ ID NO: 16636 - DNA, 20 bp, Artificial Sequence
  Description of Artificial Sequence: Synthetic oligonucleotide
  Target: SCN10A; (-) strand; PAM type: NRG; PAM sequence: TGG
tccctcccatctccttcccc

SEQ ID NO: 16637 - DNA, 20 bp, Artificial Sequence
  Description of Artificial Sequence: Synthetic oligonucleotide
  Target: SCN10A; (-) strand; PAM type: NRG; PAM sequence: CAG
ccagcccagcccgccccctg

SEQ ID NO: 16638 - DNA, 20 bp, Artificial Sequence
  Description of Artificial Sequence: Synthetic oligonucleotide
  Target: SCN10A; (-) strand; PAM type: NRG; PAM sequence: CAG
cctgcagcactgcgccagcc

SEQ ID NO: 16639 - DNA, 20 bp, Artificial Sequence
  Description of Artificial Sequence: Synthetic oligonucleotide
  Target: SCN10A; (-) strand; PAM type: NRG; PAM sequence: CAG
tcagacctgcagcactgcgc

SEQ ID NO: 16640 - DNA, 20 bp, Artificial Sequence
  Description of Artificial Sequence: Synthetic oligonucleotide
  Target: SCN10A; (-) strand; PAM type: NRG; PAM sequence: CAG
caggaggaagctcagacctg

SEQ ID NO: 16641 - DNA, 20 bp, Artificial Sequence
  Description of Artificial Sequence: Synthetic oligonucleotide
  Target: SCN10A; (-) strand; PAM type: NRG; PAM sequence: CAG
cacattcccaggaggaagct

SEQ ID NO: 16642 - DNA, 20 bp, Artificial Sequence
  Description of Artificial Sequence: Synthetic oligonucleotide
  Target: SCN10A; (-) strand; PAM type: NRG; PAM sequence: AAG
ccccccacattcccaggagg

SEQ ID NO: 16643 - DNA, 20 bp, Artificial Sequence
  Description of Artificial Sequence: Synthetic oligonucleotide
  Target: SCN10A; (-) strand; PAM type: NRG; PAM sequence: AGG
ccaccccccacattcccagg

SEQ ID NO: 16644 - DNA, 20 bp, Artificial Sequence
  Description of Artificial Sequence: Synthetic oligonucleotide
  Target: SCN10A; (-) strand; PAM type: NRG; PAM sequence: GAG
tccaccccccacattcccag

SEQ ID NO: 16645 - DNA, 20 bp, Artificial Sequence
  Description of Artificial Sequence: Synthetic oligonucleotide
  Target: SCN10A; (-) strand; PAM type: NRG; PAM sequence: AGG
ggtccaccccccacattccc

SEQ ID NO: 16646 - DNA, 20 bp, Artificial Sequence
  Description of Artificial Sequence: Synthetic oligonucleotide
  Target: SCN10A; (-) strand; PAM type: NRG; PAM sequence: CAG
cggtccaccccccacattcc

SEQ ID NO: 16647 - DNA, 20 bp, Artificial Sequence
  Description of Artificial Sequence: Synthetic oligonucleotide
  Target: SCN10A; (-) strand; PAM type: NRG; PAM sequence: CGG
gcccccttctcttcacaccc

SEQ ID NO: 16648 - DNA, 20 bp, Artificial Sequence
  Description of Artificial Sequence: Synthetic oligonucleotide
  Target: SCN10A; (-) strand; PAM type: NRG; PAM sequence: TAG
tgctccctcccttctctctc

SEQ ID NO: 16649 - DNA, 20 bp, Artificial Sequence
  Description of Artificial Sequence: Synthetic oligonucleotide
  Target: SCN10A; (-) strand; PAM type: NRG; PAM sequence: GGG
tcactacgtcattggcttgt

SEQ ID NO: 16650 - DNA, 20 bp, Artificial Sequence
  Description of Artificial Sequence: Synthetic oligonucleotide
  Target: SCN10A; (-) strand; PAM type: NRG; PAM sequence: TGG
ctcactacgtcattggcttg

SEQ ID NO: 16651 - DNA, 20 bp, Artificial Sequence
  Description of Artificial Sequence: Synthetic oligonucleotide
  Target: SCN10A; (-) strand; PAM type: NRG; PAM sequence: TGG
tgctctcctcactacgtcat

SEQ ID NO: 16652 - DNA, 20 bp, Artificial Sequence
  Description of Artificial Sequence: Synthetic oligonucleotide
  Target: SCN10A; (-) strand; PAM type: NRG; PAM sequence: AGG
aaccacatgtgctgttggcc

SEQ ID NO: 16653 - DNA, 20 bp, Artificial Sequence
  Description of Artificial Sequence: Synthetic oligonucleotide
  Target: SCN10A; (-) strand; PAM type: NRG; PAM sequence: CAG
taaccacatgtgctgttggc

SEQ ID NO: 16654 - DNA, 20 bp, Artificial Sequence
  Description of Artificial Sequence: Synthetic oligonucleotide
  Target: SCN10A; (-) strand; PAM type: NRG; PAM sequence: TGG
gtaataaccacatgtgctgt

SEQ ID NO: 16655 - DNA, 20 bp, Artificial Sequence
  Description of Artificial Sequence: Synthetic oligonucleotide
  Target: SCN10A; (-) strand; PAM type: NRG; PAM sequence: AAG
cttccagtcctgctggatta

SEQ ID NO: 16656 - DNA, 20 bp, Artificial Sequence
  Description of Artificial Sequence: Synthetic oligonucleotide
  Target: SCN10A; (-) strand; PAM type: NRG; PAM sequence: TGG
tcttctccttccagtcctgc

SEQ ID NO: 16657 - DNA, 20 bp, Artificial Sequence
  Description of Artificial Sequence: Synthetic oligonucleotide
  Target: SCN10A; (-) strand; PAM type: NRG; PAM sequence: CAG
cacctatgctcttctccttc

SEQ ID NO: 16658 - DNA, 20 bp, Artificial Sequence
  Description of Artificial Sequence: Synthetic oligonucleotide
  Target: SCN10A; (-) strand; PAM type: NRG; PAM sequence: CAG
aggggcaagagagggctggg

SEQ ID NO: 16659 - DNA, 20 bp, Artificial Sequence
  Description of Artificial Sequence: Synthetic oligonucleotide
  Target: SCN10A; (-) strand; PAM type: NRG; PAM sequence: GGG
tgcaggggcaagagagggct

SEQ ID NO: 16660 - DNA, 20 bp, Artificial Sequence
  Description of Artificial Sequence: Synthetic oligonucleotide
  Target: SCN10A; (-) strand; PAM type: NRG; PAM sequence: TGG
ttgcaggggcaagagagggc

SEQ ID NO: 16661 - DNA, 20 bp, Artificial Sequence
  Description of Artificial Sequence: Synthetic oligonucleotide
  Target: SCN10A; (-) strand; PAM type: NRG; PAM sequence: GGG
caaattgcaggggcaagaga

SEQ ID NO: 16662 - DNA, 20 bp, Artificial Sequence
  Description of Artificial Sequence: Synthetic oligonucleotide
  Target: SCN10A; (-) strand; PAM type: NRG; PAM sequence: AGG
ccaaattgcaggggcaagag

SEQ ID NO: 16663 - DNA, 20 bp, Artificial Sequence
  Description of Artificial Sequence: Synthetic oligonucleotide
  Target: SCN10A; (-) strand; PAM type: NRG; PAM sequence: GAG
gccaaattgcaggggcaaga

SEQ ID NO: 16664 - DNA, 20 bp, Artificial Sequence
  Description of Artificial Sequence: Synthetic oligonucleotide
  Target: SCN10A; (-) strand; PAM type: NRG; PAM sequence: GAG
aggccaaattgcaggggcaa

SEQ ID NO: 16665 - DNA, 20 bp, Artificial Sequence
  Description of Artificial Sequence: Synthetic oligonucleotide
  Target: SCN10A; (-) strand; PAM type: NRG; PAM sequence: AAG
agaggccaaattgcaggggc

SEQ ID NO: 16666 - DNA, 20 bp, Artificial Sequence
  Description of Artificial Sequence: Synthetic oligonucleotide
  Target: SCN10A; (-) strand; PAM type: NRG; PAM sequence: GGG
gtgtagaggccaaattgcag

SEQ ID NO: 16667 - DNA, 20 bp, Artificial Sequence
  Description of Artificial Sequence: Synthetic oligonucleotide
  Target: SCN10A; (-) strand; PAM type: NRG; PAM sequence: GGG
agtgtagaggccaaattgca

SEQ ID NO: 16668 - DNA, 20 bp, Artificial Sequence
  Description of Artificial Sequence: Synthetic oligonucleotide
  Target: SCN10A; (-) strand; PAM type: NRG; PAM sequence: AGG
cagtgtagaggccaaattgc

SEQ ID NO: 16669 - DNA, 20 bp, Artificial Sequence
  Description of Artificial Sequence: Synthetic oligonucleotide
  Target: SCN10A; (-) strand; PAM type: NRG; PAM sequence: CAG
acagtgtagaggccaaattg

SEQ ID NO: 16670 - DNA, 20 bp, Artificial Sequence
  Description of Artificial Sequence: Synthetic oligonucleotide
  Target: SCN10A; (-) strand; PAM type: NRG; PAM sequence: AGG
cggacctcagcacagtgtag

SEQ ID NO: 16671 - DNA, 20 bp, Artificial Sequence
  Description of Artificial Sequence: Synthetic oligonucleotide
  Target: SCN10A; (-) strand; PAM type: NRG; PAM sequence: GAG
acggacctcagcacagtgta

SEQ ID NO: 16672 - DNA, 20 bp, Artificial Sequence
  Description of Artificial Sequence: Synthetic oligonucleotide
  Target: SCN10A; (-) strand; PAM type: NRG; PAM sequence: TAG
acacggacctcagcacagtg

SEQ ID NO: 16673 - DNA, 20 bp, Artificial Sequence
  Description of Artificial Sequence: Synthetic oligonucleotide
  Target: SCN10A; (-) strand; PAM type: NRG; PAM sequence: CAG
tgtccacacggacctcagca

SEQ ID NO: 16674 - DNA, 20 bp, Artificial Sequence
  Description of Artificial Sequence: Synthetic oligonucleotide
  Target: SCN10A; (-) strand; PAM type: NRG; PAM sequence: CAG
gtgattgtccacacggacct

SEQ ID NO: 16675 - DNA, 20 bp, Artificial Sequence
  Description of Artificial Sequence: Synthetic oligonucleotide
  Target: SCN10A; (-) strand; PAM type: NRG; PAM sequence: CGG
cagggcagtgattgtccaca

SEQ ID NO: 16676 - DNA, 20 bp, Artificial Sequence
  Description of Artificial Sequence: Synthetic oligonucleotide
  Target: SCN10A; (-) strand; PAM type: NRG; PAM sequence: CAG
cccagtgccctggcacaggg

SEQ ID NO: 16677 - DNA, 20 bp, Artificial Sequence
  Description of Artificial Sequence: Synthetic oligonucleotide
  Target: SCN10A; (-) strand; PAM type: NRG; PAM sequence: GGG
gtgcccagtgccctggcaca

SEQ ID NO: 16678 - DNA, 20 bp, Artificial Sequence
  Description of Artificial Sequence: Synthetic oligonucleotide
  Target: SCN10A; (-) strand; PAM type: NRG; PAM sequence: AGG
ggtgcccagtgccctggcac

SEQ ID NO: 16679 - DNA, 20 bp, Artificial Sequence
  Description of Artificial Sequence: Synthetic oligonucleotide
  Target: SCN10A; (-) strand; PAM type: NRG; PAM sequence: CAG
aggtgcccagtgccctggca

SEQ ID NO: 16680 - DNA, 20 bp, Artificial Sequence
  Description of Artificial Sequence: Synthetic oligonucleotide
  Target: SCN10A; (-) strand; PAM type: NRG; PAM sequence: TGG
gctgcaggtgcccagtgccc

SEQ ID NO: 16681 - DNA, 20 bp, Artificial Sequence
  Description of Artificial Sequence: Synthetic oligonucleotide
  Target: SCN10A; (-) strand; PAM type: NRG; PAM sequence: CAG
tgacagcggctgcaggtgcc

SEQ ID NO: 16682 - DNA, 20 bp, Artificial Sequence
  Description of Artificial Sequence: Synthetic oligonucleotide
  Target: SCN10A; (-) strand; PAM type: NRG; PAM sequence: AGG
aactgtgtgacagcggctgc

SEQ ID NO: 16683 - DNA, 20 bp, Artificial Sequence
  Description of Artificial Sequence: Synthetic oligonucleotide
  Target: SCN10A; (-) strand; PAM type: NRG; PAM sequence: CAG
gaactgtgtgacagcggctg

SEQ ID NO: 16684 - DNA, 20 bp, Artificial Sequence
  Description of Artificial Sequence: Synthetic oligonucleotide
  Target: SCN10A; (-) strand; PAM type: NRG; PAM sequence: CGG
gagggggaactgtgtgacag

SEQ ID NO: 16685 - DNA, 20 bp, Artificial Sequence
  Description of Artificial Sequence: Synthetic oligonucleotide
  Target: SCN10A; (-) strand; PAM type: NRG; PAM sequence: CAG
gtggagggggaactgtgtga

SEQ ID NO: 16686 - DNA, 20 bp, Artificial Sequence
  Description of Artificial Sequence: Synthetic oligonucleotide
  Target: SCN10A; (-) strand; PAM type: NRG; PAM sequence: GGG
tctgccatcctgggtggagg

SEQ ID NO: 16687 - DNA, 20 bp, Artificial Sequence
  Description of Artificial Sequence: Synthetic oligonucleotide
  Target: SCN10A; (-) strand; PAM type: NRG; PAM sequence: GGG
gtctgccatcctgggtggag

SEQ ID NO: 16688 - DNA, 20 bp, Artificial Sequence
  Description of Artificial Sequence: Synthetic oligonucleotide
  Target: SCN10A; (-) strand; PAM type: NRG; PAM sequence: GGG
ggtctgccatcctgggtgga

SEQ ID NO: 16689 - DNA, 20 bp, Artificial Sequence
  Description of Artificial Sequence: Synthetic oligonucleotide
  Target: SCN10A; (-) strand; PAM type: NRG; PAM sequence: AGG
tggtctgccatcctgggtgg

SEQ ID NO: 16690 - DNA, 20 bp, Artificial Sequence
  Description of Artificial Sequence: Synthetic oligonucleotide
  Target: SCN10A; (-) strand; PAM type: NRG; PAM sequence: GAG
ctggtctgccatcctgggtg

SEQ ID NO: 16691 - DNA, 20 bp, Artificial Sequence
  Description of Artificial Sequence: Synthetic oligonucleotide
  Target: SCN10A; (-) strand; PAM type: NRG; PAM sequence: TGG
gactggtctgccatcctggg

SEQ ID NO: 16692 - DNA, 20 bp, Artificial Sequence
  Description of Artificial Sequence: Synthetic oligonucleotide
  Target: SCN10A; (-) strand; PAM type: NRG; PAM sequence: GGG
agggactggtctgccatcct

SEQ ID NO: 16693 - DNA, 20 bp, Artificial Sequence
  Description of Artificial Sequence: Synthetic oligonucleotide
  Target: SCN10A; (-) strand; PAM type: NRG; PAM sequence: TGG
cagggactggtctgccatcc

SEQ ID NO: 16694 - DNA, 20 bp, Artificial Sequence
  Description of Artificial Sequence: Synthetic oligonucleotide
  Target: SCN10A; (-) strand; PAM type: NRG; PAM sequence: TGG
gagagtttcggggcagggac

SEQ ID NO: 16695 - DNA, 20 bp, Artificial Sequence
  Description of Artificial Sequence: Synthetic oligonucleotide
  Target: SCN10A; (-) strand; PAM type: NRG; PAM sequence: GGG
gagaagagagtttcggggca

SEQ ID NO: 16696 - DNA, 20 bp, Artificial Sequence
  Description of Artificial Sequence: Synthetic oligonucleotide
  Target: SCN10A; (-) strand; PAM type: NRG; PAM sequence: AGG
ggagaagagagtttcggggc

SEQ ID NO: 16697 - DNA, 20 bp, Artificial Sequence
  Description of Artificial Sequence: Synthetic oligonucleotide
  Target: SCN10A; (-) strand; PAM type: NRG; PAM sequence: CAG
gggagaagagagtttcgggg

SEQ ID NO: 16698 - DNA, 20 bp, Artificial Sequence
  Description of Artificial Sequence: Synthetic oligonucleotide
  Target: SCN10A; (-) strand; PAM type: NRG; PAM sequence: GGG
caagggagaagagagtttcg

SEQ ID NO: 16699 - DNA, 20 bp, Artificial Sequence
  Description of Artificial Sequence: Synthetic oligonucleotide
  Target: SCN10A; (-) strand; PAM type: NRG; PAM sequence: GGG
ccaagggagaagagagtttc

SEQ ID NO: 16700 - DNA, 20 bp, Artificial Sequence
  Description of Artificial Sequence: Synthetic oligonucleotide
  Target: SCN10A; (-) strand; PAM type: NRG; PAM sequence: CGG
gccaagggagaagagagttt

SEQ ID NO: 16701 - DNA, 20 bp, Artificial Sequence
  Description of Artificial Sequence: Synthetic oligonucleotide
  Target: SCN10A; (-) strand; PAM type: NRG; PAM sequence: GAG
cgcaaagccaagggagaaga

SEQ ID NO: 16702 - DNA, 20 bp, Artificial Sequence
  Description of Artificial Sequence: Synthetic oligonucleotide
  Target: SCN10A; (-) strand; PAM type: NRG; PAM sequence: GAG
gacgcaaagccaagggagaa

SEQ ID NO: 16703 - DNA, 20 bp, Artificial Sequence
  Description of Artificial Sequence: Synthetic oligonucleotide
  Target: SCN10A; (-) strand; PAM type: NRG; PAM sequence: AAG
atgacgcaaagccaagggag

SEQ ID NO: 16704 - DNA, 20 bp, Artificial Sequence
  Description of Artificial Sequence: Synthetic oligonucleotide
  Target: SCN10A; (-) strand; PAM type: NRG; PAM sequence: GAG
gcaatgacgcaaagccaagg

SEQ ID NO: 16705 - DNA, 20 bp, Artificial Sequence
  Description of Artificial Sequence: Synthetic oligonucleotide
  Target: SCN10A; (-) strand; PAM type: NRG; PAM sequence: GGG
tggcaatgacgcaaagccaa

SEQ ID NO: 16706 - DNA, 20 bp, Artificial Sequence
  Description of Artificial Sequence: Synthetic oligonucleotide
  Target: SCN10A; (-) strand; PAM type: NRG; PAM sequence: AGG
gtggcaatgacgcaaagcca

SEQ ID NO: 16707 - DNA, 20 bp, Artificial Sequence
  Description of Artificial Sequence: Synthetic oligonucleotide
  Target: SCN10A; (-) strand; PAM type: NRG; PAM sequence: AAG
ggtggcaatgacgcaaagcc

SEQ ID NO: 16708 - DNA, 20 bp, Artificial Sequence
  Description of Artificial Sequence: Synthetic oligonucleotide
  Target: SCN10A; (-) strand; PAM type: NRG; PAM sequence: AAG
actagggtggcaatgacgca

SEQ ID NO: 16709 - DNA, 20 bp, Artificial Sequence
  Description of Artificial Sequence: Synthetic oligonucleotide
  Target: SCN10A; (-) strand; PAM type: NRG; PAM sequence: TGG
aggtgggaggaaaactaggg

SEQ ID NO: 16710 - DNA, 20 bp, Artificial Sequence
  Description of Artificial Sequence: Synthetic oligonucleotide
  Target: SCN10A; (-) strand; PAM type: NRG; PAM sequence: GGG
gagaggtgggaggaaaacta

SEQ ID NO: 16711 - DNA, 20 bp, Artificial Sequence
  Description of Artificial Sequence: Synthetic oligonucleotide
  Target: SCN10A; (-) strand; PAM type: NRG; PAM sequence: AGG
tgagaggtgggaggaaaact

SEQ ID NO: 16712 - DNA, 20 bp, Artificial Sequence
  Description of Artificial Sequence: Synthetic oligonucleotide
  Target: SCN10A; (-) strand; PAM type: NRG; PAM sequence: TAG
ctgagaggtgggaggaaaac

SEQ ID NO: 16713 - DNA, 20 bp, Artificial Sequence
  Description of Artificial Sequence: Synthetic oligonucleotide
  Target: SCN10A; (-) strand; PAM type: NRG; PAM sequence: AGG
ggcaggatctgagaggtggg

SEQ ID NO: 16714 - DNA, 20 bp, Artificial Sequence
  Description of Artificial Sequence: Synthetic oligonucleotide
  Target: SCN10A; (-) strand; PAM type: NRG; PAM sequence: GAG
aggcaggatctgagaggtgg

SEQ ID NO: 16715 - DNA, 20 bp, Artificial Sequence
  Description of Artificial Sequence: Synthetic oligonucleotide
  Target: SCN10A; (-) strand; PAM type: NRG; PAM sequence: GGG
cgaggcaggatctgagaggt

SEQ ID NO: 16716 - DNA, 20 bp, Artificial Sequence
  Description of Artificial Sequence: Synthetic oligonucleotide
  Target: SCN10A; (-) strand; PAM type: NRG; PAM sequence: TGG
acgaggcaggatctgagagg

SEQ ID NO: 16717 - DNA, 20 bp, Artificial Sequence
  Description of Artificial Sequence: Synthetic oligonucleotide
  Target: SCN10A; (-) strand; PAM type: NRG; PAM sequence: AGG
gggacgaggcaggatctgag

SEQ ID NO: 16718 - DNA, 20 bp, Artificial Sequence
  Description of Artificial Sequence: Synthetic oligonucleotide
  Target: SCN10A; (-) strand; PAM type: NRG; PAM sequence: GAG
cgggacgaggcaggatctga

SEQ ID NO: 16719 - DNA, 20 bp, Artificial Sequence
  Description of Artificial Sequence: Synthetic oligonucleotide
  Target: SCN10A; (-) strand; PAM type: NRG; PAM sequence: GAG
tgcgggacgaggcaggatct

SEQ ID NO: 16720 - DNA, 20 bp, Artificial Sequence
  Description of Artificial Sequence: Synthetic oligonucleotide
  Target: SCN10A; (-) strand; PAM type: NRG; PAM sequence: AGG
gcacaggtgcgggacgaggc

SEQ ID NO: 16721 - DNA, 20 bp, Artificial Sequence
  Description of Artificial Sequence: Synthetic oligonucleotide
  Target: SCN10A; (-) strand; PAM type: NRG; PAM sequence: CAG
agcacaggtgcgggacgagg

SEQ ID NO: 16722 - DNA, 20 bp, Artificial Sequence
  Description of Artificial Sequence: Synthetic oligonucleotide
  Target: SCN10A; (-) strand; PAM type: NRG; PAM sequence: AGG
aggagcacaggtgcgggacg

SEQ ID NO: 16723 - DNA, 20 bp, Artificial Sequence
  Description of Artificial Sequence: Synthetic oligonucleotide
  Target: SCN10A; (-) strand; PAM type: NRG; PAM sequence: GAG
gaggagcacaggtgcgggac

SEQ ID NO: 16724 - DNA, 20 bp, Artificial Sequence
  Description of Artificial Sequence: Synthetic oligonucleotide
  Target: SCN10A; (-) strand; PAM type: NRG; PAM sequence: GGG
ttagggaggagcacaggtgc

SEQ ID NO: 16725 - DNA, 20 bp, Artificial Sequence
  Description of Artificial Sequence: Synthetic oligonucleotide
  Target: SCN10A; (-) strand; PAM type: NRG; PAM sequence: CGG
tttagggaggagcacaggtg

SEQ ID NO: 16726 - DNA, 20 bp, Artificial Sequence
  Description of Artificial Sequence: Synthetic oligonucleotide
  Target: SCN10A; (-) strand; PAM type: NRG; PAM sequence: AGG
tcagctttagggaggagcac

SEQ ID NO: 16727 - DNA, 20 bp, Artificial Sequence
  Description of Artificial Sequence: Synthetic oligonucleotide
  Target: SCN10A; (-) strand; PAM type: NRG; PAM sequence: CAG
ctcagctttagggaggagca

SEQ ID NO: 16728 - DNA, 20 bp, Artificial Sequence
  Description of Artificial Sequence: Synthetic oligonucleotide
  Target: SCN10A; (-) strand; PAM type: NRG; PAM sequence: GAG
atggcctcagctttagggag

SEQ ID NO: 16729 - DNA, 20 bp, Artificial Sequence
  Description of Artificial Sequence: Synthetic oligonucleotide
  Target: SCN10A; (-) strand; PAM type: NRG; PAM sequence: AGG
gcatggcctcagctttaggg

SEQ ID NO: 16730 - DNA, 20 bp, Artificial Sequence
  Description of Artificial Sequence: Synthetic oligonucleotide
  Target: SCN10A; (-) strand; PAM type: NRG; PAM sequence: GAG
tgcatggcctcagctttagg

SEQ ID NO: 16731 - DNA, 20 bp, Artificial Sequence
  Description of Artificial Sequence: Synthetic oligonucleotide
  Target: SCN10A; (-) strand; PAM type: NRG; PAM sequence: GGG
ggtgcatggcctcagcttta

SEQ ID NO: 16732 - DNA, 20 bp, Artificial Sequence
  Description of Artificial Sequence: Synthetic oligonucleotide
  Target: SCN10A; (-) strand; PAM type: NRG; PAM sequence: AGG
cggtgcatggcctcagcttt

SEQ ID NO: 16733 - DNA, 20 bp, Artificial Sequence
  Description of Artificial Sequence: Synthetic oligonucleotide
  Target: SCN10A; (-) strand; PAM type: NRG; PAM sequence: TAG
tcggtgcatggcctcagctt

SEQ ID NO: 16734 - DNA, 20 bp, Artificial Sequence
  Description of Artificial Sequence: Synthetic oligonucleotide
  Target: SCN10A; (-) strand; PAM type: NRG; PAM sequence: CAG
aactgctcggtgcatggcct

SEQ ID NO: 16735 - DNA, 20 bp, Artificial Sequence
  Description of Artificial Sequence: Synthetic oligonucleotide
  Target: SCN10A; (-) strand; PAM type: NRG; PAM sequence: TGG
tgacaaaactgctcggtgca

SEQ ID NO: 16736 - DNA, 20 bp, Artificial Sequence
  Description of Artificial Sequence: Synthetic oligonucleotide
  Target: SCN10A; (-) strand; PAM type: NRG; PAM sequence: CGG
ggaagggtgacaaaactgct

SEQ ID NO: 16737 - DNA, 20 bp, Artificial Sequence
  Description of Artificial Sequence: Synthetic oligonucleotide
  Target: SCN10A; (-) strand; PAM type: NRG; PAM sequence: GGG
aatgccagattgtccaggaa

SEQ ID NO: 16738 - DNA, 20 bp, Artificial Sequence
  Description of Artificial Sequence: Synthetic oligonucleotide
  Target: SCN10A; (-) strand; PAM type: NRG; PAM sequence: AGG
aaatgccagattgtccagga

SEQ ID NO: 16739 - DNA, 20 bp, Artificial Sequence
  Description of Artificial Sequence: Synthetic oligonucleotide
  Target: SCN10A; (-) strand; PAM type: NRG; PAM sequence: AAG
taaatgccagattgtccagg

SEQ ID NO: 16740 - DNA, 20 bp, Artificial Sequence
  Description of Artificial Sequence: Synthetic oligonucleotide
  Target: SCN10A; (-) strand; PAM type: NRG; PAM sequence: AGG
atctaaatgccagattgtcc

SEQ ID NO: 16741 - DNA, 20 bp, Artificial Sequence
  Description of Artificial Sequence: Synthetic oligonucleotide
  Target: SCN10A; (-) strand; PAM type: NRG; PAM sequence: CAG
catctaaatgccagattgtc

SEQ ID NO: 16742 - DNA, 20 bp, Artificial Sequence
  Description of Artificial Sequence: Synthetic oligonucleotide
  Target: SCN10A; (-) strand; PAM type: NRG; PAM sequence: CAG
ctaggcctccatctaaatgc

SEQ ID NO: 16743 - DNA, 20 bp, Artificial Sequence
  Description of Artificial Sequence: Synthetic oligonucleotide
  Target: SCN10A; (-) strand; PAM type: NRG; PAM sequence: AGG
aaacaacctactaaatatct

SEQ ID NO: 16744 - DNA, 20 bp, Artificial Sequence
  Description of Artificial Sequence: Synthetic oligonucleotide
  Target: SCN10A; (-) strand; PAM type: NRG; PAM sequence: TAG
aaaacaacctactaaatatc

SEQ ID NO: 16745 - DNA, 20 bp, Artificial Sequence
  Description of Artificial Sequence: Synthetic oligonucleotide
  Target: SCN10A; (-) strand; PAM type: NRG; PAM sequence: CAG
gctcttccgattcacggctg

SEQ ID NO: 16746 - DNA, 20 bp, Artificial Sequence
  Description of Artificial Sequence: Synthetic oligonucleotide
  Target: SCN10A; (-) strand; PAM type: NRG; PAM sequence: CGG
agtcccgctcttccgattca

SEQ ID NO: 16747 - DNA, 20 bp, Artificial Sequence
  Description of Artificial Sequence: Synthetic oligonucleotide
  Target: SCN10A; (-) strand; PAM type: NRG; PAM sequence: CAG
tagttgaagggctaggacta

SEQ ID NO: 16748 - DNA, 20 bp, Artificial Sequence
  Description of Artificial Sequence: Synthetic oligonucleotide
  Target: SCN10A; (-) strand; PAM type: NRG; PAM sequence: AGG
agctaattagttgaagggct

SEQ ID NO: 16749 - DNA, 20 bp, Artificial Sequence
  Description of Artificial Sequence: Synthetic oligonucleotide
  Target: SCN10A; (-) strand; PAM type: NRG; PAM sequence: TAG
cagctaattagttgaagggc

SEQ ID NO: 16750 - DNA, 20 bp, Artificial Sequence
  Description of Artificial Sequence: Synthetic oligonucleotide
  Target: SCN10A; (-) strand; PAM type: NRG; PAM sequence: GGG
gtggcagctaattagttgaa

SEQ ID NO: 16751 - DNA, 20 bp, Artificial Sequence
  Description of Artificial Sequence: Synthetic oligonucleotide
  Target: SCN10A; (-) strand; PAM type: NRG; PAM sequence: AGG
ggtggcagctaattagttga

SEQ ID NO: 16752 - DNA, 20 bp, Artificial Sequence
  Description of Artificial Sequence: Synthetic oligonucleotide
  Target: SCN10A; (-) strand; PAM type: NRG; PAM sequence: AAG
gggtggcagctaattagttg

SEQ ID NO: 16753 - DNA, 20 bp, Artificial Sequence
  Description of Artificial Sequence: Synthetic oligonucleotide
  Target: SCN10A; (-) strand; PAM type: NRG; PAM sequence: TAG
agttcagggtggcagctaat

SEQ ID NO: 16754 - DNA, 20 bp, Artificial Sequence
  Description of Artificial Sequence: Synthetic oligonucleotide
  Target: SCN10A; (-) strand; PAM type: NRG; PAM sequence: CAG
gaatagagagttcagggtgg

SEQ ID NO: 16755 - DNA, 20 bp, Artificial Sequence
  Description of Artificial Sequence: Synthetic oligonucleotide
  Target: SCN10A; (-) strand; PAM type: NRG; PAM sequence: TGG
tgggaatagagagttcaggg

SEQ ID NO: 16756 - DNA, 20 bp, Artificial Sequence
  Description of Artificial Sequence: Synthetic oligonucleotide
  Target: SCN10A; (-) strand; PAM type: NRG; PAM sequence: GGG
ggctgggaatagagagttca

SEQ ID NO: 16757 - DNA, 20 bp, Artificial Sequence
  Description of Artificial Sequence: Synthetic oligonucleotide
  Target: SCN10A; (-) strand; PAM type: NRG; PAM sequence: AGG
gggctgggaatagagagttc

SEQ ID NO: 16758 - DNA, 20 bp, Artificial Sequence
  Description of Artificial Sequence: Synthetic oligonucleotide
  Target: SCN10A; (-) strand; PAM type: NRG; PAM sequence: CAG
agggctgggaatagagagtt

SEQ ID NO: 16759 - DNA, 20 bp, Artificial Sequence
  Description of Artificial Sequence: Synthetic oligonucleotide
  Target: SCN10A; (-) strand; PAM type: NRG; PAM sequence: GAG
gttgaagggctgggaataga

SEQ ID NO: 16760 - DNA, 20 bp, Artificial Sequence
  Description of Artificial Sequence: Synthetic oligonucleotide
  Target: SCN10A; (-) strand; PAM type: NRG; PAM sequence: GAG
tagttgaagggctgggaata

SEQ ID NO: 16761 - DNA, 20 bp, Artificial Sequence
  Description of Artificial Sequence: Synthetic oligonucleotide
  Target: SCN10A; (-) strand; PAM type: NRG; PAM sequence: TAG
attagttgaagggctgggaa

SEQ ID NO: 16762 - DNA, 20 bp, Artificial Sequence
  Description of Artificial Sequence: Synthetic oligonucleotide
  Target: SCN10A; (-) strand; PAM type: NRG; PAM sequence: GGG
aggtaattagttgaagggct

SEQ ID NO: 16763 - DNA, 20 bp, Artificial Sequence
  Description of Artificial Sequence: Synthetic oligonucleotide
  Target: SCN10A; (-) strand; PAM type: NRG; PAM sequence: TGG
caggtaattagttgaagggc

SEQ ID NO: 16764 - DNA, 20 bp, Artificial Sequence
  Description of Artificial Sequence: Synthetic oligonucleotide
  Target: SCN10A; (-) strand; PAM type: NRG; PAM sequence: GGG
gcttcaggtaattagttgaa

SEQ ID NO: 16765 - DNA, 20 bp, Artificial Sequence
  Description of Artificial Sequence: Synthetic oligonucleotide
  Target: SCN10A; (-) strand; PAM type: NRG; PAM sequence: AGG
ggcttcaggtaattagttga

SEQ ID NO: 16766 - DNA, 20 bp, Artificial Sequence
  Description of Artificial Sequence: Synthetic oligonucleotide
  Target: SCN10A; (-) strand; PAM type: NRG; PAM sequence: AAG
gggcttcaggtaattagttg

SEQ ID NO: 16767 - DNA, 20 bp, Artificial Sequence
  Description of Artificial Sequence: Synthetic oligonucleotide
  Target: SCN10A; (-) strand; PAM type: NRG; PAM sequence: TAG
catgaggggcttcaggtaat

SEQ ID NO: 16768 - DNA, 20 bp, Artificial Sequence
  Description of Artificial Sequence: Synthetic oligonucleotide
  Target: SCN10A; (-) strand; PAM type: NRG; PAM sequence: AGG
ccaaaggcatgaggggcttc

SEQ ID NO: 16769 - DNA, 20 bp, Artificial Sequence
  Description of Artificial Sequence: Synthetic oligonucleotide
  Target: SCN10A; (-) strand; PAM type: NRG; PAM sequence: CAG
cccaaaggcatgaggggctt

SEQ ID NO: 16770 - DNA, 20 bp, Artificial Sequence
  Description of Artificial Sequence: Synthetic oligonucleotide
  Target: SCN10A; (-) strand; PAM type: NRG; PAM sequence: GGG
tcaaagcccaaaggcatgag

SEQ ID NO: 16771 - DNA, 20 bp, Artificial Sequence
  Description of Artificial Sequence: Synthetic oligonucleotide
  Target: SCN10A; (-) strand; PAM type: NRG; PAM sequence: GGG
gtcaaagcccaaaggcatga

SEQ ID NO: 16772 - DNA, 20 bp, Artificial Sequence
  Description of Artificial Sequence: Synthetic oligonucleotide
  Target: SCN10A; (-) strand; PAM type: NRG; PAM sequence: AGG
agtcaaagcccaaaggcatg

SEQ ID NO: 16773 - DNA, 20 bp, Artificial Sequence
  Description of Artificial Sequence: Synthetic oligonucleotide
  Target: SCN10A; (-) strand; PAM type: NRG; PAM sequence: GAG
aagtcaaagcccaaaggcat

SEQ ID NO: 16774 - DNA, 20 bp, Artificial Sequence
  Description of Artificial Sequence: Synthetic oligonucleotide
  Target: SCN10A; (-) strand; PAM type: NRG; PAM sequence: AGG
atgaggaagtcaaagcccaa

SEQ ID NO: 16775 - DNA, 20 bp, Artificial Sequence
  Description of Artificial Sequence: Synthetic oligonucleotide
  Target: SCN10A; (-) strand; PAM type: NRG; PAM sequence: AAG
aatgaggaagtcaaagccca

SEQ ID NO: 16776 - DNA, 20 bp, Artificial Sequence
  Description of Artificial Sequence: Synthetic oligonucleotide
  Target: SCN10A; (-) strand; PAM type: NRG; PAM sequence: AAG
ttttctaaatgaggaagtca

SEQ ID NO: 16777 - DNA, 20 bp, Artificial Sequence
  Description of Artificial Sequence: Synthetic oligonucleotide
  Target: SCN10A; (-) strand; PAM type: NRG; PAM sequence: AAG
tttgcattttctaaatgagg

SEQ ID NO: 16778 - DNA, 20 bp, Artificial Sequence
  Description of Artificial Sequence: Synthetic oligonucleotide
  Target: SCN10A; (-) strand; PAM type: NRG; PAM sequence: AGG
ttgtttgcattttctaaatg

SEQ ID NO: 16779 - DNA, 20 bp, Artificial Sequence
  Description of Artificial Sequence: Synthetic oligonucleotide
  Target: SCN10A; (-) strand; PAM type: NRG; PAM sequence: GAG
gttgtttgcattttctaaat

SEQ ID NO: 16780 - DNA, 20 bp, Artificial Sequence
  Description of Artificial Sequence: Synthetic oligonucleotide
  Target: SCN10A; (-) strand; PAM type: NRG; PAM sequence: CAG
aggaaggaacttaacatcct

SEQ ID NO: 16781 - DNA, 20 bp, Artificial Sequence
  Description of Artificial Sequence: Synthetic oligonucleotide
  Target: SCN10A; (-) strand; PAM type: NRG; PAM sequence: AGG
aggtagacatagacacagga

SEQ ID NO: 16782 - DNA, 20 bp, Artificial Sequence
  Description of Artificial Sequence: Synthetic oligonucleotide
  Target: SCN10A; (-) strand; PAM type: NRG; PAM sequence: AAG
aaggtagacatagacacagg

SEQ ID NO: 16783 - DNA, 20 bp, Artificial Sequence
  Description of Artificial Sequence: Synthetic oligonucleotide
  Target: SCN10A; (-) strand; PAM type: NRG; PAM sequence: AGG
accaaggtagacatagacac

SEQ ID NO: 16784 - DNA, 20 bp, Artificial Sequence
  Description of Artificial Sequence: Synthetic oligonucleotide
  Target: SCN10A; (-) strand; PAM type: NRG; PAM sequence: CAG
gaccaaggtagacatagaca

SEQ ID NO: 16785 - DNA, 20 bp, Artificial Sequence
  Description of Artificial Sequence: Synthetic oligonucleotide
  Target: SCN10A; (-) strand; PAM type: NRG; PAM sequence: TAG
ccaatagaccaaggtagaca

SEQ ID NO: 16786 - DNA, 20 bp, Artificial Sequence
  Description of Artificial Sequence: Synthetic oligonucleotide
  Target: SCN10A; (-) strand; PAM type: NRG; PAM sequence: TAG
actccgccaatagaccaagg

SEQ ID NO: 16787 - DNA, 20 bp, Artificial Sequence
  Description of Artificial Sequence: Synthetic oligonucleotide
  Target: SCN10A; (-) strand; PAM type: NRG; PAM sequence: AGG
actactccgccaatagacca

SEQ ID NO: 16788 - DNA, 20 bp, Artificial Sequence
  Description of Artificial Sequence: Synthetic oligonucleotide
  Target: SCN10A; (-) strand; PAM type: NRG; PAM sequence: AAG
aactactccgccaatagacc

SEQ ID NO: 16789 - DNA, 20 bp, Artificial Sequence
  Description of Artificial Sequence: Synthetic oligonucleotide
  Target: SCN10A; (-) strand; PAM type: NRG; PAM sequence: TAG
aatctcaactactccgccaa

SEQ ID NO: 16790 - DNA, 20 bp, Artificial Sequence
  Description of Artificial Sequence: Synthetic oligonucleotide
  Target: SCN10A; (-) strand; PAM type: NRG; PAM sequence: AAG
ttctctctgtactgtggctt

SEQ ID NO: 16791 - DNA, 20 bp, Artificial Sequence
  Description of Artificial Sequence: Synthetic oligonucleotide
  Target: SCN10A; (-) strand; PAM type: NRG; PAM sequence: TGG
ggaaggttctctctgtactg

SEQ ID NO: 16792 - DNA, 20 bp, Artificial Sequence
  Description of Artificial Sequence: Synthetic oligonucleotide
  Target: SCN10A; (-) strand; PAM type: NRG; PAM sequence: AGG
ctttgtagagcaaagaagga

SEQ ID NO: 16793 - DNA, 20 bp, Artificial Sequence
  Description of Artificial Sequence: Synthetic oligonucleotide
  Target: SCN10A; (-) strand; PAM type: NRG; PAM sequence: AAG
gctttgtagagcaaagaagg

SEQ ID NO: 16794 - DNA, 20 bp, Artificial Sequence
  Description of Artificial Sequence: Synthetic oligonucleotide
  Target: SCN10A; (-) strand; PAM type: NRG; PAM sequence: AGG
tgggctttgtagagcaaaga

SEQ ID NO: 16795 - DNA, 20 bp, Artificial Sequence
  Description of Artificial Sequence: Synthetic oligonucleotide
  Target: SCN10A; (-) strand; PAM type: NRG; PAM sequence: AAG
ctgggctttgtagagcaaag

SEQ ID NO: 16796 - DNA, 20 bp, Artificial Sequence
  Description of Artificial Sequence: Synthetic oligonucleotide
  Target: SCN10A; (-) strand; PAM type: NRG; PAM sequence: AAG
atactgggctttgtagagca

SEQ ID NO: 16797 - DNA, 20 bp, Artificial Sequence
  Description of Artificial Sequence: Synthetic oligonucleotide
  Target: SCN10A; (-) strand; PAM type: NRG; PAM sequence: GAG
gctgaatactgggctttgta

SEQ ID NO: 16798 - DNA, 20 bp, Artificial Sequence
  Description of Artificial Sequence: Synthetic oligonucleotide
  Target: SCN10A; (-) strand; PAM type: NRG; PAM sequence: TAG
tggctgaatactgggctttg

SEQ ID NO: 16799 - DNA, 20 bp, Artificial Sequence
  Description of Artificial Sequence: Synthetic oligonucleotide
  Target: SCN10A; (-) strand; PAM type: NRG; PAM sequence: GGG
taaggccctggctgaatact

SEQ ID NO: 16800 - DNA, 20 bp, Artificial Sequence
  Description of Artificial Sequence: Synthetic oligonucleotide
  Target: SCN10A; (-) strand; PAM type: NRG; PAM sequence: TGG
ctaaggccctggctgaatac

SEQ ID NO: 16801 - DNA, 20 bp, Artificial Sequence
  Description of Artificial Sequence: Synthetic oligonucleotide
  Target: SCN10A; (-) strand; PAM type: NRG; PAM sequence: TGG
gggagacatctctaaggccc

SEQ ID NO: 16802 - DNA, 20 bp, Artificial Sequence
  Description of Artificial Sequence: Synthetic oligonucleotide
  Target: SCN10A; (-) strand; PAM type: NRG; PAM sequence: AGG
agagttgggagacatctcta

SEQ ID NO: 16803 - DNA, 20 bp, Artificial Sequence
  Description of Artificial Sequence: Synthetic oligonucleotide
  Target: SCN10A; (-) strand; PAM type: NRG; PAM sequence: AAG
cagagttgggagacatctct

SEQ ID NO: 16804 - DNA, 20 bp, Artificial Sequence
  Description of Artificial Sequence: Synthetic oligonucleotide
  Target: SCN10A; (-) strand; PAM type: NRG; PAM sequence: GAG
gaatagagattcagagttgg

SEQ ID NO: 16805 - DNA, 20 bp, Artificial Sequence
  Description of Artificial Sequence: Synthetic oligonucleotide
  Target: SCN10A; (-) strand; PAM type: NRG; PAM sequence: GGG
gggaatagagattcagagtt

SEQ ID NO: 16806 - DNA, 20 bp, Artificial Sequence
  Description of Artificial Sequence: Synthetic oligonucleotide
  Target: SCN10A; (-) strand; PAM type: NRG; PAM sequence: TGG
tgggaatagagattcagagt

SEQ ID NO: 16807 - DNA, 20 bp, Artificial Sequence
  Description of Artificial Sequence: Synthetic oligonucleotide
  Target: SCN10A; (-) strand; PAM type: NRG; PAM sequence: GAG
cttatgggaatagagattca

SEQ ID NO: 16808 - DNA, 20 bp, Artificial Sequence
  Description of Artificial Sequence: Synthetic oligonucleotide
  Target: SCN10A; (-) strand; PAM type: NRG; PAM sequence: CAG
gccttatgggaatagagatt

SEQ ID NO: 16809 - DNA, 20 bp, Artificial Sequence
  Description of Artificial Sequence: Synthetic oligonucleotide
  Target: SCN10A; (-) strand; PAM type: NRG; PAM sequence: GAG
aacaaggccttatgggaata

SEQ ID NO: 16810 - DNA, 20 bp, Artificial Sequence
  Description of Artificial Sequence: Synthetic oligonucleotide
  Target: SCN10A; (-) strand; PAM type: NRG; PAM sequence: TAG
ataacaaggccttatgggaa

SEQ ID NO: 16811 - DNA, 20 bp, Artificial Sequence
  Description of Artificial Sequence: Synthetic oligonucleotide
  Target: SCN10A; (-) strand; PAM type: NRG; PAM sequence: GGG
tttgaataacaaggccttat

SEQ ID NO: 16812 - DNA, 20 bp, Artificial Sequence
  Description of Artificial Sequence: Synthetic oligonucleotide
  Target: SCN10A; (-) strand; PAM type: NRG; PAM sequence: TGG
ctttgaataacaaggcctta

SEQ ID NO: 16813 - DNA, 20 bp, Artificial Sequence
  Description of Artificial Sequence: Synthetic oligonucleotide
  Target: SCN10A; (-) strand; PAM type: NRG; PAM sequence: AGG
gacccacactttgaataaca

SEQ ID NO: 16814 - DNA, 20 bp, Artificial Sequence
  Description of Artificial Sequence: Synthetic oligonucleotide
  Target: SCN10A; (-) strand; PAM type: NRG; PAM sequence: AAG
tgacccacactttgaataac

SEQ ID NO: 16815 - DNA, 20 bp, Artificial Sequence
  Description of Artificial Sequence: Synthetic oligonucleotide
  Target: SCN10A; (-) strand; PAM type: NRG; PAM sequence: CAG
ggtgatgcttgcactgccct

SEQ ID NO: 16816 - DNA, 20 bp, Artificial Sequence
  Description of Artificial Sequence: Synthetic oligonucleotide
  Target: SCN10A; (-) strand; PAM type: NRG; PAM sequence: AGG
tgcatttctaacaagctccc

SEQ ID NO: 16817 - DNA, 20 bp, Artificial Sequence
  Description of Artificial Sequence: Synthetic oligonucleotide
  Target: SCN10A; (-) strand; PAM type: NRG; PAM sequence: CAG
ttgcatttctaacaagctcc

SEQ ID NO: 16818 - DNA, 20 bp, Artificial Sequence
  Description of Artificial Sequence: Synthetic oligonucleotide
  Target: SCN10A; (-) strand; PAM type: NRG; PAM sequence: AAG
tgagaatttgcatttctaac

SEQ ID NO: 16819 - DNA, 20 bp, Artificial Sequence
  Description of Artificial Sequence: Synthetic oligonucleotide
  Target: SCN10A; (-) strand; PAM type: NRG; PAM sequence: GAG
ataaatctgtggcagggcct

SEQ ID NO: 16820 - DNA, 20 bp, Artificial Sequence
  Description of Artificial Sequence: Synthetic oligonucleotide
  Target: SCN10A; (-) strand; PAM type: NRG; PAM sequence: GGG
cattccataaatctgtggca

SEQ ID NO: 16821 - DNA, 20 bp, Artificial Sequence
  Description of Artificial Sequence: Synthetic oligonucleotide
  Target: SCN10A; (-) strand; PAM type: NRG; PAM sequence: AGG
tcattccataaatctgtggc

SEQ ID NO: 16822 - DNA, 20 bp, Artificial Sequence
  Description of Artificial Sequence: Synthetic oligonucleotide
  Target: SCN10A; (-) strand; PAM type: NRG; PAM sequence: CAG
ctcattccataaatctgtgg

SEQ ID NO: 16823 - DNA, 20 bp, Artificial Sequence
  Description of Artificial Sequence: Synthetic oligonucleotide
  Target: SCN10A; (-) strand; PAM type: NRG; PAM sequence: TGG
attctcattccataaatctg

SEQ ID NO: 16824 - DNA, 20 bp, Artificial Sequence
  Description of Artificial Sequence: Synthetic oligonucleotide
  Target: SCN10A; (-) strand; PAM type: NRG; PAM sequence: CAG
cccaggagcttgttcaaatg

SEQ ID NO: 16825 - DNA, 20 bp, Artificial Sequence
  Description of Artificial Sequence: Synthetic oligonucleotide
  Target: SCN10A; (-) strand; PAM type: NRG; PAM sequence: GAG
ctcaaaatttaatctcccag

SEQ ID NO: 16826 - DNA, 20 bp, Artificial Sequence
  Description of Artificial Sequence: Synthetic oligonucleotide
  Target: SCN10A; (-) strand; PAM type: NRG; PAM sequence: AGG
ttctcaaaatttaatctccc

SEQ ID NO: 16827 - DNA, 20 bp, Artificial Sequence
  Description of Artificial Sequence: Synthetic oligonucleotide
  Target: SCN10A; (-) strand; PAM type: NRG; PAM sequence: CAG
cttctcaaaatttaatctcc

SEQ ID NO: 16828 - DNA, 20 bp, Artificial Sequence
  Description of Artificial Sequence: Synthetic oligonucleotide
  Target: SCN10A; (-) strand; PAM type: NRG; PAM sequence: TAG
ctcacagaaaatcattacaa

SEQ ID NO: 16829 - DNA, 20 bp, Artificial Sequence
  Description of Artificial Sequence: Synthetic oligonucleotide
  Target: SCN10A; (-) strand; PAM type: NRG; PAM sequence: CAG
aattactcctttaaagctca

SEQ ID NO: 16830 - DNA, 20 bp, Artificial Sequence
  Description of Artificial Sequence: Synthetic oligonucleotide
  Target: SCN10A; (-) strand; PAM type: NRG; PAM sequence: AAG
tgctactaattactccttta

SEQ ID NO: 16831 - DNA, 20 bp, Artificial Sequence
  Description of Artificial Sequence: Synthetic oligonucleotide
  Target: SCN10A; (-) strand; PAM type: NRG; PAM sequence: AGG
tgaaggcctacaatacaaaa

SEQ ID NO: 16832 - DNA, 20 bp, Artificial Sequence
  Description of Artificial Sequence: Synthetic oligonucleotide
  Target: SCN10A; (-) strand; PAM type: NRG; PAM sequence: AAG
ctgaaggcctacaatacaaa

SEQ ID NO: 16833 - DNA, 20 bp, Artificial Sequence
  Description of Artificial Sequence: Synthetic oligonucleotide
  Target: SCN10A; (-) strand; PAM type: NRG; PAM sequence: AGG
caacacacggccttctctga

SEQ ID NO: 16834 - DNA, 20 bp, Artificial Sequence
  Description of Artificial Sequence: Synthetic oligonucleotide
  Target: SCN10A; (-) strand; PAM type: NRG; PAM sequence: AAG
ccaacacacggccttctctg

SEQ ID NO: 16835 - DNA, 20 bp, Artificial Sequence
  Description of Artificial Sequence: Synthetic oligonucleotide
  Target: SCN10A; (-) strand; PAM type: NRG; PAM sequence: CGG
cctctgacctccccaacaca

SEQ ID NO: 16836 - DNA, 20 bp, Artificial Sequence
  Description of Artificial Sequence: Synthetic oligonucleotide
  Target: SCN10A; (-) strand; PAM type: NRG; PAM sequence: TGG
ttatttaatcccgaagcccc

SEQ ID NO: 16837 - DNA, 20 bp, Artificial Sequence
  Description of Artificial Sequence: Synthetic oligonucleotide
  Target: SCN10A; (-) strand; PAM type: NRG; PAM sequence: AAG
tttgcccttatttaatcccg

SEQ ID NO: 16838 - DNA, 20 bp, Artificial Sequence
  Description of Artificial Sequence: Synthetic oligonucleotide
  Target: SCN10A; (-) strand; PAM type: NRG; PAM sequence: CAG
aacttgtcagtagcaaaacc

SEQ ID NO: 16839 - DNA, 20 bp, Artificial Sequence
  Description of Artificial Sequence: Synthetic oligonucleotide
  Target: SCN10A; (-) strand; PAM type: NRG; PAM sequence: TAG
aaggtcacccaacttgtcag

SEQ ID NO: 16840 - DNA, 20 bp, Artificial Sequence
  Description of Artificial Sequence: Synthetic oligonucleotide
  Target: SCN10A; (-) strand; PAM type: NRG; PAM sequence: CAG
tccaaggtcacccaacttgt

SEQ ID NO: 16841 - DNA, 20 bp, Artificial Sequence
  Description of Artificial Sequence: Synthetic oligonucleotide
  Target: SCN10A; (-) strand; PAM type: NRG; PAM sequence: AGG
atgtttaaaaggcttgtcca

SEQ ID NO: 16842 - DNA, 20 bp, Artificial Sequence
  Description of Artificial Sequence: Synthetic oligonucleotide
  Target: SCN10A; (-) strand; PAM type: NRG; PAM sequence: AAG
aatgtttaaaaggcttgtcc

SEQ ID NO: 16843 - DNA, 20 bp, Artificial Sequence
  Description of Artificial Sequence: Synthetic oligonucleotide
  Target: SCN10A; (-) strand; PAM type: NRG; PAM sequence: AGG
tgacactcaaaatgtttaaa

SEQ ID NO: 16844 - DNA, 20 bp, Artificial Sequence
  Description of Artificial Sequence: Synthetic oligonucleotide
  Target: SCN10A; (-) strand; PAM type: NRG; PAM sequence: AAG
ctgacactcaaaatgtttaa

SEQ ID NO: 16845 - DNA, 20 bp, Artificial Sequence
  Description of Artificial Sequence: Synthetic oligonucleotide
  Target: SCN10A; (-) strand; PAM type: NRG; PAM sequence: GGG
tgcctcccactatatagatg

SEQ ID NO: 16846 - DNA, 20 bp, Artificial Sequence
  Description of Artificial Sequence: Synthetic oligonucleotide
  Target: SCN10A; (-) strand; PAM type: NRG; PAM sequence: GGG
atgcctcccactatatagat

SEQ ID NO: 16847 - DNA, 20 bp, Artificial Sequence
  Description of Artificial Sequence: Synthetic oligonucleotide
  Target: SCN10A; (-) strand; PAM type: NRG; PAM sequence: TGG
tatgcctcccactatataga

SEQ ID NO: 16848 - DNA, 20 bp, Artificial Sequence
  Description of Artificial Sequence: Synthetic oligonucleotide
  Target: SCN10A; (-) strand; PAM type: NRG; PAM sequence: TAG
agtgtatgcctcccactata

SEQ ID NO: 16849 - DNA, 20 bp, Artificial Sequence
  Description of Artificial Sequence: Synthetic oligonucleotide
  Target: SCN10A; (-) strand; PAM type: NRG; PAM sequence: GAG
ctgcaagcatttgagtgagt

SEQ ID NO: 16850 - DNA, 20 bp, Artificial Sequence
  Description of Artificial Sequence: Synthetic oligonucleotide
  Target: SCN10A; (-) strand; PAM type: NRG; PAM sequence: GAG
ctggctgcaagcatttgagt

SEQ ID NO: 16851 - DNA, 20 bp, Artificial Sequence
  Description of Artificial Sequence: Synthetic oligonucleotide
  Target: SCN10A; (-) strand; PAM type: NRG; PAM sequence: GAG
aaacctggctgcaagcattt

SEQ ID NO: 16852 - DNA, 20 bp, Artificial Sequence
  Description of Artificial Sequence: Synthetic oligonucleotide
  Target: SCN10A; (-) strand; PAM type: NRG; PAM sequence: AAG
ggcctgccaaacctggctgc

SEQ ID NO: 16853 - DNA, 20 bp, Artificial Sequence
  Description of Artificial Sequence: Synthetic oligonucleotide
  Target: SCN10A; (-) strand; PAM type: NRG; PAM sequence: TGG
gtgccatggcctgccaaacc

SEQ ID NO: 16854 - DNA, 20 bp, Artificial Sequence
  Description of Artificial Sequence: Synthetic oligonucleotide
  Target: SCN10A; (-) strand; PAM type: NRG; PAM sequence: TGG
tgttcaaggtgcccgtgcca

SEQ ID NO: 16855 - DNA, 20 bp, Artificial Sequence
  Description of Artificial Sequence: Synthetic oligonucleotide
  Target: SCN10A; (-) strand; PAM type: NRG; PAM sequence: AGG
cagagcatgggaggtgttca

SEQ ID NO: 16856 - DNA, 20 bp, Artificial Sequence
  Description of Artificial Sequence: Synthetic oligonucleotide
  Target: SCN10A; (-) strand; PAM type: NRG; PAM sequence: AAG
gcagagcatgggaggtgttc

SEQ ID NO: 16857 - DNA, 20 bp, Artificial Sequence
  Description of Artificial Sequence: Synthetic oligonucleotide
  Target: SCN10A; (-) strand; PAM type: NRG; PAM sequence: AGG
tcttagcagcagagcatggg

SEQ ID NO: 16858 - DNA, 20 bp, Artificial Sequence
  Description of Artificial Sequence: Synthetic oligonucleotide
  Target: SCN10A; (-) strand; PAM type: NRG; PAM sequence: GAG
ctcttagcagcagagcatgg

SEQ ID NO: 16859 - DNA, 20 bp, Artificial Sequence
  Description of Artificial Sequence: Synthetic oligonucleotide
  Target: SCN10A; (-) strand; PAM type: NRG; PAM sequence: GGG
ccctcttagcagcagagcat

SEQ ID NO: 16860 - DNA, 20 bp, Artificial Sequence
  Description of Artificial Sequence: Synthetic oligonucleotide
  Target: SCN10A; (-) strand; PAM type: NRG; PAM sequence: TGG
cccctcttagcagcagagca

SEQ ID NO: 16861 - DNA, 20 bp, Artificial Sequence
  Description of Artificial Sequence: Synthetic oligonucleotide
  Target: SCN10A; (-) strand; PAM type: NRG; PAM sequence: GAG
gagggcccctcttagcagca

SEQ ID NO: 16862 - DNA, 20 bp, Artificial Sequence
  Description of Artificial Sequence: Synthetic oligonucleotide
  Target: SCN10A; (-) strand; PAM type: NRG; PAM sequence: CAG
gcgagggcccctcttagcag

SEQ ID NO: 16863 - DNA, 20 bp, Artificial Sequence
  Description of Artificial Sequence: Synthetic oligonucleotide
  Target: SCN10A; (-) strand; PAM type: NRG; PAM sequence: CAG
agggcgagggcccctcttag

SEQ ID NO: 16864 - DNA, 20 bp, Artificial Sequence
  Description of Artificial Sequence: Synthetic oligonucleotide
  Target: SCN10A; (-) strand; PAM type: NRG; PAM sequence: TAG
cccagggcgagggcccctct

SEQ ID NO: 16865 - DNA, 20 bp, Artificial Sequence
  Description of Artificial Sequence: Synthetic oligonucleotide
  Target: SCN10A; (-) strand; PAM type: NRG; PAM sequence: GGG
agagctgcagcccagggcga

SEQ ID NO: 16866 - DNA, 20 bp, Artificial Sequence
  Description of Artificial Sequence: Synthetic oligonucleotide
  Target: SCN10A; (-) strand; PAM type: NRG; PAM sequence: AGG
gagagctgcagcccagggcg

SEQ ID NO: 16867 - DNA, 20 bp, Artificial Sequence
  Description of Artificial Sequence: Synthetic oligonucleotide
  Target: SCN10A; (-) strand; PAM type: NRG; PAM sequence: GAG
ggagagctgcagcccagggc

SEQ ID NO: 16868 - DNA, 20 bp, Artificial Sequence
  Description of Artificial Sequence: Synthetic oligonucleotide
  Target: SCN10A; (-) strand; PAM type: NRG; PAM sequence: GGG
agaaggagagctgcagccca

SEQ ID NO: 16869 - DNA, 20 bp, Artificial Sequence
  Description of Artificial Sequence: Synthetic oligonucleotide
  Target: SCN10A; (-) strand; PAM type: NRG; PAM sequence: AGG
tagaaggagagctgcagccc

SEQ ID NO: 16870 - DNA, 20 bp, Artificial Sequence
  Description of Artificial Sequence: Synthetic oligonucleotide
  Target: SCN10A; (-) strand; PAM type: NRG; PAM sequence: CAG
ctagaaggagagctgcagcc

SEQ ID NO: 16871 - DNA, 20 bp, Artificial Sequence
  Description of Artificial Sequence: Synthetic oligonucleotide
  Target: SCN10A; (-) strand; PAM type: NRG; PAM sequence: CAG
tgtcactagaaggagagctg

SEQ ID NO: 16872 - DNA, 20 bp, Artificial Sequence
  Description of Artificial Sequence: Synthetic oligonucleotide
  Target: SCN10A; (-) strand; PAM type: NRG; PAM sequence: GAG
caaccttgtcactagaagga

SEQ ID NO: 16873 - DNA, 20 bp, Artificial Sequence
  Description of Artificial Sequence: Synthetic oligonucleotide
  Target: SCN10A; (-) strand; PAM type: NRG; PAM sequence: GAG
cccaaccttgtcactagaag

SEQ ID NO: 16874 - DNA, 20 bp, Artificial Sequence
  Description of Artificial Sequence: Synthetic oligonucleotide
  Target: SCN10A; (-) strand; PAM type: NRG; PAM sequence: AGG
tccccaaccttgtcactaga

SEQ ID NO: 16875 - DNA, 20 bp, Artificial Sequence
  Description of Artificial Sequence: Synthetic oligonucleotide
  Target: SCN10A; (-) strand; PAM type: NRG; PAM sequence: AAG
gtccccaaccttgtcactag

SEQ ID NO: 16876 - DNA, 20 bp, Artificial Sequence
  Description of Artificial Sequence: Synthetic oligonucleotide
  Target: SCN10A; (-) strand; PAM type: NRG; PAM sequence: TAG
aaagtccccaaccttgtcac

SEQ ID NO: 16877 - DNA, 20 bp, Artificial Sequence
  Description of Artificial Sequence: Synthetic oligonucleotide
  Target: SCN10A; (-) strand; PAM type: NRG; PAM sequence: AAG
tctcctgactactgagctga

SEQ ID NO: 16878 - DNA, 20 bp, Artificial Sequence
  Description of Artificial Sequence: Synthetic oligonucleotide
  Target: SCN10A; (-) strand; PAM type: NRG; PAM sequence: GAG
agtgggttctcctgactact

SEQ ID NO: 16879 - DNA, 20 bp, Artificial Sequence
  Description of Artificial Sequence: Synthetic oligonucleotide
  Target: SCN10A; (-) strand; PAM type: NRG; PAM sequence: GGG
ggccctggagctgcatcagt

SEQ ID NO: 16880 - DNA, 20 bp, Artificial Sequence
  Description of Artificial Sequence: Synthetic oligonucleotide
  Target: SCN10A; (-) strand; PAM type: NRG; PAM sequence: TGG
aggccctggagctgcatcag

SEQ ID NO: 16881 - DNA, 20 bp, Artificial Sequence
  Description of Artificial Sequence: Synthetic oligonucleotide
  Target: SCN10A; (-) strand; PAM type: NRG; PAM sequence: CAG
caaaggccctggagctgcat

SEQ ID NO: 16882 - DNA, 20 bp, Artificial Sequence
  Description of Artificial Sequence: Synthetic oligonucleotide
  Target: SCN10A; (-) strand; PAM type: NRG; PAM sequence: GAG
cctacaatccaaaggccctg

SEQ ID NO: 16883 - DNA, 20 bp, Artificial Sequence
  Description of Artificial Sequence: Synthetic oligonucleotide
  Target: SCN10A; (-) strand; PAM type: NRG; PAM sequence: TGG
ctcctacaatccaaaggccc

SEQ ID NO: 16884 - DNA, 20 bp, Artificial Sequence
  Description of Artificial Sequence: Synthetic oligonucleotide
  Target: SCN10A; (-) strand; PAM type: NRG; PAM sequence: AGG
aggaatctcctacaatccaa

SEQ ID NO: 16885 - DNA, 20 bp, Artificial Sequence
  Description of Artificial Sequence: Synthetic oligonucleotide
  Target: SCN10A; (-) strand; PAM type: NRG; PAM sequence: AAG
taggaatctcctacaatcca

SEQ ID NO: 16886 - DNA, 20 bp, Artificial Sequence
  Description of Artificial Sequence: Synthetic oligonucleotide
  Target: SCN10A; (-) strand; PAM type: NRG; PAM sequence: AGG
tgcccccaaatcctccagat

SEQ ID NO: 16887 - DNA, 20 bp, Artificial Sequence
  Description of Artificial Sequence: Synthetic oligonucleotide
  Target: SCN10A; (-) strand; PAM type: NRG; PAM sequence: TAG
ctgcccccaaatcctccaga

SEQ ID NO: 16888 - DNA, 20 bp, Artificial Sequence
  Description of Artificial Sequence: Synthetic oligonucleotide
  Target: SCN10A; (-) strand; PAM type: NRG; PAM sequence: CAG
gtccctgcccccaaatcctc

SEQ ID NO: 16889 - DNA, 20 bp, Artificial Sequence
  Description of Artificial Sequence: Synthetic oligonucleotide
  Target: SCN10A; (-) strand; PAM type: NRG; PAM sequence: TAG
atctctggtaaggggaggca

SEQ ID NO: 16890 - DNA, 20 bp, Artificial Sequence
  Description of Artificial Sequence: Synthetic oligonucleotide
  Target: SCN10A; (-) strand; PAM type: NRG; PAM sequence: AGG
agtggatctctggtaagggg

SEQ ID NO: 16891 - DNA, 20 bp, Artificial Sequence
  Description of Artificial Sequence: Synthetic oligonucleotide
  Target: SCN10A; (-) strand; PAM type: NRG; PAM sequence: GAG
cagtggatctctggtaaggg

SEQ ID NO: 16892 - DNA, 20 bp, Artificial Sequence
  Description of Artificial Sequence: Synthetic oligonucleotide
  Target: SCN10A; (-) strand; PAM type: NRG; PAM sequence: GGG
agcagtggatctctggtaag

SEQ ID NO: 16893 - DNA, 20 bp, Artificial Sequence
  Description of Artificial Sequence: Synthetic oligonucleotide
  Target: SCN10A; (-) strand; PAM type: NRG; PAM sequence: GGG
cagcagtggatctctggtaa

SEQ ID NO: 16894 - DNA, 20 bp, Artificial Sequence
  Description of Artificial Sequence: Synthetic oligonucleotide
  Target: SCN10A; (-) strand; PAM type: NRG; PAM sequence: AGG
tcagcagtggatctctggta

SEQ ID NO: 16895 - DNA, 20 bp, Artificial Sequence
  Description of Artificial Sequence: Synthetic oligonucleotide
  Target: SCN10A; (-) strand; PAM type: NRG; PAM sequence: AAG
ctcagcagtggatctctggt

SEQ ID NO: 16896 - DNA, 20 bp, Artificial Sequence
  Description of Artificial Sequence: Synthetic oligonucleotide
  Target: SCN10A; (-) strand; PAM type: NRG; PAM sequence: TGG
cctgctcagcagtggatctc

SEQ ID NO: 16897 - DNA, 20 bp, Artificial Sequence
  Description of Artificial Sequence: Synthetic oligonucleotide
  Target: SCN10A; (-) strand; PAM type: NRG; PAM sequence: TGG
ttcatgatcctgctcagcag

SEQ ID NO: 16898 - DNA, 20 bp, Artificial Sequence
  Description of Artificial Sequence: Synthetic oligonucleotide
  Target: SCN10A; (-) strand; PAM type: NRG; PAM sequence: CAG
atcttcatgatcctgctcag

SEQ ID NO: 16899 - DNA, 20 bp, Artificial Sequence
  Description of Artificial Sequence: Synthetic oligonucleotide
  Target: SCN10A; (-) strand; PAM type: NRG; PAM sequence: CAG
atcatcttcatgatcctgct

SEQ ID NO: 16900 - DNA, 20 bp, Artificial Sequence
  Description of Artificial Sequence: Synthetic oligonucleotide
  Target: SCN10A; (-) strand; PAM type: NRG; PAM sequence: GAG
gtggagcacagctggtttga

SEQ ID NO: 16901 - DNA, 20 bp, Artificial Sequence
  Description of Artificial Sequence: Synthetic oligonucleotide
  Target: SCN10A; (-) strand; PAM type: NRG; PAM sequence: GAG
tcgtggagcacagctggttt

SEQ ID NO: 16902 - DNA, 20 bp, Artificial Sequence
  Description of Artificial Sequence: Synthetic oligonucleotide
  Target: SCN10A; (-) strand; PAM type: NRG; PAM sequence: TGG
accgtatcgtggagcacagc

SEQ ID NO: 16903 - DNA, 20 bp, Artificial Sequence
  Description of Artificial Sequence: Synthetic oligonucleotide
  Target: SCN10A; (-) strand; PAM type: NRG; PAM sequence: CAG
tgctaccgtatcgtggagca

SEQ ID NO: 16904 - DNA, 20 bp, Artificial Sequence
  Description of Artificial Sequence: Synthetic oligonucleotide
  Target: SCN10A; (-) strand; PAM type: NRG; PAM sequence: GAG
agacttgctaccgtatcgtg

SEQ ID NO: 16905 - DNA, 20 bp, Artificial Sequence
  Description of Artificial Sequence: Synthetic oligonucleotide
  Target: SCN10A; (-) strand; PAM type: NRG; PAM sequence: TGG
caagacttgctaccgtatcg

SEQ ID NO: 16906 - DNA, 20 bp, Artificial Sequence
  Description of Artificial Sequence: Synthetic oligonucleotide
  Target: SCN10A; (-) strand; PAM type: NRG; PAM sequence: AAG
atgtgggctggcaggtgcgc

SEQ ID NO: 16907 - DNA, 20 bp, Artificial Sequence
  Description of Artificial Sequence: Synthetic oligonucleotide
  Target: SCN10A; (-) strand; PAM type: NRG; PAM sequence: AGG
tccatgggatgtgggctggc

SEQ ID NO: 16908 - DNA, 20 bp, Artificial Sequence
  Description of Artificial Sequence: Synthetic oligonucleotide
  Target: SCN10A; (-) strand; PAM type: NRG; PAM sequence: CAG
gtccatgggatgtgggctgg

SEQ ID NO: 16909 - DNA, 20 bp, Artificial Sequence
  Description of Artificial Sequence: Synthetic oligonucleotide
  Target: SCN10A; (-) strand; PAM type: NRG; PAM sequence: TGG
agagtccatgggatgtgggc

SEQ ID NO: 16910 - DNA, 20 bp, Artificial Sequence
  Description of Artificial Sequence: Synthetic oligonucleotide
  Target: SCN10A; (-) strand; PAM type: NRG; PAM sequence: GGG
accaagagtccatgggatgt

SEQ ID NO: 16911 - DNA, 20 bp, Artificial Sequence
  Description of Artificial Sequence: Synthetic oligonucleotide
  Target: SCN10A; (-) strand; PAM type: NRG; PAM sequence: TGG
caccaagagtccatgggatg

SEQ ID NO: 16912 - DNA, 20 bp, Artificial Sequence
  Description of Artificial Sequence: Synthetic oligonucleotide
  Target: SCN10A; (-) strand; PAM type: NRG; PAM sequence: GGG
ggataccaccaagagtccat

SEQ ID NO: 16913 - DNA, 20 bp, Artificial Sequence
  Description of Artificial Sequence: Synthetic oligonucleotide
  Target: SCN10A; (-) strand; PAM type: NRG; PAM sequence: TGG
tggataccaccaagagtcca

SEQ ID NO: 16914 - DNA, 20 bp, Artificial Sequence
  Description of Artificial Sequence: Synthetic oligonucleotide
  Target: SCN10A; (-) strand; PAM type: NRG; PAM sequence: GAG
tgcaaactggataccaccaa

SEQ ID NO: 16915 - DNA, 20 bp, Artificial Sequence
  Description of Artificial Sequence: Synthetic oligonucleotide
  Target: SCN10A; (-) strand; PAM type: NRG; PAM sequence: AAG
gctgcaaactggataccacc

SEQ ID NO: 16916 - DNA, 20 bp, Artificial Sequence
  Description of Artificial Sequence: Synthetic oligonucleotide
  Target: SCN10A; (-) strand; PAM type: NRG; PAM sequence: TGG
ccactgtccctgctgcaaac

SEQ ID NO: 16917 - DNA, 20 bp, Artificial Sequence
  Description of Artificial Sequence: Synthetic oligonucleotide
  Target: SCN10A; (-) strand; PAM type: NRG; PAM sequence: AGG
catcagtcacctctccccac

SEQ ID NO: 16918 - DNA, 20 bp, Artificial Sequence
  Description of Artificial Sequence: Synthetic oligonucleotide
  Target: SCN10A; (-) strand; PAM type: NRG; PAM sequence: CAG
ccatcagtcacctctcccca

SEQ ID NO: 16919 - DNA, 20 bp, Artificial Sequence
  Description of Artificial Sequence: Synthetic oligonucleotide
  Target: SCN10A; (-) strand; PAM type: NRG; PAM sequence: CAG
cactggccatcacccaccat

SEQ ID NO: 16920 - DNA, 20 bp, Artificial Sequence
  Description of Artificial Sequence: Synthetic oligonucleotide
  Target: SCN10A; (-) strand; PAM type: NRG; PAM sequence: TGG
aaattatcccctttgcccac

SEQ ID NO: 16921 - DNA, 20 bp, Artificial Sequence
  Description of Artificial Sequence: Synthetic oligonucleotide
  Target: SCN10A; (-) strand; PAM type: NRG; PAM sequence: CAG
tggtttctctgcagcaggag

SEQ ID NO: 16922 - DNA, 20 bp, Artificial Sequence
  Description of Artificial Sequence: Synthetic oligonucleotide
  Target: SCN10A; (-) strand; PAM type: NRG; PAM sequence: GAG
gaatggtttctctgcagcag

SEQ ID NO: 16923 - DNA, 20 bp, Artificial Sequence
  Description of Artificial Sequence: Synthetic oligonucleotide
  Target: SCN10A; (-) strand; PAM type: NRG; PAM sequence: AGG
cagaatggtttctctgcagc

SEQ ID NO: 16924 - DNA, 20 bp, Artificial Sequence
  Description of Artificial Sequence: Synthetic oligonucleotide
  Target: SCN10A; (-) strand; PAM type: NRG; PAM sequence: CAG
gcagaatggtttctctgcag

SEQ ID NO: 16925 - DNA, 20 bp, Artificial Sequence
  Description of Artificial Sequence: Synthetic oligonucleotide
  Target: SCN10A; (-) strand; PAM type: NRG; PAM sequence: CAG
ctagcagaatggtttctctg

SEQ ID NO: 16926 - DNA, 20 bp, Artificial Sequence
  Description of Artificial Sequence: Synthetic oligonucleotide
  Target: SCN10A; (-) strand; PAM type: NRG; PAM sequence: TGG
aagtgggtttcctagcagaa

SEQ ID NO: 16927 - DNA, 20 bp, Artificial Sequence
  Description of Artificial Sequence: Synthetic oligonucleotide
  Target: SCN10A; (-) strand; PAM type: NRG; PAM sequence: CAG
atgacaagtgggtttcctag

SEQ ID NO: 16928 - DNA, 20 bp, Artificial Sequence
  Description of Artificial Sequence: Synthetic oligonucleotide
  Target: SCN10A; (-) strand; PAM type: NRG; PAM sequence: TAG
ggcatgacaagtgggtttcc

SEQ ID NO: 16929 - DNA, 20 bp, Artificial Sequence
  Description of Artificial Sequence: Synthetic oligonucleotide
  Target: SCN10A; (-) strand; PAM type: NRG; PAM sequence: GGG
tttccaagggcatgacaagt

SEQ ID NO: 16930 - DNA, 20 bp, Artificial Sequence
  Description of Artificial Sequence: Synthetic oligonucleotide
  Target: SCN10A; (-) strand; PAM type: NRG; PAM sequence: TGG
ttttccaagggcatgacaag

SEQ ID NO: 16931 - DNA, 20 bp, Artificial Sequence
  Description of Artificial Sequence: Synthetic oligonucleotide
  Target: SCN10A; (-) strand; PAM type: NRG; PAM sequence: AAG
tttttttccaagggcatgac

SEQ ID NO: 16932 - DNA, 20 bp, Artificial Sequence
  Description of Artificial Sequence: Synthetic oligonucleotide
  Target: SCN10A; (-) strand; PAM type: NRG; PAM sequence: GGG
aggaaagaatttttttccaa

SEQ ID NO: 16933 - DNA, 20 bp, Artificial Sequence
  Description of Artificial Sequence: Synthetic oligonucleotide
  Target: SCN10A; (-) strand; PAM type: NRG; PAM sequence: AGG
caggaaagaatttttttcca

SEQ ID NO: 16934 - DNA, 20 bp, Artificial Sequence
  Description of Artificial Sequence: Synthetic oligonucleotide
  Target: SCN10A; (-) strand; PAM type: NRG; PAM sequence: AAG
ccaggaaagaatttttttcc

SEQ ID NO: 16935 - DNA, 20 bp, Artificial Sequence
  Description of Artificial Sequence: Synthetic oligonucleotide
  Target: SCN10A; (-) strand; PAM type: NRG; PAM sequence: AAG
tcttcacccatattccagga

SEQ ID NO: 16936 - DNA, 20 bp, Artificial Sequence
  Description of Artificial Sequence: Synthetic oligonucleotide
  Target: SCN10A; (-) strand; PAM type: NRG; PAM sequence: AGG
cccctcttcacccatattcc

SEQ ID NO: 16937 - DNA, 20 bp, Artificial Sequence
  Description of Artificial Sequence: Synthetic oligonucleotide
  Target: SCN10A; (-) strand; PAM type: NRG; PAM sequence: CAG
acccctcttcacccatattc

SEQ ID NO: 16938 - DNA, 20 bp, Artificial Sequence
  Description of Artificial Sequence: Synthetic oligonucleotide
  Target: SCN10A; (-) strand; PAM type: NRG; PAM sequence: GGG
gattgagggactccctggaa

SEQ ID NO: 16939 - DNA, 20 bp, Artificial Sequence
  Description of Artificial Sequence: Synthetic oligonucleotide
  Target: SCN10A; (-) strand; PAM type: NRG; PAM sequence: AGG
ggattgagggactccctgga

SEQ ID NO: 16940 - DNA, 20 bp, Artificial Sequence
  Description of Artificial Sequence: Synthetic oligonucleotide
  Target: SCN10A; (-) strand; PAM type: NRG; PAM sequence: AAG
tggattgagggactccctgg

SEQ ID NO: 16941 - DNA, 20 bp, Artificial Sequence
  Description of Artificial Sequence: Synthetic oligonucleotide
  Target: SCN10A; (-) strand; PAM type: NRG; PAM sequence: TGG
gtctggattgagggactccc

SEQ ID NO: 16942 - DNA, 20 bp, Artificial Sequence
  Description of Artificial Sequence: Synthetic oligonucleotide
  Target: SCN10A; (-) strand; PAM type: NRG; PAM sequence: GGG
cacctgttggtctggattga

SEQ ID NO: 16943 - DNA, 20 bp, Artificial Sequence
  Description of Artificial Sequence: Synthetic oligonucleotide
  Target: SCN10A; (-) strand; PAM type: NRG; PAM sequence: AGG
acacctgttggtctggattg

SEQ ID NO: 16944 - DNA, 20 bp, Artificial Sequence
  Description of Artificial Sequence: Synthetic oligonucleotide
  Target: SCN10A; (-) strand; PAM type: NRG; PAM sequence: GAG
aacacctgttggtctggatt

SEQ ID NO: 16945 - DNA, 20 bp, Artificial Sequence
  Description of Artificial Sequence: Synthetic oligonucleotide
  Target: SCN10A; (-) strand; PAM type: NRG; PAM sequence: TGG
gagaggaacacctgttggtc

SEQ ID NO: 16946 - DNA, 20 bp, Artificial Sequence
  Description of Artificial Sequence: Synthetic oligonucleotide
  Target: SCN10A; (-) strand; PAM type: NRG; PAM sequence: TGG
tgatggagaggaacacctgt

SEQ ID NO: 16947 - DNA, 20 bp, Artificial Sequence
  Description of Artificial Sequence: Synthetic oligonucleotide
  Target: SCN10A; (-) strand; PAM type: NRG; PAM sequence: AGG
gggcaagactgatgatggag

SEQ ID NO: 16948 - DNA, 20 bp, Artificial Sequence
  Description of Artificial Sequence: Synthetic oligonucleotide
  Target: SCN10A; (-) strand; PAM type: NRG; PAM sequence: GAG
tgggcaagactgatgatgga

SEQ ID NO: 16949 - DNA, 20 bp, Artificial Sequence
  Description of Artificial Sequence: Synthetic oligonucleotide
  Target: SCN10A; (-) strand; PAM type: NRG; PAM sequence: GAG
agtgggcaagactgatgatg

SEQ ID NO: 16950 - DNA, 20 bp, Artificial Sequence
  Description of Artificial Sequence: Synthetic oligonucleotide
  Target: SCN10A; (-) strand; PAM type: NRG; PAM sequence: TGG
agagtgggcaagactgatga

SEQ ID NO: 16951 - DNA, 20 bp, Artificial Sequence
  Description of Artificial Sequence: Synthetic oligonucleotide
  Target: SCN10A; (-) strand; PAM type: NRG; PAM sequence: AAG
ggaaaaacatcagagtgggc

SEQ ID NO: 16952 - DNA, 20 bp, Artificial Sequence
  Description of Artificial Sequence: Synthetic oligonucleotide
  Target: SCN10A; (-) strand; PAM type: NRG; PAM sequence: GGG
gctaggaaaaacatcagagt

SEQ ID NO: 16953 - DNA, 20 bp, Artificial Sequence
  Description of Artificial Sequence: Synthetic oligonucleotide
  Target: SCN10A; (-) strand; PAM type: NRG; PAM sequence: TGG
ggctaggaaaaacatcagag

SEQ ID NO: 16954 - DNA, 20 bp, Artificial Sequence
  Description of Artificial Sequence: Synthetic oligonucleotide
  Target: SCN10A; (-) strand; PAM type: NRG; PAM sequence: GAG
tatggctaggaaaaacatca

SEQ ID NO: 16955 - DNA, 20 bp, Artificial Sequence
  Description of Artificial Sequence: Synthetic oligonucleotide
  Target: SCN10A; (-) strand; PAM type: NRG; PAM sequence: CAG
gatatggctaggaaaaacat

SEQ ID NO: 16956 - DNA, 20 bp, Artificial Sequence
  Description of Artificial Sequence: Synthetic oligonucleotide
  Target: SCN10A; (-) strand; PAM type: NRG; PAM sequence: AGG
tctgtaagaaggatatggct

SEQ ID NO: 16957 - DNA, 20 bp, Artificial Sequence
  Description of Artificial Sequence: Synthetic oligonucleotide
  Target: SCN10A; (-) strand; PAM type: NRG; PAM sequence: TAG
atctgtaagaaggatatggc

SEQ ID NO: 16958 - DNA, 20 bp, Artificial Sequence
  Description of Artificial Sequence: Synthetic oligonucleotide
  Target: SCN10A; (-) strand; PAM type: NRG; PAM sequence: TGG
tgtcatctgtaagaaggata

SEQ ID NO: 16959 - DNA, 20 bp, Artificial Sequence
  Description of Artificial Sequence: Synthetic oligonucleotide
  Target: SCN10A; (-) strand; PAM type: NRG; PAM sequence: AGG
cactggtgtcatctgtaaga

SEQ ID NO: 16960 - DNA, 20 bp, Artificial Sequence
  Description of Artificial Sequence: Synthetic oligonucleotide
  Target: SCN10A; (-) strand; PAM type: NRG; PAM sequence: AAG
ccactggtgtcatctgtaag

SEQ ID NO: 16961 - DNA, 20 bp, Artificial Sequence
  Description of Artificial Sequence: Synthetic oligonucleotide
  Target: SCN10A; (-) strand; PAM type: NRG; PAM sequence: AAG
ggaccactggtgtcatctgt

SEQ ID NO: 16962 - DNA, 20 bp, Artificial Sequence
  Description of Artificial Sequence: Synthetic oligonucleotide
  Target: SCN10A; (-) strand; PAM type: NRG; PAM sequence: TGG
ggcagaaggacagggaccac

SEQ ID NO: 16963 - DNA, 20 bp, Artificial Sequence
  Description of Artificial Sequence: Synthetic oligonucleotide
  Target: SCN10A; (-) strand; PAM type: NRG; PAM sequence: GGG
tataggtgggcagaaggaca

SEQ ID NO: 16964 - DNA, 20 bp, Artificial Sequence
  Description of Artificial Sequence: Synthetic oligonucleotide
  Target: SCN10A; (-) strand; PAM type: NRG; PAM sequence: AGG
gtataggtgggcagaaggac

SEQ ID NO: 16965 - DNA, 20 bp, Artificial Sequence
  Description of Artificial Sequence: Synthetic oligonucleotide
  Target: SCN10A; (-) strand; PAM type: NRG; PAM sequence: CAG
ggtataggtgggcagaagga

SEQ ID NO: 16966 - DNA, 20 bp, Artificial Sequence
  Description of Artificial Sequence: Synthetic oligonucleotide
  Target: SCN10A; (-) strand; PAM type: NRG; PAM sequence: AGG
tccaggtataggtgggcaga

SEQ ID NO: 16967 - DNA, 20 bp, Artificial Sequence
  Description of Artificial Sequence: Synthetic oligonucleotide
  Target: SCN10A; (-) strand; PAM type: NRG; PAM sequence: AAG
ttccaggtataggtgggcag

SEQ ID NO: 16968 - DNA, 20 bp, Artificial Sequence
  Description of Artificial Sequence: Synthetic oligonucleotide
  Target: SCN10A; (-) strand; PAM type: NRG; PAM sequence: CAG
gttttccaggtataggtggg

SEQ ID NO: 16969 - DNA, 20 bp, Artificial Sequence
  Description of Artificial Sequence: Synthetic oligonucleotide
  Target: SCN10A; (-) strand; PAM type: NRG; PAM sequence: GGG
tctgttttccaggtataggt

SEQ ID NO: 16970 - DNA, 20 bp, Artificial Sequence
  Description of Artificial Sequence: Synthetic oligonucleotide
  Target: SCN10A; (-) strand; PAM type: NRG; PAM sequence: TGG
gtctgttttccaggtatagg

SEQ ID NO: 16971 - DNA, 20 bp, Artificial Sequence
  Description of Artificial Sequence: Synthetic oligonucleotide
  Target: SCN10A; (-) strand; PAM type: NRG; PAM sequence: AGG
cttgtctgttttccaggtat

SEQ ID NO: 16972 - DNA, 20 bp, Artificial Sequence
  Description of Artificial Sequence: Synthetic oligonucleotide
  Target: SCN10A; (-) strand; PAM type: NRG; PAM sequence: TAG
gcttgtctgttttccaggta

SEQ ID NO: 16973 - DNA, 20 bp, Artificial Sequence
  Description of Artificial Sequence: Synthetic oligonucleotide
  Target: SCN10A; (-) strand; PAM type: NRG; PAM sequence: AGG
ccgtagcttgtctgttttcc

SEQ ID NO: 16974 - DNA, 20 bp, Artificial Sequence
  Description of Artificial Sequence: Synthetic oligonucleotide
  Target: SCN10A; (-) strand; PAM type: NRG; PAM sequence: CAG
gccgtagcttgtctgttttc

SEQ ID NO: 16975 - DNA, 20 bp, Artificial Sequence
  Description of Artificial Sequence: Synthetic oligonucleotide
  Target: SCN10A; (-) strand; PAM type: NRG; PAM sequence: TAG
acccccaggctcatacgccg

SEQ ID NO: 16976 - DNA, 20 bp, Artificial Sequence
  Description of Artificial Sequence: Synthetic oligonucleotide
  Target: SCN10A; (-) strand; PAM type: NRG; PAM sequence: AGG
tatccccctcaggcaccccc

SEQ ID NO: 16977 - DNA, 20 bp, Artificial Sequence
  Description of Artificial Sequence: Synthetic oligonucleotide
  Target: SCN10A; (-) strand; PAM type: NRG; PAM sequence: CAG
atatccccctcaggcacccc

SEQ ID NO: 16978 - DNA, 20 bp, Artificial Sequence
  Description of Artificial Sequence: Synthetic oligonucleotide
  Target: SCN10A; (-) strand; PAM type: NRG; PAM sequence: AGG
gcttggagcatatccccctc

SEQ ID NO: 16979 - DNA, 20 bp, Artificial Sequence
  Description of Artificial Sequence: Synthetic oligonucleotide
  Target: SCN10A; (-) strand; PAM type: NRG; PAM sequence: CAG
ggcttggagcatatccccct

SEQ ID NO: 16980 - DNA, 20 bp, Artificial Sequence
  Description of Artificial Sequence: Synthetic oligonucleotide
  Target: SCN10A; (-) strand; PAM type: NRG; PAM sequence: GAG
ctcagttcagcttgggcttg

SEQ ID NO: 16981 - DNA, 20 bp, Artificial Sequence
  Description of Artificial Sequence: Synthetic oligonucleotide
  Target: SCN10A; (-) strand; PAM type: NRG; PAM sequence: TGG
ccctcagttcagcttgggct

SEQ ID NO: 16982 - DNA, 20 bp, Artificial Sequence
  Description of Artificial Sequence: Synthetic oligonucleotide
  Target: SCN10A; (-) strand; PAM type: NRG; PAM sequence: GGG
cgtggccctcagttcagctt

SEQ ID NO: 16983 - DNA, 20 bp, Artificial Sequence
  Description of Artificial Sequence: Synthetic oligonucleotide
  Target: SCN10A; (-) strand; PAM type: NRG; PAM sequence: TGG
tcgtggccctcagttcagct

SEQ ID NO: 16984 - DNA, 20 bp, Artificial Sequence
  Description of Artificial Sequence: Synthetic oligonucleotide
  Target: SCN10A; (-) strand; PAM type: NRG; PAM sequence: CAG
ccacgtcgtggccctcagtt

SEQ ID NO: 16985 - DNA, 20 bp, Artificial Sequence
  Description of Artificial Sequence: Synthetic oligonucleotide
  Target: SCN10A; (-) strand; PAM type: NRG; PAM sequence: CAG
cccagccacgtcgtggccct

SEQ ID NO: 16986 - DNA, 20 bp, Artificial Sequence
  Description of Artificial Sequence: Synthetic oligonucleotide
  Target: SCN10A; (-) strand; PAM type: NRG; PAM sequence: TGG
tccccatcccagccacgtcg

SEQ ID NO: 16987 - DNA, 20 bp, Artificial Sequence
  Description of Artificial Sequence: Synthetic oligonucleotide
  Target: SCN10A; (-) strand; PAM type: NRG; PAM sequence: CAG
gctggacccaatccccatcc

SEQ ID NO: 16988 - DNA, 20 bp, Artificial Sequence
  Description of Artificial Sequence: Synthetic oligonucleotide
  Target: SCN10A; (-) strand; PAM type: NRG; PAM sequence: TGG
tgggctgggctgagctgggc

SEQ ID NO: 16989 - DNA, 20 bp, Artificial Sequence
  Description of Artificial Sequence: Synthetic oligonucleotide
  Target: SCN10A; (-) strand; PAM type: NRG; PAM sequence: GGG
accctgggctgggctgagct

SEQ ID NO: 16990 - DNA, 20 bp, Artificial Sequence
  Description of Artificial Sequence: Synthetic oligonucleotide
  Target: SCN10A; (-) strand; PAM type: NRG; PAM sequence: TGG
gaccctgggctgggctgagc

SEQ ID NO: 16991 - DNA, 20 bp, Artificial Sequence
  Description of Artificial Sequence: Synthetic oligonucleotide
  Target: SCN10A; (-) strand; PAM type: NRG; PAM sequence: GAG
atttgaccctgggctgggct

SEQ ID NO: 16992 - DNA, 20 bp, Artificial Sequence
  Description of Artificial Sequence: Synthetic oligonucleotide
  Target: SCN10A; (-) strand; PAM type: NRG; PAM sequence: GGG
gttttatttgaccctgggct

SEQ ID NO: 16993 - DNA, 20 bp, Artificial Sequence
  Description of Artificial Sequence: Synthetic oligonucleotide
  Target: SCN10A; (-) strand; PAM type: NRG; PAM sequence: TGG
agttttatttgaccctgggc

SEQ ID NO: 16994 - DNA, 20 bp, Artificial Sequence
  Description of Artificial Sequence: Synthetic oligonucleotide
  Target: SCN10A; (-) strand; PAM type: NRG; PAM sequence: GGG
taatagttttatttgaccct

SEQ ID NO: 16995 - DNA, 20 bp, Artificial Sequence
  Description of Artificial Sequence: Synthetic oligonucleotide
  Target: SCN10A; (-) strand; PAM type: NRG; PAM sequence: TGG
ttaatagttttatttgaccc

SEQ ID NO: 16996 - DNA, 20 bp, Artificial Sequence
  Description of Artificial Sequence: Synthetic oligonucleotide
  Target: SCN10A; (-) strand; PAM type: NRG; PAM sequence: TAG
aatacttgagtttttattaa

SEQ ID NO: 16997 - DNA, 20 bp, Artificial Sequence
  Description of Artificial Sequence: Synthetic oligonucleotide
  Target: SCN10A; (-) strand; PAM type: NRG; PAM sequence: GAG
gaaaaattttttaaatactt

SEQ ID NO: 16998 - DNA, 20 bp, Artificial Sequence
  Description of Artificial Sequence: Synthetic oligonucleotide
  Target: SCN10A; (-) strand; PAM type: NRG; PAM sequence: AAG
caatgctttctaaaaataca

SEQ ID NO: 16999 - DNA, 20 bp, Artificial Sequence
  Description of Artificial Sequence: Synthetic oligonucleotide
  Target: SCN10A; (-) strand; PAM type: NRG; PAM sequence: TGG
ccattctataaagggaattg

SEQ ID NO: 17000 - DNA, 20 bp, Artificial Sequence
  Description of Artificial Sequence: Synthetic oligonucleotide
  Target: SCN10A; (-) strand; PAM type: NRG; PAM sequence: GGG
tcaagagtccattctataaa

SEQ ID NO: 17001 - DNA, 20 bp, Artificial Sequence
  Description of Artificial Sequence: Synthetic oligonucleotide
  Target: SCN10A; (-) strand; PAM type: NRG; PAM sequence: AGG
atcaagagtccattctataa

SEQ ID NO: 17002 - DNA, 20 bp, Artificial Sequence
  Description of Artificial Sequence: Synthetic oligonucleotide
  Target: SCN10A; (-) strand; PAM type: NRG; PAM sequence: AAG
aatcaagagtccattctata

SEQ ID NO: 17003 - DNA, 20 bp, Artificial Sequence
  Description of Artificial Sequence: Synthetic oligonucleotide
  Target: SCN10A; (-) strand; PAM type: NRG; PAM sequence: GAG
ttgtgcaatgaatgaatcaa

SEQ ID NO: 17004 - DNA, 20 bp, Artificial Sequence
  Description of Artificial Sequence: Synthetic oligonucleotide
  Target: SCN10A; (-) strand; PAM type: NRG; PAM sequence: AAG
atttgtgcaatgaatgaatc

SEQ ID NO: 17005 - DNA, 20 bp, Artificial Sequence
  Description of Artificial Sequence: Synthetic oligonucleotide
  Target: SCN10A; (-) strand; PAM type: NRG; PAM sequence: AGG
tctcagtgtttagaacagtg

SEQ ID NO: 17006 - DNA, 20 bp, Artificial Sequence
  Description of Artificial Sequence: Synthetic oligonucleotide
  Target: SCN10A; (-) strand; PAM type: NRG; PAM sequence: GAG
ctctcagtgtttagaacagt

SEQ ID NO: 17007 - DNA, 20 bp, Artificial Sequence
  Description of Artificial Sequence: Synthetic oligonucleotide
  Target: SCN10A; (-) strand; PAM type: NRG; PAM sequence: CAG
tttcctctcagtgtttagaa

SEQ ID NO: 17008 - DNA, 20 bp, Artificial Sequence
  Description of Artificial Sequence: Synthetic oligonucleotide
  Target: SCN10A; (-) strand; PAM type: NRG; PAM sequence: TAG
tcatctttcctctcagtgtt

SEQ ID NO: 17009 - DNA, 20 bp, Artificial Sequence
  Description of Artificial Sequence: Synthetic oligonucleotide
  Target: SCN10A; (-) strand; PAM type: NRG; PAM sequence: CAG
gtcttagtcatctttcctct

SEQ ID NO: 17010 - DNA, 20 bp, Artificial Sequence
  Description of Artificial Sequence: Synthetic oligonucleotide
  Target: SCN10A; (-) strand; PAM type: NRG; PAM sequence: TAG
caaaagcagaacctgtgtct

SEQ ID NO: 17011 - DNA, 20 bp, Artificial Sequence
  Description of Artificial Sequence: Synthetic oligonucleotide
  Target: SCN10A; (-) strand; PAM type: NRG; PAM sequence: CAG
ttttgtttagctctcaaaag

SEQ ID NO: 17012 - DNA, 20 bp, Artificial Sequence
  Description of Artificial Sequence: Synthetic oligonucleotide
  Target: SCN10A; (-) strand; PAM type: NRG; PAM sequence: AAG
atcttttgtttagctctcaa

SEQ ID NO: 17013 - DNA, 20 bp, Artificial Sequence
  Description of Artificial Sequence: Synthetic oligonucleotide
  Target: SCN10A; (-) strand; PAM type: NRG; PAM sequence: TAG
gcttccctcaatcttttgtt

SEQ ID NO: 17014 - DNA, 20 bp, Artificial Sequence
  Description of Artificial Sequence: Synthetic oligonucleotide
  Target: SCN10A; (-) strand; PAM type: NRG; PAM sequence: AGG
accatgaaggacccagagga

SEQ ID NO: 17015 - DNA, 20 bp, Artificial Sequence
  Description of Artificial Sequence: Synthetic oligonucleotide
  Target: SCN10A; (-) strand; PAM type: NRG; PAM sequence: AAG
gaccatgaaggacccagagg

SEQ ID NO: 17016 - DNA, 20 bp, Artificial Sequence
  Description of Artificial Sequence: Synthetic oligonucleotide
  Target: SCN10A; (-) strand; PAM type: NRG; PAM sequence: AGG
ttggaccatgaaggacccag

SEQ ID NO: 17017 - DNA, 20 bp, Artificial Sequence
  Description of Artificial Sequence: Synthetic oligonucleotide
  Target: SCN10A; (-) strand; PAM type: NRG; PAM sequence: GAG
tttggaccatgaaggaccca

SEQ ID NO: 17018 - DNA, 20 bp, Artificial Sequence
  Description of Artificial Sequence: Synthetic oligonucleotide
  Target: SCN10A; (-) strand; PAM type: NRG; PAM sequence: CAG
gatttggaccatgaaggacc

SEQ ID NO: 17019 - DNA, 20 bp, Artificial Sequence
  Description of Artificial Sequence: Synthetic oligonucleotide
  Target: SCN10A; (-) strand; PAM type: NRG; PAM sequence: AGG
actcttgatttggaccatga

SEQ ID NO: 17020 - DNA, 20 bp, Artificial Sequence
  Description of Artificial Sequence: Synthetic oligonucleotide
  Target: SCN10A; (-) strand; PAM type: NRG; PAM sequence: AAG
aactcttgatttggaccatg

SEQ ID NO: 17021 - DNA, 20 bp, Artificial Sequence
  Description of Artificial Sequence: Synthetic oligonucleotide
  Target: SCN10A; (-) strand; PAM type: NRG; PAM sequence: TGG
accactgaaaactcttgatt

SEQ ID NO: 17022 - DNA, 20 bp, Artificial Sequence
  Description of Artificial Sequence: Synthetic oligonucleotide
  Target: SCN10A; (-) strand; PAM type: NRG; PAM sequence: TAG
tgagttgaaagggggaaacg

SEQ ID NO: 17023 - DNA, 20 bp, Artificial Sequence
  Description of Artificial Sequence: Synthetic oligonucleotide
  Target: SCN10A; (-) strand; PAM type: NRG; PAM sequence: GGG
agccctcttgagttgaaagg

SEQ ID NO: 17024 - DNA, 20 bp, Artificial Sequence
  Description of Artificial Sequence: Synthetic oligonucleotide
  Target: SCN10A; (-) strand; PAM type: NRG; PAM sequence: GGG
cagccctcttgagttgaaag

SEQ ID NO: 17025 - DNA, 20 bp, Artificial Sequence
  Description of Artificial Sequence: Synthetic oligonucleotide
  Target: SCN10A; (-) strand; PAM type: NRG; PAM sequence: GGG
ccagccctcttgagttgaaa

SEQ ID NO: 17026 - DNA, 20 bp, Artificial Sequence
  Description of Artificial Sequence: Synthetic oligonucleotide
  Target: SCN10A; (-) strand; PAM type: NRG; PAM sequence: AGG
accagccctcttgagttgaa

SEQ ID NO: 17027 - DNA, 20 bp, Artificial Sequence
  Description of Artificial Sequence: Synthetic oligonucleotide
  Target: SCN10A; (-) strand; PAM type: NRG; PAM sequence: AAG
aaccagccctcttgagttga

SEQ ID NO: 17028 - DNA, 20 bp, Artificial Sequence
  Description of Artificial Sequence: Synthetic oligonucleotide
  Target: SCN10A; (-) strand; PAM type: NRG; PAM sequence: GAG
agttctaaaccagccctctt

SEQ ID NO: 17029 - DNA, 20 bp, Artificial Sequence
  Description of Artificial Sequence: Synthetic oligonucleotide
  Target: SCN10A; (-) strand; PAM type: NRG; PAM sequence: CAG
cccctccgtgagttctaaac

SEQ ID NO: 17030 - DNA, 20 bp, Artificial Sequence
  Description of Artificial Sequence: Synthetic oligonucleotide
  Target: SCN10A; (-) strand; PAM type: NRG; PAM sequence: GAG
accctcaaaaacccctccgt

SEQ ID NO: 17031 - DNA, 20 bp, Artificial Sequence
  Description of Artificial Sequence: Synthetic oligonucleotide
  Target: SCN10A; (-) strand; PAM type: NRG; PAM sequence: GGG
cagacactacggagagacgt

SEQ ID NO: 17032 - DNA, 20 bp, Artificial Sequence
  Description of Artificial Sequence: Synthetic oligonucleotide
  Target: SCN10A; (-) strand; PAM type: NRG; PAM sequence: TGG
tcagacactacggagagacg

SEQ ID NO: 17033 - DNA, 20 bp, Artificial Sequence
  Description of Artificial Sequence: Synthetic oligonucleotide
  Target: SCN10A; (-) strand; PAM type: NRG; PAM sequence: GAG
gccctatcagacactacgga

SEQ ID NO: 17034 - DNA, 20 bp, Artificial Sequence
  Description of Artificial Sequence: Synthetic oligonucleotide
  Target: SCN10A; (-) strand; PAM type: NRG; PAM sequence: GAG
atgccctatcagacactacg

SEQ ID NO: 17035 - DNA, 20 bp, Artificial Sequence
  Description of Artificial Sequence: Synthetic oligonucleotide
  Target: SCN10A; (-) strand; PAM type: NRG; PAM sequence: CGG
tcatgccctatcagacacta

SEQ ID NO: 17036 - DNA, 20 bp, Artificial Sequence
  Description of Artificial Sequence: Synthetic oligonucleotide
  Target: SCN10A; (-) strand; PAM type: NRG; PAM sequence: CAG
atctgcatctcatgccctat

SEQ ID NO: 17037 - DNA, 20 bp, Artificial Sequence
  Description of Artificial Sequence: Synthetic oligonucleotide
  Target: SCN10A; (-) strand; PAM type: NRG; PAM sequence: TGG
aggtggcagcagcctggccg

SEQ ID NO: 17038 - DNA, 20 bp, Artificial Sequence
  Description of Artificial Sequence: Synthetic oligonucleotide
  Target: SCN10A; (-) strand; PAM type: NRG; PAM sequence: TGG
tgccccaggtggcagcagcc

SEQ ID NO: 17039 - DNA, 20 bp, Artificial Sequence
  Description of Artificial Sequence: Synthetic oligonucleotide
  Target: SCN10A; (-) strand; PAM type: NRG; PAM sequence: CAG
acacatgccccaggtggcag

SEQ ID NO: 17040 - DNA, 20 bp, Artificial Sequence
  Description of Artificial Sequence: Synthetic oligonucleotide
  Target: SCN10A; (-) strand; PAM type: NRG; PAM sequence: CAG
gacacacatgccccaggtgg

SEQ ID NO: 17041 - DNA, 20 bp, Artificial Sequence
  Description of Artificial Sequence: Synthetic oligonucleotide
  Target: SCN10A; (-) strand; PAM type: NRG; PAM sequence: TGG
tcagacacacatgccccagg

SEQ ID NO: 17042 - DNA, 20 bp, Artificial Sequence
  Description of Artificial Sequence: Synthetic oligonucleotide
  Target: SCN10A; (-) strand; PAM type: NRG; PAM sequence: AGG
gcatcagacacacatgcccc

SEQ ID NO: 17043 - DNA, 20 bp, Artificial Sequence
  Description of Artificial Sequence: Synthetic oligonucleotide
  Target: SCN10A; (-) strand; PAM type: NRG; PAM sequence: CAG
cgcatcagacacacatgccc

SEQ ID NO: 17044 - DNA, 20 bp, Artificial Sequence
  Description of Artificial Sequence: Synthetic oligonucleotide
  Target: SCN10A; (-) strand; PAM type: NRG; PAM sequence: CAG
aggcttgagggcgcccgcat

SEQ ID NO: 17045 - DNA, 20 bp, Artificial Sequence
  Description of Artificial Sequence: Synthetic oligonucleotide
  Target: SCN10A; (-) strand; PAM type: NRG; PAM sequence: GGG
tgcctcactcccaggcttga

SEQ ID NO: 17046 - DNA, 20 bp, Artificial Sequence
  Description of Artificial Sequence: Synthetic oligonucleotide
  Target: SCN10A; (-) strand; PAM type: NRG; PAM sequence: AGG
ctgcctcactcccaggcttg

SEQ ID NO: 17047 - DNA, 20 bp, Artificial Sequence
  Description of Artificial Sequence: Synthetic oligonucleotide
  Target: SCN10A; (-) strand; PAM type: NRG; PAM sequence: GAG
gctgcctcactcccaggctt

SEQ ID NO: 17048 - DNA, 20 bp, Artificial Sequence
  Description of Artificial Sequence: Synthetic oligonucleotide
  Target: SCN10A; (-) strand; PAM type: NRG; PAM sequence: AGG
ccacttgctgcctcactccc

SEQ ID NO: 17049 - DNA, 20 bp, Artificial Sequence
  Description of Artificial Sequence: Synthetic oligonucleotide
  Target: SCN10A; (-) strand; PAM type: NRG; PAM sequence: CAG
cccacttgctgcctcactcc

SEQ ID NO: 17050 - DNA, 20 bp, Artificial Sequence
  Description of Artificial Sequence: Synthetic oligonucleotide
  Target: SCN10A; (-) strand; PAM type: NRG; PAM sequence: AAG
gggatccacagaagacaaac

SEQ ID NO: 17051 - DNA, 20 bp, Artificial Sequence
  Description of Artificial Sequence: Synthetic oligonucleotide
  Target: SCN10A; (-) strand; PAM type: NRG; PAM sequence: AAG
cactcacctgggatccacag

SEQ ID NO: 17052 - DNA, 20 bp, Artificial Sequence
  Description of Artificial Sequence: Synthetic oligonucleotide
  Target: SCN10A; (-) strand; PAM type: NRG; PAM sequence: CAG
gaacactcacctgggatcca

SEQ ID NO: 17053 - DNA, 20 bp, Artificial Sequence
  Description of Artificial Sequence: Synthetic oligonucleotide
  Target: SCN10A; (-) strand; PAM type: NRG; PAM sequence: GGG
agttgagcgaacactcacct

SEQ ID NO: 17054 - DNA, 20 bp, Artificial Sequence
  Description of Artificial Sequence: Synthetic oligonucleotide
  Target: SCN10A; (-) strand; PAM type: NRG; PAM sequence: TGG
cagttgagcgaacactcacc

SEQ ID NO: 17055 - DNA, 20 bp, Artificial Sequence
  Description of Artificial Sequence: Synthetic oligonucleotide
  Target: SCN10A; (-) strand; PAM type: NRG; PAM sequence: GAG
attagggccagaatccagtt

SEQ ID NO: 17056 - DNA, 20 bp, Artificial Sequence
  Description of Artificial Sequence: Synthetic oligonucleotide
  Target: SCN10A; (-) strand; PAM type: NRG; PAM sequence: CAG
tgttaattagggccagaatc

SEQ ID NO: 17057 - DNA, 20 bp, Artificial Sequence
  Description of Artificial Sequence: Synthetic oligonucleotide
  Target: SCN10A; (-) strand; PAM type: NRG; PAM sequence: CAG
acactgatgttaattagggc

SEQ ID NO: 17058 - DNA, 20 bp, Artificial Sequence
  Description of Artificial Sequence: Synthetic oligonucleotide
  Target: SCN10A; (-) strand; PAM type: NRG; PAM sequence: GGG
cctcacactgatgttaatta

SEQ ID NO: 17059 - DNA, 20 bp, Artificial Sequence
  Description of Artificial Sequence: Synthetic oligonucleotide
  Target: SCN10A; (-) strand; PAM type: NRG; PAM sequence: AGG
ccctcacactgatgttaatt

SEQ ID NO: 17060 - DNA, 20 bp, Artificial Sequence
  Description of Artificial Sequence: Synthetic oligonucleotide
  Target: SCN10A; (-) strand; PAM type: NRG; PAM sequence: TAG
cccctcacactgatgttaat

SEQ ID NO: 17061 - DNA, 20 bp, Artificial Sequence
  Description of Artificial Sequence: Synthetic oligonucleotide
  Target: SCN10A; (-) strand; PAM type: NRG; PAM sequence: AGG
gaaggtgaagggacagccac

SEQ ID NO: 17062 - DNA, 20 bp, Artificial Sequence
  Description of Artificial Sequence: Synthetic oligonucleotide
  Target: SCN10A; (-) strand; PAM type: NRG; PAM sequence: CAG
agaaggtgaagggacagcca

SEQ ID NO: 17063 - DNA, 20 bp, Artificial Sequence
  Description of Artificial Sequence: Synthetic oligonucleotide
  Target: SCN10A; (-) strand; PAM type: NRG; PAM sequence: CAG
cttcacagaaggtgaaggga

SEQ ID NO: 17064 - DNA, 20 bp, Artificial Sequence
  Description of Artificial Sequence: Synthetic oligonucleotide
  Target: SCN10A; (-) strand; PAM type: NRG; PAM sequence: GGG
actgcttcacagaaggtgaa

SEQ ID NO: 17065 - DNA, 20 bp, Artificial Sequence
  Description of Artificial Sequence: Synthetic oligonucleotide
  Target: SCN10A; (-) strand; PAM type: NRG; PAM sequence: AGG
gactgcttcacagaaggtga

SEQ ID NO: 17066 - DNA, 20 bp, Artificial Sequence
  Description of Artificial Sequence: Synthetic oligonucleotide
  Target: SCN10A; (-) strand; PAM type: NRG; PAM sequence: AAG
tgactgcttcacagaaggtg

SEQ ID NO: 17067 - DNA, 20 bp, Artificial Sequence
  Description of Artificial Sequence: Synthetic oligonucleotide
  Target: SCN10A; (-) strand; PAM type: NRG; PAM sequence: AGG
ccagatgactgcttcacaga

SEQ ID NO: 17068 - DNA, 20 bp, Artificial Sequence
  Description of Artificial Sequence: Synthetic oligonucleotide
  Target: SCN10A; (-) strand; PAM type: NRG; PAM sequence: AAG
accagatgactgcttcacag

SEQ ID NO: 17069 - DNA, 20 bp, Artificial Sequence
  Description of Artificial Sequence: Synthetic oligonucleotide
  Target: SCN10A; (-) strand; PAM type: NRG; PAM sequence: CAG
agaaccagatgactgcttca

SEQ ID NO: 17070 - DNA, 20 bp, Artificial Sequence
  Description of Artificial Sequence: Synthetic oligonucleotide
  Target: SCN10A; (-) strand; PAM type: NRG; PAM sequence: CAG
ggcagatgacctggaagaac

SEQ ID NO: 17071 - DNA, 20 bp, Artificial Sequence
  Description of Artificial Sequence: Synthetic oligonucleotide
  Target: SCN10A; (-) strand; PAM type: NRG; PAM sequence: AAG
tgagctggcagatgacctgg

SEQ ID NO: 17072 - DNA, 20 bp, Artificial Sequence
  Description of Artificial Sequence: Synthetic oligonucleotide
  Target: SCN10A; (-) strand; PAM type: NRG; PAM sequence: TGG
ccctgagctggcagatgacc

SEQ ID NO: 17073 - DNA, 20 bp, Artificial Sequence
  Description of Artificial Sequence: Synthetic oligonucleotide
  Target: SCN10A; (-) strand; PAM type: NRG; PAM sequence: CAG
gaggaagatccctgagctgg

SEQ ID NO: 17074 - DNA, 20 bp, Artificial Sequence
  Description of Artificial Sequence: Synthetic oligonucleotide
  Target: SCN10A; (-) strand; PAM type: NRG; PAM sequence: TGG
cctgaggaagatccctgagc

SEQ ID NO: 17075 - DNA, 20 bp, Artificial Sequence
  Description of Artificial Sequence: Synthetic oligonucleotide
  Target: SCN10A; (-) strand; PAM type: NRG; PAM sequence: GAG
aaatcctgaggaagatccct

SEQ ID NO: 17076 - DNA, 20 bp, Artificial Sequence
  Description of Artificial Sequence: Synthetic oligonucleotide
  Target: SCN10A; (-) strand; PAM type: NRG; PAM sequence: AAG
atcctgaggaaatcctgagg

SEQ ID NO: 17077 - DNA, 20 bp, Artificial Sequence
  Description of Artificial Sequence: Synthetic oligonucleotide
  Target: SCN10A; (-) strand; PAM type: NRG; PAM sequence: AGG
tagatcctgaggaaatcctg

SEQ ID NO: 17078 - DNA, 20 bp, Artificial Sequence
  Description of Artificial Sequence: Synthetic oligonucleotide
  Target: SCN10A; (-) strand; PAM type: NRG; PAM sequence: GAG
ctagatcctgaggaaatcct

SEQ ID NO: 17079 - DNA, 20 bp, Artificial Sequence
  Description of Artificial Sequence: Synthetic oligonucleotide
  Target: SCN10A; (-) strand; PAM type: NRG; PAM sequence: AGG
ggtggactgcctagatcctg

SEQ ID NO: 17080 - DNA, 20 bp, Artificial Sequence
  Description of Artificial Sequence: Synthetic oligonucleotide
  Target: SCN10A; (-) strand; PAM type: NRG; PAM sequence: GAG
cggtggactgcctagatcct

SEQ ID NO: 17081 - DNA, 20 bp, Artificial Sequence
  Description of Artificial Sequence: Synthetic oligonucleotide
  Target: SCN10A; (-) strand; PAM type: NRG; PAM sequence: TAG
gggcagcacggtggactgcc

SEQ ID NO: 17082 - DNA, 20 bp, Artificial Sequence
  Description of Artificial Sequence: Synthetic oligonucleotide
  Target: SCN10A; (-) strand; PAM type: NRG; PAM sequence: TGG
ctcctctgagggcagcacgg

SEQ ID NO: 17083 - DNA, 20 bp, Artificial Sequence
  Description of Artificial Sequence: Synthetic oligonucleotide
  Target: SCN10A; (-) strand; PAM type: NRG; PAM sequence: CGG
aagctcctctgagggcagca

SEQ ID NO: 17084 - DNA, 20 bp, Artificial Sequence
  Description of Artificial Sequence: Synthetic oligonucleotide
  Target: SCN10A; (-) strand; PAM type: NRG; PAM sequence: CAG
gacacaagctcctctgaggg

SEQ ID NO: 17085 - DNA, 20 bp, Artificial Sequence
  Description of Artificial Sequence: Synthetic oligonucleotide
  Target: SCN10A; (-) strand; PAM type: NRG; PAM sequence: GGG
gacgacacaagctcctctga

SEQ ID NO: 17086 - DNA, 20 bp, Artificial Sequence
  Description of Artificial Sequence: Synthetic oligonucleotide
  Target: SCN10A; (-) strand; PAM type: NRG; PAM sequence: AGG
ggacgacacaagctcctctg

SEQ ID NO: 17087 - DNA, 20 bp, Artificial Sequence
  Description of Artificial Sequence: Synthetic oligonucleotide
  Target: SCN10A; (-) strand; PAM type: NRG; PAM sequence: GAG
tggacgacacaagctcctct

SEQ ID NO: 17088 - DNA, 20 bp, Artificial Sequence
  Description of Artificial Sequence: Synthetic oligonucleotide
  Target: SCN10A; (-) strand; PAM type: NRG; PAM sequence: AAG
ctgcagggagtggacgacac

SEQ ID NO: 17089 - DNA, 20 bp, Artificial Sequence
  Description of Artificial Sequence: Synthetic oligonucleotide
  Target: SCN10A; (-) strand; PAM type: NRG; PAM sequence: TGG
ggcttctcccctgcagggag

SEQ ID NO: 17090 - DNA, 20 bp, Artificial Sequence
  Description of Artificial Sequence: Synthetic oligonucleotide
  Target: SCN10A; (-) strand; PAM type: NRG; PAM sequence: GAG
ctgggcttctcccctgcagg

SEQ ID NO: 17091 - DNA, 20 bp, Artificial Sequence
  Description of Artificial Sequence: Synthetic oligonucleotide
  Target: SCN10A; (-) strand; PAM type: NRG; PAM sequence: GGG
ccctgggcttctcccctgca

SEQ ID NO: 17092 - DNA, 20 bp, Artificial Sequence
  Description of Artificial Sequence: Synthetic oligonucleotide
  Target: SCN10A; (-) strand; PAM type: NRG; PAM sequence: AGG
gccctgggcttctcccctgc

SEQ ID NO: 17093 - DNA, 20 bp, Artificial Sequence
  Description of Artificial Sequence: Synthetic oligonucleotide
  Target: SCN10A; (-) strand; PAM type: NRG; PAM sequence: CAG
tgccctgggcttctcccctg

SEQ ID NO: 17094 - DNA, 20 bp, Artificial Sequence
  Description of Artificial Sequence: Synthetic oligonucleotide
  Target: SCN10A; (-) strand; PAM type: NRG; PAM sequence: GGG
agagacgagttcactgccct

SEQ ID NO: 17095 - DNA, 20 bp, Artificial Sequence
  Description of Artificial Sequence: Synthetic oligonucleotide
  Target: SCN10A; (-) strand; PAM type: NRG; PAM sequence: TGG
gagagacgagttcactgccc

SEQ ID NO: 17096 - DNA, 20 bp, Artificial Sequence
  Description of Artificial Sequence: Synthetic oligonucleotide
  Target: SCN10A; (-) strand; PAM type: NRG; PAM sequence: GAG
cccgggccccgcggagagac

SEQ ID NO: 17097 - DNA, 20 bp, Artificial Sequence
  Description of Artificial Sequence: Synthetic oligonucleotide
  Target: SCN10A; (-) strand; PAM type: NRG; PAM sequence: GAG
aattccccgggccccgcgga

SEQ ID NO: 17098 - DNA, 20 bp, Artificial Sequence
  Description of Artificial Sequence: Synthetic oligonucleotide
  Target: SCN10A; (-) strand; PAM type: NRG; PAM sequence: GAG
gcaattccccgggccccgcg

SEQ ID NO: 17099 - DNA, 20 bp, Artificial Sequence
  Description of Artificial Sequence: Synthetic oligonucleotide
  Target: SCN10A; (-) strand; PAM type: NRG; PAM sequence: CGG
gtgcaattccccgggccccg

SEQ ID NO: 17100 - DNA, 20 bp, Artificial Sequence
  Description of Artificial Sequence: Synthetic oligonucleotide
  Target: SCN10A; (-) strand; PAM type: NRG; PAM sequence: GGG
gtgaccgtgtgcaattcccc

SEQ ID NO: 17101 - DNA, 20 bp, Artificial Sequence
  Description of Artificial Sequence: Synthetic oligonucleotide
  Target: SCN10A; (-) strand; PAM type: NRG; PAM sequence: CGG
agtgaccgtgtgcaattccc

SEQ ID NO: 17102 - DNA, 20 bp, Artificial Sequence
  Description of Artificial Sequence: Synthetic oligonucleotide
  Target: SCN10A; (-) strand; PAM type: NRG; PAM sequence: CAG
catgggtgcagttgaacctg

SEQ ID NO: 17103 - DNA, 20 bp, Artificial Sequence
  Description of Artificial Sequence: Synthetic oligonucleotide
  Target: SCN10A; (-) strand; PAM type: NRG; PAM sequence: CAG
cgaggcaccaaacatgggtg

SEQ ID NO: 17104 - DNA, 20 bp, Artificial Sequence
  Description of Artificial Sequence: Synthetic oligonucleotide
  Target: SCN10A; (-) strand; PAM type: NRG; PAM sequence: GGG
gctggcgaggcaccaaacat

SEQ ID NO: 17105 - DNA, 20 bp, Artificial Sequence
  Description of Artificial Sequence: Synthetic oligonucleotide
  Target: SCN10A; (-) strand; PAM type: NRG; PAM sequence: TGG
agctggcgaggcaccaaaca

SEQ ID NO: 17106 - DNA, 20 bp, Artificial Sequence
  Description of Artificial Sequence: Synthetic oligonucleotide
  Target: SCN10A; (-) strand; PAM type: NRG; PAM sequence: AGG
gttccaggcctcagctggcg

SEQ ID NO: 17107 - DNA, 20 bp, Artificial Sequence
  Description of Artificial Sequence: Synthetic oligonucleotide
  Target: SCN10A; (-) strand; PAM type: NRG; PAM sequence: GAG
tgttccaggcctcagctggc

SEQ ID NO: 17108 - DNA, 20 bp, Artificial Sequence
  Description of Artificial Sequence: Synthetic oligonucleotide
  Target: SCN10A; (-) strand; PAM type: NRG; PAM sequence: TGG
gcagtgttccaggcctcagc

SEQ ID NO: 17109 - DNA, 20 bp, Artificial Sequence
  Description of Artificial Sequence: Synthetic oligonucleotide
  Target: SCN10A; (-) strand; PAM type: NRG; PAM sequence: CAG
aagagcagtgttccaggcct

SEQ ID NO: 17110 - DNA, 20 bp, Artificial Sequence
  Description of Artificial Sequence: Synthetic oligonucleotide
  Target: SCN10A; (-) strand; PAM type: NRG; PAM sequence: AGG
agggagaagagcagtgttcc

SEQ ID NO: 17111 - DNA, 20 bp, Artificial Sequence
  Description of Artificial Sequence: Synthetic oligonucleotide
  Target: SCN10A; (-) strand; PAM type: NRG; PAM sequence: CAG
cagggagaagagcagtgttc

SEQ ID NO: 17112 - DNA, 20 bp, Artificial Sequence
  Description of Artificial Sequence: Synthetic oligonucleotide
  Target: SCN10A; (-) strand; PAM type: NRG; PAM sequence: CAG
tggggctccagggagaagag

SEQ ID NO: 17113 - DNA, 20 bp, Artificial Sequence
  Description of Artificial Sequence: Synthetic oligonucleotide
  Target: SCN10A; (-) strand; PAM type: NRG; PAM sequence: GAG
ctctggggctccagggagaa

SEQ ID NO: 17114 - DNA, 20 bp, Artificial Sequence
  Description of Artificial Sequence: Synthetic oligonucleotide
  Target: SCN10A; (-) strand; PAM type: NRG; PAM sequence: AAG
gcctctggggctccagggag

SEQ ID NO: 17115 - DNA, 20 bp, Artificial Sequence
  Description of Artificial Sequence: Synthetic oligonucleotide
  Target: SCN10A; (-) strand; PAM type: NRG; PAM sequence: GAG
taagcctctggggctccagg

SEQ ID NO: 17116 - DNA, 20 bp, Artificial Sequence
  Description of Artificial Sequence: Synthetic oligonucleotide
  Target: SCN10A; (-) strand; PAM type: NRG; PAM sequence: GGG
gctaagcctctggggctcca

SEQ ID NO: 17117 - DNA, 20 bp, Artificial Sequence
  Description of Artificial Sequence: Synthetic oligonucleotide
  Target: SCN10A; (-) strand; PAM type: NRG; PAM sequence: AGG
agctaagcctctggggctcc

SEQ ID NO: 17118 - DNA, 20 bp, Artificial Sequence
  Description of Artificial Sequence: Synthetic oligonucleotide
  Target: SCN10A; (-) strand; PAM type: NRG; PAM sequence: CAG
cagctaagcctctggggctc

SEQ ID NO: 17119 - DNA, 20 bp, Artificial Sequence
  Description of Artificial Sequence: Synthetic oligonucleotide
  Target: SCN10A; (-) strand; PAM type: NRG; PAM sequence: GGG
ctcacacagctaagcctctg

SEQ ID NO: 17120 - DNA, 20 bp, Artificial Sequence
  Description of Artificial Sequence: Synthetic oligonucleotide
  Target: SCN10A; (-) strand; PAM type: NRG; PAM sequence: GGG
tctcacacagctaagcctct

SEQ ID NO: 17121 - DNA, 20 bp, Artificial Sequence
  Description of Artificial Sequence: Synthetic oligonucleotide
  Target: SCN10A; (-) strand; PAM type: NRG; PAM sequence: TGG
gtctcacacagctaagcctc

SEQ ID NO: 17122 - DNA, 20 bp, Artificial Sequence
  Description of Artificial Sequence: Synthetic oligonucleotide
  Target: SCN10A; (-) strand; PAM type: NRG; PAM sequence: AAG
gtttacagtctcacacagct

SEQ ID NO: 17123 - DNA, 20 bp, Artificial Sequence
  Description of Artificial Sequence: Synthetic oligonucleotide
  Target: SCN10A; (-) strand; PAM type: NRG; PAM sequence: CAG
cgaaggtttacagtctcaca

SEQ ID NO: 17124 - DNA, 20 bp, Artificial Sequence
  Description of Artificial Sequence: Synthetic oligonucleotide
  Target: SCN10A; (-) strand; PAM type: NRG; PAM sequence: CAG
tcaggggccccgaaggttta

SEQ ID NO: 17125 - DNA, 20 bp, Artificial Sequence
  Description of Artificial Sequence: Synthetic oligonucleotide
  Target: SCN10A; (-) strand; PAM type: NRG; PAM sequence: AGG
cactccatcaggggccccga

SEQ ID NO: 17126 - DNA, 20 bp, Artificial Sequence
  Description of Artificial Sequence: Synthetic oligonucleotide
  Target: SCN10A; (-) strand; PAM type: NRG; PAM sequence: AAG
gcactccatcaggggccccg

SEQ ID NO: 17127 - DNA, 20 bp, Artificial Sequence
  Description of Artificial Sequence: Synthetic oligonucleotide
  Target: SCN10A; (-) strand; PAM type: NRG; PAM sequence: GGG
cattgccagcactccatcag

SEQ ID NO: 17128 - DNA, 20 bp, Artificial Sequence
  Description of Artificial Sequence: Synthetic oligonucleotide
  Target: SCN10A; (-) strand; PAM type: NRG; PAM sequence: GGG
ccattgccagcactccatca

SEQ ID NO: 17129 - DNA, 20 bp, Artificial Sequence
  Description of Artificial Sequence: Synthetic oligonucleotide
  Target: SCN10A; (-) strand; PAM type: NRG; PAM sequence: AGG
gccattgccagcactccatc

SEQ ID NO: 17130 - DNA, 20 bp, Artificial Sequence
  Description of Artificial Sequence: Synthetic oligonucleotide
  Target: SCN10A; (-) strand; PAM type: NRG; PAM sequence: CAG
ggccattgccagcactccat

SEQ ID NO: 17131 - DNA, 20 bp, Artificial Sequence
  Description of Artificial Sequence: Synthetic oligonucleotide
  Target: SCN10A; (-) strand; PAM type: NRG; PAM sequence: CAG
acggtgtctcgggccattgc

SEQ ID NO: 17132 - DNA, 20 bp, Artificial Sequence
  Description of Artificial Sequence: Synthetic oligonucleotide
  Target: SCN10A; (-) strand; PAM type: NRG; PAM sequence: GGG
gggtgtaattacggtgtctc

SEQ ID NO: 17133 - DNA, 20 bp, Artificial Sequence
  Description of Artificial Sequence: Synthetic oligonucleotide
  Target: SCN10A; (-) strand; PAM type: NRG; PAM sequence: CGG
tgggtgtaattacggtgtct

SEQ ID NO: 17134 - DNA, 20 bp, Artificial Sequence
  Description of Artificial Sequence: Synthetic oligonucleotide
  Target: SCN10A; (-) strand; PAM type: NRG; PAM sequence: CGG
agtcgttatgggtgtaatta

SEQ ID NO: 17135 - DNA, 20 bp, Artificial Sequence
  Description of Artificial Sequence: Synthetic oligonucleotide
  Target: SCN10A; (-) strand; PAM type: NRG; PAM sequence: GGG
tgaatgctgagagtcgttat

SEQ ID NO: 17136 - DNA, 20 bp, Artificial Sequence
  Description of Artificial Sequence: Synthetic oligonucleotide
  Target: SCN10A; (-) strand; PAM type: NRG; PAM sequence: TGG
gtgaatgctgagagtcgtta

SEQ ID NO: 17137 - DNA, 20 bp, Artificial Sequence
  Description of Artificial Sequence: Synthetic oligonucleotide
  Target: SCN10A; (-) strand; PAM type: NRG; PAM sequence: GAG
tcaagcccagtgaatgctga

SEQ ID NO: 17138 - DNA, 20 bp, Artificial Sequence
  Description of Artificial Sequence: Synthetic oligonucleotide
  Target: SCN10A; (-) strand; PAM type: NRG; PAM sequence: GAG
attcaagcccagtgaatgct

SEQ ID NO: 17139 - DNA, 20 bp, Artificial Sequence
  Description of Artificial Sequence: Synthetic oligonucleotide
  Target: SCN10A; (-) strand; PAM type: NRG; PAM sequence: CAG
catgattaaatattcaagcc

SEQ ID NO: 17140 - DNA, 20 bp, Artificial Sequence
  Description of Artificial Sequence: Synthetic oligonucleotide
  Target: SCN10A; (-) strand; PAM type: NRG; PAM sequence: AAG
tactccatgattaaatattc

SEQ ID NO: 17141 - DNA, 20 bp, Artificial Sequence
  Description of Artificial Sequence: Synthetic oligonucleotide
  Target: SCN10A; (-) strand; PAM type: NRG; PAM sequence: CAG
aggagggcagcaggcccctg

SEQ ID NO: 17142 - DNA, 20 bp, Artificial Sequence
  Description of Artificial Sequence: Synthetic oligonucleotide
  Target: SCN10A; (-) strand; PAM type: NRG; PAM sequence: AGG
ggagctgccaggagggcagc

SEQ ID NO: 17143 - DNA, 20 bp, Artificial Sequence
  Description of Artificial Sequence: Synthetic oligonucleotide
  Target: SCN10A; (-) strand; PAM type: NRG; PAM sequence: CAG
tggagctgccaggagggcag

SEQ ID NO: 17144 - DNA, 20 bp, Artificial Sequence
  Description of Artificial Sequence: Synthetic oligonucleotide
  Target: SCN10A; (-) strand; PAM type: NRG; PAM sequence: CAG
ggctggagctgccaggaggg

SEQ ID NO: 17145 - DNA, 20 bp, Artificial Sequence
  Description of Artificial Sequence: Synthetic oligonucleotide
  Target: SCN10A; (-) strand; PAM type: NRG; PAM sequence: GGG
tagggctggagctgccagga

SEQ ID NO: 17146 - DNA, 20 bp, Artificial Sequence
  Description of Artificial Sequence: Synthetic oligonucleotide
  Target: SCN10A; (-) strand; PAM type: NRG; PAM sequence: AGG
atagggctggagctgccagg

SEQ ID NO: 17147 - DNA, 20 bp, Artificial Sequence
  Description of Artificial Sequence: Synthetic oligonucleotide
  Target: SCN10A; (-) strand; PAM type: NRG; PAM sequence: GAG
tatagggctggagctgccag

SEQ ID NO: 17148 - DNA, 20 bp, Artificial Sequence
  Description of Artificial Sequence: Synthetic oligonucleotide
  Target: SCN10A; (-) strand; PAM type: NRG; PAM sequence: AGG
attatagggctggagctgcc

SEQ ID NO: 17149 - DNA, 20 bp, Artificial Sequence
  Description of Artificial Sequence: Synthetic oligonucleotide
  Target: SCN10A; (-) strand; PAM type: NRG; PAM sequence: CAG
cattatagggctggagctgc

SEQ ID NO: 17150 - DNA, 20 bp, Artificial Sequence
  Description of Artificial Sequence: Synthetic oligonucleotide
  Target: SCN10A; (-) strand; PAM type: NRG; PAM sequence: GAG
ctggagacattatagggctg

SEQ ID NO: 17151 - DNA, 20 bp, Artificial Sequence
  Description of Artificial Sequence: Synthetic oligonucleotide
  Target: SCN10A; (-) strand; PAM type: NRG; PAM sequence: TGG
atctggagacattatagggc

SEQ ID NO: 17152 - DNA, 20 bp, Artificial Sequence
  Description of Artificial Sequence: Synthetic oligonucleotide
  Target: SCN10A; (-) strand; PAM type: NRG; PAM sequence: GGG
attcatctggagacattata

SEQ ID NO: 17153 - DNA, 20 bp, Artificial Sequence
  Description of Artificial Sequence: Synthetic oligonucleotide
  Target: SCN10A; (-) strand; PAM type: NRG; PAM sequence: AGG
aattcatctggagacattat

SEQ ID NO: 17154 - DNA, 20 bp, Artificial Sequence
  Description of Artificial Sequence: Synthetic oligonucleotide
  Target: SCN10A; (-) strand; PAM type: NRG; PAM sequence: TAG
gaattcatctggagacatta

SEQ ID NO: 17155 - DNA, 20 bp, Artificial Sequence
  Description of Artificial Sequence: Synthetic oligonucleotide
  Target: SCN10A; (-) strand; PAM type: NRG; PAM sequence: GAG
cccctaattgaattcatctg

SEQ ID NO: 17156 - DNA, 20 bp, Artificial Sequence
  Description of Artificial Sequence: Synthetic oligonucleotide
  Target: SCN10A; (-) strand; PAM type: NRG; PAM sequence: TGG
aacccctaattgaattcatc

SEQ ID NO: 17157 - DNA, 20 bp, Artificial Sequence
  Description of Artificial Sequence: Synthetic oligonucleotide
  Target: SCN10A; (-) strand; PAM type: NRG; PAM sequence: GAG
tatcaggtttactaatatga

SEQ ID NO: 17158 - DNA, 20 bp, Artificial Sequence
  Description of Artificial Sequence: Synthetic oligonucleotide
  Target: SCN10A; (-) strand; PAM type: NRG; PAM sequence: GAG
gctatcaggtttactaatat

SEQ ID NO: 17159 - DNA, 20 bp, Artificial Sequence
  Description of Artificial Sequence: Synthetic oligonucleotide
  Target: SCN10A; (-) strand; PAM type: NRG; PAM sequence: AGG
ggtccattagcaaagctatc

SEQ ID NO: 17160 - DNA, 20 bp, Artificial Sequence
  Description of Artificial Sequence: Synthetic oligonucleotide
  Target: SCN10A; (-) strand; PAM type: NRG; PAM sequence: CAG
gggtccattagcaaagctat

SEQ ID NO: 17161 - DNA, 20 bp, Artificial Sequence
  Description of Artificial Sequence: Synthetic oligonucleotide
  Target: SCN10A; (-) strand; PAM type: NRG; PAM sequence: AAG
accatttgggtccattagca

SEQ ID NO: 17162 - DNA, 20 bp, Artificial Sequence
  Description of Artificial Sequence: Synthetic oligonucleotide
  Target: SCN10A; (-) strand; PAM type: NRG; PAM sequence: TAG
gccccaccatttgggtccat

SEQ ID NO: 17163 - DNA, 20 bp, Artificial Sequence
  Description of Artificial Sequence: Synthetic oligonucleotide
  Target: SCN10A; (-) strand; PAM type: NRG; PAM sequence: GGG
ggggacccgccccaccattt

SEQ ID NO: 17164 - DNA, 20 bp, Artificial Sequence
  Description of Artificial Sequence: Synthetic oligonucleotide
  Target: SCN10A; (-) strand; PAM type: NRG; PAM sequence: TGG
tggggacccgccccaccatt

SEQ ID NO: 17165 - DNA, 20 bp, Artificial Sequence
  Description of Artificial Sequence: Synthetic oligonucleotide
  Target: SCN10A; (-) strand; PAM type: NRG; PAM sequence: GGG
gggcctgacagcgacaaatg

SEQ ID NO: 17166 - DNA, 20 bp, Artificial Sequence
  Description of Artificial Sequence: Synthetic oligonucleotide
  Target: SCN10A; (-) strand; PAM type: NRG; PAM sequence: GGG
ggggcctgacagcgacaaat

SEQ ID NO: 17167 - DNA, 20 bp, Artificial Sequence
  Description of Artificial Sequence: Synthetic oligonucleotide
  Target: SCN10A; (-) strand; PAM type: NRG; PAM sequence: TGG
aggggcctgacagcgacaaa

SEQ ID NO: 17168 - DNA, 20 bp, Artificial Sequence
  Description of Artificial Sequence: Synthetic oligonucleotide
  Target: SCN10A; (-) strand; PAM type: NRG; PAM sequence: CAG
gctaggcaggaggggcctga

SEQ ID NO: 17169 - DNA, 20 bp, Artificial Sequence
  Description of Artificial Sequence: Synthetic oligonucleotide
  Target: SCN10A; (-) strand; PAM type: NRG; PAM sequence: GGG
tgaccccggctaggcaggag

SEQ ID NO: 17170 - DNA, 20 bp, Artificial Sequence
  Description of Artificial Sequence: Synthetic oligonucleotide
  Target: SCN10A; (-) strand; PAM type: NRG; PAM sequence: GGG
atgaccccggctaggcagga

SEQ ID NO: 17171 - DNA, 20 bp, Artificial Sequence
  Description of Artificial Sequence: Synthetic oligonucleotide
  Target: SCN10A; (-) strand; PAM type: NRG; PAM sequence: AGG
catgaccccggctaggcagg

SEQ ID NO: 17172 - DNA, 20 bp, Artificial Sequence
  Description of Artificial Sequence: Synthetic oligonucleotide
  Target: SCN10A; (-) strand; PAM type: NRG; PAM sequence: GAG
ccatgaccccggctaggcag

SEQ ID NO: 17173 - DNA, 20 bp, Artificial Sequence
  Description of Artificial Sequence: Synthetic oligonucleotide
  Target: SCN10A; (-) strand; PAM type: NRG; PAM sequence: AGG
gtccatgaccccggctaggc

SEQ ID NO: 17174 - DNA, 20 bp, Artificial Sequence
  Description of Artificial Sequence: Synthetic oligonucleotide
  Target: SCN10A; (-) strand; PAM type: NRG; PAM sequence: CAG
tgtccatgaccccggctagg

SEQ ID NO: 17175 - DNA, 20 bp, Artificial Sequence
  Description of Artificial Sequence: Synthetic oligonucleotide
  Target: SCN10A; (-) strand; PAM type: NRG; PAM sequence: AGG
tcttgtccatgaccccggct

SEQ ID NO: 17176 - DNA, 20 bp, Artificial Sequence
  Description of Artificial Sequence: Synthetic oligonucleotide
  Target: SCN10A; (-) strand; PAM type: NRG; PAM sequence: TAG
ttcttgtccatgaccccggc

SEQ ID NO: 17177 - DNA, 20 bp, Artificial Sequence
  Description of Artificial Sequence: Synthetic oligonucleotide
  Target: SCN10A; (-) strand; PAM type: NRG; PAM sequence: CGG
tgttttcttgtccatgaccc

SEQ ID NO: 17178 - DNA, 20 bp, Artificial Sequence
  Description of Artificial Sequence: Synthetic oligonucleotide
  Target: SCN10A; (-) strand; PAM type: NRG; PAM sequence: TGG
agtacacaacttctgggtgt

SEQ ID NO: 17179 - DNA, 20 bp, Artificial Sequence
  Description of Artificial Sequence: Synthetic oligonucleotide
  Target: SCN10A; (-) strand; PAM type: NRG; PAM sequence: GGG
gttttcagtacacaacttct

SEQ ID NO: 17180 - DNA, 20 bp, Artificial Sequence
  Description of Artificial Sequence: Synthetic oligonucleotide
  Target: SCN10A; (-) strand; PAM type: NRG; PAM sequence: TGG
tgttttcagtacacaacttc

SEQ ID NO: 17181 - DNA, 20 bp, Artificial Sequence
  Description of Artificial Sequence: Synthetic oligonucleotide
  Target: SCN10A; (-) strand; PAM type: NRG; PAM sequence: CAG
ttgtccctactcaatgtttt

SEQ ID NO: 17182 - DNA, 20 bp, Artificial Sequence
  Description of Artificial Sequence: Synthetic oligonucleotide
  Target: SCN10A; (-) strand; PAM type: NRG; PAM sequence: TAG
gttccaaggactcccctggc

SEQ ID NO: 17183 - DNA, 20 bp, Artificial Sequence
  Description of Artificial Sequence: Synthetic oligonucleotide
  Target: SCN10A; (-) strand; PAM type: NRG; PAM sequence: TGG
aaatgttccaaggactcccc

SEQ ID NO: 17184 - DNA, 20 bp, Artificial Sequence
  Description of Artificial Sequence: Synthetic oligonucleotide
  Target: SCN10A; (-) strand; PAM type: NRG; PAM sequence: AGG
gcttcttcccaaatgttcca

SEQ ID NO: 17185 - DNA, 20 bp, Artificial Sequence
  Description of Artificial Sequence: Synthetic oligonucleotide
  Target: SCN10A; (-) strand; PAM type: NRG; PAM sequence: AAG
tgcttcttcccaaatgttcc

SEQ ID NO: 17186 - DNA, 20 bp, Artificial Sequence
  Description of Artificial Sequence: Synthetic oligonucleotide
  Target: SCN10A; (-) strand; PAM type: NRG; PAM sequence: TGG
gggctgtcacattctgcacg

SEQ ID NO: 17187 - DNA, 20 bp, Artificial Sequence
  Description of Artificial Sequence: Synthetic oligonucleotide
  Target: SCN10A; (-) strand; PAM type: NRG; PAM sequence: GGG
gcttggttcccactgggtga

SEQ ID NO: 17188 - DNA, 20 bp, Artificial Sequence
  Description of Artificial Sequence: Synthetic oligonucleotide
  Target: SCN10A; (-) strand; PAM type: NRG; PAM sequence: AGG
cgcttggttcccactgggtg

SEQ ID NO: 17189 - DNA, 20 bp, Artificial Sequence
  Description of Artificial Sequence: Synthetic oligonucleotide
  Target: SCN10A; (-) strand; PAM type: NRG; PAM sequence: GAG
ccgcttggttcccactgggt

SEQ ID NO: 17190 - DNA, 20 bp, Artificial Sequence
  Description of Artificial Sequence: Synthetic oligonucleotide
  Target: SCN10A; (-) strand; PAM type: NRG; PAM sequence: GGG
gaagccgcttggttcccact

SEQ ID NO: 17191 - DNA, 20 bp, Artificial Sequence
  Description of Artificial Sequence: Synthetic oligonucleotide
  Target: SCN10A; (-) strand; PAM type: NRG; PAM sequence: TGG
agaagccgcttggttcccac

SEQ ID NO: 17192 - DNA, 20 bp, Artificial Sequence
  Description of Artificial Sequence: Synthetic oligonucleotide
  Target: SCN10A; (-) strand; PAM type: NRG; PAM sequence: TGG
gtgggtgaacagaagccgct

SEQ ID NO: 17193 - DNA, 20 bp, Artificial Sequence
  Description of Artificial Sequence: Synthetic oligonucleotide
  Target: SCN10A; (-) strand; PAM type: NRG; PAM sequence: AAG
tgggggctgtgggtgaacag

SEQ ID NO: 17194 - DNA, 20 bp, Artificial Sequence
  Description of Artificial Sequence: Synthetic oligonucleotide
  Target: SCN10A; (-) strand; PAM type: NRG; PAM sequence: CAG
atttgggggctgtgggtgaa

SEQ ID NO: 17195 - DNA, 20 bp, Artificial Sequence
  Description of Artificial Sequence: Synthetic oligonucleotide
  Target: SCN10A; (-) strand; PAM type: NRG; PAM sequence: GGG
ggacgggatttgggggctgt

SEQ ID NO: 17196 - DNA, 20 bp, Artificial Sequence
  Description of Artificial Sequence: Synthetic oligonucleotide
  Target: SCN10A; (-) strand; PAM type: NRG; PAM sequence: TGG
gggacgggatttgggggctg

SEQ ID NO: 17197 - DNA, 20 bp, Artificial Sequence
  Description of Artificial Sequence: Synthetic oligonucleotide
  Target: SCN10A; (-) strand; PAM type: NRG; PAM sequence: GGG
agggctgggacgggatttgg

SEQ ID NO: 17198 - DNA, 20 bp, Artificial Sequence
  Description of Artificial Sequence: Synthetic oligonucleotide
  Target: SCN10A; (-) strand; PAM type: NRG; PAM sequence: GGG
gagggctgggacgggatttg

SEQ ID NO: 17199 - DNA, 20 bp, Artificial Sequence
  Description of Artificial Sequence: Synthetic oligonucleotide
  Target: SCN10A; (-) strand; PAM type: NRG; PAM sequence: GGG
ggagggctgggacgggattt

SEQ ID NO: 17200 - DNA, 20 bp, Artificial Sequence
  Description of Artificial Sequence: Synthetic oligonucleotide
  Target: SCN10A; (-) strand; PAM type: NRG; PAM sequence: TGG
gggagggctgggacgggatt

SEQ ID NO: 17201 - DNA, 20 bp, Artificial Sequence
  Description of Artificial Sequence: Synthetic oligonucleotide
  Target: SCN10A; (-) strand; PAM type: NRG; PAM sequence: GGG
ataagagggagggctgggac

SEQ ID NO: 17202 - DNA, 20 bp, Artificial Sequence
  Description of Artificial Sequence: Synthetic oligonucleotide
  Target: SCN10A; (-) strand; PAM type: NRG; PAM sequence: CGG
gataagagggagggctggga

SEQ ID NO: 17203 - DNA, 20 bp, Artificial Sequence
  Description of Artificial Sequence: Synthetic oligonucleotide
  Target: SCN10A; (-) strand; PAM type: NRG; PAM sequence: GGG
gtaagataagagggagggct

SEQ ID NO: 17204 - DNA, 20 bp, Artificial Sequence
  Description of Artificial Sequence: Synthetic oligonucleotide
  Target: SCN10A; (-) strand; PAM type: NRG; PAM sequence: TGG
ggtaagataagagggagggc

SEQ ID NO: 17205 - DNA, 20 bp, Artificial Sequence
  Description of Artificial Sequence: Synthetic oligonucleotide
  Target: SCN10A; (-) strand; PAM type: NRG; PAM sequence: GGG
gcagggtaagataagaggga

SEQ ID NO: 17206 - DNA, 20 bp, Artificial Sequence
  Description of Artificial Sequence: Synthetic oligonucleotide
  Target: SCN10A; (-) strand; PAM type: NRG; PAM sequence: AGG
agcagggtaagataagaggg

SEQ ID NO: 17207 - DNA, 20 bp, Artificial Sequence
  Description of Artificial Sequence: Synthetic oligonucleotide
  Target: SCN10A; (-) strand; PAM type: NRG; PAM sequence: GAG
cagcagggtaagataagagg

SEQ ID NO: 17208 - DNA, 20 bp, Artificial Sequence
  Description of Artificial Sequence: Synthetic oligonucleotide
  Target: SCN10A; (-) strand; PAM type: NRG; PAM sequence: GGG
cacagcagggtaagataaga

SEQ ID NO: 17209 - DNA, 20 bp, Artificial Sequence
  Description of Artificial Sequence: Synthetic oligonucleotide
  Target: SCN10A; (-) strand; PAM type: NRG; PAM sequence: AGG
ccacagcagggtaagataag

SEQ ID NO: 17210 - DNA, 20 bp, Artificial Sequence
  Description of Artificial Sequence: Synthetic oligonucleotide
  Target: SCN10A; (-) strand; PAM type: NRG; PAM sequence: GAG
accacagcagggtaagataa

SEQ ID NO: 17211 - DNA, 20 bp, Artificial Sequence
  Description of Artificial Sequence: Synthetic oligonucleotide
  Target: SCN10A; (-) strand; PAM type: NRG; PAM sequence: AAG
tgaccacagcagggtaagat

SEQ ID NO: 17212 - DNA, 20 bp, Artificial Sequence
  Description of Artificial Sequence: Synthetic oligonucleotide
  Target: SCN10A; (-) strand; PAM type: NRG; PAM sequence: AAG
aaggctgaccacagcagggt

SEQ ID NO: 17213 - DNA, 20 bp, Artificial Sequence
  Description of Artificial Sequence: Synthetic oligonucleotide
  Target: SCN10A; (-) strand; PAM type: NRG; PAM sequence: GGG
aggcaaggctgaccacagca

SEQ ID NO: 17214 - DNA, 20 bp, Artificial Sequence
  Description of Artificial Sequence: Synthetic oligonucleotide
  Target: SCN10A; (-) strand; PAM type: NRG; PAM sequence: AGG
taggcaaggctgaccacagc

SEQ ID NO: 17215 - DNA, 20 bp, Artificial Sequence
  Description of Artificial Sequence: Synthetic oligonucleotide
  Target: SCN10A; (-) strand; PAM type: NRG; PAM sequence: CAG
ctaggcaaggctgaccacag

SEQ ID NO: 17216 - DNA, 20 bp, Artificial Sequence
  Description of Artificial Sequence: Synthetic oligonucleotide
  Target: SCN10A; (-) strand; PAM type: NRG; PAM sequence: CAG
gccctaggcaaggctgacca

SEQ ID NO: 17217 - DNA, 20 bp, Artificial Sequence
  Description of Artificial Sequence: Synthetic oligonucleotide
  Target: SCN10A; (-) strand; PAM type: NRG; PAM sequence: AGG
ctggctgtgtgccctaggca

SEQ ID NO: 17218 - DNA, 20 bp, Artificial Sequence
  Description of Artificial Sequence: Synthetic oligonucleotide
  Target: SCN10A; (-) strand; PAM type: NRG; PAM sequence: AAG
actggctgtgtgccctaggc

SEQ ID NO: 17219 - DNA, 20 bp, Artificial Sequence
  Description of Artificial Sequence: Synthetic oligonucleotide
  Target: SCN10A; (-) strand; PAM type: NRG; PAM sequence: AGG
agctactggctgtgtgccct

SEQ ID NO: 17220 - DNA, 20 bp, Artificial Sequence
  Description of Artificial Sequence: Synthetic oligonucleotide
  Target: SCN10A; (-) strand; PAM type: NRG; PAM sequence: TAG
cagctactggctgtgtgccc

SEQ ID NO: 17221 - DNA, 20 bp, Artificial Sequence
  Description of Artificial Sequence: Synthetic oligonucleotide
  Target: SCN10A; (-) strand; PAM type: NRG; PAM sequence: TGG
gcttgaagaatgtcagctac

SEQ ID NO: 17222 - DNA, 20 bp, Artificial Sequence
  Description of Artificial Sequence: Synthetic oligonucleotide
  Target: SCN10A; (-) strand; PAM type: NRG; PAM sequence: CAG
cccttcagcttgaagaatgt

SEQ ID NO: 17223 - DNA, 20 bp, Artificial Sequence
  Description of Artificial Sequence: Synthetic oligonucleotide
  Target: SCN10A; (-) strand; PAM type: NRG; PAM sequence: AAG
ttatcaagcccttcagcttg

SEQ ID NO: 17224 - DNA, 20 bp, Artificial Sequence
  Description of Artificial Sequence: Synthetic oligonucleotide
  Target: SCN10A; (-) strand; PAM type: NRG; PAM sequence: CAG
cccaaagttatcaagccctt

SEQ ID NO: 17225 - DNA, 20 bp, Artificial Sequence
  Description of Artificial Sequence: Synthetic oligonucleotide
  Target: SCN10A; (-) strand; PAM type: NRG; PAM sequence: AAG
aattcatccccaaagttatc

SEQ ID NO: 17226 - DNA, 20 bp, Artificial Sequence
  Description of Artificial Sequence: Synthetic oligonucleotide
  Target: SCN10A; (-) strand; PAM type: NRG; PAM sequence: AAG
gaagtcataattcatcccca

SEQ ID NO: 17227 - DNA, 20 bp, Artificial Sequence
  Description of Artificial Sequence: Synthetic oligonucleotide
  Target: SCN10A; (-) strand; PAM type: NRG; PAM sequence: AAG
tgggctcaacagagataagg

SEQ ID NO: 17228 - DNA, 20 bp, Artificial Sequence
  Description of Artificial Sequence: Synthetic oligonucleotide
  Target: SCN10A; (-) strand; PAM type: NRG; PAM sequence: AGG
cactgggctcaacagagata

SEQ ID NO: 17229 - DNA, 20 bp, Artificial Sequence
  Description of Artificial Sequence: Synthetic oligonucleotide
  Target: SCN10A; (-) strand; PAM type: NRG; PAM sequence: AAG
gcactgggctcaacagagat

SEQ ID NO: 17230 - DNA, 20 bp, Artificial Sequence
  Description of Artificial Sequence: Synthetic oligonucleotide
  Target: SCN10A; (-) strand; PAM type: NRG; PAM sequence: GAG
gacaggcactgggctcaaca

SEQ ID NO: 17231 - DNA, 20 bp, Artificial Sequence
  Description of Artificial Sequence: Synthetic oligonucleotide
  Target: SCN10A; (-) strand; PAM type: NRG; PAM sequence: CAG
gtgacaggcactgggctcaa

SEQ ID NO: 17232 - DNA, 20 bp, Artificial Sequence
  Description of Artificial Sequence: Synthetic oligonucleotide
  Target: SCN10A; (-) strand; PAM type: NRG; PAM sequence: GGG
ctgactttgtgacaggcact

SEQ ID NO: 17233 - DNA, 20 bp, Artificial Sequence
  Description of Artificial Sequence: Synthetic oligonucleotide
  Target: SCN10A; (-) strand; PAM type: NRG; PAM sequence: TGG
gctgactttgtgacaggcac

SEQ ID NO: 17234 - DNA, 20 bp, Artificial Sequence
  Description of Artificial Sequence: Synthetic oligonucleotide
  Target: SCN10A; (-) strand; PAM type: NRG; PAM sequence: AGG
ctgagtgctgactttgtgac

SEQ ID NO: 17235 - DNA, 20 bp, Artificial Sequence
  Description of Artificial Sequence: Synthetic oligonucleotide
  Target: SCN10A; (-) strand; PAM type: NRG; PAM sequence: CAG
actgagtgctgactttgtga

SEQ ID NO: 17236 - DNA, 20 bp, Artificial Sequence
  Description of Artificial Sequence: Synthetic oligonucleotide
  Target: SCN10A; (-) strand; PAM type: NRG; PAM sequence: GAG
taatttgacacctagccact

SEQ ID NO: 17237 - DNA, 20 bp, Artificial Sequence
  Description of Artificial Sequence: Synthetic oligonucleotide
  Target: SCN10A; (-) strand; PAM type: NRG; PAM sequence: TAG
caagaatttaatttgacacc

SEQ ID NO: 17238 - DNA, 20 bp, Artificial Sequence
  Description of Artificial Sequence: Synthetic oligonucleotide
  Target: SCN10A; (-) strand; PAM type: NRG; PAM sequence: AAG
aataacactgccttcaattc

SEQ ID NO: 17239 - DNA, 20 bp, Artificial Sequence
  Description of Artificial Sequence: Synthetic oligonucleotide
  Target: SCN10A; (-) strand; PAM type: NRG; PAM sequence: TAG
aagaggcatctataaaagtt

SEQ ID NO: 17240 - DNA, 20 bp, Artificial Sequence
  Description of Artificial Sequence: Synthetic oligonucleotide
  Target: SCN10A; (-) strand; PAM type: NRG; PAM sequence: AAG
agggaaagaggcatctataa

SEQ ID NO: 17241 - DNA, 20 bp, Artificial Sequence
  Description of Artificial Sequence: Synthetic oligonucleotide
  Target: SCN10A; (-) strand; PAM type: NRG; PAM sequence: AGG
gaaacaagctatagggaaag

SEQ ID NO: 17242 - DNA, 20 bp, Artificial Sequence
  Description of Artificial Sequence: Synthetic oligonucleotide
  Target: SCN10A; (-) strand; PAM type: NRG; PAM sequence: GAG
ggaaacaagctatagggaaa

SEQ ID NO: 17243 - DNA, 20 bp, Artificial Sequence
  Description of Artificial Sequence: Synthetic oligonucleotide
  Target: SCN10A; (-) strand; PAM type: NRG; PAM sequence: AAG
aaggaaacaagctataggga

SEQ ID NO: 17244 - DNA, 20 bp, Artificial Sequence
  Description of Artificial Sequence: Synthetic oligonucleotide
  Target: SCN10A; (-) strand; PAM type: NRG; PAM sequence: GGG
cttgaaggaaacaagctata

SEQ ID NO: 17245 - DNA, 20 bp, Artificial Sequence
  Description of Artificial Sequence: Synthetic oligonucleotide
  Target: SCN10A; (-) strand; PAM type: NRG; PAM sequence: AGG
tcttgaaggaaacaagctat

SEQ ID NO: 17246 - DNA, 20 bp, Artificial Sequence
  Description of Artificial Sequence: Synthetic oligonucleotide
  Target: SCN10A; (-) strand; PAM type: NRG; PAM sequence: TAG
atcttgaaggaaacaagcta

SEQ ID NO: 17247 - DNA, 20 bp, Artificial Sequence
  Description of Artificial Sequence: Synthetic oligonucleotide
  Target: SCN10A; (-) strand; PAM type: NRG; PAM sequence: AAG
ttacaaatcttgaaggaaac

SEQ ID NO: 17248 - DNA, 20 bp, Artificial Sequence
  Description of Artificial Sequence: Synthetic oligonucleotide
  Target: SCN10A; (-) strand; PAM type: NRG; PAM sequence: AGG
gtttcacttacaaatcttga

SEQ ID NO: 17249 - DNA, 20 bp, Artificial Sequence
  Description of Artificial Sequence: Synthetic oligonucleotide
  Target: SCN10A; (-) strand; PAM type: NRG; PAM sequence: AAG
ggtttcacttacaaatcttg

SEQ ID NO: 17250 - DNA, 20 bp, Artificial Sequence
  Description of Artificial Sequence: Synthetic oligonucleotide
  Target: SCN10A; (-) strand; PAM type: NRG; PAM sequence: TGG
atacaaggtaaaaataaatg

SEQ ID NO: 17251 - DNA, 20 bp, Artificial Sequence
  Description of Artificial Sequence: Synthetic oligonucleotide
  Target: SCN10A; (-) strand; PAM type: NRG; PAM sequence: AGG
gtttaggattgtcttataca

SEQ ID NO: 17252 - DNA, 20 bp, Artificial Sequence
  Description of Artificial Sequence: Synthetic oligonucleotide
  Target: SCN10A; (-) strand; PAM type: NRG; PAM sequence: AAG
ggtttaggattgtcttatac

SEQ ID NO: 17253 - DNA, 20 bp, Artificial Sequence
  Description of Artificial Sequence: Synthetic oligonucleotide
  Target: SCN10A; (-) strand; PAM type: NRG; PAM sequence: AGG
agctggaagattagaggttt

SEQ ID NO: 17254 - DNA, 20 bp, Artificial Sequence
  Description of Artificial Sequence: Synthetic oligonucleotide
  Target: SCN10A; (-) strand; PAM type: NRG; PAM sequence: TAG
gagctggaagattagaggtt

SEQ ID NO: 17255 - DNA, 20 bp, Artificial Sequence
  Description of Artificial Sequence: Synthetic oligonucleotide
  Target: SCN10A; (-) strand; PAM type: NRG; PAM sequence: AGG
agactgagctggaagattag

SEQ ID NO: 17256 - DNA, 20 bp, Artificial Sequence
  Description of Artificial Sequence: Synthetic oligonucleotide
  Target: SCN10A; (-) strand; PAM type: NRG; PAM sequence: GAG
gagactgagctggaagatta

SEQ ID NO: 17257 - DNA, 20 bp, Artificial Sequence
  Description of Artificial Sequence: Synthetic oligonucleotide
  Target: SCN10A; (-) strand; PAM type: NRG; PAM sequence: TAG
cagagactgagctggaagat

SEQ ID NO: 17258 - DNA, 20 bp, Artificial Sequence
  Description of Artificial Sequence: Synthetic oligonucleotide
  Target: SCN10A; (-) strand; PAM type: NRG; PAM sequence: AAG
cctcacagagactgagctgg

SEQ ID NO: 17259 - DNA, 20 bp, Artificial Sequence
  Description of Artificial Sequence: Synthetic oligonucleotide
  Target: SCN10A; (-) strand; PAM type: NRG; PAM sequence: TGG
cagcctcacagagactgagc

SEQ ID NO: 17260 - DNA, 20 bp, Artificial Sequence
  Description of Artificial Sequence: Synthetic oligonucleotide
  Target: SCN10A; (-) strand; PAM type: NRG; PAM sequence: GAG
gtgacagcctcacagagact

SEQ ID NO: 17261 - DNA, 20 bp, Artificial Sequence
  Description of Artificial Sequence: Synthetic oligonucleotide
  Target: SCN10A; (-) strand; PAM type: NRG; PAM sequence: GAG
agtgaagtgacagcctcaca

SEQ ID NO: 17262 - DNA, 20 bp, Artificial Sequence
  Description of Artificial Sequence: Synthetic oligonucleotide
  Target: SCN10A; (-) strand; PAM type: NRG; PAM sequence: CAG
gtagtgaagtgacagcctca

SEQ ID NO: 17263 - DNA, 20 bp, Artificial Sequence
  Description of Artificial Sequence: Synthetic oligonucleotide
  Target: SCN10A; (-) strand; PAM type: NRG; PAM sequence: CAG
ataggtgagtagtgaagtga

SEQ ID NO: 17264 - DNA, 20 bp, Artificial Sequence
  Description of Artificial Sequence: Synthetic oligonucleotide
  Target: SCN10A; (-) strand; PAM type: NRG; PAM sequence: AAG
ctctctataggtgagtagtg

SEQ ID NO: 17265 - DNA, 20 bp, Artificial Sequence
  Description of Artificial Sequence: Synthetic oligonucleotide
  Target: SCN10A; (-) strand; PAM type: NRG; PAM sequence: TAG
agaggctctctataggtgag

SEQ ID NO: 17266 - DNA, 20 bp, Artificial Sequence
  Description of Artificial Sequence: Synthetic oligonucleotide
  Target: SCN10A; (-) strand; PAM type: NRG; PAM sequence: GAG
gggagaggctctctataggt

SEQ ID NO: 17267 - DNA, 20 bp, Artificial Sequence
  Description of Artificial Sequence: Synthetic oligonucleotide
  Target: SCN10A; (-) strand; PAM type: NRG; PAM sequence: AGG
gctagggagaggctctctat

SEQ ID NO: 17268 - DNA, 20 bp, Artificial Sequence
  Description of Artificial Sequence: Synthetic oligonucleotide
  Target: SCN10A; (-) strand; PAM type: NRG; PAM sequence: TAG
ggctagggagaggctctcta

SEQ ID NO: 17269 - DNA, 20 bp, Artificial Sequence
  Description of Artificial Sequence: Synthetic oligonucleotide
  Target: SCN10A; (-) strand; PAM type: NRG; PAM sequence: AGG
agtagcctggggctagggag

SEQ ID NO: 17270 - DNA, 20 bp, Artificial Sequence
  Description of Artificial Sequence: Synthetic oligonucleotide
  Target: SCN10A; (-) strand; PAM type: NRG; PAM sequence: GAG
aagtagcctggggctaggga

SEQ ID NO: 17271 - DNA, 20 bp, Artificial Sequence
  Description of Artificial Sequence: Synthetic oligonucleotide
  Target: SCN10A; (-) strand; PAM type: NRG; PAM sequence: GAG
aaaagtagcctggggctagg

SEQ ID NO: 17272 - DNA, 20 bp, Artificial Sequence
  Description of Artificial Sequence: Synthetic oligonucleotide
  Target: SCN10A; (-) strand; PAM type: NRG; PAM sequence: GGG
gcaaaagtagcctggggcta

SEQ ID NO: 17273 - DNA, 20 bp, Artificial Sequence
  Description of Artificial Sequence: Synthetic oligonucleotide
  Target: SCN10A; (-) strand; PAM type: NRG; PAM sequence: AGG
ggcaaaagtagcctggggct

SEQ ID NO: 17274 - DNA, 20 bp, Artificial Sequence
  Description of Artificial Sequence: Synthetic oligonucleotide
  Target: SCN10A; (-) strand; PAM type: NRG; PAM sequence: TAG
aggcaaaagtagcctggggc

SEQ ID NO: 17275 - DNA, 20 bp, Artificial Sequence
  Description of Artificial Sequence: Synthetic oligonucleotide
  Target: SCN10A; (-) strand; PAM type: NRG; PAM sequence: GGG
ctctaggcaaaagtagcctg

SEQ ID NO: 17276 - DNA, 20 bp, Artificial Sequence
  Description of Artificial Sequence: Synthetic oligonucleotide
  Target: SCN10A; (-) strand; PAM type: NRG; PAM sequence: GGG
tctctaggcaaaagtagcct

SEQ ID NO: 17277 - DNA, 20 bp, Artificial Sequence
  Description of Artificial Sequence: Synthetic oligonucleotide
  Target: SCN10A; (-) strand; PAM type: NRG; PAM sequence: TGG
ttctctaggcaaaagtagcc

SEQ ID NO: 17278 - DNA, 20 bp, Artificial Sequence
  Description of Artificial Sequence: Synthetic oligonucleotide
  Target: SCN10A; (-) strand; PAM type: NRG; PAM sequence: TAG
tcattttctctaggcaaaag

SEQ ID NO: 17279 - DNA, 20 bp, Artificial Sequence
  Description of Artificial Sequence: Synthetic oligonucleotide
  Target: SCN10A; (-) strand; PAM type: NRG; PAM sequence: AAG
acatcattttctctaggcaa

SEQ ID NO: 17280 - DNA, 20 bp, Artificial Sequence
  Description of Artificial Sequence: Synthetic oligonucleotide
  Target: SCN10A; (-) strand; PAM type: NRG; PAM sequence: AGG
ttgtccacatcattttctct

SEQ ID NO: 17281 - DNA, 20 bp, Artificial Sequence
  Description of Artificial Sequence: Synthetic oligonucleotide
  Target: SCN10A; (-) strand; PAM type: NRG; PAM sequence: TAG
tttgtccacatcattttctc

SEQ ID NO: 17282 - DNA, 20 bp, Artificial Sequence
  Description of Artificial Sequence: Synthetic oligonucleotide
  Target: SCN10A; (-) strand; PAM type: NRG; PAM sequence: AAG
ggaggtgctcacagatgaag

SEQ ID NO: 17283 - DNA, 20 bp, Artificial Sequence
  Description of Artificial Sequence: Synthetic oligonucleotide
  Target: SCN10A; (-) strand; PAM type: NRG; PAM sequence: AAG
gttggaggtgctcacagatg

SEQ ID NO: 17284 - DNA, 20 bp, Artificial Sequence
  Description of Artificial Sequence: Synthetic oligonucleotide
  Target: SCN10A; (-) strand; PAM type: NRG; PAM sequence: CAG
ataagagttggaggtgctca

SEQ ID NO: 17285 - DNA, 20 bp, Artificial Sequence
  Description of Artificial Sequence: Synthetic oligonucleotide
  Target: SCN10A; (-) strand; PAM type: NRG; PAM sequence: AGG
agccagcaaataagagttgg

SEQ ID NO: 17286 - DNA, 20 bp, Artificial Sequence
  Description of Artificial Sequence: Synthetic oligonucleotide
  Target: SCN10A; (-) strand; PAM type: NRG; PAM sequence: GAG
gagccagcaaataagagttg

SEQ ID NO: 17287 - DNA, 20 bp, Artificial Sequence
  Description of Artificial Sequence: Synthetic oligonucleotide
  Target: SCN10A; (-) strand; PAM type: NRG; PAM sequence: TGG
cagagccagcaaataagagt

SEQ ID NO: 17288 - DNA, 20 bp, Artificial Sequence
  Description of Artificial Sequence: Synthetic oligonucleotide
  Target: SCN10A; (-) strand; PAM type: NRG; PAM sequence: GAG
ctttcagagccagcaaataa

SEQ ID NO: 17289 - DNA, 20 bp, Artificial Sequence
  Description of Artificial Sequence: Synthetic oligonucleotide
  Target: SCN10A; (-) strand; PAM type: NRG; PAM sequence: AAG
atctttcagagccagcaaat

SEQ ID NO: 17290 - DNA, 20 bp, Artificial Sequence
  Description of Artificial Sequence: Synthetic oligonucleotide
  Target: SCN10A; (-) strand; PAM type: NRG; PAM sequence: CAG
agtcaaatatctttcagagc

SEQ ID NO: 17291 - DNA, 20 bp, Artificial Sequence
  Description of Artificial Sequence: Synthetic oligonucleotide
  Target: SCN10A; (-) strand; PAM type: NRG; PAM sequence: GAG
agaaagtcaaatatctttca

SEQ ID NO: 17292 - DNA, 20 bp, Artificial Sequence
  Description of Artificial Sequence: Synthetic oligonucleotide
  Target: SCN10A; (-) strand; PAM type: NRG; PAM sequence: CAG
aaagaaagtcaaatatcttt

SEQ ID NO: 17293 - DNA, 20 bp, Artificial Sequence
  Description of Artificial Sequence: Synthetic oligonucleotide
  Target: SCN10A; (-) strand; PAM type: NRG; PAM sequence: AAG
cgaaagacaacgcacaaaga

SEQ ID NO: 17294 - DNA, 20 bp, Artificial Sequence
  Description of Artificial Sequence: Synthetic oligonucleotide
  Target: SCN10A; (-) strand; PAM type: NRG; PAM sequence: AAG
gaaacgaaagacaacgcaca

SEQ ID NO: 17295 - DNA, 20 bp, Artificial Sequence
  Description of Artificial Sequence: Synthetic oligonucleotide
  Target: SCN10A; (-) strand; PAM type: NRG; PAM sequence: AAG
gccaagaaaaaaggaaacga

SEQ ID NO: 17296 - DNA, 20 bp, Artificial Sequence
  Description of Artificial Sequence: Synthetic oligonucleotide
  Target: SCN10A; (-) strand; PAM type: NRG; PAM sequence: AGG
gaaatgacagccaagaaaaa

SEQ ID NO: 17297 - DNA, 20 bp, Artificial Sequence
  Description of Artificial Sequence: Synthetic oligonucleotide
  Target: SCN10A; (-) strand; PAM type: NRG; PAM sequence: AAG
ggaaatgacagccaagaaaa

SEQ ID NO: 17298 - DNA, 20 bp, Artificial Sequence
  Description of Artificial Sequence: Synthetic oligonucleotide
  Target: SCN10A; (-) strand; PAM type: NRG; PAM sequence: AAG
gtgcccaggaaatgacagcc

SEQ ID NO: 17299 - DNA, 20 bp, Artificial Sequence
  Description of Artificial Sequence: Synthetic oligonucleotide
  Target: SCN10A; (-) strand; PAM type: NRG; PAM sequence: CAG
agtaagtgcccaggaaatga

SEQ ID NO: 17300 - DNA, 20 bp, Artificial Sequence
  Description of Artificial Sequence: Synthetic oligonucleotide
  Target: SCN10A; (-) strand; PAM type: NRG; PAM sequence: AGG
ctgagacaaagtaagtgccc

SEQ ID NO: 17301 - DNA, 20 bp, Artificial Sequence
  Description of Artificial Sequence: Synthetic oligonucleotide
  Target: SCN10A; (-) strand; PAM type: NRG; PAM sequence: CAG
cctgagacaaagtaagtgcc

SEQ ID NO: 17302 - DNA, 20 bp, Artificial Sequence
  Description of Artificial Sequence: Synthetic oligonucleotide
  Target: SCN10A; (-) strand; PAM type: NRG; PAM sequence: AAG
ggtcctgcctgagacaaagt

SEQ ID NO: 17303 - DNA, 20 bp, Artificial Sequence
  Description of Artificial Sequence: Synthetic oligonucleotide
  Target: SCN10A; (-) strand; PAM type: NRG; PAM sequence: AAG
tttaggtcctgcctgagaca

SEQ ID NO: 17304 - DNA, 20 bp, Artificial Sequence
  Description of Artificial Sequence: Synthetic oligonucleotide
  Target: SCN10A; (-) strand; PAM type: NRG; PAM sequence: GAG
caaatgtttaggtcctgcct

SEQ ID NO: 17305 - DNA, 20 bp, Artificial Sequence
  Description of Artificial Sequence: Synthetic oligonucleotide
  Target: SCN10A; (-) strand; PAM type: NRG; PAM sequence: AGG
atgctgcttgtcaaatgttt

SEQ ID NO: 17306 - DNA, 20 bp, Artificial Sequence
  Description of Artificial Sequence: Synthetic oligonucleotide
  Target: SCN10A; (-) strand; PAM type: NRG; PAM sequence: TAG
gatgctgcttgtcaaatgtt

SEQ ID NO: 17307 - DNA, 20 bp, Artificial Sequence
  Description of Artificial Sequence: Synthetic oligonucleotide
  Target: SCN10A; (-) strand; PAM type: NRG; PAM sequence: GAG
gattattttgaagcttaaat

SEQ ID NO: 17308 - DNA, 20 bp, Artificial Sequence
  Description of Artificial Sequence: Synthetic oligonucleotide
  Target: SCN10A; (-) strand; PAM type: NRG; PAM sequence: AAG
tacttggtaggattattttg

SEQ ID NO: 17309 - DNA, 20 bp, Artificial Sequence
  Description of Artificial Sequence: Synthetic oligonucleotide
  Target: SCN10A; (-) strand; PAM type: NRG; PAM sequence: AGG
aatggtaatgcctacttggt

SEQ ID NO: 17310 - DNA, 20 bp, Artificial Sequence
  Description of Artificial Sequence: Synthetic oligonucleotide
  Target: SCN10A; (-) strand; PAM type: NRG; PAM sequence: TAG
gaatggtaatgcctacttgg

SEQ ID NO: 17311 - DNA, 20 bp, Artificial Sequence
  Description of Artificial Sequence: Synthetic oligonucleotide
  Target: SCN10A; (-) strand; PAM type: NRG; PAM sequence: TGG
actgaatggtaatgcctact

SEQ ID NO: 17312 - DNA, 20 bp, Artificial Sequence
  Description of Artificial Sequence: Synthetic oligonucleotide
  Target: SCN10A; (-) strand; PAM type: NRG; PAM sequence: TGG
tattcatctatgaaactgaa

SEQ ID NO: 17313 - DNA, 20 bp, Artificial Sequence
  Description of Artificial Sequence: Synthetic oligonucleotide
  Target: SCN10A; (-) strand; PAM type: NRG; PAM sequence: GAG
atcagttcccaaacctctct

SEQ ID NO: 17314 - DNA, 20 bp, Artificial Sequence
  Description of Artificial Sequence: Synthetic oligonucleotide
  Target: SCN10A; (-) strand; PAM type: NRG; PAM sequence: CAG
caagctgtgggacctaagat

SEQ ID NO: 17315 - DNA, 20 bp, Artificial Sequence
  Description of Artificial Sequence: Synthetic oligonucleotide
  Target: SCN10A; (-) strand; PAM type: NRG; PAM sequence: AAG
ctccacaagctgtgggacct

SEQ ID NO: 17316 - DNA, 20 bp, Artificial Sequence
  Description of Artificial Sequence: Synthetic oligonucleotide
  Target: SCN10A; (-) strand; PAM type: NRG; PAM sequence: GGG
agtgagactccacaagctgt

SEQ ID NO: 17317 - DNA, 20 bp, Artificial Sequence
  Description of Artificial Sequence: Synthetic oligonucleotide
  Target: SCN10A; (-) strand; PAM type: NRG; PAM sequence: TGG
gagtgagactccacaagctg

SEQ ID NO: 17318 - DNA, 20 bp, Artificial Sequence
  Description of Artificial Sequence: Synthetic oligonucleotide
  Target: SCN10A; (-) strand; PAM type: NRG; PAM sequence: AAG
aagaaagagtgagactccac

SEQ ID NO: 17319 - DNA, 20 bp, Artificial Sequence
  Description of Artificial Sequence: Synthetic oligonucleotide
  Target: SCN10A; (-) strand; PAM type: NRG; PAM sequence: GAG
taggtatagaaagaaagagt

SEQ ID NO: 17320 - DNA, 20 bp, Artificial Sequence
  Description of Artificial Sequence: Synthetic oligonucleotide
  Target: SCN10A; (-) strand; PAM type: NRG; PAM sequence: GAG
gttctaggtatagaaagaaa

SEQ ID NO: 17321 - DNA, 20 bp, Artificial Sequence
  Description of Artificial Sequence: Synthetic oligonucleotide
  Target: SCN10A; (-) strand; PAM type: NRG; PAM sequence: AAG
tggttctaggtatagaaaga

SEQ ID NO: 17322 - DNA, 20 bp, Artificial Sequence
  Description of Artificial Sequence: Synthetic oligonucleotide
  Target: SCN10A; (-) strand; PAM type: NRG; PAM sequence: AAG
agggtggttctaggtataga

SEQ ID NO: 17323 - DNA, 20 bp, Artificial Sequence
  Description of Artificial Sequence: Synthetic oligonucleotide
  Target: SCN10A; (-) strand; PAM type: NRG; PAM sequence: TAG
ctccagggtggttctaggta

SEQ ID NO: 17324 - DNA, 20 bp, Artificial Sequence
  Description of Artificial Sequence: Synthetic oligonucleotide
  Target: SCN10A; (-) strand; PAM type: NRG; PAM sequence: AGG
tctcactccagggtggttct

SEQ ID NO: 17325 - DNA, 20 bp, Artificial Sequence
  Description of Artificial Sequence: Synthetic oligonucleotide
  Target: SCN10A; (-) strand; PAM type: NRG; PAM sequence: TAG
atctcactccagggtggttc

SEQ ID NO: 17326 - DNA, 20 bp, Artificial Sequence
  Description of Artificial Sequence: Synthetic oligonucleotide
  Target: SCN10A; (-) strand; PAM type: NRG; PAM sequence: TGG
gccacaatctcactccaggg

SEQ ID NO: 17327 - DNA, 20 bp, Artificial Sequence
  Description of Artificial Sequence: Synthetic oligonucleotide
  Target: SCN10A; (-) strand; PAM type: NRG; PAM sequence: GGG
attgccacaatctcactcca

SEQ ID NO: 17328 - DNA, 20 bp, Artificial Sequence
  Description of Artificial Sequence: Synthetic oligonucleotide
  Target: SCN10A; (-) strand; PAM type: NRG; PAM sequence: AGG
cattgccacaatctcactcc

SEQ ID NO: 17329 - DNA, 20 bp, Artificial Sequence
  Description of Artificial Sequence: Synthetic oligonucleotide
  Target: SCN10A; (-) strand; PAM type: NRG; PAM sequence: CAG
ccattgccacaatctcactc

SEQ ID NO: 17330 - DNA, 20 bp, Artificial Sequence
  Description of Artificial Sequence: Synthetic oligonucleotide
  Target: SCN10A; (-) strand; PAM type: NRG; PAM sequence: CGG
ttaaagtccctcccaacctc

SEQ ID NO: 17331 - DNA, 20 bp, Artificial Sequence
  Description of Artificial Sequence: Synthetic oligonucleotide
  Target: SCN10A; (-) strand; PAM type: NRG; PAM sequence: AAG
tcttatcctgggaattttta

SEQ ID NO: 17332 - DNA, 20 bp, Artificial Sequence
  Description of Artificial Sequence: Synthetic oligonucleotide
  Target: SCN10A; (-) strand; PAM type: NRG; PAM sequence: GGG
ataacctcatttcttatcct

SEQ ID NO: 17333 - DNA, 20 bp, Artificial Sequence
  Description of Artificial Sequence: Synthetic oligonucleotide
  Target: SCN10A; (-) strand; PAM type: NRG; PAM sequence: TGG
cataacctcatttcttatcc

SEQ ID NO: 17334 - DNA, 20 bp, Artificial Sequence
  Description of Artificial Sequence: Synthetic oligonucleotide
  Target: SCN10A; (-) strand; PAM type: NRG; PAM sequence: CAG
gcggtgaaggtggggtattc

SEQ ID NO: 17335 - DNA, 20 bp, Artificial Sequence
  Description of Artificial Sequence: Synthetic oligonucleotide
  Target: SCN10A; (-) strand; PAM type: NRG; PAM sequence: GGG
ggagggtggcggtgaaggtg

SEQ ID NO: 17336 - DNA, 20 bp, Artificial Sequence
  Description of Artificial Sequence: Synthetic oligonucleotide
  Target: SCN10A; (-) strand; PAM type: NRG; PAM sequence: GGG
tggagggtggcggtgaaggt

SEQ ID NO: 17337 - DNA, 20 bp, Artificial Sequence
  Description of Artificial Sequence: Synthetic oligonucleotide
  Target: SCN10A; (-) strand; PAM type: NRG; PAM sequence: TGG
ctggagggtggcggtgaagg

SEQ ID NO: 17338 - DNA, 20 bp, Artificial Sequence
  Description of Artificial Sequence: Synthetic oligonucleotide
  Target: SCN10A; (-) strand; PAM type: NRG; PAM sequence: AGG
aggctggagggtggcggtga

SEQ ID NO: 17339 - DNA, 20 bp, Artificial Sequence
  Description of Artificial Sequence: Synthetic oligonucleotide
  Target: SCN10A; (-) strand; PAM type: NRG; PAM sequence: AAG
gaggctggagggtggcggtg

SEQ ID NO: 17340 - DNA, 20 bp, Artificial Sequence
  Description of Artificial Sequence: Synthetic oligonucleotide
  Target: SCN10A; (-) strand; PAM type: NRG; PAM sequence: CGG
tggtagaggctggagggtgg

SEQ ID NO: 17341 - DNA, 20 bp, Artificial Sequence
  Description of Artificial Sequence: Synthetic oligonucleotide
  Target: SCN10A; (-) strand; PAM type: NRG; PAM sequence: TGG
ggctggtagaggctggaggg

SEQ ID NO: 17342 - DNA, 20 bp, Artificial Sequence
  Description of Artificial Sequence: Synthetic oligonucleotide
  Target: SCN10A; (-) strand; PAM type: NRG; PAM sequence: GGG
gtgggctggtagaggctgga

SEQ ID NO: 17343 - DNA, 20 bp, Artificial Sequence
  Description of Artificial Sequence: Synthetic oligonucleotide
  Target: SCN10A; (-) strand; PAM type: NRG; PAM sequence: AGG
agtgggctggtagaggctgg

SEQ ID NO: 17344 - DNA, 20 bp, Artificial Sequence
  Description of Artificial Sequence: Synthetic oligonucleotide
  Target: SCN10A; (-) strand; PAM type: NRG; PAM sequence: GAG
cagtgggctggtagaggctg

SEQ ID NO: 17345 - DNA, 20 bp, Artificial Sequence
  Description of Artificial Sequence: Synthetic oligonucleotide
  Target: SCN10A; (-) strand; PAM type: NRG; PAM sequence: TGG
agcagtgggctggtagaggc

SEQ ID NO: 17346 - DNA, 20 bp, Artificial Sequence
  Description of Artificial Sequence: Synthetic oligonucleotide
  Target: SCN10A; (-) strand; PAM type: NRG; PAM sequence: AGG
actgagcagtgggctggtag

SEQ ID NO: 17347 - DNA, 20 bp, Artificial Sequence
  Description of Artificial Sequence: Synthetic oligonucleotide
  Target: SCN10A; (-) strand; PAM type: NRG; PAM sequence: GAG
cactgagcagtgggctggta

SEQ ID NO: 17348 - DNA, 20 bp, Artificial Sequence
  Description of Artificial Sequence: Synthetic oligonucleotide
  Target: SCN10A; (-) strand; PAM type: NRG; PAM sequence: TAG
gacactgagcagtgggctgg

SEQ ID NO: 17349 - DNA, 20 bp, Artificial Sequence
  Description of Artificial Sequence: Synthetic oligonucleotide
  Target: SCN10A; (-) strand; PAM type: NRG; PAM sequence: TGG
ccagacactgagcagtgggc

SEQ ID NO: 17350 - DNA, 20 bp, Artificial Sequence
  Description of Artificial Sequence: Synthetic oligonucleotide
  Target: SCN10A; (-) strand; PAM type: NRG; PAM sequence: GGG
ccagccagacactgagcagt

SEQ ID NO: 17351 - DNA, 20 bp, Artificial Sequence
  Description of Artificial Sequence: Synthetic oligonucleotide
  Target: SCN10A; (-) strand; PAM type: NRG; PAM sequence: TGG
gccagccagacactgagcag

SEQ ID NO: 17352 - DNA, 20 bp, Artificial Sequence
  Description of Artificial Sequence: Synthetic oligonucleotide
  Target: SCN10A; (-) strand; PAM type: NRG; PAM sequence: CAG
acagccagccagacactgag

SEQ ID NO: 17353 - DNA, 20 bp, Artificial Sequence
  Description of Artificial Sequence: Synthetic oligonucleotide
  Target: SCN10A; (-) strand; PAM type: NRG; PAM sequence: GAG
tggacagccagccagacact

SEQ ID NO: 17354 - DNA, 20 bp, Artificial Sequence
  Description of Artificial Sequence: Synthetic oligonucleotide
  Target: SCN10A; (-) strand; PAM type: NRG; PAM sequence: CAG
ggagaggttggacagccagc

SEQ ID NO: 17355 - DNA, 20 bp, Artificial Sequence
  Description of Artificial Sequence: Synthetic oligonucleotide
  Target: SCN10A; (-) strand; PAM type: NRG; PAM sequence: CAG
tcctggagaggttggacagc

SEQ ID NO: 17356 - DNA, 20 bp, Artificial Sequence
  Description of Artificial Sequence: Synthetic oligonucleotide
  Target: SCN10A; (-) strand; PAM type: NRG; PAM sequence: CAG
agcttcctggagaggttgga

SEQ ID NO: 17357 - DNA, 20 bp, Artificial Sequence
  Description of Artificial Sequence: Synthetic oligonucleotide
  Target: SCN10A; (-) strand; PAM type: NRG; PAM sequence: TGG
tgtcagcttcctggagaggt

SEQ ID NO: 17358 - DNA, 20 bp, Artificial Sequence
  Description of Artificial Sequence: Synthetic oligonucleotide
  Target: SCN10A; (-) strand; PAM type: NRG; PAM sequence: AGG
ggtatgtcagcttcctggag

SEQ ID NO: 17359 - DNA, 20 bp, Artificial Sequence
  Description of Artificial Sequence: Synthetic oligonucleotide
  Target: SCN10A; (-) strand; PAM type: NRG; PAM sequence: GAG
aggtatgtcagcttcctgga

SEQ ID NO: 17360 - DNA, 20 bp, Artificial Sequence
  Description of Artificial Sequence: Synthetic oligonucleotide
  Target: SCN10A; (-) strand; PAM type: NRG; PAM sequence: GAG
gtaggtatgtcagcttcctg

SEQ ID NO: 17361 - DNA, 20 bp, Artificial Sequence
  Description of Artificial Sequence: Synthetic oligonucleotide
  Target: SCN10A; (-) strand; PAM type: NRG; PAM sequence: TGG
aggtaggtatgtcagcttcc

SEQ ID NO: 17362 - DNA, 20 bp, Artificial Sequence
  Description of Artificial Sequence: Synthetic oligonucleotide
  Target: SCN10A; (-) strand; PAM type: NRG; PAM sequence: CAG
ccctgctgaggtaggtatgt

SEQ ID NO: 17363 - DNA, 20 bp, Artificial Sequence
  Description of Artificial Sequence: Synthetic oligonucleotide
  Target: SCN10A; (-) strand; PAM type: NRG; PAM sequence: AGG
cctcaggtccctgctgaggt

SEQ ID NO: 17364 - DNA, 20 bp, Artificial Sequence
  Description of Artificial Sequence: Synthetic oligonucleotide
  Target: SCN10A; (-) strand; PAM type: NRG; PAM sequence: TAG
tcctcaggtccctgctgagg

SEQ ID NO: 17365 - DNA, 20 bp, Artificial Sequence
  Description of Artificial Sequence: Synthetic oligonucleotide
  Target: SCN10A; (-) strand; PAM type: NRG; PAM sequence: AGG
tgttcctcaggtccctgctg

SEQ ID NO: 17366 - DNA, 20 bp, Artificial Sequence
  Description of Artificial Sequence: Synthetic oligonucleotide
  Target: SCN10A; (-) strand; PAM type: NRG; PAM sequence: GAG
ctgttcctcaggtccctgct

SEQ ID NO: 17367 - DNA, 20 bp, Artificial Sequence
  Description of Artificial Sequence: Synthetic oligonucleotide
  Target: SCN10A; (-) strand; PAM type: NRG; PAM sequence: AGG
gaaagatgagtctgttcctc

SEQ ID NO: 17368 - DNA, 20 bp, Artificial Sequence
  Description of Artificial Sequence: Synthetic oligonucleotide
  Target: SCN10A; (-) strand; PAM type: NRG; PAM sequence: CAG
ggaaagatgagtctgttcct

SEQ ID NO: 17369 - DNA, 20 bp, Artificial Sequence
  Description of Artificial Sequence: Synthetic oligonucleotide
  Target: SCN10A; (-) strand; PAM type: NRG; PAM sequence: GAG
tgggtgagacgtggaaagat

SEQ ID NO: 17370 - DNA, 20 bp, Artificial Sequence
  Description of Artificial Sequence: Synthetic oligonucleotide
  Target: SCN10A; (-) strand; PAM type: NRG; PAM sequence: AAG
atccctgggtgagacgtgga

SEQ ID NO: 17371 - DNA, 20 bp, Artificial Sequence
  Description of Artificial Sequence: Synthetic oligonucleotide
  Target: SCN10A; (-) strand; PAM type: NRG; PAM sequence: TGG
ctccatccctgggtgagacg

SEQ ID NO: 17372 - DNA, 20 bp, Artificial Sequence
  Description of Artificial Sequence: Synthetic oligonucleotide
  Target: SCN10A; (-) strand; PAM type: NRG; PAM sequence: GAG
acctggctccatccctgggt

SEQ ID NO: 17373 - DNA, 20 bp, Artificial Sequence
  Description of Artificial Sequence: Synthetic oligonucleotide
  Target: SCN10A; (-) strand; PAM type: NRG; PAM sequence: GGG
gaggacctggctccatccct

SEQ ID NO: 17374 - DNA, 20 bp, Artificial Sequence
  Description of Artificial Sequence: Synthetic oligonucleotide
  Target: SCN10A; (-) strand; PAM type: NRG; PAM sequence: TGG
tgaggacctggctccatccc

SEQ ID NO: 17375 - DNA, 20 bp, Artificial Sequence
  Description of Artificial Sequence: Synthetic oligonucleotide
  Target: SCN10A; (-) strand; PAM type: NRG; PAM sequence: TGG
tggaacatcttctgaggacc

SEQ ID NO: 17376 - DNA, 20 bp, Artificial Sequence
  Description of Artificial Sequence: Synthetic oligonucleotide
  Target: SCN10A; (-) strand; PAM type: NRG; PAM sequence: AGG
aggcactggaacatcttctg

SEQ ID NO: 17377 - DNA, 20 bp, Artificial Sequence
  Description of Artificial Sequence: Synthetic oligonucleotide
  Target: SCN10A; (-) strand; PAM type: NRG; PAM sequence: GAG
caggcactggaacatcttct

SEQ ID NO: 17378 - DNA, 20 bp, Artificial Sequence
  Description of Artificial Sequence: Synthetic oligonucleotide
  Target: SCN10A; (-) strand; PAM type: NRG; PAM sequence: TGG
acacccaggagcccaggcac

SEQ ID NO: 17379 - DNA, 20 bp, Artificial Sequence
  Description of Artificial Sequence: Synthetic oligonucleotide
  Target: SCN10A; (-) strand; PAM type: NRG; PAM sequence: AGG
cacctgacacccaggagccc

SEQ ID NO: 17380 - DNA, 20 bp, Artificial Sequence
  Description of Artificial Sequence: Synthetic oligonucleotide
  Target: SCN10A; (-) strand; PAM type: NRG; PAM sequence: CAG
ccacctgacacccaggagcc

SEQ ID NO: 17381 - DNA, 20 bp, Artificial Sequence
  Description of Artificial Sequence: Synthetic oligonucleotide
  Target: SCN10A; (-) strand; PAM type: NRG; PAM sequence: GAG
ggggaccacctgacacccag

SEQ ID NO: 17382 - DNA, 20 bp, Artificial Sequence
  Description of Artificial Sequence: Synthetic oligonucleotide
  Target: SCN10A; (-) strand; PAM type: NRG; PAM sequence: AGG
gtggggaccacctgacaccc

SEQ ID NO: 17383 - DNA, 20 bp, Artificial Sequence
  Description of Artificial Sequence: Synthetic oligonucleotide
  Target: SCN10A; (-) strand; PAM type: NRG; PAM sequence: CAG
tgtggggaccacctgacacc

SEQ ID NO: 17384 - DNA, 20 bp, Artificial Sequence
  Description of Artificial Sequence: Synthetic oligonucleotide
  Target: SCN10A; (-) strand; PAM type: NRG; PAM sequence: GGG
gcagcaagtcgagaggtgtg

SEQ ID NO: 17385 - DNA, 20 bp, Artificial Sequence
  Description of Artificial Sequence: Synthetic oligonucleotide
  Target: SCN10A; (-) strand; PAM type: NRG; PAM sequence: GGG
tgcagcaagtcgagaggtgt

SEQ ID NO: 17386 - DNA, 20 bp, Artificial Sequence
  Description of Artificial Sequence: Synthetic oligonucleotide
  Target: SCN10A; (-) strand; PAM type: NRG; PAM sequence: TGG
ctgcagcaagtcgagaggtg

SEQ ID NO: 17387 - DNA, 20 bp, Artificial Sequence
  Description of Artificial Sequence: Synthetic oligonucleotide
  Target: SCN10A; (-) strand; PAM type: NRG; PAM sequence: AGG
agcagctgcagcaagtcgag

SEQ ID NO: 17388 - DNA, 20 bp, Artificial Sequence
  Description of Artificial Sequence: Synthetic oligonucleotide
  Target: SCN10A; (-) strand; PAM type: NRG; PAM sequence: GAG
gagcagctgcagcaagtcga

SEQ ID NO: 17389 - DNA, 20 bp, Artificial Sequence
  Description of Artificial Sequence: Synthetic oligonucleotide
  Target: SCN10A; (-) strand; PAM type: NRG; PAM sequence: GAG
aggagcagctgcagcaagtc

SEQ ID NO: 17390 - DNA, 20 bp, Artificial Sequence
  Description of Artificial Sequence: Synthetic oligonucleotide
  Target: SCN10A; (-) strand; PAM type: NRG; PAM sequence: AAG
ctagcaggagcagctgcagc

SEQ ID NO: 17391 - DNA, 20 bp, Artificial Sequence
  Description of Artificial Sequence: Synthetic oligonucleotide
  Target: SCN10A; (-) strand; PAM type: NRG; PAM sequence: CAG
ctcactagcaggagcagctg

SEQ ID NO: 17392 - DNA, 20 bp, Artificial Sequence
  Description of Artificial Sequence: Synthetic oligonucleotide
  Target: SCN10A; (-) strand; PAM type: NRG; PAM sequence: CAG
ccctctctcactagcaggag

SEQ ID NO: 17393 - DNA, 20 bp, Artificial Sequence
  Description of Artificial Sequence: Synthetic oligonucleotide
  Target: SCN10A; (-) strand; PAM type: NRG; PAM sequence: GAG
ggaccctctctcactagcag

SEQ ID NO: 17394 - DNA, 20 bp, Artificial Sequence
  Description of Artificial Sequence: Synthetic oligonucleotide
  Target: SCN10A; (-) strand; PAM type: NRG; PAM sequence: AGG
tgggaccctctctcactagc

SEQ ID NO: 17395 - DNA, 20 bp, Artificial Sequence
  Description of Artificial Sequence: Synthetic oligonucleotide
  Target: SCN10A; (-) strand; PAM type: NRG; PAM sequence: CAG
ttgggaccctctctcactag

SEQ ID NO: 17396 - DNA, 20 bp, Artificial Sequence
  Description of Artificial Sequence: Synthetic oligonucleotide
  Target: SCN10A; (-) strand; PAM type: NRG; PAM sequence: TAG
cagttgggaccctctctcac

SEQ ID NO: 17397 - DNA, 20 bp, Artificial Sequence
  Description of Artificial Sequence: Synthetic oligonucleotide
  Target: SCN10A; (-) strand; PAM type: NRG; PAM sequence: GGG
gtggggccaggcacccagtt

SEQ ID NO: 17398 - DNA, 20 bp, Artificial Sequence
  Description of Artificial Sequence: Synthetic oligonucleotide
  Target: SCN10A; (-) strand; PAM type: NRG; PAM sequence: TGG
ggtggggccaggcacccagt

SEQ ID NO: 17399 - DNA, 20 bp, Artificial Sequence
  Description of Artificial Sequence: Synthetic oligonucleotide
  Target: SCN10A; (-) strand; PAM type: NRG; PAM sequence: CAG
taagggtggggccaggcacc

SEQ ID NO: 17400 - DNA, 20 bp, Artificial Sequence
  Description of Artificial Sequence: Synthetic oligonucleotide
  Target: SCN10A; (-) strand; PAM type: NRG; PAM sequence: AGG
ggtcatctaagggtggggcc

SEQ ID NO: 17401 - DNA, 20 bp, Artificial Sequence
  Description of Artificial Sequence: Synthetic oligonucleotide
  Target: SCN10A; (-) strand; PAM type: NRG; PAM sequence: CAG
tggtcatctaagggtggggc

SEQ ID NO: 17402 - DNA, 20 bp, Artificial Sequence
  Description of Artificial Sequence: Synthetic oligonucleotide
  Target: SCN10A; (-) strand; PAM type: NRG; PAM sequence: GGG
gaactggtcatctaagggtg

SEQ ID NO: 17403 - DNA, 20 bp, Artificial Sequence
  Description of Artificial Sequence: Synthetic oligonucleotide
  Target: SCN10A; (-) strand; PAM type: NRG; PAM sequence: GGG
agaactggtcatctaagggt

SEQ ID NO: 17404 - DNA, 20 bp, Artificial Sequence
  Description of Artificial Sequence: Synthetic oligonucleotide
  Target: SCN10A; (-) strand; PAM type: NRG; PAM sequence: TGG
tagaactggtcatctaaggg

SEQ ID NO: 17405 - DNA, 20 bp, Artificial Sequence
  Description of Artificial Sequence: Synthetic oligonucleotide
  Target: SCN10A; (-) strand; PAM type: NRG; PAM sequence: GGG
atttagaactggtcatctaa

SEQ ID NO: 17406 - DNA, 20 bp, Artificial Sequence
  Description of Artificial Sequence: Synthetic oligonucleotide
  Target: SCN10A; (-) strand; PAM type: NRG; PAM sequence: AGG
aatttagaactggtcatcta

SEQ ID NO: 17407 - DNA, 20 bp, Artificial Sequence
  Description of Artificial Sequence: Synthetic oligonucleotide
  Target: SCN10A; (-) strand; PAM type: NRG; PAM sequence: AAG
aaatttagaactggtcatct

SEQ ID NO: 17408 - DNA, 20 bp, Artificial Sequence
  Description of Artificial Sequence: Synthetic oligonucleotide
  Target: SCN10A; (-) strand; PAM type: NRG; PAM sequence: TGG
gatcccttcaaatttagaac

SEQ ID NO: 17409 - DNA, 20 bp, Artificial Sequence
  Description of Artificial Sequence: Synthetic oligonucleotide
  Target: SCN10A; (-) strand; PAM type: NRG; PAM sequence: TAG
gtgcaagatcccttcaaatt

SEQ ID NO: 17410 - DNA, 20 bp, Artificial Sequence
  Description of Artificial Sequence: Synthetic oligonucleotide
  Target: SCN10A; (-) strand; PAM type: NRG; PAM sequence: AAG
tctggcagcctgtgatgtgc

SEQ ID NO: 17411 - DNA, 20 bp, Artificial Sequence
  Description of Artificial Sequence: Synthetic oligonucleotide
  Target: SCN10A; (-) strand; PAM type: NRG; PAM sequence: CAG
tatgaaactcttggctctgg

SEQ ID NO: 17412 - DNA, 20 bp, Artificial Sequence
  Description of Artificial Sequence: Synthetic oligonucleotide
  Target: SCN10A; (-) strand; PAM type: NRG; PAM sequence: TGG
atatatgaaactcttggctc

SEQ ID NO: 17413 - DNA, 20 bp, Artificial Sequence
  Description of Artificial Sequence: Synthetic oligonucleotide
  Target: SCN10A; (-) strand; PAM type: NRG; PAM sequence: TGG
agttgcatatatgaaactct

SEQ ID NO: 17414 - DNA, 20 bp, Artificial Sequence
  Description of Artificial Sequence: Synthetic oligonucleotide
  Target: SCN10A; (-) strand; PAM type: NRG; PAM sequence: GAG
atgtatatatgtatgtacat

SEQ ID NO: 17415 - DNA, 20 bp, Artificial Sequence
  Description of Artificial Sequence: Synthetic oligonucleotide
  Target: SCN10A; (-) strand; PAM type: NRG; PAM sequence: TAG
aacataggtctatctagcta

SEQ ID NO: 17416 - DNA, 20 bp, Artificial Sequence
  Description of Artificial Sequence: Synthetic oligonucleotide
  Target: SCN10A; (-) strand; PAM type: NRG; PAM sequence: TAG
ggataaaacataggtctatc

SEQ ID NO: 17417 - DNA, 20 bp, Artificial Sequence
  Description of Artificial Sequence: Synthetic oligonucleotide
  Target: SCN10A; (-) strand; PAM type: NRG; PAM sequence: AGG
ggagcccaaggataaaacat

SEQ ID NO: 17418 - DNA, 20 bp, Artificial Sequence
  Description of Artificial Sequence: Synthetic oligonucleotide
  Target: SCN10A; (-) strand; PAM type: NRG; PAM sequence: TAG
tggagcccaaggataaaaca

SEQ ID NO: 17419 - DNA, 20 bp, Artificial Sequence
  Description of Artificial Sequence: Synthetic oligonucleotide
  Target: SCN10A; (-) strand; PAM type: NRG; PAM sequence: AGG
cttataattaatggagccca

SEQ ID NO: 17420 - DNA, 20 bp, Artificial Sequence
  Description of Artificial Sequence: Synthetic oligonucleotide
  Target: SCN10A; (-) strand; PAM type: NRG; PAM sequence: AAG
tcttataattaatggagccc

SEQ ID NO: 17421 - DNA, 20 bp, Artificial Sequence
  Description of Artificial Sequence: Synthetic oligonucleotide
  Target: SCN10A; (-) strand; PAM type: NRG; PAM sequence: GAG
cacacatcttataattaatg

SEQ ID NO: 17422 - DNA, 20 bp, Artificial Sequence
  Description of Artificial Sequence: Synthetic oligonucleotide
  Target: SCN10A; (-) strand; PAM type: NRG; PAM sequence: TGG
gtcacacatcttataattaa

SEQ ID NO: 17423 - DNA, 20 bp, Artificial Sequence
  Description of Artificial Sequence: Synthetic oligonucleotide
  Target: SCN10A; (-) strand; PAM type: NRG; PAM sequence: AGG
gaggttaaacaacttgccta

SEQ ID NO: 17424 - DNA, 20 bp, Artificial Sequence
  Description of Artificial Sequence: Synthetic oligonucleotide
  Target: SCN10A; (-) strand; PAM type: NRG; PAM sequence: AAG
agaggttaaacaacttgcct

SEQ ID NO: 17425 - DNA, 20 bp, Artificial Sequence
  Description of Artificial Sequence: Synthetic oligonucleotide
  Target: SCN10A; (-) strand; PAM type: NRG; PAM sequence: AGG
gggaaaaatgaagattagag

SEQ ID NO: 17426 - DNA, 20 bp, Artificial Sequence
  Description of Artificial Sequence: Synthetic oligonucleotide
  Target: SCN10A; (-) strand; PAM type: NRG; PAM sequence: GAG
tgggaaaaatgaagattaga

SEQ ID NO: 17427 - DNA, 20 bp, Artificial Sequence
  Description of Artificial Sequence: Synthetic oligonucleotide
  Target: SCN10A; (-) strand; PAM type: NRG; PAM sequence: GAG
gctgggaaaaatgaagatta

SEQ ID NO: 17428 - DNA, 20 bp, Artificial Sequence
  Description of Artificial Sequence: Synthetic oligonucleotide
  Target: SCN10A; (-) strand; PAM type: NRG; PAM sequence: TAG
aagctgggaaaaatgaagat

SEQ ID NO: 17429 - DNA, 20 bp, Artificial Sequence
  Description of Artificial Sequence: Synthetic oligonucleotide
  Target: SCN10A; (-) strand; PAM type: NRG; PAM sequence: AAG
ttttgaagctgggaaaaatg

SEQ ID NO: 17430 - DNA, 20 bp, Artificial Sequence
  Description of Artificial Sequence: Synthetic oligonucleotide
  Target: SCN10A; (-) strand; PAM type: NRG; PAM sequence: GGG
gccttttcaattttgaagct

SEQ ID NO: 17431 - DNA, 20 bp, Artificial Sequence
  Description of Artificial Sequence: Synthetic oligonucleotide
  Target: SCN10A; (-) strand; PAM type: NRG; PAM sequence: TGG
agccttttcaattttgaagc

SEQ ID NO: 17432 - DNA, 20 bp, Artificial Sequence
  Description of Artificial Sequence: Synthetic oligonucleotide
  Target: SCN10A; (-) strand; PAM type: NRG; PAM sequence: AAG
atctagccttttcaattttg

SEQ ID NO: 17433 - DNA, 20 bp, Artificial Sequence
  Description of Artificial Sequence: Synthetic oligonucleotide
  Target: SCN10A; (-) strand; PAM type: NRG; PAM sequence: TAG
acagctgaatgatgcagatc

SEQ ID NO: 17434 - DNA, 20 bp, Artificial Sequence
  Description of Artificial Sequence: Synthetic oligonucleotide
  Target: SCN10A; (-) strand; PAM type: NRG; PAM sequence: CAG
atcaaaacagctgaatgatg

SEQ ID NO: 17435 - DNA, 20 bp, Artificial Sequence
  Description of Artificial Sequence: Synthetic oligonucleotide
  Target: SCN10A; (-) strand; PAM type: NRG; PAM sequence: CAG
aacatatttagtcatcaaaa

SEQ ID NO: 17436 - DNA, 20 bp, Artificial Sequence
  Description of Artificial Sequence: Synthetic oligonucleotide
  Target: SCN10A; (-) strand; PAM type: NRG; PAM sequence: TAG
tttacaagcgctaacatatt

SEQ ID NO: 17437 - DNA, 20 bp, Artificial Sequence
  Description of Artificial Sequence: Synthetic oligonucleotide
  Target: SCN10A; (-) strand; PAM type: NRG; PAM sequence: AAG
cttcgtgcaaagtgttttac

SEQ ID NO: 17438 - DNA, 20 bp, Artificial Sequence
  Description of Artificial Sequence: Synthetic oligonucleotide
  Target: SCN10A; (-) strand; PAM type: NRG; PAM sequence: AAG
tgagccaagcacttcgtgca

SEQ ID NO: 17439 - DNA, 20 bp, Artificial Sequence
  Description of Artificial Sequence: Synthetic oligonucleotide
  Target: SCN10A; (-) strand; PAM type: NRG; PAM sequence: AAG
tggctaaaatctattgagcc

SEQ ID NO: 17440 - DNA, 20 bp, Artificial Sequence
  Description of Artificial Sequence: Synthetic oligonucleotide
  Target: SCN10A; (-) strand; PAM type: NRG; PAM sequence: GAG
ggtcatggctaaaatctatt

SEQ ID NO: 17441 - DNA, 20 bp, Artificial Sequence
  Description of Artificial Sequence: Synthetic oligonucleotide
  Target: SCN10A; (-) strand; PAM type: NRG; PAM sequence: TGG
tggacaaataacaatggtca

SEQ ID NO: 17442 - DNA, 20 bp, Artificial Sequence
  Description of Artificial Sequence: Synthetic oligonucleotide
  Target: SCN10A; (-) strand; PAM type: NRG; PAM sequence: TGG
gacctctggacaaataacaa

SEQ ID NO: 17443 - DNA, 20 bp, Artificial Sequence
  Description of Artificial Sequence: Synthetic oligonucleotide
  Target: SCN10A; (-) strand; PAM type: NRG; PAM sequence: TGG
ttccctacaattttgacctc

SEQ ID NO: 17444 - DNA, 20 bp, Artificial Sequence
  Description of Artificial Sequence: Synthetic oligonucleotide
  Target: SCN10A; (-) strand; PAM type: NRG; PAM sequence: AAG
ttagggagctccaggtggcc

SEQ ID NO: 17445 - DNA, 20 bp, Artificial Sequence
  Description of Artificial Sequence: Synthetic oligonucleotide
  Target: SCN10A; (-) strand; PAM type: NRG; PAM sequence: TGG
ggctcttagggagctccagg

SEQ ID NO: 17446 - DNA, 20 bp, Artificial Sequence
  Description of Artificial Sequence: Synthetic oligonucleotide
  Target: SCN10A; (-) strand; PAM type: NRG; PAM sequence: AGG
tggggctcttagggagctcc

SEQ ID NO: 17447 - DNA, 20 bp, Artificial Sequence
  Description of Artificial Sequence: Synthetic oligonucleotide
  Target: SCN10A; (-) strand; PAM type: NRG; PAM sequence: CAG
ttggggctcttagggagctc

SEQ ID NO: 17448 - DNA, 20 bp, Artificial Sequence
  Description of Artificial Sequence: Synthetic oligonucleotide
  Target: SCN10A; (-) strand; PAM type: NRG; PAM sequence: GAG
gttactttggggctcttagg

SEQ ID NO: 17449 - DNA, 20 bp, Artificial Sequence
  Description of Artificial Sequence: Synthetic oligonucleotide
  Target: SCN10A; (-) strand; PAM type: NRG; PAM sequence: GGG
cagttactttggggctctta

SEQ ID NO: 17450 - DNA, 20 bp, Artificial Sequence
  Description of Artificial Sequence: Synthetic oligonucleotide
  Target: SCN10A; (-) strand; PAM type: NRG; PAM sequence: AGG
tcagttactttggggctctt

SEQ ID NO: 17451 - DNA, 20 bp, Artificial Sequence
  Description of Artificial Sequence: Synthetic oligonucleotide
  Target: SCN10A; (-) strand; PAM type: NRG; PAM sequence: TAG
ttcagttactttggggctct

SEQ ID NO: 17452 - DNA, 20 bp, Artificial Sequence
  Description of Artificial Sequence: Synthetic oligonucleotide
  Target: SCN10A; (-) strand; PAM type: NRG; PAM sequence: GGG
aagcattttcagttactttg

SEQ ID NO: 17453 - DNA, 20 bp, Artificial Sequence
  Description of Artificial Sequence: Synthetic oligonucleotide
  Target: SCN10A; (-) strand; PAM type: NRG; PAM sequence: GGG
gaagcattttcagttacttt

SEQ ID NO: 17454 - DNA, 20 bp, Artificial Sequence
  Description of Artificial Sequence: Synthetic oligonucleotide
  Target: SCN10A; (-) strand; PAM type: NRG; PAM sequence: TGG
agaagcattttcagttactt

SEQ ID NO: 17455 - DNA, 20 bp, Artificial Sequence
  Description of Artificial Sequence: Synthetic oligonucleotide
  Target: SCN10A; (-) strand; PAM type: NRG; PAM sequence: CAG
ctgccactcagaagcatttt

SEQ ID NO: 17456 - DNA, 20 bp, Artificial Sequence
  Description of Artificial Sequence: Synthetic oligonucleotide
  Target: SCN10A; (-) strand; PAM type: NRG; PAM sequence: AAG
gacagctgtctgccactcag

SEQ ID NO: 17457 - DNA, 20 bp, Artificial Sequence
  Description of Artificial Sequence: Synthetic oligonucleotide
  Target: SCN10A; (-) strand; PAM type: NRG; PAM sequence: CAG
tgtgacagctgtctgccact

SEQ ID NO: 17458 - DNA, 20 bp, Artificial Sequence
  Description of Artificial Sequence: Synthetic oligonucleotide
  Target: SCN10A; (-) strand; PAM type: NRG; PAM sequence: CAG
agagagcatgaactctgtga

SEQ ID NO: 17459 - DNA, 20 bp, Artificial Sequence
  Description of Artificial Sequence: Synthetic oligonucleotide
  Target: SCN10A; (-) strand; PAM type: NRG; PAM sequence: GAG
tttgtctaggtaacagcaga

SEQ ID NO: 17460 - DNA, 20 bp, Artificial Sequence
  Description of Artificial Sequence: Synthetic oligonucleotide
  Target: SCN10A; (-) strand; PAM type: NRG; PAM sequence: GAG
cctttgtctaggtaacagca

SEQ ID NO: 17461 - DNA, 20 bp, Artificial Sequence
  Description of Artificial Sequence: Synthetic oligonucleotide
  Target: SCN10A; (-) strand; PAM type: NRG; PAM sequence: CAG
tgcctttgtctaggtaacag

SEQ ID NO: 17462 - DNA, 20 bp, Artificial Sequence
  Description of Artificial Sequence: Synthetic oligonucleotide
  Target: SCN10A; (-) strand; PAM type: NRG; PAM sequence: CAG
acatgcctttgtctaggtaa

SEQ ID NO: 17463 - DNA, 20 bp, Artificial Sequence
  Description of Artificial Sequence: Synthetic oligonucleotide
  Target: SCN10A; (-) strand; PAM type: NRG; PAM sequence: AGG
tattttacatgcctttgtct

SEQ ID NO: 17464 - DNA, 20 bp, Artificial Sequence
  Description of Artificial Sequence: Synthetic oligonucleotide
  Target: SCN10A; (-) strand; PAM type: NRG; PAM sequence: TAG
atattttacatgcctttgtc

SEQ ID NO: 17465 - DNA, 20 bp, Artificial Sequence
  Description of Artificial Sequence: Synthetic oligonucleotide
  Target: SCN10A; (-) strand; PAM type: NRG; PAM sequence: CAG
gttccagcagctgctgttat

SEQ ID NO: 17466 - DNA, 20 bp, Artificial Sequence
  Description of Artificial Sequence: Synthetic oligonucleotide
  Target: SCN10A; (-) strand; PAM type: NRG; PAM sequence: CAG
agtcgtcacttgtgttccag

SEQ ID NO: 17467 - DNA, 20 bp, Artificial Sequence
  Description of Artificial Sequence: Synthetic oligonucleotide
  Target: SCN10A; (-) strand; PAM type: NRG; PAM sequence: CAG
tgcagtcgtcacttgtgttc

SEQ ID NO: 17468 - DNA, 20 bp, Artificial Sequence
  Description of Artificial Sequence: Synthetic oligonucleotide
  Target: SCN10A; (-) strand; PAM type: NRG; PAM sequence: CAG
tcccatagccttcttccctg

SEQ ID NO: 17469 - DNA, 20 bp, Artificial Sequence
  Description of Artificial Sequence: Synthetic oligonucleotide
  Target: SCN10A; (-) strand; PAM type: NRG; PAM sequence: TAG
ttgagtctgtagctctccca

SEQ ID NO: 17470 - DNA, 20 bp, Artificial Sequence
  Description of Artificial Sequence: Synthetic oligonucleotide
  Target: SCN10A; (-) strand; PAM type: NRG; PAM sequence: TAG
aaagctgtgctttgagtctg

SEQ ID NO: 17471 - DNA, 20 bp, Artificial Sequence
  Description of Artificial Sequence: Synthetic oligonucleotide
  Target: SCN10A; (-) strand; PAM type: NRG; PAM sequence: GAG
gtccagaaaagctgtgcttt

SEQ ID NO: 17472 - DNA, 20 bp, Artificial Sequence
  Description of Artificial Sequence: Synthetic oligonucleotide
  Target: SCN10A; (-) strand; PAM type: NRG; PAM sequence: AAG
ggttactaagtggtccagaa

SEQ ID NO: 17473 - DNA, 20 bp, Artificial Sequence
  Description of Artificial Sequence: Synthetic oligonucleotide
  Target: SCN10A; (-) strand; PAM type: NRG; PAM sequence: CAG
ggccaggttactaagtggtc

SEQ ID NO: 17474 - DNA, 20 bp, Artificial Sequence
  Description of Artificial Sequence: Synthetic oligonucleotide
  Target: SCN10A; (-) strand; PAM type: NRG; PAM sequence: TGG
ctgctggccaggttactaag

SEQ ID NO: 17475 - DNA, 20 bp, Artificial Sequence
  Description of Artificial Sequence: Synthetic oligonucleotide
  Target: SCN10A; (-) strand; PAM type: NRG; PAM sequence: AAG
gggctgctggccaggttact

SEQ ID NO: 17476 - DNA, 20 bp, Artificial Sequence
  Description of Artificial Sequence: Synthetic oligonucleotide
  Target: SCN10A; (-) strand; PAM type: NRG; PAM sequence: AGG
aacatgcagggctgctggcc

SEQ ID NO: 17477 - DNA, 20 bp, Artificial Sequence
  Description of Artificial Sequence: Synthetic oligonucleotide
  Target: SCN10A; (-) strand; PAM type: NRG; PAM sequence: CAG
gaacatgcagggctgctggc

SEQ ID NO: 17478 - DNA, 20 bp, Artificial Sequence
  Description of Artificial Sequence: Synthetic oligonucleotide
  Target: SCN10A; (-) strand; PAM type: NRG; PAM sequence: TGG
tcaggaacatgcagggctgc

SEQ ID NO: 17479 - DNA, 20 bp, Artificial Sequence
  Description of Artificial Sequence: Synthetic oligonucleotide
  Target: SCN10A; (-) strand; PAM type: NRG; PAM sequence: GGG
tgaggcctcaggaacatgca

SEQ ID NO: 17480 - DNA, 20 bp, Artificial Sequence
  Description of Artificial Sequence: Synthetic oligonucleotide
  Target: SCN10A; (-) strand; PAM type: NRG; PAM sequence: AGG
gtgaggcctcaggaacatgc

SEQ ID NO: 17481 - DNA, 20 bp, Artificial Sequence
  Description of Artificial Sequence: Synthetic oligonucleotide
  Target: SCN10A; (-) strand; PAM type: NRG; PAM sequence: CAG
tgtgaggcctcaggaacatg

SEQ ID NO: 17482 - DNA, 20 bp, Artificial Sequence
  Description of Artificial Sequence: Synthetic oligonucleotide
  Target: SCN10A; (-) strand; PAM type: NRG; PAM sequence: AGG
agggaaccctgtgaggcctc

SEQ ID NO: 17483 - DNA, 20 bp, Artificial Sequence
  Description of Artificial Sequence: Synthetic oligonucleotide
  Target: SCN10A; (-) strand; PAM type: NRG; PAM sequence: CAG
cagggaaccctgtgaggcct

SEQ ID NO: 17484 - DNA, 20 bp, Artificial Sequence
  Description of Artificial Sequence: Synthetic oligonucleotide
  Target: SCN10A; (-) strand; PAM type: NRG; PAM sequence: AGG
ggaaggcagggaaccctgtg

SEQ ID NO: 17485 - DNA, 20 bp, Artificial Sequence
  Description of Artificial Sequence: Synthetic oligonucleotide
  Target: SCN10A; (-) strand; PAM type: NRG; PAM sequence: GAG
gggaaggcagggaaccctgt

SEQ ID NO: 17486 - DNA, 20 bp, Artificial Sequence
  Description of Artificial Sequence: Synthetic oligonucleotide
  Target: SCN10A; (-) strand; PAM type: NRG; PAM sequence: GGG
ctgcccaacgtgggaaggca

SEQ ID NO: 17487 - DNA, 20 bp, Artificial Sequence
  Description of Artificial Sequence: Synthetic oligonucleotide
  Target: SCN10A; (-) strand; PAM type: NRG; PAM sequence: AGG
tctgcccaacgtgggaaggc

SEQ ID NO: 17488 - DNA, 20 bp, Artificial Sequence
  Description of Artificial Sequence: Synthetic oligonucleotide
  Target: SCN10A; (-) strand; PAM type: NRG; PAM sequence: CAG
ctctgcccaacgtgggaagg

SEQ ID NO: 17489 - DNA, 20 bp, Artificial Sequence
  Description of Artificial Sequence: Synthetic oligonucleotide
  Target: SCN10A; (-) strand; PAM type: NRG; PAM sequence: AGG
cacctctgcccaacgtggga

SEQ ID NO: 17490 - DNA, 20 bp, Artificial Sequence
  Description of Artificial Sequence: Synthetic oligonucleotide
  Target: SCN10A; (-) strand; PAM type: NRG; PAM sequence: AAG
tcacctctgcccaacgtggg

SEQ ID NO: 17491 - DNA, 20 bp, Artificial Sequence
  Description of Artificial Sequence: Synthetic oligonucleotide
  Target: SCN10A; (-) strand; PAM type: NRG; PAM sequence: GGG
cattcacctctgcccaacgt

SEQ ID NO: 17492 - DNA, 20 bp, Artificial Sequence
  Description of Artificial Sequence: Synthetic oligonucleotide
  Target: SCN10A; (-) strand; PAM type: NRG; PAM sequence: TGG
gcattcacctctgcccaacg

SEQ ID NO: 17493 - DNA, 20 bp, Artificial Sequence
  Description of Artificial Sequence: Synthetic oligonucleotide
  Target: SCN10A; (-) strand; PAM type: NRG; PAM sequence: GGG
aacctcttctcagtaactca

SEQ ID NO: 17494 - DNA, 20 bp, Artificial Sequence
  Description of Artificial Sequence: Synthetic oligonucleotide
  Target: SCN10A; (-) strand; PAM type: NRG; PAM sequence: AGG
taacctcttctcagtaactc

SEQ ID NO: 17495 - DNA, 20 bp, Artificial Sequence
  Description of Artificial Sequence: Synthetic oligonucleotide
  Target: SCN10A; (-) strand; PAM type: NRG; PAM sequence: CAG
ctaacctcttctcagtaact

SEQ ID NO: 17496 - DNA, 20 bp, Artificial Sequence
  Description of Artificial Sequence: Synthetic oligonucleotide
  Target: SCN10A; (-) strand; PAM type: NRG; PAM sequence: CAG
aaccctcgctaacctcttct

SEQ ID NO: 17497 - DNA, 20 bp, Artificial Sequence
  Description of Artificial Sequence: Synthetic oligonucleotide
  Target: SCN10A; (-) strand; PAM type: NRG; PAM sequence: TGG
tattccttactaccttaagc

SEQ ID NO: 17498 - DNA, 20 bp, Artificial Sequence
  Description of Artificial Sequence: Synthetic oligonucleotide
  Target: SCN10A; (-) strand; PAM type: NRG; PAM sequence: AAG
gcactattccttactacctt

SEQ ID NO: 17499 - DNA, 20 bp, Artificial Sequence
  Description of Artificial Sequence: Synthetic oligonucleotide
  Target: SCN10A; (-) strand; PAM type: NRG; PAM sequence: TGG
aatatatatttttaaatact

SEQ ID NO: 17500 - DNA, 20 bp, Artificial Sequence
  Description of Artificial Sequence: Synthetic oligonucleotide
  Target: SCN10A; (-) strand; PAM type: NRG; PAM sequence: GAG
aactaatttaaagcacattt

SEQ ID NO: 17501 - DNA, 20 bp, Artificial Sequence
  Description of Artificial Sequence: Synthetic oligonucleotide
  Target: SCN10A; (-) strand; PAM type: NRG; PAM sequence: AAG
ttttggcaccaactaattta

SEQ ID NO: 17502 - DNA, 20 bp, Artificial Sequence
  Description of Artificial Sequence: Synthetic oligonucleotide
  Target: SCN10A; (-) strand; PAM type: NRG; PAM sequence: TGG
gggaaatgacacgctccttt

SEQ ID NO: 17503 - DNA, 20 bp, Artificial Sequence
  Description of Artificial Sequence: Synthetic oligonucleotide
  Target: SCN10A; (-) strand; PAM type: NRG; PAM sequence: GGG
tccccacaagtggtatcaca

SEQ ID NO: 17504 - DNA, 20 bp, Artificial Sequence
  Description of Artificial Sequence: Synthetic oligonucleotide
  Target: SCN10A; (-) strand; PAM type: NRG; PAM sequence: AGG
ttccccacaagtggtatcac

SEQ ID NO: 17505 - DNA, 20 bp, Artificial Sequence
  Description of Artificial Sequence: Synthetic oligonucleotide
  Target: SCN10A; (-) strand; PAM type: NRG; PAM sequence: CAG
tttccccacaagtggtatca

SEQ ID NO: 17506 - DNA, 20 bp, Artificial Sequence
  Description of Artificial Sequence: Synthetic oligonucleotide
  Target: SCN10A; (-) strand; PAM type: NRG; PAM sequence: TGG
agccagcttttccccacaag

SEQ ID NO: 17507 - DNA, 20 bp, Artificial Sequence
  Description of Artificial Sequence: Synthetic oligonucleotide
  Target: SCN10A; (-) strand; PAM type: NRG; PAM sequence: AAG
tttagccagcttttccccac

SEQ ID NO: 17508 - DNA, 20 bp, Artificial Sequence
  Description of Artificial Sequence: Synthetic oligonucleotide
  Target: SCN10A; (-) strand; PAM type: NRG; PAM sequence: CAG
tcttatgtgactcatttagc

SEQ ID NO: 17509 - DNA, 20 bp, Artificial Sequence
  Description of Artificial Sequence: Synthetic oligonucleotide
  Target: SCN10A; (-) strand; PAM type: NRG; PAM sequence: TAG
tgattcttatgtgactcatt

SEQ ID NO: 17510 - DNA, 20 bp, Artificial Sequence
  Description of Artificial Sequence: Synthetic oligonucleotide
  Target: SCN10A; (-) strand; PAM type: NRG; PAM sequence: AAG
atctttaccagcatcctaag

SEQ ID NO: 17511 - DNA, 20 bp, Artificial Sequence
  Description of Artificial Sequence: Synthetic oligonucleotide
  Target: SCN10A; (-) strand; PAM type: NRG; PAM sequence: AAG
ctaatctttaccagcatcct

SEQ ID NO: 17512 - DNA, 20 bp, Artificial Sequence
  Description of Artificial Sequence: Synthetic oligonucleotide
  Target: SCN10A; (-) strand; PAM type: NRG; PAM sequence: CAG
aaggctcatctaatctttac

SEQ ID NO: 17513 - DNA, 20 bp, Artificial Sequence
  Description of Artificial Sequence: Synthetic oligonucleotide
  Target: SCN10A; (-) strand; PAM type: NRG; PAM sequence: AGG
caggatgttgtccaagagca

SEQ ID NO: 17514 - DNA, 20 bp, Artificial Sequence
  Description of Artificial Sequence: Synthetic oligonucleotide
  Target: SCN10A; (-) strand; PAM type: NRG; PAM sequence: AAG
acaggatgttgtccaagagc

SEQ ID NO: 17515 - DNA, 20 bp, Artificial Sequence
  Description of Artificial Sequence: Synthetic oligonucleotide
  Target: SCN10A; (-) strand; PAM type: NRG; PAM sequence: GAG
aagaacaggatgttgtccaa

SEQ ID NO: 17516 - DNA, 20 bp, Artificial Sequence
  Description of Artificial Sequence: Synthetic oligonucleotide
  Target: SCN10A; (-) strand; PAM type: NRG; PAM sequence: AAG
ctaagaacaggatgttgtcc

SEQ ID NO: 17517 - DNA, 20 bp, Artificial Sequence
  Description of Artificial Sequence: Synthetic oligonucleotide
  Target: SCN10A; (-) strand; PAM type: NRG; PAM sequence: AGG
aatgagatttctctaagaac

SEQ ID NO: 17518 - DNA, 20 bp, Artificial Sequence
  Description of Artificial Sequence: Synthetic oligonucleotide
  Target: SCN10A; (-) strand; PAM type: NRG; PAM sequence: CAG
taatgagatttctctaagaa

SEQ ID NO: 17519 - DNA, 20 bp, Artificial Sequence
  Description of Artificial Sequence: Synthetic oligonucleotide
  Target: SCN10A; (-) strand; PAM type: NRG; PAM sequence: AAG
gatgctaatgagatttctct

SEQ ID NO: 17520 - DNA, 20 bp, Artificial Sequence
  Description of Artificial Sequence: Synthetic oligonucleotide
  Target: SCN10A; (-) strand; PAM type: NRG; PAM sequence: GAG
tctgtgcatgagatgctaat

SEQ ID NO: 17521 - DNA, 20 bp, Artificial Sequence
  Description of Artificial Sequence: Synthetic oligonucleotide
  Target: SCN10A; (-) strand; PAM type: NRG; PAM sequence: GAG
ccaacccaggctctgtgcat

SEQ ID NO: 17522 - DNA, 20 bp, Artificial Sequence
  Description of Artificial Sequence: Synthetic oligonucleotide
  Target: SCN10A; (-) strand; PAM type: NRG; PAM sequence: AGG
ccatgcgctctgcccaaccc

SEQ ID NO: 17523 - DNA, 20 bp, Artificial Sequence
  Description of Artificial Sequence: Synthetic oligonucleotide
  Target: SCN10A; (-) strand; PAM type: NRG; PAM sequence: CAG
cccatgcgctctgcccaacc

SEQ ID NO: 17524 - DNA, 20 bp, Artificial Sequence
  Description of Artificial Sequence: Synthetic oligonucleotide
  Target: SCN10A; (-) strand; PAM type: NRG; PAM sequence: CAG
cttggggattgtctttcaca

SEQ ID NO: 17525 - DNA, 20 bp, Artificial Sequence
  Description of Artificial Sequence: Synthetic oligonucleotide
  Target: SCN10A; (-) strand; PAM type: NRG; PAM sequence: GGG
aggccaccttgaggtgcttg

SEQ ID NO: 17526 - DNA, 20 bp, Artificial Sequence
  Description of Artificial Sequence: Synthetic oligonucleotide
  Target: SCN10A; (-) strand; PAM type: NRG; PAM sequence: GGG
aaggccaccttgaggtgctt

SEQ ID NO: 17527 - DNA, 20 bp, Artificial Sequence
  Description of Artificial Sequence: Synthetic oligonucleotide
  Target: SCN10A; (-) strand; PAM type: NRG; PAM sequence: TGG
aaaggccaccttgaggtgct

SEQ ID NO: 17528 - DNA, 20 bp, Artificial Sequence
  Description of Artificial Sequence: Synthetic oligonucleotide
  Target: SCN10A; (-) strand; PAM type: NRG; PAM sequence: AGG
gtgagcaaaaggccaccttg

SEQ ID NO: 17529 - DNA, 20 bp, Artificial Sequence
  Description of Artificial Sequence: Synthetic oligonucleotide
  Target: SCN10A; (-) strand; PAM type: NRG; PAM sequence: GAG
ggtgagcaaaaggccacctt

SEQ ID NO: 17530 - DNA, 20 bp, Artificial Sequence
  Description of Artificial Sequence: Synthetic oligonucleotide
  Target: SCN10A; (-) strand; PAM type: NRG; PAM sequence: AGG
gggggcagcaggtgagcaaa

SEQ ID NO: 17531 - DNA, 20 bp, Artificial Sequence
  Description of Artificial Sequence: Synthetic oligonucleotide
  Target: SCN10A; (-) strand; PAM type: NRG; PAM sequence: AAG
ggggggcagcaggtgagcaa

SEQ ID NO: 17532 - DNA, 20 bp, Artificial Sequence
  Description of Artificial Sequence: Synthetic oligonucleotide
  Target: SCN10A; (-) strand; PAM type: NRG; PAM sequence: GAG
gggagtggggggcagcaggt

SEQ ID NO: 17533 - DNA, 20 bp, Artificial Sequence
  Description of Artificial Sequence: Synthetic oligonucleotide
  Target: SCN10A; (-) strand; PAM type: NRG; PAM sequence: AGG
aacagggagtggggggcagc

SEQ ID NO: 17534 - DNA, 20 bp, Artificial Sequence
  Description of Artificial Sequence: Synthetic oligonucleotide
  Target: SCN10A; (-) strand; PAM type: NRG; PAM sequence: CAG
aaacagggagtggggggcag

SEQ ID NO: 17535 - DNA, 20 bp, Artificial Sequence
  Description of Artificial Sequence: Synthetic oligonucleotide
  Target: SCN10A; (-) strand; PAM type: NRG; PAM sequence: CAG
gacaaacagggagtgggggg

SEQ ID NO: 17536 - DNA, 20 bp, Artificial Sequence
  Description of Artificial Sequence: Synthetic oligonucleotide
  Target: SCN10A; (-) strand; PAM type: NRG; PAM sequence: GGG
gcagacaaacagggagtggg

SEQ ID NO: 17537 - DNA, 20 bp, Artificial Sequence
  Description of Artificial Sequence: Synthetic oligonucleotide
  Target: SCN10A; (-) strand; PAM type: NRG; PAM sequence: GGG
ggcagacaaacagggagtgg

SEQ ID NO: 17538 - DNA, 20 bp, Artificial Sequence
  Description of Artificial Sequence: Synthetic oligonucleotide
  Target: SCN10A; (-) strand; PAM type: NRG; PAM sequence: GGG
aggcagacaaacagggagtg

SEQ ID NO: 17539 - DNA, 20 bp, Artificial Sequence
  Description of Artificial Sequence: Synthetic oligonucleotide
  Target: SCN10A; (-) strand; PAM type: NRG; PAM sequence: GGG
caggcagacaaacagggagt

SEQ ID NO: 17540 - DNA, 20 bp, Artificial Sequence
  Description of Artificial Sequence: Synthetic oligonucleotide
  Target: SCN10A; (-) strand; PAM type: NRG; PAM sequence: TGG
ccaggcagacaaacagggag

SEQ ID NO: 17541 - DNA, 20 bp, Artificial Sequence
  Description of Artificial Sequence: Synthetic oligonucleotide
  Target: SCN10A; (-) strand; PAM type: NRG; PAM sequence: GAG
tccccaggcagacaaacagg

SEQ ID NO: 17542 - DNA, 20 bp, Artificial Sequence
  Description of Artificial Sequence: Synthetic oligonucleotide
  Target: SCN10A; (-) strand; PAM type: NRG; PAM sequence: GGG
attccccaggcagacaaaca

SEQ ID NO: 17543 - DNA, 20 bp, Artificial Sequence
  Description of Artificial Sequence: Synthetic oligonucleotide
  Target: SCN10A; (-) strand; PAM type: NRG; PAM sequence: AGG
aattccccaggcagacaaac

SEQ ID NO: 17544 - DNA, 20 bp, Artificial Sequence
  Description of Artificial Sequence: Synthetic oligonucleotide
  Target: SCN10A; (-) strand; PAM type: NRG; PAM sequence: CAG
gaattccccaggcagacaaa

SEQ ID NO: 17545 - DNA, 20 bp, Artificial Sequence
  Description of Artificial Sequence: Synthetic oligonucleotide
  Target: SCN10A; (-) strand; PAM type: NRG; PAM sequence: CAG
aaaagtcagaattccccagg

SEQ ID NO: 17546 - DNA, 20 bp, Artificial Sequence
  Description of Artificial Sequence: Synthetic oligonucleotide
  Target: SCN10A; (-) strand; PAM type: NRG; PAM sequence: AGG
agaaaaagtcagaattcccc

SEQ ID NO: 17547 - DNA, 20 bp, Artificial Sequence
  Description of Artificial Sequence: Synthetic oligonucleotide
  Target: SCN10A; (-) strand; PAM type: NRG; PAM sequence: CAG
aagaaaaagtcagaattccc

SEQ ID NO: 17548 - DNA, 20 bp, Artificial Sequence
  Description of Artificial Sequence: Synthetic oligonucleotide
  Target: SCN10A; (-) strand; PAM type: NRG; PAM sequence: CAG
cagggcctggaagaaaaagt

SEQ ID NO: 17549 - DNA, 20 bp, Artificial Sequence
  Description of Artificial Sequence: Synthetic oligonucleotide
  Target: SCN10A; (-) strand; PAM type: NRG; PAM sequence: AAG
tgagcagggcctggaagaaa

SEQ ID NO: 17550 - DNA, 20 bp, Artificial Sequence
  Description of Artificial Sequence: Synthetic oligonucleotide
  Target: SCN10A; (-) strand; PAM type: NRG; PAM sequence: AAG
ggcgtttgagcagggcctgg

SEQ ID NO: 17551 - DNA, 20 bp, Artificial Sequence
  Description of Artificial Sequence: Synthetic oligonucleotide
  Target: SCN10A; (-) strand; PAM type: NRG; PAM sequence: TGG
gttggcgtttgagcagggcc

SEQ ID NO: 17552 - DNA, 20 bp, Artificial Sequence
  Description of Artificial Sequence: Synthetic oligonucleotide
  Target: SCN10A; (-) strand; PAM type: NRG; PAM sequence: GGG
gaggagttggcgtttgagca

SEQ ID NO: 17553 - DNA, 20 bp, Artificial Sequence
  Description of Artificial Sequence: Synthetic oligonucleotide
  Target: SCN10A; (-) strand; PAM type: NRG; PAM sequence: AGG
agaggagttggcgtttgagc

SEQ ID NO: 17554 - DNA, 20 bp, Artificial Sequence
  Description of Artificial Sequence: Synthetic oligonucleotide
  Target: SCN10A; (-) strand; PAM type: NRG; PAM sequence: CAG
cagaggagttggcgtttgag

SEQ ID NO: 17555 - DNA, 20 bp, Artificial Sequence
  Description of Artificial Sequence: Synthetic oligonucleotide
  Target: SCN10A; (-) strand; PAM type: NRG; PAM sequence: GAG
ttccagaggagttggcgttt

SEQ ID NO: 17556 - DNA, 20 bp, Artificial Sequence
  Description of Artificial Sequence: Synthetic oligonucleotide
  Target: SCN10A; (-) strand; PAM type: NRG; PAM sequence: TGG
gccaagctttccagaggagt

SEQ ID NO: 17557 - DNA, 20 bp, Artificial Sequence
  Description of Artificial Sequence: Synthetic oligonucleotide
  Target: SCN10A; (-) strand; PAM type: NRG; PAM sequence: GAG
ccatgccaagctttccagag

SEQ ID NO: 17558 - DNA, 20 bp, Artificial Sequence
  Description of Artificial Sequence: Synthetic oligonucleotide
  Target: SCN10A; (-) strand; PAM type: NRG; PAM sequence: AGG
aaccatgccaagctttccag

SEQ ID NO: 17559 - DNA, 20 bp, Artificial Sequence
  Description of Artificial Sequence: Synthetic oligonucleotide
  Target: SCN10A; (-) strand; PAM type: NRG; PAM sequence: GAG
aaaccatgccaagctttcca

SEQ ID NO: 17560 - DNA, 20 bp, Artificial Sequence
  Description of Artificial Sequence: Synthetic oligonucleotide
  Target: SCN10A; (-) strand; PAM type: NRG; PAM sequence: CAG
ttaaaccatgccaagctttc

SEQ ID NO: 17561 - DNA, 20 bp, Artificial Sequence
  Description of Artificial Sequence: Synthetic oligonucleotide
  Target: SCN10A; (-) strand; PAM type: NRG; PAM sequence: AAG
aaagaagtttaaaccatgcc

SEQ ID NO: 17562 - DNA, 20 bp, Artificial Sequence
  Description of Artificial Sequence: Synthetic oligonucleotide
  Target: SCN10A; (-) strand; PAM type: NRG; PAM sequence: AAG
gaggagaccttgacataaag

SEQ ID NO: 17563 - DNA, 20 bp, Artificial Sequence
  Description of Artificial Sequence: Synthetic oligonucleotide
  Target: SCN10A; (-) strand; PAM type: NRG; PAM sequence: AAG
gcagaggagaccttgacata

SEQ ID NO: 17564 - DNA, 20 bp, Artificial Sequence
  Description of Artificial Sequence: Synthetic oligonucleotide
  Target: SCN10A; (-) strand; PAM type: NRG; PAM sequence: GAG
ggcaaaagggaaatgcagag

SEQ ID NO: 17565 - DNA, 20 bp, Artificial Sequence
  Description of Artificial Sequence: Synthetic oligonucleotide
  Target: SCN10A; (-) strand; PAM type: NRG; PAM sequence: AGG
agggcaaaagggaaatgcag

SEQ ID NO: 17566 - DNA, 20 bp, Artificial Sequence
  Description of Artificial Sequence: Synthetic oligonucleotide
  Target: SCN10A; (-) strand; PAM type: NRG; PAM sequence: GAG
aagggcaaaagggaaatgca

SEQ ID NO: 17567 - DNA, 20 bp, Artificial Sequence
  Description of Artificial Sequence: Synthetic oligonucleotide
  Target: SCN10A; (-) strand; PAM type: NRG; PAM sequence: CAG
caaagggcaaaagggaaatg

SEQ ID NO: 17568 - DNA, 20 bp, Artificial Sequence
  Description of Artificial Sequence: Synthetic oligonucleotide
  Target: SCN10A; (-) strand; PAM type: NRG; PAM sequence: GGG
ttgagtgacaaagggcaaaa

SEQ ID NO: 17569 - DNA, 20 bp, Artificial Sequence
  Description of Artificial Sequence: Synthetic oligonucleotide
  Target: SCN10A; (-) strand; PAM type: NRG; PAM sequence: AGG
cttgagtgacaaagggcaaa

SEQ ID NO: 17570 - DNA, 20 bp, Artificial Sequence
  Description of Artificial Sequence: Synthetic oligonucleotide
  Target: SCN10A; (-) strand; PAM type: NRG; PAM sequence: AAG
gcttgagtgacaaagggcaa

SEQ ID NO: 17571 - DNA, 20 bp, Artificial Sequence
  Description of Artificial Sequence: Synthetic oligonucleotide
  Target: SCN10A; (-) strand; PAM type: NRG; PAM sequence: GGG
ttcagggcttgagtgacaaa

SEQ ID NO: 17572 - DNA, 20 bp, Artificial Sequence
  Description of Artificial Sequence: Synthetic oligonucleotide
  Target: SCN10A; (-) strand; PAM type: NRG; PAM sequence: AGG
cttcagggcttgagtgacaa

SEQ ID NO: 17573 - DNA, 20 bp, Artificial Sequence
  Description of Artificial Sequence: Synthetic oligonucleotide
  Target: SCN10A; (-) strand; PAM type: NRG; PAM sequence: AAG
gcttcagggcttgagtgaca

SEQ ID NO: 17574 - DNA, 20 bp, Artificial Sequence
  Description of Artificial Sequence: Synthetic oligonucleotide
  Target: SCN10A; (-) strand; PAM type: NRG; PAM sequence: GAG
ggggaggggcttcagggctt

SEQ ID NO: 17575 - DNA, 20 bp, Artificial Sequence
  Description of Artificial Sequence: Synthetic oligonucleotide
  Target: SCN10A; (-) strand; PAM type: NRG; PAM sequence: GGG
ggcagtggggaggggcttca

SEQ ID NO: 17576 - DNA, 20 bp, Artificial Sequence
  Description of Artificial Sequence: Synthetic oligonucleotide
  Target: SCN10A; (-) strand; PAM type: NRG; PAM sequence: AGG
aggcagtggggaggggcttc

SEQ ID NO: 17577 - DNA, 20 bp, Artificial Sequence
  Description of Artificial Sequence: Synthetic oligonucleotide
  Target: SCN10A; (-) strand; PAM type: NRG; PAM sequence: CAG
caggcagtggggaggggctt

SEQ ID NO: 17578 - DNA, 20 bp, Artificial Sequence
  Description of Artificial Sequence: Synthetic oligonucleotide
  Target: SCN10A; (-) strand; PAM type: NRG; PAM sequence: GGG
cagccacaggcagtggggag

SEQ ID NO: 17579 - DNA, 20 bp, Artificial Sequence
  Description of Artificial Sequence: Synthetic oligonucleotide
  Target: SCN10A; (-) strand; PAM type: NRG; PAM sequence: GGG
acagccacaggcagtgggga

SEQ ID NO: 17580 - DNA, 20 bp, Artificial Sequence
  Description of Artificial Sequence: Synthetic oligonucleotide
  Target: SCN10A; (-) strand; PAM type: NRG; PAM sequence: AGG
gacagccacaggcagtgggg

SEQ ID NO: 17581 - DNA, 20 bp, Artificial Sequence
  Description of Artificial Sequence: Synthetic oligonucleotide
  Target: SCN10A; (-) strand; PAM type: NRG; PAM sequence: GAG
ggacagccacaggcagtggg

SEQ ID NO: 17582 - DNA, 20 bp, Artificial Sequence
  Description of Artificial Sequence: Synthetic oligonucleotide
  Target: SCN10A; (-) strand; PAM type: NRG; PAM sequence: GGG
agggacagccacaggcagtg

SEQ ID NO: 17583 - DNA, 20 bp, Artificial Sequence
  Description of Artificial Sequence: Synthetic oligonucleotide
  Target: SCN10A; (-) strand; PAM type: NRG; PAM sequence: GGG
aagggacagccacaggcagt

SEQ ID NO: 17584 - DNA, 20 bp, Artificial Sequence
  Description of Artificial Sequence: Synthetic oligonucleotide
  Target: SCN10A; (-) strand; PAM type: NRG; PAM sequence: TGG
caagggacagccacaggcag

SEQ ID NO: 17585 - DNA, 20 bp, Artificial Sequence
  Description of Artificial Sequence: Synthetic oligonucleotide
  Target: SCN10A; (-) strand; PAM type: NRG; PAM sequence: CAG
ccccaagggacagccacagg

SEQ ID NO: 17586 - DNA, 20 bp, Artificial Sequence
  Description of Artificial Sequence: Synthetic oligonucleotide
  Target: SCN10A; (-) strand; PAM type: NRG; PAM sequence: AGG
tatccccaagggacagccac

SEQ ID NO: 17587 - DNA, 20 bp, Artificial Sequence
  Description of Artificial Sequence: Synthetic oligonucleotide
  Target: SCN10A; (-) strand; PAM type: NRG; PAM sequence: CAG
ttatccccaagggacagcca

SEQ ID NO: 17588 - DNA, 20 bp, Artificial Sequence
  Description of Artificial Sequence: Synthetic oligonucleotide
  Target: SCN10A; (-) strand; PAM type: NRG; PAM sequence: CAG
taagagttatccccaaggga

SEQ ID NO: 17589 - DNA, 20 bp, Artificial Sequence
  Description of Artificial Sequence: Synthetic oligonucleotide
  Target: SCN10A; (-) strand; PAM type: NRG; PAM sequence: GGG
caggtaagagttatccccaa

SEQ ID NO: 17590 - DNA, 20 bp, Artificial Sequence
  Description of Artificial Sequence: Synthetic oligonucleotide
  Target: SCN10A; (-) strand; PAM type: NRG; PAM sequence: AGG
acaggtaagagttatcccca

SEQ ID NO: 17591 - DNA, 20 bp, Artificial Sequence
  Description of Artificial Sequence: Synthetic oligonucleotide
  Target: SCN10A; (-) strand; PAM type: NRG; PAM sequence: AAG
gacaggtaagagttatcccc

SEQ ID NO: 17592 - DNA, 20 bp, Artificial Sequence
  Description of Artificial Sequence: Synthetic oligonucleotide
  Target: SCN10A; (-) strand; PAM type: NRG; PAM sequence: GAG
gatccccaaaggacaggtaa

SEQ ID NO: 17593 - DNA, 20 bp, Artificial Sequence
  Description of Artificial Sequence: Synthetic oligonucleotide
  Target: SCN10A; (-) strand; PAM type: NRG; PAM sequence: AAG
gtgatccccaaaggacaggt

SEQ ID NO: 17594 - DNA, 20 bp, Artificial Sequence
  Description of Artificial Sequence: Synthetic oligonucleotide
  Target: SCN10A; (-) strand; PAM type: NRG; PAM sequence: AGG
ggaagtgatccccaaaggac

SEQ ID NO: 17595 - DNA, 20 bp, Artificial Sequence
  Description of Artificial Sequence: Synthetic oligonucleotide
  Target: SCN10A; (-) strand; PAM type: NRG; PAM sequence: CAG
aggaagtgatccccaaagga

SEQ ID NO: 17596 - DNA, 20 bp, Artificial Sequence
  Description of Artificial Sequence: Synthetic oligonucleotide
  Target: SCN10A; (-) strand; PAM type: NRG; PAM sequence: AGG
cagcaggaagtgatccccaa

SEQ ID NO: 17597 - DNA, 20 bp, Artificial Sequence
  Description of Artificial Sequence: Synthetic oligonucleotide
  Target: SCN10A; (-) strand; PAM type: NRG; PAM sequence: AAG
ccagcaggaagtgatcccca

SEQ ID NO: 17598 - DNA, 20 bp, Artificial Sequence
  Description of Artificial Sequence: Synthetic oligonucleotide
  Target: SCN10A; (-) strand; PAM type: NRG; PAM sequence: AAG
tgctcagagcttccagcagg

SEQ ID NO: 17599 - DNA, 20 bp, Artificial Sequence
  Description of Artificial Sequence: Synthetic oligonucleotide
  Target: SCN10A; (-) strand; PAM type: NRG; PAM sequence: AGG
agatgctcagagcttccagc

SEQ ID NO: 17600 - DNA, 20 bp, Artificial Sequence
  Description of Artificial Sequence: Synthetic oligonucleotide
  Target: SCN10A; (-) strand; PAM type: NRG; PAM sequence: CAG
aagatgctcagagcttccag

SEQ ID NO: 17601 - DNA, 20 bp, Artificial Sequence
  Description of Artificial Sequence: Synthetic oligonucleotide
  Target: SCN10A; (-) strand; PAM type: NRG; PAM sequence: CAG
gggaagatgctcagagcttc

SEQ ID NO: 17602 - DNA, 20 bp, Artificial Sequence
  Description of Artificial Sequence: Synthetic oligonucleotide
  Target: SCN10A; (-) strand; PAM type: NRG; PAM sequence: GAG
gatggtggggaagatgctca

SEQ ID NO: 17603 - DNA, 20 bp, Artificial Sequence
  Description of Artificial Sequence: Synthetic oligonucleotide
  Target: SCN10A; (-) strand; PAM type: NRG; PAM sequence: CAG
atgatggtggggaagatgct

SEQ ID NO: 17604 - DNA, 20 bp, Artificial Sequence
  Description of Artificial Sequence: Synthetic oligonucleotide
  Target: SCN10A; (-) strand; PAM type: NRG; PAM sequence: AAG
cttggaggatgatggtgggg

SEQ ID NO: 17605 - DNA, 20 bp, Artificial Sequence
  Description of Artificial Sequence: Synthetic oligonucleotide
  Target: SCN10A; (-) strand; PAM type: NRG; PAM sequence: GGG
tgacttggaggatgatggtg

SEQ ID NO: 17606 - DNA, 20 bp, Artificial Sequence
  Description of Artificial Sequence: Synthetic oligonucleotide
  Target: SCN10A; (-) strand; PAM type: NRG; PAM sequence: GGG
atgacttggaggatgatggt

SEQ ID NO: 17607 - DNA, 20 bp, Artificial Sequence
  Description of Artificial Sequence: Synthetic oligonucleotide
  Target: SCN10A; (-) strand; PAM type: NRG; PAM sequence: TGG
gatgacttggaggatgatgg

SEQ ID NO: 17608 - DNA, 20 bp, Artificial Sequence
  Description of Artificial Sequence: Synthetic oligonucleotide
  Target: SCN10A; (-) strand; PAM type: NRG; PAM sequence: TGG
cttgatgacttggaggatga

SEQ ID NO: 17609 - DNA, 20 bp, Artificial Sequence
  Description of Artificial Sequence: Synthetic oligonucleotide
  Target: SCN10A; (-) strand; PAM type: NRG; PAM sequence: AGG
atctgatcttgatgacttgg

SEQ ID NO: 17610 - DNA, 20 bp, Artificial Sequence
  Description of Artificial Sequence: Synthetic oligonucleotide
  Target: SCN10A; (-) strand; PAM type: NRG; PAM sequence: GAG
aatctgatcttgatgacttg

SEQ ID NO: 17611 - DNA, 20 bp, Artificial Sequence
  Description of Artificial Sequence: Synthetic oligonucleotide
  Target: SCN10A; (-) strand; PAM type: NRG; PAM sequence: TGG
tgaatctgatcttgatgact

SEQ ID NO: 17612 - DNA, 20 bp, Artificial Sequence
  Description of Artificial Sequence: Synthetic oligonucleotide
  Target: SCN10A; (-) strand; PAM type: NRG; PAM sequence: GGG
gtctctgtgcccattgctga

SEQ ID NO: 17613 - DNA, 20 bp, Artificial Sequence
  Description of Artificial Sequence: Synthetic oligonucleotide
  Target: SCN10A; (-) strand; PAM type: NRG; PAM sequence: AGG
ggtctctgtgcccattgctg

SEQ ID NO: 17614 - DNA, 20 bp, Artificial Sequence
  Description of Artificial Sequence: Synthetic oligonucleotide
  Target: SCN10A; (-) strand; PAM type: NRG; PAM sequence: GAG
gggtctctgtgcccattgct

SEQ ID NO: 17615 - DNA, 20 bp, Artificial Sequence
  Description of Artificial Sequence: Synthetic oligonucleotide
  Target: SCN10A; (-) strand; PAM type: NRG; PAM sequence: GGG
catcgctaatccgactgtgt

SEQ ID NO: 17616 - DNA, 20 bp, Artificial Sequence
  Description of Artificial Sequence: Synthetic oligonucleotide
  Target: SCN10A; (-) strand; PAM type: NRG; PAM sequence: TGG
tcatcgctaatccgactgtg

SEQ ID NO: 17617 - DNA, 20 bp, Artificial Sequence
  Description of Artificial Sequence: Synthetic oligonucleotide
  Target: SCN10A; (-) strand; PAM type: NRG; PAM sequence: CAG
agaggccccagggatgagca

SEQ ID NO: 17618 - DNA, 20 bp, Artificial Sequence
  Description of Artificial Sequence: Synthetic oligonucleotide
  Target: SCN10A; (-) strand; PAM type: NRG; PAM sequence: GAG
ctcccagaggccccagggat

SEQ ID NO: 17619 - DNA, 20 bp, Artificial Sequence
  Description of Artificial Sequence: Synthetic oligonucleotide
  Target: SCN10A; (-) strand; PAM type: NRG; PAM sequence: GGG
ccaagctcccagaggcccca

SEQ ID NO: 17620 - DNA, 20 bp, Artificial Sequence
  Description of Artificial Sequence: Synthetic oligonucleotide
  Target: SCN10A; (-) strand; PAM type: NRG; PAM sequence: AGG
tccaagctcccagaggcccc

SEQ ID NO: 17621 - DNA, 20 bp, Artificial Sequence
  Description of Artificial Sequence: Synthetic oligonucleotide
  Target: SCN10A; (-) strand; PAM type: NRG; PAM sequence: CAG
ctccaagctcccagaggccc

SEQ ID NO: 17622 - DNA, 20 bp, Artificial Sequence
  Description of Artificial Sequence: Synthetic oligonucleotide
  Target: SCN10A; (-) strand; PAM type: NRG; PAM sequence: AGG
ggagggctccaagctcccag

SEQ ID NO: 17623 - DNA, 20 bp, Artificial Sequence
  Description of Artificial Sequence: Synthetic oligonucleotide
  Target: SCN10A; (-) strand; PAM type: NRG; PAM sequence: GAG
tggagggctccaagctccca

SEQ ID NO: 17624 - DNA, 20 bp, Artificial Sequence
  Description of Artificial Sequence: Synthetic oligonucleotide
  Target: SCN10A; (-) strand; PAM type: NRG; PAM sequence: CAG
tctggagggctccaagctcc

SEQ ID NO: 17625 - DNA, 20 bp, Artificial Sequence
  Description of Artificial Sequence: Synthetic oligonucleotide
  Target: SCN10A; (-) strand; PAM type: NRG; PAM sequence: AAG
ggggagctctggagggctcc

SEQ ID NO: 17626 - DNA, 20 bp, Artificial Sequence
  Description of Artificial Sequence: Synthetic oligonucleotide
  Target: SCN10A; (-) strand; PAM type: NRG; PAM sequence: GGG
ctgccagggggagctctgga

SEQ ID NO: 17627 - DNA, 20 bp, Artificial Sequence
  Description of Artificial Sequence: Synthetic oligonucleotide
  Target: SCN10A; (-) strand; PAM type: NRG; PAM sequence: AGG
actgccagggggagctctgg

SEQ ID NO: 17628 - DNA, 20 bp, Artificial Sequence
  Description of Artificial Sequence: Synthetic oligonucleotide
  Target: SCN10A; (-) strand; PAM type: NRG; PAM sequence: GAG
cactgccagggggagctctg

SEQ ID NO: 17629 - DNA, 20 bp, Artificial Sequence
  Description of Artificial Sequence: Synthetic oligonucleotide
  Target: SCN10A; (-) strand; PAM type: NRG; PAM sequence: TGG
aacactgccagggggagctc

SEQ ID NO: 17630 - DNA, 20 bp, Artificial Sequence
  Description of Artificial Sequence: Synthetic oligonucleotide
  Target: SCN10A; (-) strand; PAM type: NRG; PAM sequence: GAG
gctgccaacactgccagggg

SEQ ID NO: 17631 - DNA, 20 bp, Artificial Sequence
  Description of Artificial Sequence: Synthetic oligonucleotide
  Target: SCN10A; (-) strand; PAM type: NRG; PAM sequence: GGG
ttgctgccaacactgccagg

SEQ ID NO: 17632 - DNA, 20 bp, Artificial Sequence
  Description of Artificial Sequence: Synthetic oligonucleotide
  Target: SCN10A; (-) strand; PAM type: NRG; PAM sequence: GGG
attgctgccaacactgccag

SEQ ID NO: 17633 - DNA, 20 bp, Artificial Sequence
  Description of Artificial Sequence: Synthetic oligonucleotide
  Target: SCN10A; (-) strand; PAM type: NRG; PAM sequence: GGG
cattgctgccaacactgcca

SEQ ID NO: 17634 - DNA, 20 bp, Artificial Sequence
  Description of Artificial Sequence: Synthetic oligonucleotide
  Target: SCN10A; (-) strand; PAM type: NRG; PAM sequence: AGG
acattgctgccaacactgcc

SEQ ID NO: 17635 - DNA, 20 bp, Artificial Sequence
  Description of Artificial Sequence: Synthetic oligonucleotide
  Target: SCN10A; (-) strand; PAM type: NRG; PAM sequence: CAG
cacattgctgccaacactgc

SEQ ID NO: 17636 - DNA, 20 bp, Artificial Sequence
  Description of Artificial Sequence: Synthetic oligonucleotide
  Target: SCN10A; (-) strand; PAM type: NRG; PAM sequence: GAG
cactctccagctccaaggct

SEQ ID NO: 17637 - DNA, 20 bp, Artificial Sequence
  Description of Artificial Sequence: Synthetic oligonucleotide
  Target: SCN10A; (-) strand; PAM type: NRG; PAM sequence: AGG
actcccactctccagctcca

SEQ ID NO: 17638 - DNA, 20 bp, Artificial Sequence
  Description of Artificial Sequence: Synthetic oligonucleotide
  Target: SCN10A; (-) strand; PAM type: NRG; PAM sequence: AAG
aactcccactctccagctcc

SEQ ID NO: 17639 - DNA, 20 bp, Artificial Sequence
  Description of Artificial Sequence: Synthetic oligonucleotide
  Target: SCN10A; (-) strand; PAM type: NRG; PAM sequence: CAG
gtggtgaaactcccactctc

SEQ ID NO: 17640 - DNA, 20 bp, Artificial Sequence
  Description of Artificial Sequence: Synthetic oligonucleotide
  Target: SCN10A; (-) strand; PAM type: NRG; PAM sequence: TGG
caaggcagagcctgagctgg

SEQ ID NO: 17641 - DNA, 20 bp, Artificial Sequence
  Description of Artificial Sequence: Synthetic oligonucleotide
  Target: SCN10A; (-) strand; PAM type: NRG; PAM sequence: TGG
gcccaaggcagagcctgagc

SEQ ID NO: 17642 - DNA, 20 bp, Artificial Sequence
  Description of Artificial Sequence: Synthetic oligonucleotide
  Target: SCN10A; (-) strand; PAM type: NRG; PAM sequence: GAG
cccagcccaaggcagagcct

SEQ ID NO: 17643 - DNA, 20 bp, Artificial Sequence
  Description of Artificial Sequence: Synthetic oligonucleotide
  Target: SCN10A; (-) strand; PAM type: NRG; PAM sequence: GAG
cattcccccagcccaaggca

SEQ ID NO: 17644 - DNA, 20 bp, Artificial Sequence
  Description of Artificial Sequence: Synthetic oligonucleotide
  Target: SCN10A; (-) strand; PAM type: NRG; PAM sequence: CAG
cccattcccccagcccaagg

SEQ ID NO: 17645 - DNA, 20 bp, Artificial Sequence
  Description of Artificial Sequence: Synthetic oligonucleotide
  Target: SCN10A; (-) strand; PAM type: NRG; PAM sequence: AGG
ctgcccattcccccagccca

SEQ ID NO: 17646 - DNA, 20 bp, Artificial Sequence
  Description of Artificial Sequence: Synthetic oligonucleotide
  Target: SCN10A; (-) strand; PAM type: NRG; PAM sequence: AAG
cctgcccattcccccagccc

SEQ ID NO: 17647 - DNA, 20 bp, Artificial Sequence
  Description of Artificial Sequence: Synthetic oligonucleotide
  Target: SCN10A; (-) strand; PAM type: NRG; PAM sequence: CAG
gcaggtcctgcccattcccc

SEQ ID NO: 17648 - DNA, 20 bp, Artificial Sequence
  Description of Artificial Sequence: Synthetic oligonucleotide
  Target: SCN10A; (-) strand; PAM type: NRG; PAM sequence: AGG
ctctttgcagcttcttcagc

SEQ ID NO: 17649 - DNA, 20 bp, Artificial Sequence
  Description of Artificial Sequence: Synthetic oligonucleotide
  Target: SCN10A; (-) strand; PAM type: NRG; PAM sequence: CAG
gctctttgcagcttcttcag

SEQ ID NO: 17650 - DNA, 20 bp, Artificial Sequence
  Description of Artificial Sequence: Synthetic oligonucleotide
  Target: SCN10A; (-) strand; PAM type: NRG; PAM sequence: CAG
caggctctttgcagcttctt

SEQ ID NO: 17651 - DNA, 20 bp, Artificial Sequence
  Description of Artificial Sequence: Synthetic oligonucleotide
  Target: SCN10A; (-) strand; PAM type: NRG; PAM sequence: CAG
cgtaccaaacaggctctttg

SEQ ID NO: 17652 - DNA, 20 bp, Artificial Sequence
  Description of Artificial Sequence: Synthetic oligonucleotide
  Target: SCN10A; (-) strand; PAM type: NRG; PAM sequence: AGG
ctttggccatcgtaccaaac

SEQ ID NO: 17653 - DNA, 20 bp, Artificial Sequence
  Description of Artificial Sequence: Synthetic oligonucleotide
  Target: SCN10A; (-) strand; PAM type: NRG; PAM sequence: CAG
tctttggccatcgtaccaaa

SEQ ID NO: 17654 - DNA, 20 bp, Artificial Sequence
  Description of Artificial Sequence: Synthetic oligonucleotide
  Target: SCN10A; (-) strand; PAM type: NRG; PAM sequence: TGG
ctggcacggatccaggtctt

SEQ ID NO: 17655 - DNA, 20 bp, Artificial Sequence
  Description of Artificial Sequence: Synthetic oligonucleotide
  Target: SCN10A; (-) strand; PAM type: NRG; PAM sequence: AGG
ggtggccctggcacggatcc

SEQ ID NO: 17656 - DNA, 20 bp, Artificial Sequence
  Description of Artificial Sequence: Synthetic oligonucleotide
  Target: SCN10A; (-) strand; PAM type: NRG; PAM sequence: CAG
aggtggccctggcacggatc

SEQ ID NO: 17657 - DNA, 20 bp, Artificial Sequence
  Description of Artificial Sequence: Synthetic oligonucleotide
  Target: SCN10A; (-) strand; PAM type: NRG; PAM sequence: CGG
acctgcaggtggccctggca

SEQ ID NO: 17658 - DNA, 20 bp, Artificial Sequence
  Description of Artificial Sequence: Synthetic oligonucleotide
  Target: SCN10A; (-) strand; PAM type: NRG; PAM sequence: TGG
gaacaacctgcaggtggccc

SEQ ID NO: 17659 - DNA, 20 bp, Artificial Sequence
  Description of Artificial Sequence: Synthetic oligonucleotide
  Target: SCN10A; (-) strand; PAM type: NRG; PAM sequence: TGG
ggaggtgaacaacctgcagg

SEQ ID NO: 17660 - DNA, 20 bp, Artificial Sequence
  Description of Artificial Sequence: Synthetic oligonucleotide
  Target: SCN10A; (-) strand; PAM type: NRG; PAM sequence: AGG
tggggaggtgaacaacctgc

SEQ ID NO: 17661 - DNA, 20 bp, Artificial Sequence
  Description of Artificial Sequence: Synthetic oligonucleotide
  Target: SCN10A; (-) strand; PAM type: NRG; PAM sequence: CAG
atggggaggtgaacaacctg

SEQ ID NO: 17662 - DNA, 20 bp, Artificial Sequence
  Description of Artificial Sequence: Synthetic oligonucleotide
  Target: SCN10A; (-) strand; PAM type: NRG; PAM sequence: AGG
agccccggaggacgatgggg

SEQ ID NO: 17663 - DNA, 20 bp, Artificial Sequence
  Description of Artificial Sequence: Synthetic oligonucleotide
  Target: SCN10A; (-) strand; PAM type: NRG; PAM sequence: GAG
cagccccggaggacgatggg

SEQ ID NO: 17664 - DNA, 20 bp, Artificial Sequence
  Description of Artificial Sequence: Synthetic oligonucleotide
  Target: SCN10A; (-) strand; PAM type: NRG; PAM sequence: GGG
cacagccccggaggacgatg

SEQ ID NO: 17665 - DNA, 20 bp, Artificial Sequence
  Description of Artificial Sequence: Synthetic oligonucleotide
  Target: SCN10A; (-) strand; PAM type: NRG; PAM sequence: GGG
tcacagccccggaggacgat

SEQ ID NO: 17666 - DNA, 20 bp, Artificial Sequence
  Description of Artificial Sequence: Synthetic oligonucleotide
  Target: SCN10A; (-) strand; PAM type: NRG; PAM sequence: TGG
ctcacagccccggaggacga

SEQ ID NO: 17667 - DNA, 20 bp, Artificial Sequence
  Description of Artificial Sequence: Synthetic oligonucleotide
  Target: SCN10A; (-) strand; PAM type: NRG; PAM sequence: AGG
tgacaacctcacagccccgg

SEQ ID NO: 17668 - DNA, 20 bp, Artificial Sequence
  Description of Artificial Sequence: Synthetic oligonucleotide
  Target: SCN10A; (-) strand; PAM type: NRG; PAM sequence: GAG
ctgacaacctcacagccccg

SEQ ID NO: 17669 - DNA, 20 bp, Artificial Sequence
  Description of Artificial Sequence: Synthetic oligonucleotide
  Target: SCN10A; (-) strand; PAM type: NRG; PAM sequence: CGG
tgctgacaacctcacagccc

SEQ ID NO: 17670 - DNA, 20 bp, Artificial Sequence
  Description of Artificial Sequence: Synthetic oligonucleotide
  Target: SCN10A; (-) strand; PAM type: NRG; PAM sequence: CAG
tttcagtgctgacaacctca

SEQ ID NO: 17671 - DNA, 20 bp, Artificial Sequence
  Description of Artificial Sequence: Synthetic oligonucleotide
  Target: SCN10A; (-) strand; PAM type: NRG; PAM sequence: CAG
gccctgctattgaactcttt

SEQ ID NO: 17672 - DNA, 20 bp, Artificial Sequence
  Description of Artificial Sequence: Synthetic oligonucleotide
  Target: SCN10A; (-) strand; PAM type: NRG; PAM sequence: AGG
cccttccattccttctcttc

SEQ ID NO: 17673 - DNA, 20 bp, Artificial Sequence
  Description of Artificial Sequence: Synthetic oligonucleotide
  Target: SCN10A; (-) strand; PAM type: NRG; PAM sequence: CAG
tcccttccattccttctctt

SEQ ID NO: 17674 - DNA, 20 bp, Artificial Sequence
  Description of Artificial Sequence: Synthetic oligonucleotide
  Target: SCN10A; (-) strand; PAM type: NRG; PAM sequence: GAG
ccaatgtggggctcagctta

SEQ ID NO: 17675 - DNA, 20 bp, Artificial Sequence
  Description of Artificial Sequence: Synthetic oligonucleotide
  Target: SCN10A; (-) strand; PAM type: NRG; PAM sequence: TAG
ggccaatgtggggctcagct

SEQ ID NO: 17676 - DNA, 20 bp, Artificial Sequence
  Description of Artificial Sequence: Synthetic oligonucleotide
  Target: SCN10A; (-) strand; PAM type: NRG; PAM sequence: CAG
cggtaggccaatgtggggct

SEQ ID NO: 17677 - DNA, 20 bp, Artificial Sequence
  Description of Artificial Sequence: Synthetic oligonucleotide
  Target: SCN10A; (-) strand; PAM type: NRG; PAM sequence: GGG
taacccggtaggccaatgtg

SEQ ID NO: 17678 - DNA, 20 bp, Artificial Sequence
  Description of Artificial Sequence: Synthetic oligonucleotide
  Target: SCN10A; (-) strand; PAM type: NRG; PAM sequence: GGG
ctaacccggtaggccaatgt

SEQ ID NO: 17679 - DNA, 20 bp, Artificial Sequence
  Description of Artificial Sequence: Synthetic oligonucleotide
  Target: SCN10A; (-) strand; PAM type: NRG; PAM sequence: TGG
gctaacccggtaggccaatg

SEQ ID NO: 17680 - DNA, 20 bp, Artificial Sequence
  Description of Artificial Sequence: Synthetic oligonucleotide
  Target: SCN10A; (-) strand; PAM type: NRG; PAM sequence: AGG
cagccagctgctaacccggt

SEQ ID NO: 17681 - DNA, 20 bp, Artificial Sequence
  Description of Artificial Sequence: Synthetic oligonucleotide
  Target: SCN10A; (-) strand; PAM type: NRG; PAM sequence: TAG
ccagccagctgctaacccgg

SEQ ID NO: 17682 - DNA, 20 bp, Artificial Sequence
  Description of Artificial Sequence: Synthetic oligonucleotide
  Target: SCN10A; (-) strand; PAM type: NRG; PAM sequence: CGG
ttgccagccagctgctaacc

SEQ ID NO: 17683 - DNA, 20 bp, Artificial Sequence
  Description of Artificial Sequence: Synthetic oligonucleotide
  Target: SCN10A; (-) strand; PAM type: NRG; PAM sequence: CAG
gccgtggctgtcttgccagc

SEQ ID NO: 17684 - DNA, 20 bp, Artificial Sequence
  Description of Artificial Sequence: Synthetic oligonucleotide
  Target: SCN10A; (-) strand; PAM type: NRG; PAM sequence: CAG
ccaggccgtggctgtcttgc

SEQ ID NO: 17685 - DNA, 20 bp, Artificial Sequence
  Description of Artificial Sequence: Synthetic oligonucleotide
  Target: SCN10A; (-) strand; PAM type: NRG; PAM sequence: TGG
gcaggaagaggcccaggccg

SEQ ID NO: 17686 - DNA, 20 bp, Artificial Sequence
  Description of Artificial Sequence: Synthetic oligonucleotide
  Target: SCN10A; (-) strand; PAM type: NRG; PAM sequence: AGG
gggtgggcaggaagaggccc

SEQ ID NO: 17687 - DNA, 20 bp, Artificial Sequence
  Description of Artificial Sequence: Synthetic oligonucleotide
  Target: SCN10A; (-) strand; PAM type: NRG; PAM sequence: CAG
cgggtgggcaggaagaggcc

SEQ ID NO: 17688 - DNA, 20 bp, Artificial Sequence
  Description of Artificial Sequence: Synthetic oligonucleotide
  Target: SCN10A; (-) strand; PAM type: NRG; PAM sequence: AGG
catcccgggtgggcaggaag

SEQ ID NO: 17689 - DNA, 20 bp, Artificial Sequence
  Description of Artificial Sequence: Synthetic oligonucleotide
  Target: SCN10A; (-) strand; PAM type: NRG; PAM sequence: GAG
gcatcccgggtgggcaggaa

SEQ ID NO: 17690 - DNA, 20 bp, Artificial Sequence
  Description of Artificial Sequence: Synthetic oligonucleotide
  Target: SCN10A; (-) strand; PAM type: NRG; PAM sequence: AAG
cagcatcccgggtgggcagg

SEQ ID NO: 17691 - DNA, 20 bp, Artificial Sequence
  Description of Artificial Sequence: Synthetic oligonucleotide
  Target: SCN10A; (-) strand; PAM type: NRG; PAM sequence: AGG
ggacagcatcccgggtgggc

SEQ ID NO: 17692 - DNA, 20 bp, Artificial Sequence
  Description of Artificial Sequence: Synthetic oligonucleotide
  Target: SCN10A; (-) strand; PAM type: NRG; PAM sequence: CAG
gggacagcatcccgggtggg

SEQ ID NO: 17693 - DNA, 20 bp, Artificial Sequence
  Description of Artificial Sequence: Synthetic oligonucleotide
  Target: SCN10A; (-) strand; PAM type: NRG; PAM sequence: GGG
aaagggacagcatcccgggt

SEQ ID NO: 17694 - DNA, 20 bp, Artificial Sequence
  Description of Artificial Sequence: Synthetic oligonucleotide
  Target: SCN10A; (-) strand; PAM type: NRG; PAM sequence: TGG
aaaagggacagcatcccggg

SEQ ID NO: 17695 - DNA, 20 bp, Artificial Sequence
  Description of Artificial Sequence: Synthetic oligonucleotide
  Target: SCN10A; (-) strand; PAM type: NRG; PAM sequence: GGG
cccaaaagggacagcatccc

SEQ ID NO: 17696 - DNA, 20 bp, Artificial Sequence
  Description of Artificial Sequence: Synthetic oligonucleotide
  Target: SCN10A; (-) strand; PAM type: NRG; PAM sequence: CGG
ccccaaaagggacagcatcc

SEQ ID NO: 17697 - DNA, 20 bp, Artificial Sequence
  Description of Artificial Sequence: Synthetic oligonucleotide
  Target: SCN10A; (-) strand; PAM type: NRG; PAM sequence: CAG
gtccattcccccaaaaggga

SEQ ID NO: 17698 - DNA, 20 bp, Artificial Sequence
  Description of Artificial Sequence: Synthetic oligonucleotide
  Target: SCN10A; (-) strand; PAM type: NRG; PAM sequence: GGG
gaaagtccattcccccaaaa

SEQ ID NO: 17699 - DNA, 20 bp, Artificial Sequence
  Description of Artificial Sequence: Synthetic oligonucleotide
  Target: SCN10A; (-) strand; PAM type: NRG; PAM sequence: AGG
agaaagtccattcccccaaa

SEQ ID NO: 17700 - DNA, 20 bp, Artificial Sequence
  Description of Artificial Sequence: Synthetic oligonucleotide
  Target: SCN10A; (-) strand; PAM type: NRG; PAM sequence: AAG
cagaaagtccattcccccaa

SEQ ID NO: 17701 - DNA, 20 bp, Artificial Sequence
  Description of Artificial Sequence: Synthetic oligonucleotide
  Target: SCN10A; (-) strand; PAM type: NRG; PAM sequence: AAG
ttccctcaactgctctcaga

SEQ ID NO: 17702 - DNA, 20 bp, Artificial Sequence
  Description of Artificial Sequence: Synthetic oligonucleotide
  Target: SCN10A; (-) strand; PAM type: NRG; PAM sequence: CAG
aactttccctcaactgctct

SEQ ID NO: 17703 - DNA, 20 bp, Artificial Sequence
  Description of Artificial Sequence: Synthetic oligonucleotide
  Target: SCN10A; (-) strand; PAM type: NRG; PAM sequence: AGG
ccactgaggcgggtcactcc

SEQ ID NO: 17704 - DNA, 20 bp, Artificial Sequence
  Description of Artificial Sequence: Synthetic oligonucleotide
  Target: SCN10A; (-) strand; PAM type: NRG; PAM sequence: CAG
tccactgaggcgggtcactc

SEQ ID NO: 17705 - DNA, 20 bp, Artificial Sequence
  Description of Artificial Sequence: Synthetic oligonucleotide
  Target: SCN10A; (-) strand; PAM type: NRG; PAM sequence: GGG
caagcctcgtccactgaggc

SEQ ID NO: 17706 - DNA, 20 bp, Artificial Sequence
  Description of Artificial Sequence: Synthetic oligonucleotide
  Target: SCN10A; (-) strand; PAM type: NRG; PAM sequence: CGG
ccaagcctcgtccactgagg

SEQ ID NO: 17707 - DNA, 20 bp, Artificial Sequence
  Description of Artificial Sequence: Synthetic oligonucleotide
  Target: SCN10A; (-) strand; PAM type: NRG; PAM sequence: AGG
cttccaagcctcgtccactg

SEQ ID NO: 17708 - DNA, 20 bp, Artificial Sequence
  Description of Artificial Sequence: Synthetic oligonucleotide
  Target: SCN10A; (-) strand; PAM type: NRG; PAM sequence: GAG
gcttccaagcctcgtccact

SEQ ID NO: 17709 - DNA, 20 bp, Artificial Sequence
  Description of Artificial Sequence: Synthetic oligonucleotide
  Target: SCN10A; (-) strand; PAM type: NRG; PAM sequence: AAG
atggtggaaaatatgcttcc

SEQ ID NO: 17710 - DNA, 20 bp, Artificial Sequence
  Description of Artificial Sequence: Synthetic oligonucleotide
  Target: SCN10A; (-) strand; PAM type: NRG; PAM sequence: TGG
ggggggctcctcctttatgg

SEQ ID NO: 17711 - DNA, 20 bp, Artificial Sequence
  Description of Artificial Sequence: Synthetic oligonucleotide
  Target: SCN10A; (-) strand; PAM type: NRG; PAM sequence: TGG
agcggggggctcctccttta

SEQ ID NO: 17712 - DNA, 20 bp, Artificial Sequence
  Description of Artificial Sequence: Synthetic oligonucleotide
  Target: SCN10A; (-) strand; PAM type: NRG; PAM sequence: GGG
atgtccctctgctcagcggg

SEQ ID NO: 17713 - DNA, 20 bp, Artificial Sequence
  Description of Artificial Sequence: Synthetic oligonucleotide
  Target: SCN10A; (-) strand; PAM type: NRG; PAM sequence: GGG
aatgtccctctgctcagcgg

SEQ ID NO: 17714 - DNA, 20 bp, Artificial Sequence
  Description of Artificial Sequence: Synthetic oligonucleotide
  Target: SCN10A; (-) strand; PAM type: NRG; PAM sequence: GGG
aaatgtccctctgctcagcg

SEQ ID NO: 17715 - DNA, 20 bp, Artificial Sequence
  Description of Artificial Sequence: Synthetic oligonucleotide
  Target: SCN10A; (-) strand; PAM type: NRG; PAM sequence: GGG
taaatgtccctctgctcagc

SEQ ID NO: 17716 - DNA, 20 bp, Artificial Sequence
  Description of Artificial Sequence: Synthetic oligonucleotide
  Target: SCN10A; (-) strand; PAM type: NRG; PAM sequence: CGG
ctaaatgtccctctgctcag

SEQ ID NO: 17717 - DNA, 20 bp, Artificial Sequence
  Description of Artificial Sequence: Synthetic oligonucleotide
  Target: SCN10A; (-) strand; PAM type: NRG; PAM sequence: CAG
tccctaaatgtccctctgct

SEQ ID NO: 17718 - DNA, 20 bp, Artificial Sequence
  Description of Artificial Sequence: Synthetic oligonucleotide
  Target: SCN10A; (-) strand; PAM type: NRG; PAM sequence: TGG
agggtggttgcaggaagggc

SEQ ID NO: 17719 - DNA, 20 bp, Artificial Sequence
  Description of Artificial Sequence: Synthetic oligonucleotide
  Target: SCN10A; (-) strand; PAM type: NRG; PAM sequence: GGG
catgagggtggttgcaggaa

SEQ ID NO: 17720 - DNA, 20 bp, Artificial Sequence
  Description of Artificial Sequence: Synthetic oligonucleotide
  Target: SCN10A; (-) strand; PAM type: NRG; PAM sequence: AGG
acatgagggtggttgcagga

SEQ ID NO: 17721 - DNA, 20 bp, Artificial Sequence
  Description of Artificial Sequence: Synthetic oligonucleotide
  Target: SCN10A; (-) strand; PAM type: NRG; PAM sequence: AAG
cacatgagggtggttgcagg

SEQ ID NO: 17722 - DNA, 20 bp, Artificial Sequence
  Description of Artificial Sequence: Synthetic oligonucleotide
  Target: SCN10A; (-) strand; PAM type: NRG; PAM sequence: AGG
tggcacatgagggtggttgc

SEQ ID NO: 17723 - DNA, 20 bp, Artificial Sequence
  Description of Artificial Sequence: Synthetic oligonucleotide
  Target: SCN10A; (-) strand; PAM type: NRG; PAM sequence: CAG
ttggcacatgagggtggttg

SEQ ID NO: 17724 - DNA, 20 bp, Artificial Sequence
  Description of Artificial Sequence: Synthetic oligonucleotide
  Target: SCN10A; (-) strand; PAM type: NRG; PAM sequence: TGG
agggctttggcacatgaggg

SEQ ID NO: 17725 - DNA, 20 bp, Artificial Sequence
  Description of Artificial Sequence: Synthetic oligonucleotide
  Target: SCN10A; (-) strand; PAM type: NRG; PAM sequence: GGG
cccagggctttggcacatga

SEQ ID NO: 17726 - DNA, 20 bp, Artificial Sequence
  Description of Artificial Sequence: Synthetic oligonucleotide
  Target: SCN10A; (-) strand; PAM type: NRG; PAM sequence: AGG
gcccagggctttggcacatg

SEQ ID NO: 17727 - DNA, 20 bp, Artificial Sequence
  Description of Artificial Sequence: Synthetic oligonucleotide
  Target: SCN10A; (-) strand; PAM type: NRG; PAM sequence: GAG
agcccagggctttggcacat

SEQ ID NO: 17728 - DNA, 20 bp, Artificial Sequence
  Description of Artificial Sequence: Synthetic oligonucleotide
  Target: SCN10A; (-) strand; PAM type: NRG; PAM sequence: TGG
aggaacagagcccagggctt

SEQ ID NO: 17729 - DNA, 20 bp, Artificial Sequence
  Description of Artificial Sequence: Synthetic oligonucleotide
  Target: SCN10A; (-) strand; PAM type: NRG; PAM sequence: GGG
agagtcaggaacagagccca

SEQ ID NO: 17730 - DNA, 20 bp, Artificial Sequence
  Description of Artificial Sequence: Synthetic oligonucleotide
  Target: SCN10A; (-) strand; PAM type: NRG; PAM sequence: AGG
cagagtcaggaacagagccc

SEQ ID NO: 17731 - DNA, 20 bp, Artificial Sequence
  Description of Artificial Sequence: Synthetic oligonucleotide
  Target: SCN10A; (-) strand; PAM type: NRG; PAM sequence: CAG
ccagagtcaggaacagagcc

SEQ ID NO: 17732 - DNA, 20 bp, Artificial Sequence
  Description of Artificial Sequence: Synthetic oligonucleotide
  Target: SCN10A; (-) strand; PAM type: NRG; PAM sequence: GAG
ggattccagagtcaggaaca

SEQ ID NO: 17733 - DNA, 20 bp, Artificial Sequence
  Description of Artificial Sequence: Synthetic oligonucleotide
  Target: SCN10A; (-) strand; PAM type: NRG; PAM sequence: CAG
caggattccagagtcaggaa

SEQ ID NO: 17734 - DNA, 20 bp, Artificial Sequence
  Description of Artificial Sequence: Synthetic oligonucleotide
  Target: SCN10A; (-) strand; PAM type: NRG; PAM sequence: AGG
gtgcccaggattccagagtc

SEQ ID NO: 17735 - DNA, 20 bp, Artificial Sequence
  Description of Artificial Sequence: Synthetic oligonucleotide
  Target: SCN10A; (-) strand; PAM type: NRG; PAM sequence: CAG
tgtgcccaggattccagagt

SEQ ID NO: 17736 - DNA, 20 bp, Artificial Sequence
  Description of Artificial Sequence: Synthetic oligonucleotide
  Target: SCN10A; (-) strand; PAM type: NRG; PAM sequence: GAG
aagatgtgcccaggattcca

SEQ ID NO: 17737 - DNA, 20 bp, Artificial Sequence
  Description of Artificial Sequence: Synthetic oligonucleotide
  Target: SCN10A; (-) strand; PAM type: NRG; PAM sequence: CAG
gcaagatgtgcccaggattc

SEQ ID NO: 17738 - DNA, 20 bp, Artificial Sequence
  Description of Artificial Sequence: Synthetic oligonucleotide
  Target: SCN10A; (-) strand; PAM type: NRG; PAM sequence: AGG
ggaagcagcaagatgtgccc

SEQ ID NO: 17739 - DNA, 20 bp, Artificial Sequence
  Description of Artificial Sequence: Synthetic oligonucleotide
  Target: SCN10A; (-) strand; PAM type: NRG; PAM sequence: CAG
tggaagcagcaagatgtgcc

SEQ ID NO: 17740 - DNA, 20 bp, Artificial Sequence
  Description of Artificial Sequence: Synthetic oligonucleotide
  Target: SCN10A; (-) strand; PAM type: NRG; PAM sequence: AAG
agtgaagaactggaagcagc

SEQ ID NO: 17741 - DNA, 20 bp, Artificial Sequence
  Description of Artificial Sequence: Synthetic oligonucleotide
  Target: SCN10A; (-) strand; PAM type: NRG; PAM sequence: CAG
ctcaagtgaagaactggaag

SEQ ID NO: 17742 - DNA, 20 bp, Artificial Sequence
  Description of Artificial Sequence: Synthetic oligonucleotide
  Target: SCN10A; (-) strand; PAM type: NRG; PAM sequence: AAG
gctctcaagtgaagaactgg

SEQ ID NO: 17743 - DNA, 20 bp, Artificial Sequence
  Description of Artificial Sequence: Synthetic oligonucleotide
  Target: SCN10A; (-) strand; PAM type: NRG; PAM sequence: TGG
tctgctctcaagtgaagaac

SEQ ID NO: 17744 - DNA, 20 bp, Artificial Sequence
  Description of Artificial Sequence: Synthetic oligonucleotide
  Target: SCN10A; (-) strand; PAM type: NRG; PAM sequence: AAG
tcttcatctgctctcaagtg

SEQ ID NO: 17745 - DNA, 20 bp, Artificial Sequence
  Description of Artificial Sequence: Synthetic oligonucleotide
  Target: SCN10A; (-) strand; PAM type: NRG; PAM sequence: AAG
accgctcttcatctgctctc

SEQ ID NO: 17746 - DNA, 20 bp, Artificial Sequence
  Description of Artificial Sequence: Synthetic oligonucleotide
  Target: SCN10A; (-) strand; PAM type: NRG; PAM sequence: GAG
gacaggaagtttacccctct

SEQ ID NO: 17747 - DNA, 20 bp, Artificial Sequence
  Description of Artificial Sequence: Synthetic oligonucleotide
  Target: SCN10A; (-) strand; PAM type: NRG; PAM sequence: AAG
gcccctcaccctcagacagg

SEQ ID NO: 17748 - DNA, 20 bp, Artificial Sequence
  Description of Artificial Sequence: Synthetic oligonucleotide
  Target: SCN10A; (-) strand; PAM type: NRG; PAM sequence: AGG
gatgcccctcaccctcagac

SEQ ID NO: 17749 - DNA, 20 bp, Artificial Sequence
  Description of Artificial Sequence: Synthetic oligonucleotide
  Target: SCN10A; (-) strand; PAM type: NRG; PAM sequence: CAG
agatgcccctcaccctcaga

SEQ ID NO: 17750 - DNA, 20 bp, Artificial Sequence
  Description of Artificial Sequence: Synthetic oligonucleotide
  Target: SCN10A; (-) strand; PAM type: NRG; PAM sequence: CAG
ccacagatgcccctcaccct

SEQ ID NO: 17751 - DNA, 20 bp, Artificial Sequence
  Description of Artificial Sequence: Synthetic oligonucleotide
  Target: SCN10A; (-) strand; PAM type: NRG; PAM sequence: CAG
ccaccatccctgcagagcca

SEQ ID NO: 17752 - DNA, 20 bp, Artificial Sequence
  Description of Artificial Sequence: Synthetic oligonucleotide
  Target: SCN10A; (-) strand; PAM type: NRG; PAM sequence: GAG
ctgagcccaccatccctgca

SEQ ID NO: 17753 - DNA, 20 bp, Artificial Sequence
  Description of Artificial Sequence: Synthetic oligonucleotide
  Target: SCN10A; (-) strand; PAM type: NRG; PAM sequence: CAG
ggctgagcccaccatccctg

SEQ ID NO: 17754 - DNA, 20 bp, Artificial Sequence
  Description of Artificial Sequence: Synthetic oligonucleotide
  Target: SCN10A; (-) strand; PAM type: NRG; PAM sequence: GAG
aaactctgttcttccaggct

SEQ ID NO: 17755 - DNA, 20 bp, Artificial Sequence
  Description of Artificial Sequence: Synthetic oligonucleotide
  Target: SCN10A; (-) strand; PAM type: NRG; PAM sequence: AGG
cccagaaactctgttcttcc

SEQ ID NO: 17756 - DNA, 20 bp, Artificial Sequence
  Description of Artificial Sequence: Synthetic oligonucleotide
  Target: SCN10A; (-) strand; PAM type: NRG; PAM sequence: CAG
tcccagaaactctgttcttc

SEQ ID NO: 17757 - DNA, 20 bp, Artificial Sequence
  Description of Artificial Sequence: Synthetic oligonucleotide
  Target: SCN10A; (-) strand; PAM type: NRG; PAM sequence: CAG
ggatgcctctgcctgcatcc

SEQ ID NO: 17758 - DNA, 20 bp, Artificial Sequence
  Description of Artificial Sequence: Synthetic oligonucleotide
  Target: SCN10A; (-) strand; PAM type: NRG; PAM sequence: GGG
ccaccctggtgcctgagcca

SEQ ID NO: 17759 - DNA, 20 bp, Artificial Sequence
  Description of Artificial Sequence: Synthetic oligonucleotide
  Target: SCN10A; (-) strand; PAM type: NRG; PAM sequence: AGG
tccaccctggtgcctgagcc

SEQ ID NO: 17760 - DNA, 20 bp, Artificial Sequence
  Description of Artificial Sequence: Synthetic oligonucleotide
  Target: SCN10A; (-) strand; PAM type: NRG; PAM sequence: CAG
ttccaccctggtgcctgagc

SEQ ID NO: 17761 - DNA, 20 bp, Artificial Sequence
  Description of Artificial Sequence: Synthetic oligonucleotide
  Target: SCN10A; (-) strand; PAM type: NRG; PAM sequence: GAG
tcttttccaccctggtgcct

SEQ ID NO: 17762 - DNA, 20 bp, Artificial Sequence
  Description of Artificial Sequence: Synthetic oligonucleotide
  Target: SCN10A; (-) strand; PAM type: NRG; PAM sequence: TGG
ctctttagtcttttccaccc

SEQ ID NO: 17763 - DNA, 20 bp, Artificial Sequence
  Description of Artificial Sequence: Synthetic oligonucleotide
  Target: SCN10A; (-) strand; PAM type: NRG; PAM sequence: TAG
aacaacaaatccagactctt

SEQ ID NO: 17764 - DNA, 20 bp, Artificial Sequence
  Description of Artificial Sequence: Synthetic oligonucleotide
  Target: SCN10A; (-) strand; PAM type: NRG; PAM sequence: CAG
aagggaagcaacaacaaatc

SEQ ID NO: 17765 - DNA, 20 bp, Artificial Sequence
  Description of Artificial Sequence: Synthetic oligonucleotide
  Target: SCN10A; (-) strand; PAM type: NRG; PAM sequence: AAG
aagctaaaccaagaaaaggg

SEQ ID NO: 17766 - DNA, 20 bp, Artificial Sequence
  Description of Artificial Sequence: Synthetic oligonucleotide
  Target: SCN10A; (-) strand; PAM type: NRG; PAM sequence: GGG
agaaagctaaaccaagaaaa

SEQ ID NO: 17767 - DNA, 20 bp, Artificial Sequence
  Description of Artificial Sequence: Synthetic oligonucleotide
  Target: SCN10A; (-) strand; PAM type: NRG; PAM sequence: AGG
aagaaagctaaaccaagaaa

SEQ ID NO: 17768 - DNA, 20 bp, Artificial Sequence
  Description of Artificial Sequence: Synthetic oligonucleotide
  Target: SCN10A; (-) strand; PAM type: NRG; PAM sequence: AAG
gaagaaagctaaaccaagaa

SEQ ID NO: 17769 - DNA, 20 bp, Artificial Sequence
  Description of Artificial Sequence: Synthetic oligonucleotide
  Target: SCN10A; (-) strand; PAM type: NRG; PAM sequence: AAG
agacagaagaaagctaaacc

SEQ ID NO: 17770 - DNA, 20 bp, Artificial Sequence
  Description of Artificial Sequence: Synthetic oligonucleotide
  Target: SCN10A; (-) strand; PAM type: NRG; PAM sequence: AAG
tgagttttatagacagaaga

SEQ ID NO: 17771 - DNA, 20 bp, Artificial Sequence
  Description of Artificial Sequence: Synthetic oligonucleotide
  Target: SCN10A; (-) strand; PAM type: NRG; PAM sequence: AAG
ctcatgagttttatagacag

SEQ ID NO: 17772 - DNA, 20 bp, Artificial Sequence
  Description of Artificial Sequence: Synthetic oligonucleotide
  Target: SCN10A; (-) strand; PAM type: NRG; PAM sequence: CAG
ttcctcatgagttttataga

SEQ ID NO: 17773 - DNA, 20 bp, Artificial Sequence
  Description of Artificial Sequence: Synthetic oligonucleotide
  Target: SCN10A; (-) strand; PAM type: NRG; PAM sequence: TAG
ttctttcctcatgagtttta

SEQ ID NO: 17774 - DNA, 20 bp, Artificial Sequence
  Description of Artificial Sequence: Synthetic oligonucleotide
  Target: SCN10A; (-) strand; PAM type: NRG; PAM sequence: GAG
aacttgggttctttcctcat

SEQ ID NO: 17775 - DNA, 20 bp, Artificial Sequence
  Description of Artificial Sequence: Synthetic oligonucleotide
  Target: SCN10A; (-) strand; PAM type: NRG; PAM sequence: GGG
ccctggacatcaaccaactt

SEQ ID NO: 17776 - DNA, 20 bp, Artificial Sequence
  Description of Artificial Sequence: Synthetic oligonucleotide
  Target: SCN10A; (-) strand; PAM type: NRG; PAM sequence: TGG
gccctggacatcaaccaact

SEQ ID NO: 17777 - DNA, 20 bp, Artificial Sequence
  Description of Artificial Sequence: Synthetic oligonucleotide
  Target: SCN10A; (-) strand; PAM type: NRG; PAM sequence: TGG
aagcccctttcttattgccc

SEQ ID NO: 17778 - DNA, 20 bp, Artificial Sequence
  Description of Artificial Sequence: Synthetic oligonucleotide
  Target: SCN10A; (-) strand; PAM type: NRG; PAM sequence: AAG
gggaggatgcagtcttccag

SEQ ID NO: 17779 - DNA, 20 bp, Artificial Sequence
  Description of Artificial Sequence: Synthetic oligonucleotide
  Target: SCN10A; (-) strand; PAM type: NRG; PAM sequence: CAG
tgtgggaggatgcagtcttc

SEQ ID NO: 17780 - DNA, 20 bp, Artificial Sequence
  Description of Artificial Sequence: Synthetic oligonucleotide
  Target: SCN10A; (-) strand; PAM type: NRG; PAM sequence: CAG
actggttgtgtgggaggatg

SEQ ID NO: 17781 - DNA, 20 bp, Artificial Sequence
  Description of Artificial Sequence: Synthetic oligonucleotide
  Target: SCN10A; (-) strand; PAM type: NRG; PAM sequence: AGG
ggactgactggttgtgtggg

SEQ ID NO: 17782 - DNA, 20 bp, Artificial Sequence
  Description of Artificial Sequence: Synthetic oligonucleotide
  Target: SCN10A; (-) strand; PAM type: NRG; PAM sequence: GAG
gggactgactggttgtgtgg

SEQ ID NO: 17783 - DNA, 20 bp, Artificial Sequence
  Description of Artificial Sequence: Synthetic oligonucleotide
  Target: SCN10A; (-) strand; PAM type: NRG; PAM sequence: GGG
ctgggactgactggttgtgt

SEQ ID NO: 17784 - DNA, 20 bp, Artificial Sequence
  Description of Artificial Sequence: Synthetic oligonucleotide
  Target: SCN10A; (-) strand; PAM type: NRG; PAM sequence: TGG
cctgggactgactggttgtg

SEQ ID NO: 17785 - DNA, 20 bp, Artificial Sequence
  Description of Artificial Sequence: Synthetic oligonucleotide
  Target: SCN10A; (-) strand; PAM type: NRG; PAM sequence: TGG
cttgccctcctgggactgac

SEQ ID NO: 17786 - DNA, 20 bp, Artificial Sequence
  Description of Artificial Sequence: Synthetic oligonucleotide
  Target: SCN10A; (-) strand; PAM type: NRG; PAM sequence: GGG
ggtggggtccttgccctcct

SEQ ID NO: 17787 - DNA, 20 bp, Artificial Sequence
  Description of Artificial Sequence: Synthetic oligonucleotide
  Target: SCN10A; (-) strand; PAM type: NRG; PAM sequence: TGG
tggtggggtccttgccctcc

SEQ ID NO: 17788 - DNA, 20 bp, Artificial Sequence
  Description of Artificial Sequence: Synthetic oligonucleotide
  Target: SCN10A; (-) strand; PAM type: NRG; PAM sequence: GGG
cacccactctggtcatggtg

SEQ ID NO: 17789 - DNA, 20 bp, Artificial Sequence
  Description of Artificial Sequence: Synthetic oligonucleotide
  Target: SCN10A; (-) strand; PAM type: NRG; PAM sequence: GGG
ccacccactctggtcatggt

SEQ ID NO: 17790 - DNA, 20 bp, Artificial Sequence
  Description of Artificial Sequence: Synthetic oligonucleotide
  Target: SCN10A; (-) strand; PAM type: NRG; PAM sequence: TGG
tccacccactctggtcatgg

SEQ ID NO: 17791 - DNA, 20 bp, Artificial Sequence
  Description of Artificial Sequence: Synthetic oligonucleotide
  Target: SCN10A; (-) strand; PAM type: NRG; PAM sequence: TGG
gtctccacccactctggtca

SEQ ID NO: 17792 - DNA, 20 bp, Artificial Sequence
  Description of Artificial Sequence: Synthetic oligonucleotide
  Target: SCN10A; (-) strand; PAM type: NRG; PAM sequence: TGG
cagcttgtctccacccactc

SEQ ID NO: 17793 - DNA, 20 bp, Artificial Sequence
  Description of Artificial Sequence: Synthetic oligonucleotide
  Target: SCN10A; (-) strand; PAM type: NRG; PAM sequence: CAG
ccagcctggccccctgccct

SEQ ID NO: 17794 - DNA, 20 bp, Artificial Sequence
  Description of Artificial Sequence: Synthetic oligonucleotide
  Target: SCN10A; (-) strand; PAM type: NRG; PAM sequence: TGG
accccttctccgccccagcc

SEQ ID NO: 17795 - DNA, 20 bp, Artificial Sequence
  Description of Artificial Sequence: Synthetic oligonucleotide
  Target: SCN10A; (-) strand; PAM type: NRG; PAM sequence: CAG
ccaataccccttctccgccc

SEQ ID NO: 17796 - DNA, 20 bp, Artificial Sequence
  Description of Artificial Sequence: Synthetic oligonucleotide
  Target: SCN10A; (-) strand; PAM type: NRG; PAM sequence: AAG
ctggagactcacttgccaat

SEQ ID NO: 17797 - DNA, 20 bp, Artificial Sequence
  Description of Artificial Sequence: Synthetic oligonucleotide
  Target: SCN10A; (-) strand; PAM type: NRG; PAM sequence: GAG
gtttggaggaagcccctctg

SEQ ID NO: 17798 - DNA, 20 bp, Artificial Sequence
  Description of Artificial Sequence: Synthetic oligonucleotide
  Target: SCN10A; (-) strand; PAM type: NRG; PAM sequence: TGG
atgtttggaggaagcccctc

SEQ ID NO: 17799 - DNA, 20 bp, Artificial Sequence
  Description of Artificial Sequence: Synthetic oligonucleotide
  Target: SCN10A; (-) strand; PAM type: NRG; PAM sequence: AAG
atctactccatgtttggagg

SEQ ID NO: 17800 - DNA, 20 bp, Artificial Sequence
  Description of Artificial Sequence: Synthetic oligonucleotide
  Target: SCN10A; (-) strand; PAM type: NRG; PAM sequence: AGG
aaaatctactccatgtttgg

SEQ ID NO: 17801 - DNA, 20 bp, Artificial Sequence
  Description of Artificial Sequence: Synthetic oligonucleotide
  Target: SCN10A; (-) strand; PAM type: NRG; PAM sequence: GAG
caaaatctactccatgtttg

SEQ ID NO: 17802 - DNA, 20 bp, Artificial Sequence
  Description of Artificial Sequence: Synthetic oligonucleotide
  Target: SCN10A; (-) strand; PAM type: NRG; PAM sequence: TGG
aacaaaatctactccatgtt

SEQ ID NO: 17803 - DNA, 20 bp, Artificial Sequence
  Description of Artificial Sequence: Synthetic oligonucleotide
  Target: SCN10A; (-) strand; PAM type: NRG; PAM sequence: CAG
acggacaacatccaaggcca

SEQ ID NO: 17804 - DNA, 20 bp, Artificial Sequence
  Description of Artificial Sequence: Synthetic oligonucleotide
  Target: SCN10A; (-) strand; PAM type: NRG; PAM sequence: AGG
tgggtcacggacaacatcca

SEQ ID NO: 17805 - DNA, 20 bp, Artificial Sequence
  Description of Artificial Sequence: Synthetic oligonucleotide
  Target: SCN10A; (-) strand; PAM type: NRG; PAM sequence: AAG
atgggtcacggacaacatcc

SEQ ID NO: 17806 - DNA, 20 bp, Artificial Sequence
  Description of Artificial Sequence: Synthetic oligonucleotide
  Target: SCN10A; (-) strand; PAM type: NRG; PAM sequence: CGG
ggagggggcacaatgggtca

SEQ ID NO: 17807 - DNA, 20 bp, Artificial Sequence
  Description of Artificial Sequence: Synthetic oligonucleotide
  Target: SCN10A; (-) strand; PAM type: NRG; PAM sequence: GGG
ctgcagggagggggcacaat

SEQ ID NO: 17808 - DNA, 20 bp, Artificial Sequence
  Description of Artificial Sequence: Synthetic oligonucleotide
  Target: SCN10A; (-) strand; PAM type: NRG; PAM sequence: TGG
gctgcagggagggggcacaa

SEQ ID NO: 17809 - DNA, 20 bp, Artificial Sequence
  Description of Artificial Sequence: Synthetic oligonucleotide
  Target: SCN10A; (-) strand; PAM type: NRG; PAM sequence: GGG
ggggagaggctgcagggagg

SEQ ID NO: 17810 - DNA, 20 bp, Artificial Sequence
  Description of Artificial Sequence: Synthetic oligonucleotide
  Target: SCN10A; (-) strand; PAM type: NRG; PAM sequence: GGG
gggggagaggctgcagggag

SEQ ID NO: 17811 - DNA, 20 bp, Artificial Sequence
  Description of Artificial Sequence: Synthetic oligonucleotide
  Target: SCN10A; (-) strand; PAM type: NRG; PAM sequence: GGG
agggggagaggctgcaggga

SEQ ID NO: 17812 - DNA, 20 bp, Artificial Sequence
  Description of Artificial Sequence: Synthetic oligonucleotide
  Target: SCN10A; (-) strand; PAM type: NRG; PAM sequence: AGG
cagggggagaggctgcaggg

SEQ ID NO: 17813 - DNA, 20 bp, Artificial Sequence
  Description of Artificial Sequence: Synthetic oligonucleotide
  Target: SCN10A; (-) strand; PAM type: NRG; PAM sequence: GAG
gcagggggagaggctgcagg

SEQ ID NO: 17814 - DNA, 20 bp, Artificial Sequence
  Description of Artificial Sequence: Synthetic oligonucleotide
  Target: SCN10A; (-) strand; PAM type: NRG; PAM sequence: GGG
gagcagggggagaggctgca

SEQ ID NO: 17815 - DNA, 20 bp, Artificial Sequence
  Description of Artificial Sequence: Synthetic oligonucleotide
  Target: SCN10A; (-) strand; PAM type: NRG; PAM sequence: AGG
ggagcagggggagaggctgc

SEQ ID NO: 17816 - DNA, 20 bp, Artificial Sequence
  Description of Artificial Sequence: Synthetic oligonucleotide
  Target: SCN10A; (-) strand; PAM type: NRG; PAM sequence: CAG
gggagcagggggagaggctg

SEQ ID NO: 17817 - DNA, 20 bp, Artificial Sequence
  Description of Artificial Sequence: Synthetic oligonucleotide
  Target: SCN10A; (-) strand; PAM type: NRG; PAM sequence: AGG
ctagctgggagcagggggag

SEQ ID NO: 17818 - DNA, 20 bp, Artificial Sequence
  Description of Artificial Sequence: Synthetic oligonucleotide
  Target: SCN10A; (-) strand; PAM type: NRG; PAM sequence: GAG
cctagctgggagcaggggga

SEQ ID NO: 17819 - DNA, 20 bp, Artificial Sequence
  Description of Artificial Sequence: Synthetic oligonucleotide
  Target: SCN10A; (-) strand; PAM type: NRG; PAM sequence: GAG
gtcctagctgggagcagggg

SEQ ID NO: 17820 - DNA, 20 bp, Artificial Sequence
  Description of Artificial Sequence: Synthetic oligonucleotide
  Target: SCN10A; (-) strand; PAM type: NRG; PAM sequence: GGG
aggtcctagctgggagcagg

SEQ ID NO: 17821 - DNA, 20 bp, Artificial Sequence
  Description of Artificial Sequence: Synthetic oligonucleotide
  Target: SCN10A; (-) strand; PAM type: NRG; PAM sequence: GGG
caggtcctagctgggagcag

SEQ ID NO: 17822 - DNA, 20 bp, Artificial Sequence
  Description of Artificial Sequence: Synthetic oligonucleotide
  Target: SCN10A; (-) strand; PAM type: NRG; PAM sequence: GGG
acaggtcctagctgggagca

SEQ ID NO: 17823 - DNA, 20 bp, Artificial Sequence
  Description of Artificial Sequence: Synthetic oligonucleotide
  Target: SCN10A; (-) strand; PAM type: NRG; PAM sequence: AGG
cacaggtcctagctgggagc

SEQ ID NO: 17824 - DNA, 20 bp, Artificial Sequence
  Description of Artificial Sequence: Synthetic oligonucleotide
  Target: SCN10A; (-) strand; PAM type: NRG; PAM sequence: CAG
gcacaggtcctagctgggag

SEQ ID NO: 17825 - DNA, 20 bp, Artificial Sequence
  Description of Artificial Sequence: Synthetic oligonucleotide
  Target: SCN10A; (-) strand; PAM type: NRG; PAM sequence: GAG
gctgcacaggtcctagctgg

SEQ ID NO: 17826 - DNA, 20 bp, Artificial Sequence
  Description of Artificial Sequence: Synthetic oligonucleotide
  Target: SCN10A; (-) strand; PAM type: NRG; PAM sequence: GGG
aagctgcacaggtcctagct

SEQ ID NO: 17827 - DNA, 20 bp, Artificial Sequence
  Description of Artificial Sequence: Synthetic oligonucleotide
  Target: SCN10A; (-) strand; PAM type: NRG; PAM sequence: TGG
caagctgcacaggtcctagc

SEQ ID NO: 17828 - DNA, 20 bp, Artificial Sequence
  Description of Artificial Sequence: Synthetic oligonucleotide
  Target: SCN10A; (-) strand; PAM type: NRG; PAM sequence: TAG
tctccaagctgcacaggtcc

SEQ ID NO: 17829 - DNA, 20 bp, Artificial Sequence
  Description of Artificial Sequence: Synthetic oligonucleotide
  Target: SCN10A; (-) strand; PAM type: NRG; PAM sequence: AGG
ctgatttctccaagctgcac

SEQ ID NO: 17830 - DNA, 20 bp, Artificial Sequence
  Description of Artificial Sequence: Synthetic oligonucleotide
  Target: SCN10A; (-) strand; PAM type: NRG; PAM sequence: CAG
actgatttctccaagctgca

SEQ ID NO: 17831 - DNA, 20 bp, Artificial Sequence
  Description of Artificial Sequence: Synthetic oligonucleotide
  Target: SCN10A; (-) strand; PAM type: NRG; PAM sequence: AAG
aagagctgactgatttctcc

SEQ ID NO: 17832 - DNA, 20 bp, Artificial Sequence
  Description of Artificial Sequence: Synthetic oligonucleotide
  Target: SCN10A; (-) strand; PAM type: NRG; PAM sequence: GAG
atttttattcagggaagtaa

SEQ ID NO: 17833 - DNA, 20 bp, Artificial Sequence
  Description of Artificial Sequence: Synthetic oligonucleotide
  Target: SCN10A; (-) strand; PAM type: NRG; PAM sequence: AAG
acatttttattcagggaagt

SEQ ID NO: 17834 - DNA, 20 bp, Artificial Sequence
  Description of Artificial Sequence: Synthetic oligonucleotide
  Target: SCN10A; (-) strand; PAM type: NRG; PAM sequence: AAG
gaaaacatttttattcaggg

SEQ ID NO: 17835 - DNA, 20 bp, Artificial Sequence
  Description of Artificial Sequence: Synthetic oligonucleotide
  Target: SCN10A; (-) strand; PAM type: NRG; PAM sequence: GGG
tcagaaaacatttttattca

SEQ ID NO: 17836 - DNA, 20 bp, Artificial Sequence
  Description of Artificial Sequence: Synthetic oligonucleotide
  Target: SCN10A; (-) strand; PAM type: NRG; PAM sequence: AGG
ctcagaaaacatttttattc

SEQ ID NO: 17837 - DNA, 20 bp, Artificial Sequence
  Description of Artificial Sequence: Synthetic oligonucleotide
  Target: SCN10A; (-) strand; PAM type: NRG; PAM sequence: CAG
gctcagaaaacatttttatt

SEQ ID NO: 17838 - DNA, 20 bp, Artificial Sequence
  Description of Artificial Sequence: Synthetic oligonucleotide
  Target: SCN10A; (-) strand; PAM type: NRG; PAM sequence: CAG
ttccccaatctgagggggct

SEQ ID NO: 17839 - DNA, 20 bp, Artificial Sequence
  Description of Artificial Sequence: Synthetic oligonucleotide
  Target: SCN10A; (-) strand; PAM type: NRG; PAM sequence: GGG
tgtccttccccaatctgagg

SEQ ID NO: 17840 - DNA, 20 bp, Artificial Sequence
  Description of Artificial Sequence: Synthetic oligonucleotide
  Target: SCN10A; (-) strand; PAM type: NRG; PAM sequence: GGG
atgtccttccccaatctgag

SEQ ID NO: 17841 - DNA, 20 bp, Artificial Sequence
  Description of Artificial Sequence: Synthetic oligonucleotide
  Target: SCN10A; (-) strand; PAM type: NRG; PAM sequence: GGG
aatgtccttccccaatctga

SEQ ID NO: 17842 - DNA, 20 bp, Artificial Sequence
  Description of Artificial Sequence: Synthetic oligonucleotide
  Target: SCN10A; (-) strand; PAM type: NRG; PAM sequence: AGG
aaatgtccttccccaatctg

SEQ ID NO: 17843 - DNA, 20 bp, Artificial Sequence
  Description of Artificial Sequence: Synthetic oligonucleotide
  Target: SCN10A; (-) strand; PAM type: NRG; PAM sequence: GAG
aaaatgtccttccccaatct

SEQ ID NO: 17844 - DNA, 20 bp, Artificial Sequence
  Description of Artificial Sequence: Synthetic oligonucleotide
  Target: SCN10A; (-) strand; PAM type: NRG; PAM sequence: AGG
cggtgtctattagctgttaa

SEQ ID NO: 17845 - DNA, 20 bp, Artificial Sequence
  Description of Artificial Sequence: Synthetic oligonucleotide
  Target: SCN10A; (-) strand; PAM type: NRG; PAM sequence: AAG
acggtgtctattagctgtta

SEQ ID NO: 17846 - DNA, 20 bp, Artificial Sequence
  Description of Artificial Sequence: Synthetic oligonucleotide
  Target: SCN10A; (-) strand; PAM type: NRG; PAM sequence: TAG
actcaataaacggtgtctat

SEQ ID NO: 17847 - DNA, 20 bp, Artificial Sequence
  Description of Artificial Sequence: Synthetic oligonucleotide
  Target: SCN10A; (-) strand; PAM type: NRG; PAM sequence: CGG
tgaggcaggaactcaataaa

SEQ ID NO: 17848 - DNA, 20 bp, Artificial Sequence
  Description of Artificial Sequence: Synthetic oligonucleotide
  Target: SCN10A; (-) strand; PAM type: NRG; PAM sequence: AGG
tgcaatgtctgggctgaggc

SEQ ID NO: 17849 - DNA, 20 bp, Artificial Sequence
  Description of Artificial Sequence: Synthetic oligonucleotide
  Target: SCN10A; (-) strand; PAM type: NRG; PAM sequence: CAG
atgcaatgtctgggctgagg

SEQ ID NO: 17850 - DNA, 20 bp, Artificial Sequence
  Description of Artificial Sequence: Synthetic oligonucleotide
  Target: SCN10A; (-) strand; PAM type: NRG; PAM sequence: AGG
ctaatgcaatgtctgggctg

SEQ ID NO: 17851 - DNA, 20 bp, Artificial Sequence
  Description of Artificial Sequence: Synthetic oligonucleotide
  Target: SCN10A; (-) strand; PAM type: NRG; PAM sequence: GAG
cctaatgcaatgtctgggct

SEQ ID NO: 17852 - DNA, 20 bp, Artificial Sequence
  Description of Artificial Sequence: Synthetic oligonucleotide
  Target: SCN10A; (-) strand; PAM type: NRG; PAM sequence: GGG
aattgcctaatgcaatgtct

SEQ ID NO: 17853 - DNA, 20 bp, Artificial Sequence
  Description of Artificial Sequence: Synthetic oligonucleotide
  Target: SCN10A; (-) strand; PAM type: NRG; PAM sequence: TGG
aaattgcctaatgcaatgtc

SEQ ID NO: 17854 - DNA, 20 bp, Artificial Sequence
  Description of Artificial Sequence: Synthetic oligonucleotide
  Target: SCN10A; (-) strand; PAM type: NRG; PAM sequence: GAG
ctgggagaattaaatgacag

SEQ ID NO: 17855 - DNA, 20 bp, Artificial Sequence
  Description of Artificial Sequence: Synthetic oligonucleotide
  Target: SCN10A; (-) strand; PAM type: NRG; PAM sequence: AGG
tactgggagaattaaatgac

SEQ ID NO: 17856 - DNA, 20 bp, Artificial Sequence
  Description of Artificial Sequence: Synthetic oligonucleotide
  Target: SCN10A; (-) strand; PAM type: NRG; PAM sequence: CAG
ttactgggagaattaaatga

SEQ ID NO: 17857 - DNA, 20 bp, Artificial Sequence
  Description of Artificial Sequence: Synthetic oligonucleotide
  Target: SCN10A; (-) strand; PAM type: NRG; PAM sequence: GAG
cttactcatgggtttactgg

SEQ ID NO: 17858 - DNA, 20 bp, Artificial Sequence
  Description of Artificial Sequence: Synthetic oligonucleotide
  Target: SCN10A; (-) strand; PAM type: NRG; PAM sequence: GGG
tgcttactcatgggtttact

SEQ ID NO: 17859 - DNA, 20 bp, Artificial Sequence
  Description of Artificial Sequence: Synthetic oligonucleotide
  Target: SCN10A; (-) strand; PAM type: NRG; PAM sequence: TGG
atgcttactcatgggtttac

SEQ ID NO: 17860 - DNA, 20 bp, Artificial Sequence
  Description of Artificial Sequence: Synthetic oligonucleotide
  Target: SCN10A; (-) strand; PAM type: NRG; PAM sequence: GGG
agaaaataatgcttactcat

SEQ ID NO: 17861 - DNA, 20 bp, Artificial Sequence
  Description of Artificial Sequence: Synthetic oligonucleotide
  Target: SCN10A; (-) strand; PAM type: NRG; PAM sequence: TGG
aagaaaataatgcttactca

SEQ ID NO: 17862 - DNA, 20 bp, Artificial Sequence
  Description of Artificial Sequence: Synthetic oligonucleotide
  Target: SCN10A; (-) strand; PAM type: NRG; PAM sequence: AAG
gatctaatttccttaaaatc

SEQ ID NO: 17863 - DNA, 20 bp, Artificial Sequence
  Description of Artificial Sequence: Synthetic oligonucleotide
  Target: SCN10A; (-) strand; PAM type: NRG; PAM sequence: AAG
gcaagagacttaatctcctc

SEQ ID NO: 17864 - DNA, 20 bp, Artificial Sequence
  Description of Artificial Sequence: Synthetic oligonucleotide
  Target: SCN10A; (-) strand; PAM type: NRG; PAM sequence: GAG
aggtgggtgaccccaggcaa

SEQ ID NO: 17865 - DNA, 20 bp, Artificial Sequence
  Description of Artificial Sequence: Synthetic oligonucleotide
  Target: SCN10A; (-) strand; PAM type: NRG; PAM sequence: AAG
ctaggtgggtgaccccaggc

SEQ ID NO: 17866 - DNA, 20 bp, Artificial Sequence
  Description of Artificial Sequence: Synthetic oligonucleotide
  Target: SCN10A; (-) strand; PAM type: NRG; PAM sequence: AGG
tttactaggtgggtgacccc

SEQ ID NO: 17867 - DNA, 20 bp, Artificial Sequence
  Description of Artificial Sequence: Synthetic oligonucleotide
  Target: SCN10A; (-) strand; PAM type: NRG; PAM sequence: CAG
atttactaggtgggtgaccc

SEQ ID NO: 17868 - DNA, 20 bp, Artificial Sequence
  Description of Artificial Sequence: Synthetic oligonucleotide
  Target: SCN10A; (-) strand; PAM type: NRG; PAM sequence: GGG
tgctccaccatttactaggt

SEQ ID NO: 17869 - DNA, 20 bp, Artificial Sequence
  Description of Artificial Sequence: Synthetic oligonucleotide
  Target: SCN10A; (-) strand; PAM type: NRG; PAM sequence: TGG
ctgctccaccatttactagg

SEQ ID NO: 17870 - DNA, 20 bp, Artificial Sequence
  Description of Artificial Sequence: Synthetic oligonucleotide
  Target: SCN10A; (-) strand; PAM type: NRG; PAM sequence: AGG
tctctgctccaccatttact

SEQ ID NO: 17871 - DNA, 20 bp, Artificial Sequence
  Description of Artificial Sequence: Synthetic oligonucleotide
  Target: SCN10A; (-) strand; PAM type: NRG; PAM sequence: TAG
atctctgctccaccatttac

SEQ ID NO: 17872 - DNA, 20 bp, Artificial Sequence
  Description of Artificial Sequence: Synthetic oligonucleotide
  Target: SCN10A; (-) strand; PAM type: NRG; PAM sequence: TAG
tagaaaagaaagacctggtg

SEQ ID NO: 17873 - DNA, 20 bp, Artificial Sequence
  Description of Artificial Sequence: Synthetic oligonucleotide
  Target: SCN10A; (-) strand; PAM type: NRG; PAM sequence: TGG
atgattagaaaagaaagacc

SEQ ID NO: 17874 - DNA, 20 bp, Artificial Sequence
  Description of Artificial Sequence: Synthetic oligonucleotide
  Target: SCN10A; (-) strand; PAM type: NRG; PAM sequence: AAG
gaacatatgattagaaaaga

SEQ ID NO: 17875 - DNA, 20 bp, Artificial Sequence
  Description of Artificial Sequence: Synthetic oligonucleotide
  Target: SCN10A; (-) strand; PAM type: NRG; PAM sequence: AAG
atgagaacatatgattagaa

SEQ ID NO: 17876 - DNA, 20 bp, Artificial Sequence
  Description of Artificial Sequence: Synthetic oligonucleotide
  Target: SCN10A; (-) strand; PAM type: NRG; PAM sequence: TAG
caggaatgagaacatatgat

SEQ ID NO: 17877 - DNA, 20 bp, Artificial Sequence
  Description of Artificial Sequence: Synthetic oligonucleotide
  Target: SCN10A; (-) strand; PAM type: NRG; PAM sequence: GAG
gcagtctgacttgcaggaat

SEQ ID NO: 17878 - DNA, 20 bp, Artificial Sequence
  Description of Artificial Sequence: Synthetic oligonucleotide
  Target: SCN10A; (-) strand; PAM type: NRG; PAM sequence: AGG
tgggaggcagtctgacttgc

SEQ ID NO: 17879 - DNA, 20 bp, Artificial Sequence
  Description of Artificial Sequence: Synthetic oligonucleotide
  Target: SCN10A; (-) strand; PAM type: NRG; PAM sequence: CAG
ttgggaggcagtctgacttg

SEQ ID NO: 17880 - DNA, 20 bp, Artificial Sequence
  Description of Artificial Sequence: Synthetic oligonucleotide
  Target: SCN10A; (-) strand; PAM type: NRG; PAM sequence: CAG
aagaagtgtgccttgggagg

SEQ ID NO: 17881 - DNA, 20 bp, Artificial Sequence
  Description of Artificial Sequence: Synthetic oligonucleotide
  Target: SCN10A; (-) strand; PAM type: NRG; PAM sequence: AGG
tacaagaagtgtgccttggg

SEQ ID NO: 17882 - DNA, 20 bp, Artificial Sequence
  Description of Artificial Sequence: Synthetic oligonucleotide
  Target: SCN10A; (-) strand; PAM type: NRG; PAM sequence: GAG
ttacaagaagtgtgccttgg

SEQ ID NO: 17883 - DNA, 20 bp, Artificial Sequence
  Description of Artificial Sequence: Synthetic oligonucleotide
  Target: SCN10A; (-) strand; PAM type: NRG; PAM sequence: GGG
cattacaagaagtgtgcctt

SEQ ID NO: 17884 - DNA, 20 bp, Artificial Sequence
  Description of Artificial Sequence: Synthetic oligonucleotide
  Target: SCN10A; (-) strand; PAM type: NRG; PAM sequence: TGG
tcattacaagaagtgtgcct

SEQ ID NO: 17885 - DNA, 20 bp, Artificial Sequence
  Description of Artificial Sequence: Synthetic oligonucleotide
  Target: SCN10A; (-) strand; PAM type: NRG; PAM sequence: AAG
catgtgggattcattacaag

SEQ ID NO: 17886 - DNA, 20 bp, Artificial Sequence
  Description of Artificial Sequence: Synthetic oligonucleotide
  Target: SCN10A; (-) strand; PAM type: NRG; PAM sequence: AAG
attcatgtgggattcattac

SEQ ID NO: 17887 - DNA, 20 bp, Artificial Sequence
  Description of Artificial Sequence: Synthetic oligonucleotide
  Target: SCN10A; (-) strand; PAM type: NRG; PAM sequence: GGG
caaacttttcaaattcatgt

SEQ ID NO: 17888 - DNA, 20 bp, Artificial Sequence
  Description of Artificial Sequence: Synthetic oligonucleotide
  Target: SCN10A; (-) strand; PAM type: NRG; PAM sequence: TGG
tcaaacttttcaaattcatg

SEQ ID NO: 17889 - DNA, 20 bp, Artificial Sequence
  Description of Artificial Sequence: Synthetic oligonucleotide
  Target: SCN10A; (-) strand; PAM type: NRG; PAM sequence: AAG
attgtacttctctggttgaa

SEQ ID NO: 17890 - DNA, 20 bp, Artificial Sequence
  Description of Artificial Sequence: Synthetic oligonucleotide
  Target: SCN10A; (-) strand; PAM type: NRG; PAM sequence: TGG
atgcccagattgtacttctc

SEQ ID NO: 17891 - DNA, 20 bp, Artificial Sequence
  Description of Artificial Sequence: Synthetic oligonucleotide
  Target: SCN10A; (-) strand; PAM type: NRG; PAM sequence: CAG
ttgatctgcatttttatgcc

SEQ ID NO: 17892 - DNA, 20 bp, Artificial Sequence
  Description of Artificial Sequence: Synthetic oligonucleotide
  Target: SCN10A; (-) strand; PAM type: NRG; PAM sequence: AAG
ggcttctgggttatctgaaa

SEQ ID NO: 17893 - DNA, 20 bp, Artificial Sequence
  Description of Artificial Sequence: Synthetic oligonucleotide
  Target: SCN10A; (-) strand; PAM type: NRG; PAM sequence: GGG
ggggaaaggagaaggcttct

SEQ ID NO: 17894 - DNA, 20 bp, Artificial Sequence
  Description of Artificial Sequence: Synthetic oligonucleotide
  Target: SCN10A; (-) strand; PAM type: NRG; PAM sequence: TGG
tggggaaaggagaaggcttc

SEQ ID NO: 17895 - DNA, 20 bp, Artificial Sequence
  Description of Artificial Sequence: Synthetic oligonucleotide
  Target: SCN10A; (-) strand; PAM type: NRG; PAM sequence: AGG
tgtctcctggggaaaggaga

SEQ ID NO: 17896 - DNA, 20 bp, Artificial Sequence
  Description of Artificial Sequence: Synthetic oligonucleotide
  Target: SCN10A; (-) strand; PAM type: NRG; PAM sequence: AAG
ctgtctcctggggaaaggag

SEQ ID NO: 17897 - DNA, 20 bp, Artificial Sequence
  Description of Artificial Sequence: Synthetic oligonucleotide
  Target: SCN10A; (-) strand; PAM type: NRG; PAM sequence: GAG
gcactgtctcctggggaaag

SEQ ID NO: 17898 - DNA, 20 bp, Artificial Sequence
  Description of Artificial Sequence: Synthetic oligonucleotide
  Target: SCN10A; (-) strand; PAM type: NRG; PAM sequence: AGG
gggcactgtctcctggggaa

SEQ ID NO: 17899 - DNA, 20 bp, Artificial Sequence
  Description of Artificial Sequence: Synthetic oligonucleotide
  Target: SCN10A; (-) strand; PAM type: NRG; PAM sequence: AAG
ggggcactgtctcctgggga

SEQ ID NO: 17900 - DNA, 20 bp, Artificial Sequence
  Description of Artificial Sequence: Synthetic oligonucleotide
  Target: SCN10A; (-) strand; PAM type: NRG; PAM sequence: GGG
gctgggggcactgtctcctg

SEQ ID NO: 17901 - DNA, 20 bp, Artificial Sequence
  Description of Artificial Sequence: Synthetic oligonucleotide
  Target: SCN10A; (-) strand; PAM type: NRG; PAM sequence: GGG
tgctgggggcactgtctcct

SEQ ID NO: 17902 - DNA, 20 bp, Artificial Sequence
  Description of Artificial Sequence: Synthetic oligonucleotide
  Target: SCN10A; (-) strand; PAM type: NRG; PAM sequence: TGG
ctgctgggggcactgtctcc

SEQ ID NO: 17903 - DNA, 20 bp, Artificial Sequence
  Description of Artificial Sequence: Synthetic oligonucleotide
  Target: SCN10A; (-) strand; PAM type: NRG; PAM sequence: GGG
tgagtggtgaaccctgctgg

SEQ ID NO: 17904 - DNA, 20 bp, Artificial Sequence
  Description of Artificial Sequence: Synthetic oligonucleotide
  Target: SCN10A; (-) strand; PAM type: NRG; PAM sequence: GGG
gtgagtggtgaaccctgctg

SEQ ID NO: 17905 - DNA, 20 bp, Artificial Sequence
  Description of Artificial Sequence: Synthetic oligonucleotide
  Target: SCN10A; (-) strand; PAM type: NRG; PAM sequence: GGG
ggtgagtggtgaaccctgct

SEQ ID NO: 17906 - DNA, 20 bp, Artificial Sequence
  Description of Artificial Sequence: Synthetic oligonucleotide
  Target: SCN10A; (-) strand; PAM type: NRG; PAM sequence: TGG
tggtgagtggtgaaccctgc

SEQ ID NO: 17907 - DNA, 20 bp, Artificial Sequence
  Description of Artificial Sequence: Synthetic oligonucleotide
  Target: SCN10A; (-) strand; PAM type: NRG; PAM sequence: TGG
ctagggaacctggtggtgag

SEQ ID NO: 17908 - DNA, 20 bp, Artificial Sequence
  Description of Artificial Sequence: Synthetic oligonucleotide
  Target: SCN10A; (-) strand; PAM type: NRG; PAM sequence: GAG
gtgctagggaacctggtggt

SEQ ID NO: 17909 - DNA, 20 bp, Artificial Sequence
  Description of Artificial Sequence: Synthetic oligonucleotide
  Target: SCN10A; (-) strand; PAM type: NRG; PAM sequence: TGG
gatggtgctagggaacctgg

SEQ ID NO: 17910 - DNA, 20 bp, Artificial Sequence
  Description of Artificial Sequence: Synthetic oligonucleotide
  Target: SCN10A; (-) strand; PAM type: NRG; PAM sequence: TGG
ggtgatggtgctagggaacc

SEQ ID NO: 17911 - DNA, 20 bp, Artificial Sequence
  Description of Artificial Sequence: Synthetic oligonucleotide
  Target: SCN10A; (-) strand; PAM type: NRG; PAM sequence: GGG
tcttgacggtgatggtgcta

SEQ ID NO: 17912 - DNA, 20 bp, Artificial Sequence
  Description of Artificial Sequence: Synthetic oligonucleotide
  Target: SCN10A; (-) strand; PAM type: NRG; PAM sequence: AGG
ttcttgacggtgatggtgct

SEQ ID NO: 17913 - DNA, 20 bp, Artificial Sequence
  Description of Artificial Sequence: Synthetic oligonucleotide
  Target: SCN10A; (-) strand; PAM type: NRG; PAM sequence: TAG
tttcttgacggtgatggtgc

SEQ ID NO: 17914 - DNA, 20 bp, Artificial Sequence
  Description of Artificial Sequence: Synthetic oligonucleotide
  Target: SCN10A; (-) strand; PAM type: NRG; PAM sequence: TGG
catccttttcttgacggtga

SEQ ID NO: 17915 - DNA, 20 bp, Artificial Sequence
  Description of Artificial Sequence: Synthetic oligonucleotide
  Target: SCN10A; (-) strand; PAM type: NRG; PAM sequence: CGG
atgcctcatccttttcttga

SEQ ID NO: 17916 - DNA, 20 bp, Artificial Sequence
  Description of Artificial Sequence: Synthetic oligonucleotide
  Target: SCN10A; (-) strand; PAM type: NRG; PAM sequence: TGG
atgtgggcctgcatggaagt

SEQ ID NO: 17917 - DNA, 20 bp, Artificial Sequence
  Description of Artificial Sequence: Synthetic oligonucleotide
  Target: SCN10A; (-) strand; PAM type: NRG; PAM sequence: AAG
gaacatgtgggcctgcatgg

SEQ ID NO: 17918 - DNA, 20 bp, Artificial Sequence
  Description of Artificial Sequence: Synthetic oligonucleotide
  Target: SCN10A; (-) strand; PAM type: NRG; PAM sequence: TGG
tgagaacatgtgggcctgca

SEQ ID NO: 17919 - DNA, 20 bp, Artificial Sequence
  Description of Artificial Sequence: Synthetic oligonucleotide
  Target: SCN10A; (-) strand; PAM type: NRG; PAM sequence: GGG
agagtggattgagaacatgt

SEQ ID NO: 17920 - DNA, 20 bp, Artificial Sequence
  Description of Artificial Sequence: Synthetic oligonucleotide
  Target: SCN10A; (-) strand; PAM type: NRG; PAM sequence: TGG
gagagtggattgagaacatg

SEQ ID NO: 17921 - DNA, 20 bp, Artificial Sequence
  Description of Artificial Sequence: Synthetic oligonucleotide
  Target: SCN10A; (-) strand; PAM type: NRG; PAM sequence: GAG
tcctctgtggagagtggatt

SEQ ID NO: 17922 - DNA, 20 bp, Artificial Sequence
  Description of Artificial Sequence: Synthetic oligonucleotide
  Target: SCN10A; (-) strand; PAM type: NRG; PAM sequence: TGG
tccgtatcctctgtggagag

SEQ ID NO: 17923 - DNA, 20 bp, Artificial Sequence
  Description of Artificial Sequence: Synthetic oligonucleotide
  Target: SCN10A; (-) strand; PAM type: NRG; PAM sequence: GAG
tcttccgtatcctctgtgga

SEQ ID NO: 17924 - DNA, 20 bp, Artificial Sequence
  Description of Artificial Sequence: Synthetic oligonucleotide
  Target: SCN10A; (-) strand; PAM type: NRG; PAM sequence: GAG
tgtcttccgtatcctctgtg

SEQ ID NO: 17925 - DNA, 20 bp, Artificial Sequence
  Description of Artificial Sequence: Synthetic oligonucleotide
  Target: SCN10A; (-) strand; PAM type: NRG; PAM sequence: TGG
attgtcttccgtatcctctg

SEQ ID NO: 17926 - DNA, 20 bp, Artificial Sequence
  Description of Artificial Sequence: Synthetic oligonucleotide
  Target: SCN10A; (-) strand; PAM type: NRG; PAM sequence: TGG
cccatgaagactggccccgc

SEQ ID NO: 17927 - DNA, 20 bp, Artificial Sequence
  Description of Artificial Sequence: Synthetic oligonucleotide
  Target: SCN10A; (-) strand; PAM type: NRG; PAM sequence: TGG
tctccgcgccccatgaagac

SEQ ID NO: 17928 - DNA, 20 bp, Artificial Sequence
  Description of Artificial Sequence: Synthetic oligonucleotide
  Target: SCN10A; (-) strand; PAM type: NRG; PAM sequence: AAG
aaatatctccgcgccccatg

SEQ ID NO: 17929 - DNA, 20 bp, Artificial Sequence
  Description of Artificial Sequence: Synthetic oligonucleotide
  Target: SCN10A; (-) strand; PAM type: NRG; PAM sequence: GGG
ggttggcaagcagctcctag

SEQ ID NO: 17930 - DNA, 20 bp, Artificial Sequence
  Description of Artificial Sequence: Synthetic oligonucleotide
  Target: SCN10A; (-) strand; PAM type: NRG; PAM sequence: GGG
tggttggcaagcagctccta

SEQ ID NO: 17931 - DNA, 20 bp, Artificial Sequence
  Description of Artificial Sequence: Synthetic oligonucleotide
  Target: SCN10A; (-) strand; PAM type: NRG; PAM sequence: AGG
ctggttggcaagcagctcct

SEQ ID NO: 17932 - DNA, 20 bp, Artificial Sequence
  Description of Artificial Sequence: Synthetic oligonucleotide
  Target: SCN10A; (-) strand; PAM type: NRG; PAM sequence: TAG
tctggttggcaagcagctcc

SEQ ID NO: 17933 - DNA, 20 bp, Artificial Sequence
  Description of Artificial Sequence: Synthetic oligonucleotide
  Target: SCN10A; (-) strand; PAM type: NRG; PAM sequence: CAG
tctttgctctggttggcaag

SEQ ID NO: 17934 - DNA, 20 bp, Artificial Sequence
  Description of Artificial Sequence: Synthetic oligonucleotide
  Target: SCN10A; (-) strand; PAM type: NRG; PAM sequence: AAG
ttgtctttgctctggttggc

SEQ ID NO: 17935 - DNA, 20 bp, Artificial Sequence
  Description of Artificial Sequence: Synthetic oligonucleotide
  Target: SCN10A; (-) strand; PAM type: NRG; PAM sequence: TGG
gtctttgtctttgctctggt

SEQ ID NO: 17936 - DNA, 20 bp, Artificial Sequence
  Description of Artificial Sequence: Synthetic oligonucleotide
  Target: SCN10A; (-) strand; PAM type: NRG; PAM sequence: TGG
cattgtctttgtctttgctc

SEQ ID NO: 17937 - DNA, 20 bp, Artificial Sequence
  Description of Artificial Sequence: Synthetic oligonucleotide
  Target: SCN10A; (-) strand; PAM type: NRG; PAM sequence: TGG
ggggaacctcaccatcatcc

SEQ ID NO: 17938 - DNA, 20 bp, Artificial Sequence
  Description of Artificial Sequence: Synthetic oligonucleotide
  Target: SCN10A; (-) strand; PAM type: NRG; PAM sequence: GGG
gaaactcagtgggggcactg

SEQ ID NO: 17939 - DNA, 20 bp, Artificial Sequence
  Description of Artificial Sequence: Synthetic oligonucleotide
  Target: SCN10A; (-) strand; PAM type: NRG; PAM sequence: GGG
ggaaactcagtgggggcact

SEQ ID NO: 17940 - DNA, 20 bp, Artificial Sequence
  Description of Artificial Sequence: Synthetic oligonucleotide
  Target: SCN10A; (-) strand; PAM type: NRG; PAM sequence: TGG
cggaaactcagtgggggcac

SEQ ID NO: 17941 - DNA, 20 bp, Artificial Sequence
  Description of Artificial Sequence: Synthetic oligonucleotide
  Target: SCN10A; (-) strand; PAM type: NRG; PAM sequence: GGG
gatcatcggaaactcagtgg

SEQ ID NO: 17942 - DNA, 20 bp, Artificial Sequence
  Description of Artificial Sequence: Synthetic oligonucleotide
  Target: SCN10A; (-) strand; PAM type: NRG; PAM sequence: GGG
agatcatcggaaactcagtg

SEQ ID NO: 17943 - DNA, 20 bp, Artificial Sequence
  Description of Artificial Sequence: Synthetic oligonucleotide
  Target: SCN10A; (-) strand; PAM type: NRG; PAM sequence: GGG
aagatcatcggaaactcagt

SEQ ID NO: 17944 - DNA, 20 bp, Artificial Sequence
  Description of Artificial Sequence: Synthetic oligonucleotide
  Target: SCN10A; (-) strand; PAM type: NRG; PAM sequence: TGG
caagatcatcggaaactcag

SEQ ID NO: 17945 - DNA, 20 bp, Artificial Sequence
  Description of Artificial Sequence: Synthetic oligonucleotide
  Target: SCN10A; (-) strand; PAM type: NRG; PAM sequence: CAG
catcaagatcatcggaaact

SEQ ID NO: 17946 - DNA, 20 bp, Artificial Sequence
  Description of Artificial Sequence: Synthetic oligonucleotide
  Target: SCN10A; (-) strand; PAM type: NRG; PAM sequence: CGG
aacacactcatcaagatcat

SEQ ID NO: 17947 - DNA, 20 bp, Artificial Sequence
  Description of Artificial Sequence: Synthetic oligonucleotide
  Target: SCN10A; (-) strand; PAM type: NRG; PAM sequence: AAG
ccaccttaaacacactcatc

SEQ ID NO: 17948 - DNA, 20 bp, Artificial Sequence
  Description of Artificial Sequence: Synthetic oligonucleotide
  Target: SCN10A; (-) strand; PAM type: NRG; PAM sequence: TGG
tattcaagctggccaaatcc

SEQ ID NO: 17949 - DNA, 20 bp, Artificial Sequence
  Description of Artificial Sequence: Synthetic oligonucleotide
  Target: SCN10A; (-) strand; PAM type: NRG; PAM sequence: TGG
gcagctgcgcgtattcaagc

SEQ ID NO: 17950 - DNA, 20 bp, Artificial Sequence
  Description of Artificial Sequence: Synthetic oligonucleotide
  Target: SCN10A; (-) strand; PAM type: NRG; PAM sequence: AAG
ctctgcagctgcgcgtattc

SEQ ID NO: 17951 - DNA, 20 bp, Artificial Sequence
  Description of Artificial Sequence: Synthetic oligonucleotide
  Target: SCN10A; (-) strand; PAM type: NRG; PAM sequence: CAG
tgacggtctctgtttctctg

SEQ ID NO: 17952 - DNA, 20 bp, Artificial Sequence
  Description of Artificial Sequence: Synthetic oligonucleotide
  Target: SCN10A; (-) strand; PAM type: NRG; PAM sequence: CGG
gcacagctaccaaaacctga

SEQ ID NO: 17953 - DNA, 20 bp, Artificial Sequence
  Description of Artificial Sequence: Synthetic oligonucleotide
  Target: SCN10A; (-) strand; PAM type: NRG; PAM sequence: CAG
tagatgaaaggtaatgagca

SEQ ID NO: 17954 - DNA, 20 bp, Artificial Sequence
  Description of Artificial Sequence: Synthetic oligonucleotide
  Target: SCN10A; (-) strand; PAM type: NRG; PAM sequence: GAG
aactttagatgaaaggtaat

SEQ ID NO: 17955 - DNA, 20 bp, Artificial Sequence
  Description of Artificial Sequence: Synthetic oligonucleotide
  Target: SCN10A; (-) strand; PAM type: NRG; PAM sequence: AGG
caggcaaaactttagatgaa

SEQ ID NO: 17956 - DNA, 20 bp, Artificial Sequence
  Description of Artificial Sequence: Synthetic oligonucleotide
  Target: SCN10A; (-) strand; PAM type: NRG; PAM sequence: AAG
ccaggcaaaactttagatga

SEQ ID NO: 17957 - DNA, 20 bp, Artificial Sequence
  Description of Artificial Sequence: Synthetic oligonucleotide
  Target: SCN10A; (-) strand; PAM type: NRG; PAM sequence: TAG
ttggtttccaggcaaaactt

SEQ ID NO: 17958 - DNA, 20 bp, Artificial Sequence
  Description of Artificial Sequence: Synthetic oligonucleotide
  Target: SCN10A; (-) strand; PAM type: NRG; PAM sequence: AGG
ttcccagatctttggtttcc

SEQ ID NO: 17959 - DNA, 20 bp, Artificial Sequence
  Description of Artificial Sequence: Synthetic oligonucleotide
  Target: SCN10A; (-) strand; PAM type: NRG; PAM sequence: CAG
tttcccagatctttggtttc

SEQ ID NO: 17960 - DNA, 20 bp, Artificial Sequence
  Description of Artificial Sequence: Synthetic oligonucleotide
  Target: SCN10A; (-) strand; PAM type: NRG; PAM sequence: TGG
ttgtgtttttcccagatctt

SEQ ID NO: 17961 - DNA, 20 bp, Artificial Sequence
  Description of Artificial Sequence: Synthetic oligonucleotide
  Target: SCN10A; (-) strand; PAM type: NRG; PAM sequence: CAG
gagaggccttgtgtttttcc

SEQ ID NO: 17962 - DNA, 20 bp, Artificial Sequence
  Description of Artificial Sequence: Synthetic oligonucleotide
  Target: SCN10A; (-) strand; PAM type: NRG; PAM sequence: AGG
ccctggtttaatgggatgag

SEQ ID NO: 17963 - DNA, 20 bp, Artificial Sequence
  Description of Artificial Sequence: Synthetic oligonucleotide
  Target: SCN10A; (-) strand; PAM type: NRG; PAM sequence: GAG
gccctggtttaatgggatga

SEQ ID NO: 17964 - DNA, 20 bp, Artificial Sequence
  Description of Artificial Sequence: Synthetic oligonucleotide
  Target: SCN10A; (-) strand; PAM type: NRG; PAM sequence: GAG
acgccctggtttaatgggat

SEQ ID NO: 17965 - DNA, 20 bp, Artificial Sequence
  Description of Artificial Sequence: Synthetic oligonucleotide
  Target: SCN10A; (-) strand; PAM type: NRG; PAM sequence: GGG
agaaaacgccctggtttaat

SEQ ID NO: 17966 - DNA, 20 bp, Artificial Sequence
  Description of Artificial Sequence: Synthetic oligonucleotide
  Target: SCN10A; (-) strand; PAM type: NRG; PAM sequence: TGG
cagaaaacgccctggtttaa

SEQ ID NO: 17967 - DNA, 20 bp, Artificial Sequence
  Description of Artificial Sequence: Synthetic oligonucleotide
  Target: SCN10A; (-) strand; PAM type: NRG; PAM sequence: TGG
gcagtgtccagaaaacgccc

SEQ ID NO: 17968 - DNA, 20 bp, Artificial Sequence
  Description of Artificial Sequence: Synthetic oligonucleotide
  Target: SCN10A; (-) strand; PAM type: NRG; PAM sequence: CAG
aggtctccaaaagcagtgtc

SEQ ID NO: 17969 - DNA, 20 bp, Artificial Sequence
  Description of Artificial Sequence: Synthetic oligonucleotide
  Target: SCN10A; (-) strand; PAM type: NRG; PAM sequence: CAG
ggaagaaaggtctccaaaag

SEQ ID NO: 17970 - DNA, 20 bp, Artificial Sequence
  Description of Artificial Sequence: Synthetic oligonucleotide
  Target: SCN10A; (-) strand; PAM type: NRG; PAM sequence: AAG
ataggaagaaaggtctccaa

SEQ ID NO: 17971 - DNA, 20 bp, Artificial Sequence
  Description of Artificial Sequence: Synthetic oligonucleotide
  Target: SCN10A; (-) strand; PAM type: NRG; PAM sequence: AGG
aatttatagcataggaagaa

SEQ ID NO: 17972 - DNA, 20 bp, Artificial Sequence
  Description of Artificial Sequence: Synthetic oligonucleotide
  Target: SCN10A; (-) strand; PAM type: NRG; PAM sequence: AAG
taatttatagcataggaaga

SEQ ID NO: 17973 - DNA, 20 bp, Artificial Sequence
  Description of Artificial Sequence: Synthetic oligonucleotide
  Target: SCN10A; (-) strand; PAM type: NRG; PAM sequence: AAG
tgagtaatttatagcatagg

SEQ ID NO: 17974 - DNA, 20 bp, Artificial Sequence
  Description of Artificial Sequence: Synthetic oligonucleotide
  Target: SCN10A; (-) strand; PAM type: NRG; PAM sequence: AGG
ttttgagtaatttatagcat

SEQ ID NO: 17975 - DNA, 20 bp, Artificial Sequence
  Description of Artificial Sequence: Synthetic oligonucleotide
  Target: SCN10A; (-) strand; PAM type: NRG; PAM sequence: TAG
tttttgagtaatttatagca

SEQ ID NO: 17976 - DNA, 20 bp, Artificial Sequence
  Description of Artificial Sequence: Synthetic oligonucleotide
  Target: SCN10A; (-) strand; PAM type: NRG; PAM sequence: TAG
tcatatttttgagtaattta

SEQ ID NO: 17977 - DNA, 20 bp, Artificial Sequence
  Description of Artificial Sequence: Synthetic oligonucleotide
  Target: SCN10A; (-) strand; PAM type: NRG; PAM sequence: GAG
agaaggcagatcatattttt

SEQ ID NO: 17978 - DNA, 20 bp, Artificial Sequence
  Description of Artificial Sequence: Synthetic oligonucleotide
  Target: SCN10A; (-) strand; PAM type: NRG; PAM sequence: CAG
tacttatgaaccatagaagg

SEQ ID NO: 17979 - DNA, 20 bp, Artificial Sequence
  Description of Artificial Sequence: Synthetic oligonucleotide
  Target: SCN10A; (-) strand; PAM type: NRG; PAM sequence: AGG
tgatacttatgaaccataga

SEQ ID NO: 17980 - DNA, 20 bp, Artificial Sequence
  Description of Artificial Sequence: Synthetic oligonucleotide
  Target: SCN10A; (-) strand; PAM type: NRG; PAM sequence: AAG
ttgatacttatgaaccatag

SEQ ID NO: 17981 - DNA, 20 bp, Artificial Sequence
  Description of Artificial Sequence: Synthetic oligonucleotide
  Target: SCN10A; (-) strand; PAM type: NRG; PAM sequence: TAG
acattgatacttatgaacca

SEQ ID NO: 17982 - DNA, 20 bp, Artificial Sequence
  Description of Artificial Sequence: Synthetic oligonucleotide
  Target: SCN10A; (-) strand; PAM type: NRG; PAM sequence: AAG
tgactcagccacagtcaatg

SEQ ID NO: 17983 - DNA, 20 bp, Artificial Sequence
  Description of Artificial Sequence: Synthetic oligonucleotide
  Target: SCN10A; (-) strand; PAM type: NRG; PAM sequence: CAG
agaagaccctgactcagcca

SEQ ID NO: 17984 - DNA, 20 bp, Artificial Sequence
  Description of Artificial Sequence: Synthetic oligonucleotide
  Target: SCN10A; (-) strand; PAM type: NRG; PAM sequence: CAG
cccagtagaagaccctgact

SEQ ID NO: 17985 - DNA, 20 bp, Artificial Sequence
  Description of Artificial Sequence: Synthetic oligonucleotide
  Target: SCN10A; (-) strand; PAM type: NRG; PAM sequence: AAG
caaggccaccaccccagtag

SEQ ID NO: 17986 - DNA, 20 bp, Artificial Sequence
  Description of Artificial Sequence: Synthetic oligonucleotide
  Target: SCN10A; (-) strand; PAM type: NRG; PAM sequence: TAG
tcgcaaggccaccaccccag

SEQ ID NO: 17987 - DNA, 20 bp, Artificial Sequence
  Description of Artificial Sequence: Synthetic oligonucleotide
  Target: SCN10A; (-) strand; PAM type: NRG; PAM sequence: CAG
agatcgcaaggccaccaccc

SEQ ID NO: 17988 - DNA, 20 bp, Artificial Sequence
  Description of Artificial Sequence: Synthetic oligonucleotide
  Target: SCN10A; (-) strand; PAM type: NRG; PAM sequence: AGG
agaacagagtacagatcgca

SEQ ID NO: 17989 - DNA, 20 bp, Artificial Sequence
  Description of Artificial Sequence: Synthetic oligonucleotide
  Target: SCN10A; (-) strand; PAM type: NRG; PAM sequence: AAG
tagaacagagtacagatcgc

SEQ ID NO: 17990 - DNA, 20 bp, Artificial Sequence
  Description of Artificial Sequence: Synthetic oligonucleotide
  Target: SCN10A; (-) strand; PAM type: NRG; PAM sequence: CAG
tgtggctatagaacagagta

SEQ ID NO: 17991 - DNA, 20 bp, Artificial Sequence
  Description of Artificial Sequence: Synthetic oligonucleotide
  Target: SCN10A; (-) strand; PAM type: NRG; PAM sequence: GAG
aggcctgtggctatagaaca

SEQ ID NO: 17992 - DNA, 20 bp, Artificial Sequence
  Description of Artificial Sequence: Synthetic oligonucleotide
  Target: SCN10A; (-) strand; PAM type: NRG; PAM sequence: CAG
tcaggcctgtggctatagaa

SEQ ID NO: 17993 - DNA, 20 bp, Artificial Sequence
  Description of Artificial Sequence: Synthetic oligonucleotide
  Target: SCN10A; (-) strand; PAM type: NRG; PAM sequence: TAG
agggatcaggcctgtggcta

SEQ ID NO: 17994 - DNA, 20 bp, Artificial Sequence
  Description of Artificial Sequence: Synthetic oligonucleotide
  Target: SCN10A; (-) strand; PAM type: NRG; PAM sequence: TGG
ttcaggagggatcaggcctg

SEQ ID NO: 17995 - DNA, 20 bp, Artificial Sequence
  Description of Artificial Sequence: Synthetic oligonucleotide
  Target: SCN10A; (-) strand; PAM type: NRG; PAM sequence: AGG
gcccatattcaggagggatc

SEQ ID NO: 17996 - DNA, 20 bp, Artificial Sequence
  Description of Artificial Sequence: Synthetic oligonucleotide
  Target: SCN10A; (-) strand; PAM type: NRG; PAM sequence: CAG
ggcccatattcaggagggat

SEQ ID NO: 17997 - DNA, 20 bp, Artificial Sequence
  Description of Artificial Sequence: Synthetic oligonucleotide
  Target: SCN10A; (-) strand; PAM type: NRG; PAM sequence: GGG
gaagaggcccatattcagga

SEQ ID NO: 17998 - DNA, 20 bp, Artificial Sequence
  Description of Artificial Sequence: Synthetic oligonucleotide
  Target: SCN10A; (-) strand; PAM type: NRG; PAM sequence: AGG
agaagaggcccatattcagg

SEQ ID NO: 17999 - DNA, 20 bp, Artificial Sequence
  Description of Artificial Sequence: Synthetic oligonucleotide
  Target: SCN10A; (-) strand; PAM type: NRG; PAM sequence: GAG
cagaagaggcccatattcag

SEQ ID NO: 18000 - DNA, 20 bp, Artificial Sequence
  Description of Artificial Sequence: Synthetic oligonucleotide
  Target: SCN10A; (-) strand; PAM type: NRG; PAM sequence: AGG
cacagaagaggcccatattc

SEQ ID NO: 18001 - DNA, 20 bp, Artificial Sequence
  Description of Artificial Sequence: Synthetic oligonucleotide
  Target: SCN10A; (-) strand; PAM type: NRG; PAM sequence: CAG
ccacagaagaggcccatatt

SEQ ID NO: 18002 - DNA, 20 bp, Artificial Sequence
  Description of Artificial Sequence: Synthetic oligonucleotide
  Target: SCN10A; (-) strand; PAM type: NRG; PAM sequence: AGG
ccaccccacctccacagaag

SEQ ID NO: 18003 - DNA, 20 bp, Artificial Sequence
  Description of Artificial Sequence: Synthetic oligonucleotide
  Target: SCN10A; (-) strand; PAM type: NRG; PAM sequence: GAG
cccaccccacctccacagaa

SEQ ID NO: 18004 - DNA, 20 bp, Artificial Sequence
  Description of Artificial Sequence: Synthetic oligonucleotide
  Target: SCN10A; (-) strand; PAM type: NRG; PAM sequence: AAG
cacccaccccacctccacag

SEQ ID NO: 18005 - DNA, 20 bp, Artificial Sequence
  Description of Artificial Sequence: Synthetic oligonucleotide
  Target: SCN10A; (-) strand; PAM type: NRG; PAM sequence: CAG
tcacacccaccccacctcca

SEQ ID NO: 18006 - DNA, 20 bp, Artificial Sequence
  Description of Artificial Sequence: Synthetic oligonucleotide
  Target: SCN10A; (-) strand; PAM type: NRG; PAM sequence: GAG
gcttgttctcacttatttgt

SEQ ID NO: 18007 - DNA, 20 bp, Artificial Sequence
  Description of Artificial Sequence: Synthetic oligonucleotide
  Target: SCN10A; (-) strand; PAM type: NRG; PAM sequence: AAG
gtctctcttcagtcataaat

SEQ ID NO: 18008 - DNA, 20 bp, Artificial Sequence
  Description of Artificial Sequence: Synthetic oligonucleotide
  Target: SCN10A; (-) strand; PAM type: NRG; PAM sequence: CAG
gaaggaggctggtctctctt

SEQ ID NO: 18009 - DNA, 20 bp, Artificial Sequence
  Description of Artificial Sequence: Synthetic oligonucleotide
  Target: SCN10A; (-) strand; PAM type: NRG; PAM sequence: TGG
atcccctacccgaaggaggc

SEQ ID NO: 18010 - DNA, 20 bp, Artificial Sequence
  Description of Artificial Sequence: Synthetic oligonucleotide
  Target: SCN10A; (-) strand; PAM type: NRG; PAM sequence: AGG
ggtcatcccctacccgaagg

SEQ ID NO: 18011 - DNA, 20 bp, Artificial Sequence
  Description of Artificial Sequence: Synthetic oligonucleotide
  Target: SCN10A; (-) strand; PAM type: NRG; PAM sequence: GAG
gggtcatcccctacccgaag

SEQ ID NO: 18012 - DNA, 20 bp, Artificial Sequence
  Description of Artificial Sequence: Synthetic oligonucleotide
  Target: SCN10A; (-) strand; PAM type: NRG; PAM sequence: AGG
gtgggtcatcccctacccga

SEQ ID NO: 18013 - DNA, 20 bp, Artificial Sequence
  Description of Artificial Sequence: Synthetic oligonucleotide
  Target: SCN10A; (-) strand; PAM type: NRG; PAM sequence: AAG
agtgggtcatcccctacccg

SEQ ID NO: 18014 - DNA, 20 bp, Artificial Sequence
  Description of Artificial Sequence: Synthetic oligonucleotide
  Target: SCN10A; (-) strand; PAM type: NRG; PAM sequence: GGG
caatacctatcgaatgcagt

SEQ ID NO: 18015 - DNA, 20 bp, Artificial Sequence
  Description of Artificial Sequence: Synthetic oligonucleotide
  Target: SCN10A; (-) strand; PAM type: NRG; PAM sequence: TGG
ccaatacctatcgaatgcag

SEQ ID NO: 18016 - DNA, 20 bp, Artificial Sequence
  Description of Artificial Sequence: Synthetic oligonucleotide
  Target: SCN10A; (-) strand; PAM type: NRG; PAM sequence: CAG
ttgccaatacctatcgaatg

SEQ ID NO: 18017 - DNA, 20 bp, Artificial Sequence
  Description of Artificial Sequence: Synthetic oligonucleotide
  Target: SCN10A; (-) strand; PAM type: NRG; PAM sequence: GAG
caagatgagaaatgccctaa

SEQ ID NO: 18018 - DNA, 20 bp, Artificial Sequence
  Description of Artificial Sequence: Synthetic oligonucleotide
  Target: SCN10A; (-) strand; PAM type: NRG; PAM sequence: AAG
cccaagatgagaaatgccct

SEQ ID NO: 18019 - DNA, 20 bp, Artificial Sequence
  Description of Artificial Sequence: Synthetic oligonucleotide
  Target: SCN10A; (-) strand; PAM type: NRG; PAM sequence: GAG
gttgtccactgccccaagat

SEQ ID NO: 18020 - DNA, 20 bp, Artificial Sequence
  Description of Artificial Sequence: Synthetic oligonucleotide
  Target: SCN10A; (-) strand; PAM type: NRG; PAM sequence: AAG
cagatgttgtccactgcccc

SEQ ID NO: 18021 - DNA, 20 bp, Artificial Sequence
  Description of Artificial Sequence: Synthetic oligonucleotide
  Target: SCN10A; (-) strand; PAM type: NRG; PAM sequence: CAG
ttcaaagctggtgggagcaa

SEQ ID NO: 18022 - DNA, 20 bp, Artificial Sequence
  Description of Artificial Sequence: Synthetic oligonucleotide
  Target: SCN10A; (-) strand; PAM type: NRG; PAM sequence: GAG
tgcagtttcaaagctggtgg

SEQ ID NO: 18023 - DNA, 20 bp, Artificial Sequence
  Description of Artificial Sequence: Synthetic oligonucleotide
  Target: SCN10A; (-) strand; PAM type: NRG; PAM sequence: GGG
tttgcagtttcaaagctggt

SEQ ID NO: 18024 - DNA, 20 bp, Artificial Sequence
  Description of Artificial Sequence: Synthetic oligonucleotide
  Target: SCN10A; (-) strand; PAM type: NRG; PAM sequence: TGG
atttgcagtttcaaagctgg

SEQ ID NO: 18025 - DNA, 20 bp, Artificial Sequence
  Description of Artificial Sequence: Synthetic oligonucleotide
  Target: SCN10A; (-) strand; PAM type: NRG; PAM sequence: TGG
gacatttgcagtttcaaagc

SEQ ID NO: 18026 - DNA, 20 bp, Artificial Sequence
  Description of Artificial Sequence: Synthetic oligonucleotide
  Target: SCN10A; (-) strand; PAM type: NRG; PAM sequence: AAG
catggacatttgcagtttca

SEQ ID NO: 18027 - DNA, 20 bp, Artificial Sequence
  Description of Artificial Sequence: Synthetic oligonucleotide
  Target: SCN10A; (-) strand; PAM type: NRG; PAM sequence: CAG
catgaaatcatggacatttg

SEQ ID NO: 18028 - DNA, 20 bp, Artificial Sequence
  Description of Artificial Sequence: Synthetic oligonucleotide
  Target: SCN10A; (-) strand; PAM type: NRG; PAM sequence: TGG
atgctgagtccatgaaatca

SEQ ID NO: 18029 - DNA, 20 bp, Artificial Sequence
  Description of Artificial Sequence: Synthetic oligonucleotide
  Target: SCN10A; (-) strand; PAM type: NRG; PAM sequence: GAG
taaatcaacttatgaatgct

SEQ ID NO: 18030 - DNA, 20 bp, Artificial Sequence
  Description of Artificial Sequence: Synthetic oligonucleotide
  Target: SCN10A; (-) strand; PAM type: NRG; PAM sequence: TGG
gttctggggggtaggttcgt

SEQ ID NO: 18031 - DNA, 20 bp, Artificial Sequence
  Description of Artificial Sequence: Synthetic oligonucleotide
  Target: SCN10A; (-) strand; PAM type: NRG; PAM sequence: AGG
cggctggagttctggggggt

SEQ ID NO: 18032 - DNA, 20 bp, Artificial Sequence
  Description of Artificial Sequence: Synthetic oligonucleotide
  Target: SCN10A; (-) strand; PAM type: NRG; PAM sequence: TAG
acggctggagttctgggggg

SEQ ID NO: 18033 - DNA, 20 bp, Artificial Sequence
  Description of Artificial Sequence: Synthetic oligonucleotide
  Target: SCN10A; (-) strand; PAM type: NRG; PAM sequence: GGG
tgcacggctggagttctggg

SEQ ID NO: 18034 - DNA, 20 bp, Artificial Sequence
  Description of Artificial Sequence: Synthetic oligonucleotide
  Target: SCN10A; (-) strand; PAM type: NRG; PAM sequence: GGG
ctgcacggctggagttctgg

SEQ ID NO: 18035 - DNA, 20 bp, Artificial Sequence
  Description of Artificial Sequence: Synthetic oligonucleotide
  Target: SCN10A; (-) strand; PAM type: NRG; PAM sequence: GGG
cctgcacggctggagttctg

SEQ ID NO: 18036 - DNA, 20 bp, Artificial Sequence
  Description of Artificial Sequence: Synthetic oligonucleotide
  Target: SCN10A; (-) strand; PAM type: NRG; PAM sequence: GGG
acctgcacggctggagttct

SEQ ID NO: 18037 - DNA, 20 bp, Artificial Sequence
  Description of Artificial Sequence: Synthetic oligonucleotide
  Target: SCN10A; (-) strand; PAM type: NRG; PAM sequence: TGG
cacctgcacggctggagttc

SEQ ID NO: 18038 - DNA, 20 bp, Artificial Sequence
  Description of Artificial Sequence: Synthetic oligonucleotide
  Target: SCN10A; (-) strand; PAM type: NRG; PAM sequence: GAG
gccatgcacctgcacggctg

SEQ ID NO: 18039 - DNA, 20 bp, Artificial Sequence
  Description of Artificial Sequence: Synthetic oligonucleotide
  Target: SCN10A; (-) strand; PAM type: NRG; PAM sequence: TGG
ctgccatgcacctgcacggc

SEQ ID NO: 18040 - DNA, 20 bp, Artificial Sequence
  Description of Artificial Sequence: Synthetic oligonucleotide
  Target: SCN10A; (-) strand; PAM type: NRG; PAM sequence: CGG
cacactgccatgcacctgca

SEQ ID NO: 18041 - DNA, 20 bp, Artificial Sequence
  Description of Artificial Sequence: Synthetic oligonucleotide
  Target: SCN10A; (-) strand; PAM type: NRG; PAM sequence: TAG
tcttcatacacctcataggc

SEQ ID NO: 18042 - DNA, 20 bp, Artificial Sequence
  Description of Artificial Sequence: Synthetic oligonucleotide
  Target: SCN10A; (-) strand; PAM type: NRG; PAM sequence: AGG
cctctcttcatacacctcat

SEQ ID NO: 18043 - DNA, 20 bp, Artificial Sequence
  Description of Artificial Sequence: Synthetic oligonucleotide
  Target: SCN10A; (-) strand; PAM type: NRG; PAM sequence: TAG
acctctcttcatacacctca

SEQ ID NO: 18044 - DNA, 20 bp, Artificial Sequence
  Description of Artificial Sequence: Synthetic oligonucleotide
  Target: SCN10A; (-) strand; PAM type: NRG; PAM sequence: GAG
cattggttccatgagagcaa

SEQ ID NO: 18045 - DNA, 20 bp, Artificial Sequence
  Description of Artificial Sequence: Synthetic oligonucleotide
  Target: SCN10A; (-) strand; PAM type: NRG; PAM sequence: AAG
accattggttccatgagagc

SEQ ID NO: 18046 - DNA, 20 bp, Artificial Sequence
  Description of Artificial Sequence: Synthetic oligonucleotide
  Target: SCN10A; (-) strand; PAM type: NRG; PAM sequence: GAG
ctaaaccattggttccatga

SEQ ID NO: 18047 - DNA, 20 bp, Artificial Sequence
  Description of Artificial Sequence: Synthetic oligonucleotide
  Target: SCN10A; (-) strand; PAM type: NRG; PAM sequence: GAG
aactaaaccattggttccat

SEQ ID NO: 18048 - DNA, 20 bp, Artificial Sequence
  Description of Artificial Sequence: Synthetic oligonucleotide
  Target: SCN10A; (-) strand; PAM type: NRG; PAM sequence: TGG
tttctcagtaactaaaccat

SEQ ID NO: 18049 - DNA, 20 bp, Artificial Sequence
  Description of Artificial Sequence: Synthetic oligonucleotide
  Target: SCN10A; (-) strand; PAM type: NRG; PAM sequence: CAG
tttgagacttcatcttttct

SEQ ID NO: 18050 - DNA, 20 bp, Artificial Sequence
  Description of Artificial Sequence: Synthetic oligonucleotide
  Target: SCN10A; (-) strand; PAM type: NRG; PAM sequence: GAG
agtttacagtgaagactttt

SEQ ID NO: 18051 - DNA, 20 bp, Artificial Sequence
  Description of Artificial Sequence: Synthetic oligonucleotide
  Target: SCN10A; (-) strand; PAM type: NRG; PAM sequence: AAG
gcatatttgagtttacagtg

SEQ ID NO: 18052 - DNA, 20 bp, Artificial Sequence
  Description of Artificial Sequence: Synthetic oligonucleotide
  Target: SCN10A; (-) strand; PAM type: NRG; PAM sequence: CAG
acttagcatatttgagttta

SEQ ID NO: 18053 - DNA, 20 bp, Artificial Sequence
  Description of Artificial Sequence: Synthetic oligonucleotide
  Target: SCN10A; (-) strand; PAM type: NRG; PAM sequence: GAG
ttgtgggacttagcatattt

SEQ ID NO: 18054 - DNA, 20 bp, Artificial Sequence
  Description of Artificial Sequence: Synthetic oligonucleotide
  Target: SCN10A; (-) strand; PAM type: NRG; PAM sequence: TAG
ttttgctgtcttgtgggact

SEQ ID NO: 18055 - DNA, 20 bp, Artificial Sequence
  Description of Artificial Sequence: Synthetic oligonucleotide
  Target: SCN10A; (-) strand; PAM type: NRG; PAM sequence: GGG
tgatgattttgctgtcttgt

SEQ ID NO: 18056 - DNA, 20 bp, Artificial Sequence
  Description of Artificial Sequence: Synthetic oligonucleotide
  Target: SCN10A; (-) strand; PAM type: NRG; PAM sequence: TGG
ttgatgattttgctgtcttg

SEQ ID NO: 18057 - DNA, 20 bp, Artificial Sequence
  Description of Artificial Sequence: Synthetic oligonucleotide
  Target: SCN10A; (-) strand; PAM type: NRG; PAM sequence: GAG
ttttttttcctgacaaatta

SEQ ID NO: 18058 - DNA, 20 bp, Artificial Sequence
  Description of Artificial Sequence: Synthetic oligonucleotide
  Target: SCN10A; (-) strand; PAM type: NRG; PAM sequence: TAG
gattttttttcctgacaaat

SEQ ID NO: 18059 - DNA, 20 bp, Artificial Sequence
  Description of Artificial Sequence: Synthetic oligonucleotide
  Target: SCN10A; (-) strand; PAM type: NRG; PAM sequence: CAG
gacagactgacagttgagct

SEQ ID NO: 18060 - DNA, 20 bp, Artificial Sequence
  Description of Artificial Sequence: Synthetic oligonucleotide
  Target: SCN10A; (-) strand; PAM type: NRG; PAM sequence: GAG
tgactgacagactgacagtt

SEQ ID NO: 18061 - DNA, 20 bp, Artificial Sequence
  Description of Artificial Sequence: Synthetic oligonucleotide
  Target: SCN10A; (-) strand; PAM type: NRG; PAM sequence: CAG
caccttgactgacagactga

SEQ ID NO: 18062 - DNA, 20 bp, Artificial Sequence
  Description of Artificial Sequence: Synthetic oligonucleotide
  Target: SCN10A; (-) strand; PAM type: NRG; PAM sequence: CAG
cataaacacaccttgactga

SEQ ID NO: 18063 - DNA, 20 bp, Artificial Sequence
  Description of Artificial Sequence: Synthetic oligonucleotide
  Target: SCN10A; (-) strand; PAM type: NRG; PAM sequence: AGG
gccacagcctggctcttagt

SEQ ID NO: 18064 - DNA, 20 bp, Artificial Sequence
  Description of Artificial Sequence: Synthetic oligonucleotide
  Target: SCN10A; (-) strand; PAM type: NRG; PAM sequence: TAG
agccacagcctggctcttag

SEQ ID NO: 18065 - DNA, 20 bp, Artificial Sequence
  Description of Artificial Sequence: Synthetic oligonucleotide
  Target: SCN10A; (-) strand; PAM type: NRG; PAM sequence: TAG
ctaagccacagcctggctct

SEQ ID NO: 18066 - DNA, 20 bp, Artificial Sequence
  Description of Artificial Sequence: Synthetic oligonucleotide
  Target: SCN10A; (-) strand; PAM type: NRG; PAM sequence: TGG
ctagcacctaagccacagcc

SEQ ID NO: 18067 - DNA, 20 bp, Artificial Sequence
  Description of Artificial Sequence: Synthetic oligonucleotide
  Target: SCN10A; (-) strand; PAM type: NRG; PAM sequence: CAG
gcatcctagcacctaagcca

SEQ ID NO: 18068 - DNA, 20 bp, Artificial Sequence
  Description of Artificial Sequence: Synthetic oligonucleotide
  Target: SCN10A; (-) strand; PAM type: NRG; PAM sequence: AAG
agcattgcatcctagcacct

SEQ ID NO: 18069 - DNA, 20 bp, Artificial Sequence
  Description of Artificial Sequence: Synthetic oligonucleotide
  Target: SCN10A; (-) strand; PAM type: NRG; PAM sequence: TAG
ttgtgttcagcattgcatcc

SEQ ID NO: 18070 - DNA, 20 bp, Artificial Sequence
  Description of Artificial Sequence: Synthetic oligonucleotide
  Target: SCN10A; (-) strand; PAM type: NRG; PAM sequence: CAG
tgtagctacactgttgtgtt

SEQ ID NO: 18071 - DNA, 20 bp, Artificial Sequence
  Description of Artificial Sequence: Synthetic oligonucleotide
  Target: SCN10A; (-) strand; PAM type: NRG; PAM sequence: TAG
ggatatgggtgataaaattg

SEQ ID NO: 18072 - DNA, 20 bp, Artificial Sequence
  Description of Artificial Sequence: Synthetic oligonucleotide
  Target: SCN10A; (-) strand; PAM type: NRG; PAM sequence: GGG
tgggatttactcacggatat

SEQ ID NO: 18073 - DNA, 20 bp, Artificial Sequence
  Description of Artificial Sequence: Synthetic oligonucleotide
  Target: SCN10A; (-) strand; PAM type: NRG; PAM sequence: TGG
gtgggatttactcacggata

SEQ ID NO: 18074 - DNA, 20 bp, Artificial Sequence
  Description of Artificial Sequence: Synthetic oligonucleotide
  Target: SCN10A; (-) strand; PAM type: NRG; PAM sequence: CGG
cctcccgtgggatttactca

SEQ ID NO: 18075 - DNA, 20 bp, Artificial Sequence
  Description of Artificial Sequence: Synthetic oligonucleotide
  Target: SCN10A; (-) strand; PAM type: NRG; PAM sequence: GGG
aggattaaacctcctcccgt

SEQ ID NO: 18076 - DNA, 20 bp, Artificial Sequence
  Description of Artificial Sequence: Synthetic oligonucleotide
  Target: SCN10A; (-) strand; PAM type: NRG; PAM sequence: TGG
caggattaaacctcctcccg

SEQ ID NO: 18077 - DNA, 20 bp, Artificial Sequence
  Description of Artificial Sequence: Synthetic oligonucleotide
  Target: SCN10A; (-) strand; PAM type: NRG; PAM sequence: AGG
tacagcacttactgtataac

SEQ ID NO: 18078 - DNA, 20 bp, Artificial Sequence
  Description of Artificial Sequence: Synthetic oligonucleotide
  Target: SCN10A; (-) strand; PAM type: NRG; PAM sequence: CAG
atacagcacttactgtataa

SEQ ID NO: 18079 - DNA, 20 bp, Artificial Sequence
  Description of Artificial Sequence: Synthetic oligonucleotide
  Target: SCN10A; (-) strand; PAM type: NRG; PAM sequence: CAG
atcacataaagaggtgcata

SEQ ID NO: 18080 - DNA, 20 bp, Artificial Sequence
  Description of Artificial Sequence: Synthetic oligonucleotide
  Target: SCN10A; (-) strand; PAM type: NRG; PAM sequence: AGG
ctctcccccatcacataaag

SEQ ID NO: 18081 - DNA, 20 bp, Artificial Sequence
  Description of Artificial Sequence: Synthetic oligonucleotide
  Target: SCN10A; (-) strand; PAM type: NRG; PAM sequence: GAG
gctctcccccatcacataaa

SEQ ID NO: 18082 - DNA, 20 bp, Artificial Sequence
  Description of Artificial Sequence: Synthetic oligonucleotide
  Target: SCN10A; (-) strand; PAM type: NRG; PAM sequence: AAG
ccgctctcccccatcacata

SEQ ID NO: 18083 - DNA, 20 bp, Artificial Sequence
  Description of Artificial Sequence: Synthetic oligonucleotide
  Target: SCN10A; (-) strand; PAM type: NRG; PAM sequence: TGG
gattgggtgtaaggtgaacg

SEQ ID NO: 18084 - DNA, 20 bp, Artificial Sequence
  Description of Artificial Sequence: Synthetic oligonucleotide
  Target: SCN10A; (-) strand; PAM type: NRG; PAM sequence: AGG
taacttccagattgggtgta

SEQ ID NO: 18085 - DNA, 20 bp, Artificial Sequence
  Description of Artificial Sequence: Synthetic oligonucleotide
  Target: SCN10A; (-) strand; PAM type: NRG; PAM sequence: AAG
gtaacttccagattgggtgt

SEQ ID NO: 18086 - DNA, 20 bp, Artificial Sequence
  Description of Artificial Sequence: Synthetic oligonucleotide
  Target: SCN10A; (-) strand; PAM type: NRG; PAM sequence: GGG
aggagagtaacttccagatt

SEQ ID NO: 18087 - DNA, 20 bp, Artificial Sequence
  Description of Artificial Sequence: Synthetic oligonucleotide
  Target: SCN10A; (-) strand; PAM type: NRG; PAM sequence: TGG
gaggagagtaacttccagat

SEQ ID NO: 18088 - DNA, 20 bp, Artificial Sequence
  Description of Artificial Sequence: Synthetic oligonucleotide
  Target: SCN10A; (-) strand; PAM type: NRG; PAM sequence: CAG
catatgaggagagtaacttc

SEQ ID NO: 18089 - DNA, 20 bp, Artificial Sequence
  Description of Artificial Sequence: Synthetic oligonucleotide
  Target: SCN10A; (-) strand; PAM type: NRG; PAM sequence: GAG
ctctgcttcccatatgagga

SEQ ID NO: 18090 - DNA, 20 bp, Artificial Sequence
  Description of Artificial Sequence: Synthetic oligonucleotide
  Target: SCN10A; (-) strand; PAM type: NRG; PAM sequence: GAG
agctctgcttcccatatgag

SEQ ID NO: 18091 - DNA, 20 bp, Artificial Sequence
  Description of Artificial Sequence: Synthetic oligonucleotide
  Target: SCN10A; (-) strand; PAM type: NRG; PAM sequence: AGG
taagctctgcttcccatatg

SEQ ID NO: 18092 - DNA, 20 bp, Artificial Sequence
  Description of Artificial Sequence: Synthetic oligonucleotide
  Target: SCN10A; (-) strand; PAM type: NRG; PAM sequence: GAG
ttaagctctgcttcccatat

SEQ ID NO: 18093 - DNA, 20 bp, Artificial Sequence
  Description of Artificial Sequence: Synthetic oligonucleotide
  Target: SCN10A; (-) strand; PAM type: NRG; PAM sequence: AAG
gtccacagagttgttgtttt

SEQ ID NO: 18094 - DNA, 20 bp, Artificial Sequence
  Description of Artificial Sequence: Synthetic oligonucleotide
  Target: SCN10A; (-) strand; PAM type: NRG; PAM sequence: GAG
gcctctgtgaccagtccaca

SEQ ID NO: 18095 - DNA, 20 bp, Artificial Sequence
  Description of Artificial Sequence: Synthetic oligonucleotide
  Target: SCN10A; (-) strand; PAM type: NRG; PAM sequence: CAG
ctgcctctgtgaccagtcca

SEQ ID NO: 18096 - DNA, 20 bp, Artificial Sequence
  Description of Artificial Sequence: Synthetic oligonucleotide
  Target: SCN10A; (-) strand; PAM type: NRG; PAM sequence: CAG
ttatcagctgcctctgtgac

SEQ ID NO: 18097 - DNA, 20 bp, Artificial Sequence
  Description of Artificial Sequence: Synthetic oligonucleotide
  Target: SCN10A; (-) strand; PAM type: NRG; PAM sequence: CAG
cagtttttatttgtgtttat

SEQ ID NO: 18098 - DNA, 20 bp, Artificial Sequence
  Description of Artificial Sequence: Synthetic oligonucleotide
  Target: SCN10A; (-) strand; PAM type: NRG; PAM sequence: CAG
ccatactagttactaatgct

SEQ ID NO: 18099 - DNA, 20 bp, Artificial Sequence
  Description of Artificial Sequence: Synthetic oligonucleotide
  Target: SCN10A; (-) strand; PAM type: NRG; PAM sequence: TAG
acgtttcctgctccccatac

SEQ ID NO: 18100 - DNA, 20 bp, Artificial Sequence
  Description of Artificial Sequence: Synthetic oligonucleotide
  Target: SCN10A; (-) strand; PAM type: NRG; PAM sequence: TGG
ttacaaccttcggcaggcca

SEQ ID NO: 18101 - DNA, 20 bp, Artificial Sequence
  Description of Artificial Sequence: Synthetic oligonucleotide
  Target: SCN10A; (-) strand; PAM type: NRG; PAM sequence: AGG
ctaggcttacaaccttcggc

SEQ ID NO: 18102 - DNA, 20 bp, Artificial Sequence
  Description of Artificial Sequence: Synthetic oligonucleotide
  Target: SCN10A; (-) strand; PAM type: NRG; PAM sequence: CAG
gctaggcttacaaccttcgg

SEQ ID NO: 18103 - DNA, 20 bp, Artificial Sequence
  Description of Artificial Sequence: Synthetic oligonucleotide
  Target: SCN10A; (-) strand; PAM type: NRG; PAM sequence: CGG
cctgctaggcttacaacctt

SEQ ID NO: 18104 - DNA, 20 bp, Artificial Sequence
  Description of Artificial Sequence: Synthetic oligonucleotide
  Target: SCN10A; (-) strand; PAM type: NRG; PAM sequence: AGG
agcagggagaaattcctgct

SEQ ID NO: 18105 - DNA, 20 bp, Artificial Sequence
  Description of Artificial Sequence: Synthetic oligonucleotide
  Target: SCN10A; (-) strand; PAM type: NRG; PAM sequence: TAG
aagcagggagaaattcctgc

SEQ ID NO: 18106 - DNA, 20 bp, Artificial Sequence
  Description of Artificial Sequence: Synthetic oligonucleotide
  Target: SCN10A; (-) strand; PAM type: NRG; PAM sequence: GAG
ggatctagtcttaaagcagg

SEQ ID NO: 18107 - DNA, 20 bp, Artificial Sequence
  Description of Artificial Sequence: Synthetic oligonucleotide
  Target: SCN10A; (-) strand; PAM type: NRG; PAM sequence: GGG
tgggatctagtcttaaagca

SEQ ID NO: 18108 - DNA, 20 bp, Artificial Sequence
  Description of Artificial Sequence: Synthetic oligonucleotide
  Target: SCN10A; (-) strand; PAM type: NRG; PAM sequence: AGG
ttgggatctagtcttaaagc

SEQ ID NO: 18109 - DNA, 20 bp, Artificial Sequence
  Description of Artificial Sequence: Synthetic oligonucleotide
  Target: SCN10A; (-) strand; PAM type: NRG; PAM sequence: CAG
tttgggatctagtcttaaag

SEQ ID NO: 18110 - DNA, 20 bp, Artificial Sequence
  Description of Artificial Sequence: Synthetic oligonucleotide
  Target: SCN10A; (-) strand; PAM type: NRG; PAM sequence: AAG
ctctttgggatctagtctta

SEQ ID NO: 18111 - DNA, 20 bp, Artificial Sequence
  Description of Artificial Sequence: Synthetic oligonucleotide
  Target: SCN10A; (-) strand; PAM type: NRG; PAM sequence: TAG
gggtatagctctttgggatc

SEQ ID NO: 18112 - DNA, 20 bp, Artificial Sequence
  Description of Artificial Sequence: Synthetic oligonucleotide
  Target: SCN10A; (-) strand; PAM type: NRG; PAM sequence: GGG
catgaagggtatagctcttt

SEQ ID NO: 18113 - DNA, 20 bp, Artificial Sequence
  Description of Artificial Sequence: Synthetic oligonucleotide
  Target: SCN10A; (-) strand; PAM type: NRG; PAM sequence: TGG
acatgaagggtatagctctt

SEQ ID NO: 18114 - DNA, 20 bp, Artificial Sequence
  Description of Artificial Sequence: Synthetic oligonucleotide
  Target: SCN10A; (-) strand; PAM type: NRG; PAM sequence: TAG
tcatccttacatgaagggta

SEQ ID NO: 18115 - DNA, 20 bp, Artificial Sequence
  Description of Artificial Sequence: Synthetic oligonucleotide
  Target: SCN10A; (-) strand; PAM type: NRG; PAM sequence: GGG
gtggttcatccttacatgaa

SEQ ID NO: 18116 - DNA, 20 bp, Artificial Sequence
  Description of Artificial Sequence: Synthetic oligonucleotide
  Target: SCN10A; (-) strand; PAM type: NRG; PAM sequence: AGG
tgtggttcatccttacatga

SEQ ID NO: 18117 - DNA, 20 bp, Artificial Sequence
  Description of Artificial Sequence: Synthetic oligonucleotide
  Target: SCN10A; (-) strand; PAM type: NRG; PAM sequence: AAG
ttgtggttcatccttacatg

SEQ ID NO: 18118 - DNA, 20 bp, Artificial Sequence
  Description of Artificial Sequence: Synthetic oligonucleotide
  Target: SCN10A; (-) strand; PAM type: NRG; PAM sequence: TGG
cattctcctgggattgtttg

SEQ ID NO: 18119 - DNA, 20 bp, Artificial Sequence
  Description of Artificial Sequence: Synthetic oligonucleotide
  Target: SCN10A; (-) strand; PAM type: NRG; PAM sequence: GGG
aattttccttgcattctcct

SEQ ID NO: 18120 - DNA, 20 bp, Artificial Sequence
  Description of Artificial Sequence: Synthetic oligonucleotide
  Target: SCN10A; (-) strand; PAM type: NRG; PAM sequence: TGG
caattttccttgcattctcc

SEQ ID NO: 18121 - DNA, 20 bp, Artificial Sequence
  Description of Artificial Sequence: Synthetic oligonucleotide
  Target: SCN10A; (-) strand; PAM type: NRG; PAM sequence: CAG
ctgtagctggtacctaacac

SEQ ID NO: 18122 - DNA, 20 bp, Artificial Sequence
  Description of Artificial Sequence: Synthetic oligonucleotide
  Target: SCN10A; (-) strand; PAM type: NRG; PAM sequence: TGG
gtcaattttcctcctgtagc

SEQ ID NO: 18123 - DNA, 20 bp, Artificial Sequence
  Description of Artificial Sequence: Synthetic oligonucleotide
  Target: SCN10A; (-) strand; PAM type: NRG; PAM sequence: TAG
cagcgtcaattttcctcctg

SEQ ID NO: 18124 - DNA, 20 bp, Artificial Sequence
  Description of Artificial Sequence: Synthetic oligonucleotide
  Target: SCN10A; (-) strand; PAM type: NRG; PAM sequence: CAG
actttgttgtttcaaatgct

SEQ ID NO: 18125 - DNA, 20 bp, Artificial Sequence
  Description of Artificial Sequence: Synthetic oligonucleotide
  Target: SCN10A; (-) strand; PAM type: NRG; PAM sequence: GAG
ttccagataaaatcctatat

SEQ ID NO: 18126 - DNA, 20 bp, Artificial Sequence
  Description of Artificial Sequence: Synthetic oligonucleotide
  Target: SCN10A; (-) strand; PAM type: NRG; PAM sequence: CAG
tacctaggtagtgtgaattc

SEQ ID NO: 18127 - DNA, 20 bp, Artificial Sequence
  Description of Artificial Sequence: Synthetic oligonucleotide
  Target: SCN10A; (-) strand; PAM type: NRG; PAM sequence: TAG
ctcaacttaaaatacctagg

SEQ ID NO: 18128 - DNA, 20 bp, Artificial Sequence
  Description of Artificial Sequence: Synthetic oligonucleotide
  Target: SCN10A; (-) strand; PAM type: NRG; PAM sequence: AGG
attctcaacttaaaatacct

SEQ ID NO: 18129 - DNA, 20 bp, Artificial Sequence
  Description of Artificial Sequence: Synthetic oligonucleotide
  Target: SCN10A; (-) strand; PAM type: NRG; PAM sequence: TAG
aattctcaacttaaaatacc

SEQ ID NO: 18130 - DNA, 20 bp, Artificial Sequence
  Description of Artificial Sequence: Synthetic oligonucleotide
  Target: SCN10A; (-) strand; PAM type: NRG; PAM sequence: TAG
taattctgcagagcactttg

SEQ ID NO: 18131 - DNA, 20 bp, Artificial Sequence
  Description of Artificial Sequence: Synthetic oligonucleotide
  Target: SCN10A; (-) strand; PAM type: NRG; PAM sequence: GAG
tatttgcatttaattctgca

SEQ ID NO: 18132 - DNA, 20 bp, Artificial Sequence
  Description of Artificial Sequence: Synthetic oligonucleotide
  Target: SCN10A; (-) strand; PAM type: NRG; PAM sequence: CAG
ggtatttgcatttaattctg

SEQ ID NO: 18133 - DNA, 20 bp, Artificial Sequence
  Description of Artificial Sequence: Synthetic oligonucleotide
  Target: SCN10A; (-) strand; PAM type: NRG; PAM sequence: AGG
ataaaggcaggttcctccag

SEQ ID NO: 18134 - DNA, 20 bp, Artificial Sequence
  Description of Artificial Sequence: Synthetic oligonucleotide
  Target: SCN10A; (-) strand; PAM type: NRG; PAM sequence: GAG
gataaaggcaggttcctcca

SEQ ID NO: 18135 - DNA, 20 bp, Artificial Sequence
  Description of Artificial Sequence: Synthetic oligonucleotide
  Target: SCN10A; (-) strand; PAM type: NRG; PAM sequence: CAG
gagataaaggcaggttcctc

SEQ ID NO: 18136 - DNA, 20 bp, Artificial Sequence
  Description of Artificial Sequence: Synthetic oligonucleotide
  Target: SCN10A; (-) strand; PAM type: NRG; PAM sequence: AGG
ttgaaacctgagataaaggc

SEQ ID NO: 18137 - DNA, 20 bp, Artificial Sequence
  Description of Artificial Sequence: Synthetic oligonucleotide
  Target: SCN10A; (-) strand; PAM type: NRG; PAM sequence: CAG
tttgaaacctgagataaagg

SEQ ID NO: 18138 - DNA, 20 bp, Artificial Sequence
  Description of Artificial Sequence: Synthetic oligonucleotide
  Target: SCN10A; (-) strand; PAM type: NRG; PAM sequence: AGG
tagtttgaaacctgagataa

SEQ ID NO: 18139 - DNA, 20 bp, Artificial Sequence
  Description of Artificial Sequence: Synthetic oligonucleotide
  Target: SCN10A; (-) strand; PAM type: NRG; PAM sequence: AAG
atagtttgaaacctgagata

SEQ ID NO: 18140 - DNA, 20 bp, Artificial Sequence
  Description of Artificial Sequence: Synthetic oligonucleotide
  Target: SCN10A; (-) strand; PAM type: NRG; PAM sequence: GAG
gagggaatagtttgaaacct

SEQ ID NO: 18141 - DNA, 20 bp, Artificial Sequence
  Description of Artificial Sequence: Synthetic oligonucleotide
  Target: SCN10A; (-) strand; PAM type: NRG; PAM sequence: TAG
ttaaacaatttttgagggaa

SEQ ID NO: 18142 - DNA, 20 bp, Artificial Sequence
  Description of Artificial Sequence: Synthetic oligonucleotide
  Target: SCN10A; (-) strand; PAM type: NRG; PAM sequence: GGG
aactcttaaacaatttttga

SEQ ID NO: 18143 - DNA, 20 bp, Artificial Sequence
  Description of Artificial Sequence: Synthetic oligonucleotide
  Target: SCN10A; (-) strand; PAM type: NRG; PAM sequence: AGG
caactcttaaacaatttttg

SEQ ID NO: 18144 - DNA, 20 bp, Artificial Sequence
  Description of Artificial Sequence: Synthetic oligonucleotide
  Target: SCN10A; (-) strand; PAM type: NRG; PAM sequence: GAG
gcaactcttaaacaattttt

SEQ ID NO: 18145 - DNA, 20 bp, Artificial Sequence
  Description of Artificial Sequence: Synthetic oligonucleotide
  Target: SCN10A; (-) strand; PAM type: NRG; PAM sequence: AAG
tccacatctgtggtttcttc

SEQ ID NO: 18146 - DNA, 20 bp, Artificial Sequence
  Description of Artificial Sequence: Synthetic oligonucleotide
  Target: SCN10A; (-) strand; PAM type: NRG; PAM sequence: TGG
aatgactatttccacatctg

SEQ ID NO: 18147 - DNA, 20 bp, Artificial Sequence
  Description of Artificial Sequence: Synthetic oligonucleotide
  Target: SCN10A; (-) strand; PAM type: NRG; PAM sequence: TGG
aattctatcatctgaagaaa

SEQ ID NO: 18148 - DNA, 20 bp, Artificial Sequence
  Description of Artificial Sequence: Synthetic oligonucleotide
  Target: SCN10A; (-) strand; PAM type: NRG; PAM sequence: AAG
actaataattctatcatctg

SEQ ID NO: 18149 - DNA, 20 bp, Artificial Sequence
  Description of Artificial Sequence: Synthetic oligonucleotide
  Target: SCN10A; (-) strand; PAM type: NRG; PAM sequence: AAG
tattctctgcacatagtttc

SEQ ID NO: 18150 - DNA, 20 bp, Artificial Sequence
  Description of Artificial Sequence: Synthetic oligonucleotide
  Target: SCN10A; (-) strand; PAM type: NRG; PAM sequence: TAG
gtttttttattctctgcaca

SEQ ID NO: 18151 - DNA, 20 bp, Artificial Sequence
  Description of Artificial Sequence: Synthetic oligonucleotide
  Target: SCN10A; (-) strand; PAM type: NRG; PAM sequence: TAG
caacttgttattgttatcta

SEQ ID NO: 18152 - DNA, 20 bp, Artificial Sequence
  Description of Artificial Sequence: Synthetic oligonucleotide
  Target: SCN10A; (-) strand; PAM type: NRG; PAM sequence: GAG
attatatttttcatttctaa

SEQ ID NO: 18153 - DNA, 20 bp, Artificial Sequence
  Description of Artificial Sequence: Synthetic oligonucleotide
  Target: SCN10A; (-) strand; PAM type: NRG; PAM sequence: AAG
gtattatatttttcatttct

SEQ ID NO: 18154 - DNA, 20 bp, Artificial Sequence
  Description of Artificial Sequence: Synthetic oligonucleotide
  Target: SCN10A; (-) strand; PAM type: NRG; PAM sequence: AAG
ttcataatatttttaatttt

SEQ ID NO: 18155 - DNA, 20 bp, Artificial Sequence
  Description of Artificial Sequence: Synthetic oligonucleotide
  Target: SCN10A; (-) strand; PAM type: NRG; PAM sequence: CAG
aatttattctgatatatcct

SEQ ID NO: 18156 - DNA, 20 bp, Artificial Sequence
  Description of Artificial Sequence: Synthetic oligonucleotide
  Target: SCN10A; (-) strand; PAM type: NRG; PAM sequence: AGG
ttttcatcttatgtctctct

SEQ ID NO: 18157 - DNA, 20 bp, Artificial Sequence
  Description of Artificial Sequence: Synthetic oligonucleotide
  Target: SCN10A; (-) strand; PAM type: NRG; PAM sequence: TAG
tttttcatcttatgtctctc

SEQ ID NO: 18158 - DNA, 20 bp, Artificial Sequence
  Description of Artificial Sequence: Synthetic oligonucleotide
  Target: SCN10A; (-) strand; PAM type: NRG; PAM sequence: TAG
ccttctggactttggttaga

SEQ ID NO: 18159 - DNA, 20 bp, Artificial Sequence
  Description of Artificial Sequence: Synthetic oligonucleotide
  Target: SCN10A; (-) strand; PAM type: NRG; PAM sequence: TAG
ttctccttctggactttggt

SEQ ID NO: 18160 - DNA, 20 bp, Artificial Sequence
  Description of Artificial Sequence: Synthetic oligonucleotide
  Target: SCN10A; (-) strand; PAM type: NRG; PAM sequence: TGG
ttttttctccttctggactt

SEQ ID NO: 18161 - DNA, 20 bp, Artificial Sequence
  Description of Artificial Sequence: Synthetic oligonucleotide
  Target: SCN10A; (-) strand; PAM type: NRG; PAM sequence: TGG
cattctattttttctccttc

SEQ ID NO: 18162 - DNA, 20 bp, Artificial Sequence
  Description of Artificial Sequence: Synthetic oligonucleotide
  Target: SCN10A; (-) strand; PAM type: NRG; PAM sequence: TAG
agacatgatgtgggcagtca

SEQ ID NO: 18163 - DNA, 20 bp, Artificial Sequence
  Description of Artificial Sequence: Synthetic oligonucleotide
  Target: SCN10A; (-) strand; PAM type: NRG; PAM sequence: CAG
gttcccagacatgatgtggg

SEQ ID NO: 18164 - DNA, 20 bp, Artificial Sequence
  Description of Artificial Sequence: Synthetic oligonucleotide
  Target: SCN10A; (-) strand; PAM type: NRG; PAM sequence: GGG
aaagttcccagacatgatgt

SEQ ID NO: 18165 - DNA, 20 bp, Artificial Sequence
  Description of Artificial Sequence: Synthetic oligonucleotide
  Target: SCN10A; (-) strand; PAM type: NRG; PAM sequence: TGG
gaaagttcccagacatgatg

SEQ ID NO: 18166 - DNA, 20 bp, Artificial Sequence
  Description of Artificial Sequence: Synthetic oligonucleotide
  Target: SCN10A; (-) strand; PAM type: NRG; PAM sequence: CAG
cttcaattctggaaagttcc

SEQ ID NO: 18167 - DNA, 20 bp, Artificial Sequence
  Description of Artificial Sequence: Synthetic oligonucleotide
  Target: SCN10A; (-) strand; PAM type: NRG; PAM sequence: AAG
taattttcttcaattctgga

SEQ ID NO: 18168 - DNA, 20 bp, Artificial Sequence
  Description of Artificial Sequence: Synthetic oligonucleotide
  Target: SCN10A; (-) strand; PAM type: NRG; PAM sequence: TGG
tttgtaattttcttcaattc

SEQ ID NO: 18169 - DNA, 20 bp, Artificial Sequence
  Description of Artificial Sequence: Synthetic oligonucleotide
  Target: SCN10A; (-) strand; PAM type: NRG; PAM sequence: TAG
atactgacttcttgaatctt

SEQ ID NO: 18170 - DNA, 20 bp, Artificial Sequence
  Description of Artificial Sequence: Synthetic oligonucleotide
  Target: SCN10A; (-) strand; PAM type: NRG; PAM sequence: AAG
tctttccatttataatgctt

SEQ ID NO: 18171 - DNA, 20 bp, Artificial Sequence
  Description of Artificial Sequence: Synthetic oligonucleotide
  Target: SCN10A; (-) strand; PAM type: NRG; PAM sequence: TGG
cactgtaatatgtctaggtg

SEQ ID NO: 18172 - DNA, 20 bp, Artificial Sequence
  Description of Artificial Sequence: Synthetic oligonucleotide
  Target: SCN10A; (-) strand; PAM type: NRG; PAM sequence: AGG
agtttcactgtaatatgtct

SEQ ID NO: 18173 - DNA, 20 bp, Artificial Sequence
  Description of Artificial Sequence: Synthetic oligonucleotide
  Target: SCN10A; (-) strand; PAM type: NRG; PAM sequence: TAG
cagtttcactgtaatatgtc

SEQ ID NO: 18174 - DNA, 20 bp, Artificial Sequence
  Description of Artificial Sequence: Synthetic oligonucleotide
  Target: SCN10A; (-) strand; PAM type: NRG; PAM sequence: CAG
tatccatctttggtgttctg

SEQ ID NO: 18175 - DNA, 20 bp, Artificial Sequence
  Description of Artificial Sequence: Synthetic oligonucleotide
  Target: SCN10A; (-) strand; PAM type: NRG; PAM sequence: TGG
ttaaatcttctatccatctt

SEQ ID NO: 18176 - DNA, 20 bp, Artificial Sequence
  Description of Artificial Sequence: Synthetic oligonucleotide
  Target: SCN10A; (-) strand; PAM type: NRG; PAM sequence: TGG
aactgttattccttcctttc

SEQ ID NO: 18177 - DNA, 20 bp, Artificial Sequence
  Description of Artificial Sequence: Synthetic oligonucleotide
  Target: SCN10A; (-) strand; PAM type: NRG; PAM sequence: CAG
cattgttgctaatgagcagt

SEQ ID NO: 18178 - DNA, 20 bp, Artificial Sequence
  Description of Artificial Sequence: Synthetic oligonucleotide
  Target: SCN10A; (-) strand; PAM type: NRG; PAM sequence: CAG
cctccattgttgctaatgag

SEQ ID NO: 18179 - DNA, 20 bp, Artificial Sequence
  Description of Artificial Sequence: Synthetic oligonucleotide
  Target: SCN10A; (-) strand; PAM type: NRG; PAM sequence: GAG
tagcctccattgttgctaat

SEQ ID NO: 18180 - DNA, 20 bp, Artificial Sequence
  Description of Artificial Sequence: Synthetic oligonucleotide
  Target: SCN10A; (-) strand; PAM type: NRG; PAM sequence: TAG
gaagatagtattccaacaat

SEQ ID NO: 18181 - DNA, 20 bp, Artificial Sequence
  Description of Artificial Sequence: Synthetic oligonucleotide
  Target: SCN10A; (-) strand; PAM type: NRG; PAM sequence: TAG
ttatcttccttcagtgaaga

SEQ ID NO: 18182 - DNA, 20 bp, Artificial Sequence
  Description of Artificial Sequence: Synthetic oligonucleotide
  Target: SCN10A; (-) strand; PAM type: NRG; PAM sequence: AAG
tactttatcttccttcagtg

SEQ ID NO: 18183 - DNA, 20 bp, Artificial Sequence
  Description of Artificial Sequence: Synthetic oligonucleotide
  Target: SCN10A; (-) strand; PAM type: NRG; PAM sequence: CAG
gttgatactttatcttcctt

SEQ ID NO: 18184 - DNA, 20 bp, Artificial Sequence
  Description of Artificial Sequence: Synthetic oligonucleotide
  Target: SCN10A; (-) strand; PAM type: NRG; PAM sequence: TAG
ttcttatgaatgtaaaattc

SEQ ID NO: 18185 - DNA, 20 bp, Artificial Sequence
  Description of Artificial Sequence: Synthetic oligonucleotide
  Target: SCN10A; (-) strand; PAM type: NRG; PAM sequence: GAG
cagtttgcccgtgtctttga

SEQ ID NO: 18186 - DNA, 20 bp, Artificial Sequence
  Description of Artificial Sequence: Synthetic oligonucleotide
  Target: SCN10A; (-) strand; PAM type: NRG; PAM sequence: GAG
ttcagtttgcccgtgtcttt

SEQ ID NO: 18187 - DNA, 20 bp, Artificial Sequence
  Description of Artificial Sequence: Synthetic oligonucleotide
  Target: SCN10A; (-) strand; PAM type: NRG; PAM sequence: CAG
tttatctgaaatttgctctt

SEQ ID NO: 18188 - DNA, 20 bp, Artificial Sequence
  Description of Artificial Sequence: Synthetic oligonucleotide
  Target: SCN10A; (-) strand; PAM type: NRG; PAM sequence: TGG
ttcttttagtaagtgccttc

SEQ ID NO: 18189 - DNA, 20 bp, Artificial Sequence
  Description of Artificial Sequence: Synthetic oligonucleotide
  Target: SCN10A; (-) strand; PAM type: NRG; PAM sequence: AAG
cctttagaatttcttttagt

SEQ ID NO: 18190 - DNA, 20 bp, Artificial Sequence
  Description of Artificial Sequence: Synthetic oligonucleotide
  Target: SCN10A; (-) strand; PAM type: NRG; PAM sequence: TAG
acctcctttagaatttcttt

SEQ ID NO: 18191 - DNA, 20 bp, Artificial Sequence
  Description of Artificial Sequence: Synthetic oligonucleotide
  Target: SCN10A; (-) strand; PAM type: NRG; PAM sequence: TAG
tctacctgaagtacctcctt

SEQ ID NO: 18192 - DNA, 20 bp, Artificial Sequence
  Description of Artificial Sequence: Synthetic oligonucleotide
  Target: SCN10A; (-) strand; PAM type: NRG; PAM sequence: AAG
gatcactttctatctacctg

SEQ ID NO: 18193 - DNA, 20 bp, Artificial Sequence
  Description of Artificial Sequence: Synthetic oligonucleotide
  Target: SCN10A; (-) strand; PAM type: NRG; PAM sequence: GGG
acacattacatattacttct

SEQ ID NO: 18194 - DNA, 20 bp, Artificial Sequence
  Description of Artificial Sequence: Synthetic oligonucleotide
  Target: SCN10A; (-) strand; PAM type: NRG; PAM sequence: TGG
tacacattacatattacttc

SEQ ID NO: 18195 - DNA, 20 bp, Artificial Sequence
  Description of Artificial Sequence: Synthetic oligonucleotide
  Target: SCN10A; (-) strand; PAM type: NRG; PAM sequence: CAG
ttcttcaaccctttggagca

SEQ ID NO: 18196 - DNA, 20 bp, Artificial Sequence
  Description of Artificial Sequence: Synthetic oligonucleotide
  Target: SCN10A; (-) strand; PAM type: NRG; PAM sequence: GAG
ttgatttcttcaaccctttg

SEQ ID NO: 18197 - DNA, 20 bp, Artificial Sequence
  Description of Artificial Sequence: Synthetic oligonucleotide
  Target: SCN10A; (-) strand; PAM type: NRG; PAM sequence: TGG
tattgatttcttcaaccctt

SEQ ID NO: 18198 - DNA, 20 bp, Artificial Sequence
  Description of Artificial Sequence: Synthetic oligonucleotide
  Target: SCN10A; (-) strand; PAM type: NRG; PAM sequence: TAG
atcctgtaagcctaaaaatt

SEQ ID NO: 18199 - DNA, 20 bp, Artificial Sequence
  Description of Artificial Sequence: Synthetic oligonucleotide
  Target: SCN10A; (-) strand; PAM type: NRG; PAM sequence: AAG
tttcttatctggtatcctgt

SEQ ID NO: 18200 - DNA, 20 bp, Artificial Sequence
  Description of Artificial Sequence: Synthetic oligonucleotide
  Target: SCN10A; (-) strand; PAM type: NRG; PAM sequence: TGG
tcagtgagttatttcttatc

SEQ ID NO: 18201 - DNA, 20 bp, Artificial Sequence
  Description of Artificial Sequence: Synthetic oligonucleotide
  Target: SCN10A; (-) strand; PAM type: NRG; PAM sequence: GAG
ttgagtttcagattttcagt

SEQ ID NO: 18202 - DNA, 20 bp, Artificial Sequence
  Description of Artificial Sequence: Synthetic oligonucleotide
  Target: SCN10A; (-) strand; PAM type: NRG; PAM sequence: CAG
cagtttgagtttcagatttt

SEQ ID NO: 18203 - DNA, 20 bp, Artificial Sequence
  Description of Artificial Sequence: Synthetic oligonucleotide
  Target: SCN10A; (-) strand; PAM type: NRG; PAM sequence: CAG
ttggaacacagtttgagttt

SEQ ID NO: 18204 - DNA, 20 bp, Artificial Sequence
  Description of Artificial Sequence: Synthetic oligonucleotide
  Target: SCN10A; (-) strand; PAM type: NRG; PAM sequence: GAG
tactctttggaacacagttt

SEQ ID NO: 18205 - DNA, 20 bp, Artificial Sequence
  Description of Artificial Sequence: Synthetic oligonucleotide
  Target: SCN10A; (-) strand; PAM type: NRG; PAM sequence: CAG
atttcttactctttggaaca

SEQ ID NO: 18206 - DNA, 20 bp, Artificial Sequence
  Description of Artificial Sequence: Synthetic oligonucleotide
  Target: SCN10A; (-) strand; PAM type: NRG; PAM sequence: TGG
gttactgatttcttactctt

SEQ ID NO: 18207 - DNA, 20 bp, Artificial Sequence
  Description of Artificial Sequence: Synthetic oligonucleotide
  Target: SCN10A; (-) strand; PAM type: NRG; PAM sequence: AAG
aaaaactcaagaatttttgt

SEQ ID NO: 18208 - DNA, 20 bp, Artificial Sequence
  Description of Artificial Sequence: Synthetic oligonucleotide
  Target: SCN10A; (-) strand; PAM type: NRG; PAM sequence: AAG
atctgctatcctaaaaactc

SEQ ID NO: 18209 - DNA, 20 bp, Artificial Sequence
  Description of Artificial Sequence: Synthetic oligonucleotide
  Target: SCN10A; (-) strand; PAM type: NRG; PAM sequence: AAG
gggagtttcagtgtctcagc

SEQ ID NO: 18210 - DNA, 20 bp, Artificial Sequence
  Description of Artificial Sequence: Synthetic oligonucleotide
  Target: SCN10A; (-) strand; PAM type: NRG; PAM sequence: CAG
gggagggagtttcagtgtct

SEQ ID NO: 18211 - DNA, 20 bp, Artificial Sequence
  Description of Artificial Sequence: Synthetic oligonucleotide
  Target: SCN10A; (-) strand; PAM type: NRG; PAM sequence: CAG
cacacaaggggagggagttt

SEQ ID NO: 18212 - DNA, 20 bp, Artificial Sequence
  Description of Artificial Sequence: Synthetic oligonucleotide
  Target: SCN10A; (-) strand; PAM type: NRG; PAM sequence: GAG
catcatcacacaaggggagg

SEQ ID NO: 18213 - DNA, 20 bp, Artificial Sequence
  Description of Artificial Sequence: Synthetic oligonucleotide
  Target: SCN10A; (-) strand; PAM type: NRG; PAM sequence: GGG
ttcatcatcacacaagggga

SEQ ID NO: 18214 - DNA, 20 bp, Artificial Sequence
  Description of Artificial Sequence: Synthetic oligonucleotide
  Target: SCN10A; (-) strand; PAM type: NRG; PAM sequence: AGG
tttcatcatcacacaagggg

SEQ ID NO: 18215 - DNA, 20 bp, Artificial Sequence
  Description of Artificial Sequence: Synthetic oligonucleotide
  Target: SCN10A; (-) strand; PAM type: NRG; PAM sequence: GAG
ttttcatcatcacacaaggg

SEQ ID NO: 18216 - DNA, 20 bp, Artificial Sequence
  Description of Artificial Sequence: Synthetic oligonucleotide
  Target: SCN10A; (-) strand; PAM type: NRG; PAM sequence: GGG
ttttttcatcatcacacaag

SEQ ID NO: 18217 - DNA, 20 bp, Artificial Sequence
  Description of Artificial Sequence: Synthetic oligonucleotide
  Target: SCN10A; (-) strand; PAM type: NRG; PAM sequence: GGG
gttttttcatcatcacacaa

SEQ ID NO: 18218 - DNA, 20 bp, Artificial Sequence
  Description of Artificial Sequence: Synthetic oligonucleotide
  Target: SCN10A; (-) strand; PAM type: NRG; PAM sequence: AGG
tgttttttcatcatcacaca

SEQ ID NO: 18219 - DNA, 20 bp, Artificial Sequence
  Description of Artificial Sequence: Synthetic oligonucleotide
  Target: SCN10A; (-) strand; PAM type: NRG; PAM sequence: AAG
ctgttttttcatcatcacac

SEQ ID NO: 18220 - DNA, 20 bp, Artificial Sequence
  Description of Artificial Sequence: Synthetic oligonucleotide
  Target: SCN10A; (-) strand; PAM type: NRG; PAM sequence: CAG
atcctggttccaattgattt

SEQ ID NO: 18221 - DNA, 20 bp, Artificial Sequence
  Description of Artificial Sequence: Synthetic oligonucleotide
  Target: SCN10A; (-) strand; PAM type: NRG; PAM sequence: TGG
caaactccagtcggccatcc

SEQ ID NO: 18222 - DNA, 20 bp, Artificial Sequence
  Description of Artificial Sequence: Synthetic oligonucleotide
  Target: SCN10A; (-) strand; PAM type: NRG; PAM sequence: CGG
cattctgcacaaactccagt

SEQ ID NO: 18223 - DNA, 20 bp, Artificial Sequence
  Description of Artificial Sequence: Synthetic oligonucleotide
  Target: SCN10A; (-) strand; PAM type: NRG; PAM sequence: CAG
agctcattctgcacaaactc

SEQ ID NO: 18224 - DNA, 20 bp, Artificial Sequence
  Description of Artificial Sequence: Synthetic oligonucleotide
  Target: SCN10A; (-) strand; PAM type: NRG; PAM sequence: AAG
attcagtccatgacgtcagc

SEQ ID NO: 18225 - DNA, 20 bp, Artificial Sequence
  Description of Artificial Sequence: Synthetic oligonucleotide
  Target: SCN10A; (-) strand; PAM type: NRG; PAM sequence: CAG
ggaaattcagtccatgacgt

SEQ ID NO: 18226 - DNA, 20 bp, Artificial Sequence
  Description of Artificial Sequence: Synthetic oligonucleotide
  Target: SCN10A; (-) strand; PAM type: NRG; PAM sequence: CAG
tgcaatatgaagtggaaatt

SEQ ID NO: 18227 - DNA, 20 bp, Artificial Sequence
  Description of Artificial Sequence: Synthetic oligonucleotide
  Target: SCN10A; (-) strand; PAM type: NRG; PAM sequence: TGG
agttagtatgcaatatgaag

SEQ ID NO: 18228 - DNA, 20 bp, Artificial Sequence
  Description of Artificial Sequence: Synthetic oligonucleotide
  Target: SCN10A; (-) strand; PAM type: NRG; PAM sequence: AAG
gggagttagtatgcaatatg

SEQ ID NO: 18229 - DNA, 20 bp, Artificial Sequence
  Description of Artificial Sequence: Synthetic oligonucleotide
  Target: SCN10A; (-) strand; PAM type: NRG; PAM sequence: TAG
tatgcaaatctggggggagt

SEQ ID NO: 18230 - DNA, 20 bp, Artificial Sequence
  Description of Artificial Sequence: Synthetic oligonucleotide
  Target: SCN10A; (-) strand; PAM type: NRG; PAM sequence: GAG
tgcatatgcaaatctggggg

SEQ ID NO: 18231 - DNA, 20 bp, Artificial Sequence
  Description of Artificial Sequence: Synthetic oligonucleotide
  Target: SCN10A; (-) strand; PAM type: NRG; PAM sequence: GGG
gttgcatatgcaaatctggg

SEQ ID NO: 18232 - DNA, 20 bp, Artificial Sequence
  Description of Artificial Sequence: Synthetic oligonucleotide
  Target: SCN10A; (-) strand; PAM type: NRG; PAM sequence: GGG
ggttgcatatgcaaatctgg

SEQ ID NO: 18233 - DNA, 20 bp, Artificial Sequence
  Description of Artificial Sequence: Synthetic oligonucleotide
  Target: SCN10A; (-) strand; PAM type: NRG; PAM sequence: GGG
gggttgcatatgcaaatctg

SEQ ID NO: 18234 - DNA, 20 bp, Artificial Sequence
  Description of Artificial Sequence: Synthetic oligonucleotide
  Target: SCN10A; (-) strand; PAM type: NRG; PAM sequence: GGG
tgggttgcatatgcaaatct

SEQ ID NO: 18235 - DNA, 20 bp, Artificial Sequence
  Description of Artificial Sequence: Synthetic oligonucleotide
  Target: SCN10A; (-) strand; PAM type: NRG; PAM sequence: TGG
atgggttgcatatgcaaatc

SEQ ID NO: 18236 - DNA, 20 bp, Artificial Sequence
  Description of Artificial Sequence: Synthetic oligonucleotide
  Target: SCN10A; (-) strand; PAM type: NRG; PAM sequence: GGG
atctcttcatgcttactcat

SEQ ID NO: 18237 - DNA, 20 bp, Artificial Sequence
  Description of Artificial Sequence: Synthetic oligonucleotide
  Target: SCN10A; (-) strand; PAM type: NRG; PAM sequence: TGG
tatctcttcatgcttactca

SEQ ID NO: 18238 - DNA, 20 bp, Artificial Sequence
  Description of Artificial Sequence: Synthetic oligonucleotide
  Target: SCN10A; (-) strand; PAM type: NRG; PAM sequence: CAG
ggagagtccatgggcctgca

SEQ ID NO: 18239 - DNA, 20 bp, Artificial Sequence
  Description of Artificial Sequence: Synthetic oligonucleotide
  Target: SCN10A; (-) strand; PAM type: NRG; PAM sequence: GGG
gggaggtttggagagtccat

SEQ ID NO: 18240 - DNA, 20 bp, Artificial Sequence
  Description of Artificial Sequence: Synthetic oligonucleotide
  Target: SCN10A; (-) strand; PAM type: NRG; PAM sequence: TGG
ggggaggtttggagagtcca

SEQ ID NO: 18241 - DNA, 20 bp, Artificial Sequence
  Description of Artificial Sequence: Synthetic oligonucleotide
  Target: SCN10A; (-) strand; PAM type: NRG; PAM sequence: GAG
aaggaaaggggaggtttgga

SEQ ID NO: 18242 - DNA, 20 bp, Artificial Sequence
  Description of Artificial Sequence: Synthetic oligonucleotide
  Target: SCN10A; (-) strand; PAM type: NRG; PAM sequence: GAG
ggaaggaaaggggaggtttg

SEQ ID NO: 18243 - DNA, 20 bp, Artificial Sequence
  Description of Artificial Sequence: Synthetic oligonucleotide
  Target: SCN10A; (-) strand; PAM type: NRG; PAM sequence: TGG
gtggaaggaaaggggaggtt

SEQ ID NO: 18244 - DNA, 20 bp, Artificial Sequence
  Description of Artificial Sequence: Synthetic oligonucleotide
  Target: SCN10A; (-) strand; PAM type: NRG; PAM sequence: AGG
gattggtggaaggaaagggg

SEQ ID NO: 18245 - DNA, 20 bp, Artificial Sequence
  Description of Artificial Sequence: Synthetic oligonucleotide
  Target: SCN10A; (-) strand; PAM type: NRG; PAM sequence: GAG
tgattggtggaaggaaaggg

SEQ ID NO: 18246 - DNA, 20 bp, Artificial Sequence
  Description of Artificial Sequence: Synthetic oligonucleotide
  Target: SCN10A; (-) strand; PAM type: NRG; PAM sequence: GGG
ggtgattggtggaaggaaag

SEQ ID NO: 18247 - DNA, 20 bp, Artificial Sequence
  Description of Artificial Sequence: Synthetic oligonucleotide
  Target: SCN10A; (-) strand; PAM type: NRG; PAM sequence: GGG
aggtgattggtggaaggaaa

SEQ ID NO: 18248 - DNA, 20 bp, Artificial Sequence
  Description of Artificial Sequence: Synthetic oligonucleotide
  Target: SCN10A; (-) strand; PAM type: NRG; PAM sequence: AGG
caggtgattggtggaaggaa

SEQ ID NO: 18249 - DNA, 20 bp, Artificial Sequence
  Description of Artificial Sequence: Synthetic oligonucleotide
  Target: SCN10A; (-) strand; PAM type: NRG; PAM sequence: AAG
gcaggtgattggtggaagga

SEQ ID NO: 18250 - DNA, 20 bp, Artificial Sequence
  Description of Artificial Sequence: Synthetic oligonucleotide
  Target: SCN10A; (-) strand; PAM type: NRG; PAM sequence: AGG
atttgcaggtgattggtgga

SEQ ID NO: 18251 - DNA, 20 bp, Artificial Sequence
  Description of Artificial Sequence: Synthetic oligonucleotide
  Target: SCN10A; (-) strand; PAM type: NRG; PAM sequence: AAG
gatttgcaggtgattggtgg

SEQ ID NO: 18252 - DNA, 20 bp, Artificial Sequence
  Description of Artificial Sequence: Synthetic oligonucleotide
  Target: SCN10A; (-) strand; PAM type: NRG; PAM sequence: TGG
cgggatttgcaggtgattgg

SEQ ID NO: 18253 - DNA, 20 bp, Artificial Sequence
  Description of Artificial Sequence: Synthetic oligonucleotide
  Target: SCN10A; (-) strand; PAM type: NRG; PAM sequence: TGG
taccgggatttgcaggtgat

SEQ ID NO: 18254 - DNA, 20 bp, Artificial Sequence
  Description of Artificial Sequence: Synthetic oligonucleotide
  Target: SCN10A; (-) strand; PAM type: NRG; PAM sequence: AGG
gggtggataccgggatttgc

SEQ ID NO: 18255 - DNA, 20 bp, Artificial Sequence
  Description of Artificial Sequence: Synthetic oligonucleotide
  Target: SCN10A; (-) strand; PAM type: NRG; PAM sequence: CAG
tgggtggataccgggatttg

SEQ ID NO: 18256 - DNA, 20 bp, Artificial Sequence
  Description of Artificial Sequence: Synthetic oligonucleotide
  Target: SCN10A; (-) strand; PAM type: NRG; PAM sequence: GGG
atgtttagtgggtggatacc

SEQ ID NO: 18257 - DNA, 20 bp, Artificial Sequence
  Description of Artificial Sequence: Synthetic oligonucleotide
  Target: SCN10A; (-) strand; PAM type: NRG; PAM sequence: CGG
aatgtttagtgggtggatac

SEQ ID NO: 18258 - DNA, 20 bp, Artificial Sequence
  Description of Artificial Sequence: Synthetic oligonucleotide
  Target: SCN10A; (-) strand; PAM type: NRG; PAM sequence: TGG
attagaaaatgtttagtggg

SEQ ID NO: 18259 - DNA, 20 bp, Artificial Sequence
  Description of Artificial Sequence: Synthetic oligonucleotide
  Target: SCN10A; (-) strand; PAM type: NRG; PAM sequence: GGG
tttattagaaaatgtttagt

SEQ ID NO: 18260 - DNA, 20 bp, Artificial Sequence
  Description of Artificial Sequence: Synthetic oligonucleotide
  Target: SCN10A; (-) strand; PAM type: NRG; PAM sequence: TGG
ttttattagaaaatgtttag

SEQ ID NO: 18261 - DNA, 20 bp, Artificial Sequence
  Description of Artificial Sequence: Synthetic oligonucleotide
  Target: SCN10A; (-) strand; PAM type: NRG; PAM sequence: TAG
tatttttattagaaaatgtt

SEQ ID NO: 18262 - DNA, 20 bp, Artificial Sequence
  Description of Artificial Sequence: Synthetic oligonucleotide
  Target: SCN10A; (-) strand; PAM type: NRG; PAM sequence: TAG
cttcaaggcagtatttttat

SEQ ID NO: 18263 - DNA, 20 bp, Artificial Sequence
  Description of Artificial Sequence: Synthetic oligonucleotide
  Target: SCN10A; (-) strand; PAM type: NRG; PAM sequence: CAG
tccctgtgctgtcttcaagg

SEQ ID NO: 18264 - DNA, 20 bp, Artificial Sequence
  Description of Artificial Sequence: Synthetic oligonucleotide
  Target: SCN10A; (-) strand; PAM type: NRG; PAM sequence: AGG
gtctccctgtgctgtcttca

SEQ ID NO: 18265 - DNA, 20 bp, Artificial Sequence
  Description of Artificial Sequence: Synthetic oligonucleotide
  Target: SCN10A; (-) strand; PAM type: NRG; PAM sequence: AAG
tgtctccctgtgctgtcttc

SEQ ID NO: 18266 - DNA, 20 bp, Artificial Sequence
  Description of Artificial Sequence: Synthetic oligonucleotide
  Target: SCN10A; (-) strand; PAM type: NRG; PAM sequence: CAG
agaagacaggaggtcaagct

SEQ ID NO: 18267 - DNA, 20 bp, Artificial Sequence
  Description of Artificial Sequence: Synthetic oligonucleotide
  Target: SCN10A; (-) strand; PAM type: NRG; PAM sequence: AAG
tggcaagaagacaggaggtc

SEQ ID NO: 18268 - DNA, 20 bp, Artificial Sequence
  Description of Artificial Sequence: Synthetic oligonucleotide
  Target: SCN10A; (-) strand; PAM type: NRG; PAM sequence: AGG
ctggctggcaagaagacagg

SEQ ID NO: 18269 - DNA, 20 bp, Artificial Sequence
  Description of Artificial Sequence: Synthetic oligonucleotide
  Target: SCN10A; (-) strand; PAM type: NRG; PAM sequence: GAG
gctggctggcaagaagacag

SEQ ID NO: 18270 - DNA, 20 bp, Artificial Sequence
  Description of Artificial Sequence: Synthetic oligonucleotide
  Target: SCN10A; (-) strand; PAM type: NRG; PAM sequence: AGG
aagctggctggcaagaagac

SEQ ID NO: 18271 - DNA, 20 bp, Artificial Sequence
  Description of Artificial Sequence: Synthetic oligonucleotide
  Target: SCN10A; (-) strand; PAM type: NRG; PAM sequence: CAG
caagctggctggcaagaaga

SEQ ID NO: 18272 - DNA, 20 bp, Artificial Sequence
  Description of Artificial Sequence: Synthetic oligonucleotide
  Target: SCN10A; (-) strand; PAM type: NRG; PAM sequence: AAG
actgcaagctggctggcaag

SEQ ID NO: 18273 - DNA, 20 bp, Artificial Sequence
  Description of Artificial Sequence: Synthetic oligonucleotide
  Target: SCN10A; (-) strand; PAM type: NRG; PAM sequence: AAG
aatactgcaagctggctggc

SEQ ID NO: 18274 - DNA, 20 bp, Artificial Sequence
  Description of Artificial Sequence: Synthetic oligonucleotide
  Target: SCN10A; (-) strand; PAM type: NRG; PAM sequence: TGG
gcttaatactgcaagctggc

SEQ ID NO: 18275 - DNA, 20 bp, Artificial Sequence
  Description of Artificial Sequence: Synthetic oligonucleotide
  Target: SCN10A; (-) strand; PAM type: NRG; PAM sequence: TGG
aaaagcttaatactgcaagc

SEQ ID NO: 18276 - DNA, 20 bp, Artificial Sequence
  Description of Artificial Sequence: Synthetic oligonucleotide
  Target: SCN10A; (-) strand; PAM type: NRG; PAM sequence: AAG
aaagaaaagcttaatactgc

SEQ ID NO: 18277 - DNA, 20 bp, Artificial Sequence
  Description of Artificial Sequence: Synthetic oligonucleotide
  Target: SCN10A; (-) strand; PAM type: NRG; PAM sequence: AAG
ccaggcttttgagaaaagaa

SEQ ID NO: 18278 - DNA, 20 bp, Artificial Sequence
  Description of Artificial Sequence: Synthetic oligonucleotide
  Target: SCN10A; (-) strand; PAM type: NRG; PAM sequence: AAG
ggacaccaggcttttgagaa

SEQ ID NO: 18279 - DNA, 20 bp, Artificial Sequence
  Description of Artificial Sequence: Synthetic oligonucleotide
  Target: SCN10A; (-) strand; PAM type: NRG; PAM sequence: GAG
gacgaggacaccaggctttt

SEQ ID NO: 18280 - DNA, 20 bp, Artificial Sequence
  Description of Artificial Sequence: Synthetic oligonucleotide
  Target: SCN10A; (-) strand; PAM type: NRG; PAM sequence: AGG
gaagccaagacgaggacacc

SEQ ID NO: 18281 - DNA, 20 bp, Artificial Sequence
  Description of Artificial Sequence: Synthetic oligonucleotide
  Target: SCN10A; (-) strand; PAM type: NRG; PAM sequence: CAG
ggaagccaagacgaggacac

SEQ ID NO: 18282 - DNA, 20 bp, Artificial Sequence
  Description of Artificial Sequence: Synthetic oligonucleotide
  Target: SCN10A; (-) strand; PAM type: NRG; PAM sequence: AGG
tgactttggaagccaagacg

SEQ ID NO: 18283 - DNA, 20 bp, Artificial Sequence
  Description of Artificial Sequence: Synthetic oligonucleotide
  Target: SCN10A; (-) strand; PAM type: NRG; PAM sequence: GAG
atgactttggaagccaagac

SEQ ID NO: 18284 - DNA, 20 bp, Artificial Sequence
  Description of Artificial Sequence: Synthetic oligonucleotide
  Target: SCN10A; (-) strand; PAM type: NRG; PAM sequence: AAG
atactatgactttggaagcc

SEQ ID NO: 18285 - DNA, 20 bp, Artificial Sequence
  Description of Artificial Sequence: Synthetic oligonucleotide
  Target: SCN10A; (-) strand; PAM type: NRG; PAM sequence: AAG
agccaatactatgactttgg

SEQ ID NO: 18286 - DNA, 20 bp, Artificial Sequence
  Description of Artificial Sequence: Synthetic oligonucleotide
  Target: SCN10A; (-) strand; PAM type: NRG; PAM sequence: TGG
agaagccaatactatgactt

SEQ ID NO: 18287 - DNA, 20 bp, Artificial Sequence
  Description of Artificial Sequence: Synthetic oligonucleotide
  Target: SCN10A; (-) strand; PAM type: NRG; PAM sequence: AAG
ctcactgcccaatgctctag

SEQ ID NO: 18288 - DNA, 20 bp, Artificial Sequence
  Description of Artificial Sequence: Synthetic oligonucleotide
  Target: SCN10A; (-) strand; PAM type: NRG; PAM sequence: TAG
gggctcactgcccaatgctc

SEQ ID NO: 18289 - DNA, 20 bp, Artificial Sequence
  Description of Artificial Sequence: Synthetic oligonucleotide
  Target: SCN10A; (-) strand; PAM type: NRG; PAM sequence: GGG
ctttgttatagagccagtgg

SEQ ID NO: 18290 - DNA, 20 bp, Artificial Sequence
  Description of Artificial Sequence: Synthetic oligonucleotide
  Target: SCN10A; (-) strand; PAM type: NRG; PAM sequence: GGG
cctttgttatagagccagtg

SEQ ID NO: 18291 - DNA, 20 bp, Artificial Sequence
  Description of Artificial Sequence: Synthetic oligonucleotide
  Target: SCN10A; (-) strand; PAM type: NRG; PAM sequence: GGG
acctttgttatagagccagt

SEQ ID NO: 18292 - DNA, 20 bp, Artificial Sequence
  Description of Artificial Sequence: Synthetic oligonucleotide
  Target: SCN10A; (-) strand; PAM type: NRG; PAM sequence: TGG
tacctttgttatagagccag

SEQ ID NO: 18293 - DNA, 20 bp, Artificial Sequence
  Description of Artificial Sequence: Synthetic oligonucleotide
  Target: SCN10A; (-) strand; PAM type: NRG; PAM sequence: CAG
ttatacctttgttatagagc

SEQ ID NO: 18294 - DNA, 20 bp, Artificial Sequence
  Description of Artificial Sequence: Synthetic oligonucleotide
  Target: SCN10A; (-) strand; PAM type: NRG; PAM sequence: GAG
ctctttatacctttgttata

SEQ ID NO: 18295 - DNA, 20 bp, Artificial Sequence
  Description of Artificial Sequence: Synthetic oligonucleotide
  Target: SCN10A; (-) strand; PAM type: NRG; PAM sequence: TAG
tgctctttatacctttgtta

SEQ ID NO: 18296 - DNA, 20 bp, Artificial Sequence
  Description of Artificial Sequence: Synthetic oligonucleotide
  Target: SCN10A; (-) strand; PAM type: NRG; PAM sequence: TAG
tttagattcactctcatgct

SEQ ID NO: 18297 - DNA, 20 bp, Artificial Sequence
  Description of Artificial Sequence: Synthetic oligonucleotide
  Target: SCN10A; (-) strand; PAM type: NRG; PAM sequence: TAG
gtgtccactcaatgtttatt

SEQ ID NO: 18298 - DNA, 20 bp, Artificial Sequence
  Description of Artificial Sequence: Synthetic oligonucleotide
  Target: SCN10A; (-) strand; PAM type: NRG; PAM sequence: AAG
cagtctcttccacatctcac

SEQ ID NO: 18299 - DNA, 20 bp, Artificial Sequence
  Description of Artificial Sequence: Synthetic oligonucleotide
  Target: SCN10A; (-) strand; PAM type: NRG; PAM sequence: CAG
gtgaatggagactatatgac

SEQ ID NO: 18300 - DNA, 20 bp, Artificial Sequence
  Description of Artificial Sequence: Synthetic oligonucleotide
  Target: SCN10A; (-) strand; PAM type: NRG; PAM sequence: GAG
tgggaggagaaaagtgaatg

SEQ ID NO: 18301 - DNA, 20 bp, Artificial Sequence
  Description of Artificial Sequence: Synthetic oligonucleotide
  Target: SCN10A; (-) strand; PAM type: NRG; PAM sequence: TGG
tctgggaggagaaaagtgaa

SEQ ID NO: 18302 - DNA, 20 bp, Artificial Sequence
  Description of Artificial Sequence: Synthetic oligonucleotide
  Target: SCN10A; (-) strand; PAM type: NRG; PAM sequence: AAG
cgttgtgtctgggaggagaa

SEQ ID NO: 18303 - DNA, 20 bp, Artificial Sequence
  Description of Artificial Sequence: Synthetic oligonucleotide
  Target: SCN10A; (-) strand; PAM type: NRG; PAM sequence: GAG
tcttccgttgtgtctgggag

SEQ ID NO: 18304 - DNA, 20 bp, Artificial Sequence
  Description of Artificial Sequence: Synthetic oligonucleotide
  Target: SCN10A; (-) strand; PAM type: NRG; PAM sequence: AGG
agtcttccgttgtgtctggg

SEQ ID NO: 18305 - DNA, 20 bp, Artificial Sequence
  Description of Artificial Sequence: Synthetic oligonucleotide
  Target: SCN10A; (-) strand; PAM type: NRG; PAM sequence: GAG
cagtcttccgttgtgtctgg

SEQ ID NO: 18306 - DNA, 20 bp, Artificial Sequence
  Description of Artificial Sequence: Synthetic oligonucleotide
  Target: SCN10A; (-) strand; PAM type: NRG; PAM sequence: GGG
aacagtcttccgttgtgtct

SEQ ID NO: 18307 - DNA, 20 bp, Artificial Sequence
  Description of Artificial Sequence: Synthetic oligonucleotide
  Target: SCN10A; (-) strand; PAM type: NRG; PAM sequence: TGG
aaacagtcttccgttgtgtc

SEQ ID NO: 18308 - DNA, 20 bp, Artificial Sequence
  Description of Artificial Sequence: Synthetic oligonucleotide
  Target: SCN10A; (-) strand; PAM type: NRG; PAM sequence: CAG
ttgcaagcaaaactggaaaa

SEQ ID NO: 18309 - DNA, 20 bp, Artificial Sequence
  Description of Artificial Sequence: Synthetic oligonucleotide
  Target: SCN10A; (-) strand; PAM type: NRG; PAM sequence: TGG
caactatttgcaagcaaaac

SEQ ID NO: 18310 - DNA, 20 bp, Artificial Sequence
  Description of Artificial Sequence: Synthetic oligonucleotide
  Target: SCN10A; (-) strand; PAM type: NRG; PAM sequence: AAG
acatgaccccaactatttgc

SEQ ID NO: 18311 - DNA, 20 bp, Artificial Sequence
  Description of Artificial Sequence: Synthetic oligonucleotide
  Target: SCN10A; (-) strand; PAM type: NRG; PAM sequence: CAG
tccatctccattccaccaga

SEQ ID NO: 18312 - DNA, 20 bp, Artificial Sequence
  Description of Artificial Sequence: Synthetic oligonucleotide
  Target: SCN10A; (-) strand; PAM type: NRG; PAM sequence: CAG
tgtctccatctccattccac

SEQ ID NO: 18313 - DNA, 20 bp, Artificial Sequence
  Description of Artificial Sequence: Synthetic oligonucleotide
  Target: SCN10A; (-) strand; PAM type: NRG; PAM sequence: AAG
gggtttaaggctatgcctaa

SEQ ID NO: 18314 - DNA, 20 bp, Artificial Sequence
  Description of Artificial Sequence: Synthetic oligonucleotide
  Target: SCN10A; (-) strand; PAM type: NRG; PAM sequence: AGG
gaaaaagttcagggggttta

SEQ ID NO: 18315 - DNA, 20 bp, Artificial Sequence
  Description of Artificial Sequence: Synthetic oligonucleotide
  Target: SCN10A; (-) strand; PAM type: NRG; PAM sequence: AAG
agaaaaagttcagggggttt

SEQ ID NO: 18316 - DNA, 20 bp, Artificial Sequence
  Description of Artificial Sequence: Synthetic oligonucleotide
  Target: SCN10A; (-) strand; PAM type: NRG; PAM sequence: GGG
agggaaagaaaaagttcagg

SEQ ID NO: 18317 - DNA, 20 bp, Artificial Sequence
  Description of Artificial Sequence: Synthetic oligonucleotide
  Target: SCN10A; (-) strand; PAM type: NRG; PAM sequence: GGG
aagggaaagaaaaagttcag

SEQ ID NO: 18318 - DNA, 20 bp, Artificial Sequence
  Description of Artificial Sequence: Synthetic oligonucleotide
  Target: SCN10A; (-) strand; PAM type: NRG; PAM sequence: GGG
aaagggaaagaaaaagttca

SEQ ID NO: 18319 - DNA, 20 bp, Artificial Sequence
  Description of Artificial Sequence: Synthetic oligonucleotide
  Target: SCN10A; (-) strand; PAM type: NRG; PAM sequence: AGG
gaaagggaaagaaaaagttc

SEQ ID NO: 18320 - DNA, 20 bp, Artificial Sequence
  Description of Artificial Sequence: Synthetic oligonucleotide
  Target: SCN10A; (-) strand; PAM type: NRG; PAM sequence: CAG
tgaaagggaaagaaaaagtt

SEQ ID NO: 18321 - DNA, 20 bp, Artificial Sequence
  Description of Artificial Sequence: Synthetic oligonucleotide
  Target: SCN10A; (-) strand; PAM type: NRG; PAM sequence: AAG
gaacatgaaagggaaagaaa

SEQ ID NO: 18322 - DNA, 20 bp, Artificial Sequence
  Description of Artificial Sequence: Synthetic oligonucleotide
  Target: SCN10A; (-) strand; PAM type: NRG; PAM sequence: AAG
tatggtgaacatgaaaggga

SEQ ID NO: 18323 - DNA, 20 bp, Artificial Sequence
  Description of Artificial Sequence: Synthetic oligonucleotide
  Target: SCN10A; (-) strand; PAM type: NRG; PAM sequence: GGG
cctttatggtgaacatgaaa

SEQ ID NO: 18324 - DNA, 20 bp, Artificial Sequence
  Description of Artificial Sequence: Synthetic oligonucleotide
  Target: SCN10A; (-) strand; PAM type: NRG; PAM sequence: AGG
acctttatggtgaacatgaa

SEQ ID NO: 18325 - DNA, 20 bp, Artificial Sequence
  Description of Artificial Sequence: Synthetic oligonucleotide
  Target: SCN10A; (-) strand; PAM type: NRG; PAM sequence: AAG
gacctttatggtgaacatga

SEQ ID NO: 18326 - DNA, 20 bp, Artificial Sequence
  Description of Artificial Sequence: Synthetic oligonucleotide
  Target: SCN10A; (-) strand; PAM type: NRG; PAM sequence: TGG
tcttcagttagtgaccttta

SEQ ID NO: 18327 - DNA, 20 bp, Artificial Sequence
  Description of Artificial Sequence: Synthetic oligonucleotide
  Target: SCN10A; (-) strand; PAM type: NRG; PAM sequence: TAG
gtgatgtcaccatcttcagt

SEQ ID NO: 18328 - DNA, 20 bp, Artificial Sequence
  Description of Artificial Sequence: Synthetic oligonucleotide
  Target: SCN10A; (-) strand; PAM type: NRG; PAM sequence: CAG
tatcgtgatgtcaccatctt

SEQ ID NO: 18329 - DNA, 20 bp, Artificial Sequence
  Description of Artificial Sequence: Synthetic oligonucleotide
  Target: SCN10A; (-) strand; PAM type: NRG; PAM sequence: AGG
aagtagcgcctcaaggatct

SEQ ID NO: 18330 - DNA, 20 bp, Artificial Sequence
  Description of Artificial Sequence: Synthetic oligonucleotide
  Target: SCN10A; (-) strand; PAM type: NRG; PAM sequence: TAG
caagtagcgcctcaaggatc

SEQ ID NO: 18331 - DNA, 20 bp, Artificial Sequence
  Description of Artificial Sequence: Synthetic oligonucleotide
  Target: SCN10A; (-) strand; PAM type: NRG; PAM sequence: AGG
ctacttcaagtagcgcctca

SEQ ID NO: 18332 - DNA, 20 bp, Artificial Sequence
  Description of Artificial Sequence: Synthetic oligonucleotide
  Target: SCN10A; (-) strand; PAM type: NRG; PAM sequence: AAG
tctacttcaagtagcgcctc

SEQ ID NO: 18333 - DNA, 20 bp, Artificial Sequence
  Description of Artificial Sequence: Synthetic oligonucleotide
  Target: SCN10A; (-) strand; PAM type: NRG; PAM sequence: TAG
ctgggagtgtctacttcaag

SEQ ID NO: 18334 - DNA, 20 bp, Artificial Sequence
  Description of Artificial Sequence: Synthetic oligonucleotide
  Target: SCN10A; (-) strand; PAM type: NRG; PAM sequence: AAG
ctcctgggagtgtctacttc

SEQ ID NO: 18335 - DNA, 20 bp, Artificial Sequence
  Description of Artificial Sequence: Synthetic oligonucleotide
  Target: SCN10A; (-) strand; PAM type: NRG; PAM sequence: GAG
ttgttgggaagctctcctgg

SEQ ID NO: 18336 - DNA, 20 bp, Artificial Sequence
  Description of Artificial Sequence: Synthetic oligonucleotide
  Target: SCN10A; (-) strand; PAM type: NRG; PAM sequence: GGG
gcttgttgggaagctctcct

SEQ ID NO: 18337 - DNA, 20 bp, Artificial Sequence
  Description of Artificial Sequence: Synthetic oligonucleotide
  Target: SCN10A; (-) strand; PAM type: NRG; PAM sequence: TGG
tgcttgttgggaagctctcc

SEQ ID NO: 18338 - DNA, 20 bp, Artificial Sequence
  Description of Artificial Sequence: Synthetic oligonucleotide
  Target: SCN10A; (-) strand; PAM type: NRG; PAM sequence: AAG
cacattcagtgcttgttggg

SEQ ID NO: 18339 - DNA, 20 bp, Artificial Sequence
  Description of Artificial Sequence: Synthetic oligonucleotide
  Target: SCN10A; (-) strand; PAM type: NRG; PAM sequence: GGG
cagcacattcagtgcttgtt

SEQ ID NO: 18340 - DNA, 20 bp, Artificial Sequence
  Description of Artificial Sequence: Synthetic oligonucleotide
  Target: SCN10A; (-) strand; PAM type: NRG; PAM sequence: TGG
acagcacattcagtgcttgt

SEQ ID NO: 18341 - DNA, 20 bp, Artificial Sequence
  Description of Artificial Sequence: Synthetic oligonucleotide
  Target: SCN10A; (-) strand; PAM type: NRG; PAM sequence: CAG
tgtatgtctcacagcacatt

SEQ ID NO: 18342 - DNA, 20 bp, Artificial Sequence
  Description of Artificial Sequence: Synthetic oligonucleotide
  Target: SCN10A; (-) strand; PAM type: NRG; PAM sequence: CAG
taatagagatgtatgtctca

SEQ ID NO: 18343 - DNA, 20 bp, Artificial Sequence
  Description of Artificial Sequence: Synthetic oligonucleotide
  Target: SCN10A; (-) strand; PAM type: NRG; PAM sequence: GAG
atctgtgagttaacataata

SEQ ID NO: 18344 - DNA, 20 bp, Artificial Sequence
  Description of Artificial Sequence: Synthetic oligonucleotide
  Target: SCN10A; (-) strand; PAM type: NRG; PAM sequence: TAG
aaatctgtgagttaacataa

SEQ ID NO: 18345 - DNA, 20 bp, Artificial Sequence
  Description of Artificial Sequence: Synthetic oligonucleotide
  Target: SCN10A; (-) strand; PAM type: NRG; PAM sequence: GAG
gtgataccctctaaatctgt

SEQ ID NO: 18346 - DNA, 20 bp, Artificial Sequence
  Description of Artificial Sequence: Synthetic oligonucleotide
  Target: SCN10A; (-) strand; PAM type: NRG; PAM sequence: CAG
aagataagtacaactagctg

SEQ ID NO: 18347 - DNA, 20 bp, Artificial Sequence
  Description of Artificial Sequence: Synthetic oligonucleotide
  Target: SCN10A; (-) strand; PAM type: NRG; PAM sequence: TAG
ttactcaagataagtacaac

SEQ ID NO: 18348 - DNA, 20 bp, Artificial Sequence
  Description of Artificial Sequence: Synthetic oligonucleotide
  Target: SCN10A; (-) strand; PAM type: NRG; PAM sequence: AAG
atttctccattactcaagat

SEQ ID NO: 18349 - DNA, 20 bp, Artificial Sequence
  Description of Artificial Sequence: Synthetic oligonucleotide
  Target: SCN10A; (-) strand; PAM type: NRG; PAM sequence: AAG
aagcaatttctccattactc

SEQ ID NO: 18350 - DNA, 20 bp, Artificial Sequence
  Description of Artificial Sequence: Synthetic oligonucleotide
  Target: SCN10A; (-) strand; PAM type: NRG; PAM sequence: AAG
ggcaataccttttttcaatg

SEQ ID NO: 18351 - DNA, 20 bp, Artificial Sequence
  Description of Artificial Sequence: Synthetic oligonucleotide
  Target: SCN10A; (-) strand; PAM type: NRG; PAM sequence: AGG
catagttgatgcttttgaaa

SEQ ID NO: 18352 - DNA, 20 bp, Artificial Sequence
  Description of Artificial Sequence: Synthetic oligonucleotide
  Target: SCN10A; (-) strand; PAM type: NRG; PAM sequence: AAG
acatagttgatgcttttgaa

SEQ ID NO: 18353 - DNA, 20 bp, Artificial Sequence
  Description of Artificial Sequence: Synthetic oligonucleotide
  Target: SCN10A; (-) strand; PAM type: NRG; PAM sequence: TAG
atcattaagccagtgccaca

SEQ ID NO: 18354 - DNA, 20 bp, Artificial Sequence
  Description of Artificial Sequence: Synthetic oligonucleotide
  Target: SCN10A; (-) strand; PAM type: NRG; PAM sequence: CAG
ccaccacatgatcattaagc

SEQ ID NO: 18355 - DNA, 20 bp, Artificial Sequence
  Description of Artificial Sequence: Synthetic oligonucleotide
  Target: SCN10A; (-) strand; PAM type: NRG; PAM sequence: AAG
ttgcccaccacatgatcatt

SEQ ID NO: 18356 - DNA, 20 bp, Artificial Sequence
  Description of Artificial Sequence: Synthetic oligonucleotide
  Target: SCN10A; (-) strand; PAM type: NRG; PAM sequence: CAG
cattccaagccttctcctat

SEQ ID NO: 18357 - DNA, 20 bp, Artificial Sequence
  Description of Artificial Sequence: Synthetic oligonucleotide
  Target: SCN10A; (-) strand; PAM type: NRG; PAM sequence: AAG
ataacatagattgacattcc

SEQ ID NO: 18358 - DNA, 20 bp, Artificial Sequence
  Description of Artificial Sequence: Synthetic oligonucleotide
  Target: SCN10A; (-) strand; PAM type: NRG; PAM sequence: TAG
atttttgtcactgaataaca

SEQ ID NO: 18359 - DNA, 20 bp, Artificial Sequence
  Description of Artificial Sequence: Synthetic oligonucleotide
  Target: SCN10A; (-) strand; PAM type: NRG; PAM sequence: CAG
ctctgcctcaaaatttttgc

SEQ ID NO: 18360 - DNA, 20 bp, Artificial Sequence
  Description of Artificial Sequence: Synthetic oligonucleotide
  Target: SCN10A; (-) strand; PAM type: NRG; PAM sequence: AGG
cctagggttgctggttcatg

SEQ ID NO: 18361 - DNA, 20 bp, Artificial Sequence
  Description of Artificial Sequence: Synthetic oligonucleotide
  Target: SCN10A; (-) strand; PAM type: NRG; PAM sequence: GAG
ccctagggttgctggttcat

SEQ ID NO: 18362 - DNA, 20 bp, Artificial Sequence
  Description of Artificial Sequence: Synthetic oligonucleotide
  Target: SCN10A; (-) strand; PAM type: NRG; PAM sequence: TGG
aacccttcccctagggttgc

SEQ ID NO: 18363 - DNA, 20 bp, Artificial Sequence
  Description of Artificial Sequence: Synthetic oligonucleotide
  Target: SCN10A; (-) strand; PAM type: NRG; PAM sequence: GGG
tttaataaacccttccccta

SEQ ID NO: 18364 - DNA, 20 bp, Artificial Sequence
  Description of Artificial Sequence: Synthetic oligonucleotide
  Target: SCN10A; (-) strand; PAM type: NRG; PAM sequence: AGG
gtttaataaacccttcccct

SEQ ID NO: 18365 - DNA, 20 bp, Artificial Sequence
  Description of Artificial Sequence: Synthetic oligonucleotide
  Target: SCN10A; (-) strand; PAM type: NRG; PAM sequence: TAG
ggtttaataaacccttcccc

SEQ ID NO: 18366 - DNA, 20 bp, Artificial Sequence
  Description of Artificial Sequence: Synthetic oligonucleotide
  Target: SCN10A; (-) strand; PAM type: NRG; PAM sequence: AGG
acaactgacccacaatacta

SEQ ID NO: 18367 - DNA, 20 bp, Artificial Sequence
  Description of Artificial Sequence: Synthetic oligonucleotide
  Target: SCN10A; (-) strand; PAM type: NRG; PAM sequence: AAG
tacaactgacccacaatact

SEQ ID NO: 18368 - DNA, 20 bp, Artificial Sequence
  Description of Artificial Sequence: Synthetic oligonucleotide
  Target: SCN10A; (-) strand; PAM type: NRG; PAM sequence: TAG
ttgtactgtcttgaccaaca

SEQ ID NO: 18369 - DNA, 20 bp, Artificial Sequence
  Description of Artificial Sequence: Synthetic oligonucleotide
  Target: SCN10A; (-) strand; PAM type: NRG; PAM sequence: GAG
aaaccagctaaatctttcct

SEQ ID NO: 18370 - DNA, 20 bp, Artificial Sequence
  Description of Artificial Sequence: Synthetic oligonucleotide
  Target: SCN10A; (-) strand; PAM type: NRG; PAM sequence: CAG
tttcttttattcttataaac

SEQ ID NO: 18371 - DNA, 20 bp, Artificial Sequence
  Description of Artificial Sequence: Synthetic oligonucleotide
  Target: SCN10A; (-) strand; PAM type: NRG; PAM sequence: TGG
tcgtcaaggctctaaacttc

SEQ ID NO: 18372 - DNA, 20 bp, Artificial Sequence
  Description of Artificial Sequence: Synthetic oligonucleotide
  Target: SCN10A; (-) strand; PAM type: NRG; PAM sequence: AGG
tacagttccctaaatcgtca

SEQ ID NO: 18373 - DNA, 20 bp, Artificial Sequence
  Description of Artificial Sequence: Synthetic oligonucleotide
  Target: SCN10A; (-) strand; PAM type: NRG; PAM sequence: AAG
gtacagttccctaaatcgtc

SEQ ID NO: 18374 - DNA, 20 bp, Artificial Sequence
  Description of Artificial Sequence: Synthetic oligonucleotide
  Target: SCN10A; (-) strand; PAM type: NRG; PAM sequence: CAG
cctggaatctagaagcagta

SEQ ID NO: 18375 - DNA, 20 bp, Artificial Sequence
  Description of Artificial Sequence: Synthetic oligonucleotide
  Target: SCN10A; (-) strand; PAM type: NRG; PAM sequence: CAG
cactgcctggaatctagaag

SEQ ID NO: 18376 - DNA, 20 bp, Artificial Sequence
  Description of Artificial Sequence: Synthetic oligonucleotide
  Target: SCN10A; (-) strand; PAM type: NRG; PAM sequence: AAG
gctcactgcctggaatctag

SEQ ID NO: 18377 - DNA, 20 bp, Artificial Sequence
  Description of Artificial Sequence: Synthetic oligonucleotide
  Target: SCN10A; (-) strand; PAM type: NRG; PAM sequence: TAG
attgctcactgcctggaatc

SEQ ID NO: 18378 - DNA, 20 bp, Artificial Sequence
  Description of Artificial Sequence: Synthetic oligonucleotide
  Target: SCN10A; (-) strand; PAM type: NRG; PAM sequence: TGG
taatcccattgctcactgcc

SEQ ID NO: 18379 - DNA, 20 bp, Artificial Sequence
  Description of Artificial Sequence: Synthetic oligonucleotide
  Target: SCN10A; (-) strand; PAM type: NRG; PAM sequence: AAG
taactagtcttcaacatttg

SEQ ID NO: 18380 - DNA, 20 bp, Artificial Sequence
  Description of Artificial Sequence: Synthetic oligonucleotide
  Target: SCN10A; (-) strand; PAM type: NRG; PAM sequence: TAG
atttaattggaaaatttaac

SEQ ID NO: 18381 - DNA, 20 bp, Artificial Sequence
  Description of Artificial Sequence: Synthetic oligonucleotide
  Target: SCN10A; (-) strand; PAM type: NRG; PAM sequence: TGG
taagagttgtttcatttaat

SEQ ID NO: 18382 - DNA, 20 bp, Artificial Sequence
  Description of Artificial Sequence: Synthetic oligonucleotide
  Target: SCN10A; (-) strand; PAM type: NRG; PAM sequence: GAG
attactacaagctttgctaa

SEQ ID NO: 18383 - DNA, 20 bp, Artificial Sequence
  Description of Artificial Sequence: Synthetic oligonucleotide
  Target: SCN10A; (-) strand; PAM type: NRG; PAM sequence: AAG
ccattactacaagctttgct

SEQ ID NO: 18384 - DNA, 20 bp, Artificial Sequence
  Description of Artificial Sequence: Synthetic oligonucleotide
  Target: SCN10A; (-) strand; PAM type: NRG; PAM sequence: AAG
agtggctacaccattactac

SEQ ID NO: 18385 - DNA, 20 bp, Artificial Sequence
  Description of Artificial Sequence: Synthetic oligonucleotide
  Target: SCN10A; (-) strand; PAM type: NRG; PAM sequence: TGG
ttctcttgcacaagaaacag

SEQ ID NO: 18386 - DNA, 20 bp, Artificial Sequence
  Description of Artificial Sequence: Synthetic oligonucleotide
  Target: SCN10A; (-) strand; PAM type: NRG; PAM sequence: CAG
cctttctcttgcacaagaaa

SEQ ID NO: 18387 - DNA, 20 bp, Artificial Sequence
  Description of Artificial Sequence: Synthetic oligonucleotide
  Target: SCN10A; (-) strand; PAM type: NRG; PAM sequence: AAG
cccatgcctttctcttgcac

SEQ ID NO: 18388 - DNA, 20 bp, Artificial Sequence
  Description of Artificial Sequence: Synthetic oligonucleotide
  Target: SCN10A; (-) strand; PAM type: NRG; PAM sequence: AAG
acaaagtgctttctttgaca

SEQ ID NO: 18389 - DNA, 20 bp, Artificial Sequence
  Description of Artificial Sequence: Synthetic oligonucleotide
  Target: SCN10A; (-) strand; PAM type: NRG; PAM sequence: AAG
agacctctcattgccacaca

SEQ ID NO: 18390 - DNA, 20 bp, Artificial Sequence
  Description of Artificial Sequence: Synthetic oligonucleotide
  Target: SCN10A; (-) strand; PAM type: NRG; PAM sequence: CAG
ttcaaaaacttagatggctt

SEQ ID NO: 18391 - DNA, 20 bp, Artificial Sequence
  Description of Artificial Sequence: Synthetic oligonucleotide
  Target: SCN10A; (-) strand; PAM type: NRG; PAM sequence: TGG
aattacttcaaaaacttaga

SEQ ID NO: 18392 - DNA, 20 bp, Artificial Sequence
  Description of Artificial Sequence: Synthetic oligonucleotide
  Target: SCN10A; (-) strand; PAM type: NRG; PAM sequence: TAG
atacaattacttcaaaaact

SEQ ID NO: 18393 - DNA, 20 bp, Artificial Sequence
  Description of Artificial Sequence: Synthetic oligonucleotide
  Target: SCN10A; (-) strand; PAM type: NRG; PAM sequence: GGG
gtgaaaggctttttcagtca

SEQ ID NO: 18394 - DNA, 20 bp, Artificial Sequence
  Description of Artificial Sequence: Synthetic oligonucleotide
  Target: SCN10A; (-) strand; PAM type: NRG; PAM sequence: AGG
agtgaaaggctttttcagtc

SEQ ID NO: 18395 - DNA, 20 bp, Artificial Sequence
  Description of Artificial Sequence: Synthetic oligonucleotide
  Target: SCN10A; (-) strand; PAM type: NRG; PAM sequence: CAG
cagtgaaaggctttttcagt

SEQ ID NO: 18396 - DNA, 20 bp, Artificial Sequence
  Description of Artificial Sequence: Synthetic oligonucleotide
  Target: SCN10A; (-) strand; PAM type: NRG; PAM sequence: CAG
taaacagtgaaaggcttttt

SEQ ID NO: 18397 - DNA, 20 bp, Artificial Sequence
  Description of Artificial Sequence: Synthetic oligonucleotide
  Target: SCN10A; (-) strand; PAM type: NRG; PAM sequence: AGG
tttaaggtttaaacagtgaa

SEQ ID NO: 18398 - DNA, 20 bp, Artificial Sequence
  Description of Artificial Sequence: Synthetic oligonucleotide
  Target: SCN10A; (-) strand; PAM type: NRG; PAM sequence: AAG
ttttaaggtttaaacagtga

SEQ ID NO: 18399 - DNA, 20 bp, Artificial Sequence
  Description of Artificial Sequence: Synthetic oligonucleotide
  Target: SCN10A; (-) strand; PAM type: NRG; PAM sequence: CAG
ggtttgttttaaggtttaaa

SEQ ID NO: 18400 - DNA, 20 bp, Artificial Sequence
  Description of Artificial Sequence: Synthetic oligonucleotide
  Target: SCN10A; (-) strand; PAM type: NRG; PAM sequence: AGG
gaaagccaaggtttgtttta

SEQ ID NO: 18401 - DNA, 20 bp, Artificial Sequence
  Description of Artificial Sequence: Synthetic oligonucleotide
  Target: SCN10A; (-) strand; PAM type: NRG; PAM sequence: AAG
ggaaagccaaggtttgtttt

SEQ ID NO: 18402 - DNA, 20 bp, Artificial Sequence
  Description of Artificial Sequence: Synthetic oligonucleotide
  Target: SCN10A; (-) strand; PAM type: NRG; PAM sequence: AGG
tgtgggaaaatggaaagcca

SEQ ID NO: 18403 - DNA, 20 bp, Artificial Sequence
  Description of Artificial Sequence: Synthetic oligonucleotide
  Target: SCN10A; (-) strand; PAM type: NRG; PAM sequence: AAG
ttgtgggaaaatggaaagcc

SEQ ID NO: 18404 - DNA, 20 bp, Artificial Sequence
  Description of Artificial Sequence: Synthetic oligonucleotide
  Target: SCN10A; (-) strand; PAM type: NRG; PAM sequence: AAG
cctgcttgtgggaaaatgga

SEQ ID NO: 18405 - DNA, 20 bp, Artificial Sequence
  Description of Artificial Sequence: Synthetic oligonucleotide
  Target: SCN10A; (-) strand; PAM type: NRG; PAM sequence: TGG
gcctcctgcttgtgggaaaa

SEQ ID NO: 18406 - DNA, 20 bp, Artificial Sequence
  Description of Artificial Sequence: Synthetic oligonucleotide
  Target: SCN10A; (-) strand; PAM type: NRG; PAM sequence: GGG
aaagtttgcctcctgcttgt

SEQ ID NO: 18407 - DNA, 20 bp, Artificial Sequence
  Description of Artificial Sequence: Synthetic oligonucleotide
  Target: SCN10A; (-) strand; PAM type: NRG; PAM sequence: TGG
caaagtttgcctcctgcttg

SEQ ID NO: 18408 - DNA, 20 bp, Artificial Sequence
  Description of Artificial Sequence: Synthetic oligonucleotide
  Target: SCN10A; (-) strand; PAM type: NRG; PAM sequence: AAG
aggaggccaatataacttca

SEQ ID NO: 18409 - DNA, 20 bp, Artificial Sequence
  Description of Artificial Sequence: Synthetic oligonucleotide
  Target: SCN10A; (-) strand; PAM type: NRG; PAM sequence: AGG
gactttgccatgcctgaagg

SEQ ID NO: 18410 - DNA, 20 bp, Artificial Sequence
  Description of Artificial Sequence: Synthetic oligonucleotide
  Target: SCN10A; (-) strand; PAM type: NRG; PAM sequence: GAG
tgactttgccatgcctgaag

SEQ ID NO: 18411 - DNA, 20 bp, Artificial Sequence
  Description of Artificial Sequence: Synthetic oligonucleotide
  Target: SCN10A; (-) strand; PAM type: NRG; PAM sequence: AGG
agtgactttgccatgcctga

SEQ ID NO: 18412 - DNA, 20 bp, Artificial Sequence
  Description of Artificial Sequence: Synthetic oligonucleotide
  Target: SCN10A; (-) strand; PAM type: NRG; PAM sequence: AAG
aagtgactttgccatgcctg

SEQ ID NO: 18413 - DNA, 20 bp, Artificial Sequence
  Description of Artificial Sequence: Synthetic oligonucleotide
  Target: SCN10A; (-) strand; PAM type: NRG; PAM sequence: AAG
gctctaggtgggactccaag

SEQ ID NO: 18414 - DNA, 20 bp, Artificial Sequence
  Description of Artificial Sequence: Synthetic oligonucleotide
  Target: SCN10A; (-) strand; PAM type: NRG; PAM sequence: AAG
acagctctaggtgggactcc

SEQ ID NO: 18415 - DNA, 20 bp, Artificial Sequence
  Description of Artificial Sequence: Synthetic oligonucleotide
  Target: SCN10A; (-) strand; PAM type: NRG; PAM sequence: GGG
caagccagacagctctaggt

SEQ ID NO: 18416 - DNA, 20 bp, Artificial Sequence
  Description of Artificial Sequence: Synthetic oligonucleotide
  Target: SCN10A; (-) strand; PAM type: NRG; PAM sequence: TGG
gcaagccagacagctctagg

SEQ ID NO: 18417 - DNA, 20 bp, Artificial Sequence
  Description of Artificial Sequence: Synthetic oligonucleotide
  Target: SCN10A; (-) strand; PAM type: NRG; PAM sequence: AGG
aatgcaagccagacagctct

SEQ ID NO: 18418 - DNA, 20 bp, Artificial Sequence
  Description of Artificial Sequence: Synthetic oligonucleotide
  Target: SCN10A; (-) strand; PAM type: NRG; PAM sequence: TAG
taatgcaagccagacagctc

SEQ ID NO: 18419 - DNA, 20 bp, Artificial Sequence
  Description of Artificial Sequence: Synthetic oligonucleotide
  Target: SCN10A; (-) strand; PAM type: NRG; PAM sequence: CAG
atagcctaatgcaagccaga

SEQ ID NO: 18420 - DNA, 20 bp, Artificial Sequence
  Description of Artificial Sequence: Synthetic oligonucleotide
  Target: SCN10A; (-) strand; PAM type: NRG; PAM sequence: CAG
tatcatagcctaatgcaagc

SEQ ID NO: 18421 - DNA, 20 bp, Artificial Sequence
  Description of Artificial Sequence: Synthetic oligonucleotide
  Target: SCN10A; (-) strand; PAM type: NRG; PAM sequence: AAG
ctcgtatcatagcctaatgc

SEQ ID NO: 18422 - DNA, 20 bp, Artificial Sequence
  Description of Artificial Sequence: Synthetic oligonucleotide
  Target: SCN10A; (-) strand; PAM type: NRG; PAM sequence: TAG
tttatttctcactcgtatca

SEQ ID NO: 18423 - DNA, 20 bp, Artificial Sequence
  Description of Artificial Sequence: Synthetic oligonucleotide
  Target: SCN10A; (-) strand; PAM type: NRG; PAM sequence: AGG
tgagtaactgaccccaataa

SEQ ID NO: 18424 - DNA, 20 bp, Artificial Sequence
  Description of Artificial Sequence: Synthetic oligonucleotide
  Target: SCN10A; (-) strand; PAM type: NRG; PAM sequence: AAG
ctgagtaactgaccccaata

SEQ ID NO: 18425 - DNA, 20 bp, Artificial Sequence
  Description of Artificial Sequence: Synthetic oligonucleotide
  Target: SCN10A; (-) strand; PAM type: NRG; PAM sequence: GAG
tacagacaatctctaaaact

SEQ ID NO: 18426 - DNA, 20 bp, Artificial Sequence
  Description of Artificial Sequence: Synthetic oligonucleotide
  Target: SCN10A; (-) strand; PAM type: NRG; PAM sequence: CAG
aaataaagctacctattata

SEQ ID NO: 18427 - DNA, 20 bp, Artificial Sequence
  Description of Artificial Sequence: Synthetic oligonucleotide
  Target: SCN10A; (-) strand; PAM type: NRG; PAM sequence: AAG
ttattaatcaatgaaaaata

SEQ ID NO: 18428 - DNA, 20 bp, Artificial Sequence
  Description of Artificial Sequence: Synthetic oligonucleotide
  Target: SCN10A; (-) strand; PAM type: NRG; PAM sequence: AAG
tcccaatttattgtaatgat

SEQ ID NO: 18429 - DNA, 20 bp, Artificial Sequence
  Description of Artificial Sequence: Synthetic oligonucleotide
  Target: SCN10A; (-) strand; PAM type: NRG; PAM sequence: CAG
tccaagacaacttttcattc

SEQ ID NO: 18430 - DNA, 20 bp, Artificial Sequence
  Description of Artificial Sequence: Synthetic oligonucleotide
  Target: SCN10A; (-) strand; PAM type: NRG; PAM sequence: AAG
aaaatctttaaccttcctcc

SEQ ID NO: 18431 - DNA, 20 bp, Artificial Sequence
  Description of Artificial Sequence: Synthetic oligonucleotide
  Target: SCN10A; (-) strand; PAM type: NRG; PAM sequence: TAG
acttaatcaaagccaaaagt

SEQ ID NO: 18432 - DNA, 20 bp, Artificial Sequence
  Description of Artificial Sequence: Synthetic oligonucleotide
  Target: SCN10A; (-) strand; PAM type: NRG; PAM sequence: AAG
gttaacttaatcaaagccaa

SEQ ID NO: 18433 - DNA, 20 bp, Artificial Sequence
  Description of Artificial Sequence: Synthetic oligonucleotide
  Target: SCN10A; (-) strand; PAM type: NRG; PAM sequence: AAG
tccattagttaacttaatca

SEQ ID NO: 18434 - DNA, 20 bp, Artificial Sequence
  Description of Artificial Sequence: Synthetic oligonucleotide
  Target: SCN10A; (-) strand; PAM type: NRG; PAM sequence: TAG
agcataaattaactctccat

SEQ ID NO: 18435 - DNA, 20 bp, Artificial Sequence
  Description of Artificial Sequence: Synthetic oligonucleotide
  Target: SCN10A; (-) strand; PAM type: NRG; PAM sequence: CAG
ggtcgtggctgcagaaatta

SEQ ID NO: 18436 - DNA, 20 bp, Artificial Sequence
  Description of Artificial Sequence: Synthetic oligonucleotide
  Target: SCN10A; (-) strand; PAM type: NRG; PAM sequence: CAG
agcccaggaggtcgtggctg

SEQ ID NO: 18437 - DNA, 20 bp, Artificial Sequence
  Description of Artificial Sequence: Synthetic oligonucleotide
  Target: SCN10A; (-) strand; PAM type: NRG; PAM sequence: TGG
gacttgagcccaggaggtcg

SEQ ID NO: 18438 - DNA, 20 bp, Artificial Sequence
  Description of Artificial Sequence: Synthetic oligonucleotide
  Target: SCN10A; (-) strand; PAM type: NRG; PAM sequence: AGG
gaggatgacttgagcccagg

SEQ ID NO: 18439 - DNA, 20 bp, Artificial Sequence
  Description of Artificial Sequence: Synthetic oligonucleotide
  Target: SCN10A; (-) strand; PAM type: NRG; PAM sequence: GAG
ggaggatgacttgagcccag

SEQ ID NO: 18440 - DNA, 20 bp, Artificial Sequence
  Description of Artificial Sequence: Synthetic oligonucleotide
  Target: SCN10A; (-) strand; PAM type: NRG; PAM sequence: AGG
tgggaggatgacttgagccc

SEQ ID NO: 18441 - DNA, 20 bp, Artificial Sequence
  Description of Artificial Sequence: Synthetic oligonucleotide
  Target: SCN10A; (-) strand; PAM type: NRG; PAM sequence: CAG
gtgggaggatgacttgagcc

SEQ ID NO: 18442 - DNA, 20 bp, Artificial Sequence
  Description of Artificial Sequence: Synthetic oligonucleotide
  Target: SCN10A; (-) strand; PAM type: NRG; PAM sequence: GAG
ctgaggtgggaggatgactt

SEQ ID NO: 18443 - DNA, 20 bp, Artificial Sequence
  Description of Artificial Sequence: Synthetic oligonucleotide
  Target: SCN10A; (-) strand; PAM type: NRG; PAM sequence: AGG
atttgggaggctgaggtggg

SEQ ID NO: 18444 - DNA, 20 bp, Artificial Sequence
  Description of Artificial Sequence: Synthetic oligonucleotide
  Target: SCN10A; (-) strand; PAM type: NRG; PAM sequence: GAG
tatttgggaggctgaggtgg

SEQ ID NO: 18445 - DNA, 20 bp, Artificial Sequence
  Description of Artificial Sequence: Synthetic oligonucleotide
  Target: SCN10A; (-) strand; PAM type: NRG; PAM sequence: GGG
gctatttgggaggctgaggt

SEQ ID NO: 18446 - DNA, 20 bp, Artificial Sequence
  Description of Artificial Sequence: Synthetic oligonucleotide
  Target: SCN10A; (-) strand; PAM type: NRG; PAM sequence: TGG
agctatttgggaggctgagg

SEQ ID NO: 18447 - DNA, 20 bp, Artificial Sequence
  Description of Artificial Sequence: Synthetic oligonucleotide
  Target: SCN10A; (-) strand; PAM type: NRG; PAM sequence: AGG
ctcagctatttgggaggctg

SEQ ID NO: 18448 - DNA, 20 bp, Artificial Sequence
  Description of Artificial Sequence: Synthetic oligonucleotide
  Target: SCN10A; (-) strand; PAM type: NRG; PAM sequence: GAG
tctcagctatttgggaggct

SEQ ID NO: 18449 - DNA, 20 bp, Artificial Sequence
  Description of Artificial Sequence: Synthetic oligonucleotide
  Target: SCN10A; (-) strand; PAM type: NRG; PAM sequence: AGG
tgtagtctcagctatttggg

SEQ ID NO: 18450 - DNA, 20 bp, Artificial Sequence
  Description of Artificial Sequence: Synthetic oligonucleotide
  Target: SCN10A; (-) strand; PAM type: NRG; PAM sequence: GAG
ctgtagtctcagctatttgg

SEQ ID NO: 18451 - DNA, 20 bp, Artificial Sequence
  Description of Artificial Sequence: Synthetic oligonucleotide
  Target: SCN10A; (-) strand; PAM type: NRG; PAM sequence: GGG
gtctgtagtctcagctattt

SEQ ID NO: 18452 - DNA, 20 bp, Artificial Sequence
  Description of Artificial Sequence: Synthetic oligonucleotide
  Target: SCN10A; (-) strand; PAM type: NRG; PAM sequence: TGG
tgtctgtagtctcagctatt

SEQ ID NO: 18453 - DNA, 20 bp, Artificial Sequence
  Description of Artificial Sequence: Synthetic oligonucleotide
  Target: SCN10A; (-) strand; PAM type: NRG; PAM sequence: CAG
atggcacgtgtctgtagtct

SEQ ID NO: 18454 - DNA, 20 bp, Artificial Sequence
  Description of Artificial Sequence: Synthetic oligonucleotide
  Target: SCN10A; (-) strand; PAM type: NRG; PAM sequence: TAG
ggcatgatggcacgtgtctg

SEQ ID NO: 18455 - DNA, 20 bp, Artificial Sequence
  Description of Artificial Sequence: Synthetic oligonucleotide
  Target: SCN10A; (-) strand; PAM type: NRG; PAM sequence: TGG
aagaaattagctgggcatga

SEQ ID NO: 18456 - DNA, 20 bp, Artificial Sequence
  Description of Artificial Sequence: Synthetic oligonucleotide
  Target: SCN10A; (-) strand; PAM type: NRG; PAM sequence: GGG
gaaaaggaaagaaattagct

SEQ ID NO: 18457 - DNA, 20 bp, Artificial Sequence
  Description of Artificial Sequence: Synthetic oligonucleotide
  Target: SCN10A; (-) strand; PAM type: NRG; PAM sequence: TGG
agaaaaggaaagaaattagc

SEQ ID NO: 18458 - DNA, 20 bp, Artificial Sequence
  Description of Artificial Sequence: Synthetic oligonucleotide
  Target: SCN10A; (-) strand; PAM type: NRG; PAM sequence: TAG
aaaaagaaaaggaaagaaat

SEQ ID NO: 18459 - DNA, 20 bp, Artificial Sequence
  Description of Artificial Sequence: Synthetic oligonucleotide
  Target: SCN10A; (-) strand; PAM type: NRG; PAM sequence: AAG
aaatttaaaaaagaaaagga

SEQ ID NO: 18460 - DNA, 20 bp, Artificial Sequence
  Description of Artificial Sequence: Synthetic oligonucleotide
  Target: SCN10A; (-) strand; PAM type: NRG; PAM sequence: AGG
ttttaaatttaaaaaagaaa

SEQ ID NO: 18461 - DNA, 20 bp, Artificial Sequence
  Description of Artificial Sequence: Synthetic oligonucleotide
  Target: SCN10A; (-) strand; PAM type: NRG; PAM sequence: AAG
attttaaatttaaaaaagaa

SEQ ID NO: 18462 - DNA, 20 bp, Artificial Sequence
  Description of Artificial Sequence: Synthetic oligonucleotide
  Target: SCN10A; (-) strand; PAM type: NRG; PAM sequence: AAG
aataaattttaaatttaaaa

SEQ ID NO: 18463 - DNA, 20 bp, Artificial Sequence
  Description of Artificial Sequence: Synthetic oligonucleotide
  Target: SCN10A; (-) strand; PAM type: NRG; PAM sequence: GGG
cactccagcctgggcaacaa

SEQ ID NO: 18464 - DNA, 20 bp, Artificial Sequence
  Description of Artificial Sequence: Synthetic oligonucleotide
  Target: SCN10A; (-) strand; PAM type: NRG; PAM sequence: AGG
gcactccagcctgggcaaca

SEQ ID NO: 18465 - DNA, 20 bp, Artificial Sequence
  Description of Artificial Sequence: Synthetic oligonucleotide
  Target: SCN10A; (-) strand; PAM type: NRG; PAM sequence: AAG
tgcactccagcctgggcaac

SEQ ID NO: 18466 - DNA, 20 bp, Artificial Sequence
  Description of Artificial Sequence: Synthetic oligonucleotide
  Target: SCN10A; (-) strand; PAM type: NRG; PAM sequence: GGG
gcaccattgcactccagcct

SEQ ID NO: 18467 - DNA, 20 bp, Artificial Sequence
  Description of Artificial Sequence: Synthetic oligonucleotide
  Target: SCN10A; (-) strand; PAM type: NRG; PAM sequence: TGG
tgcaccattgcactccagcc

SEQ ID NO: 18468 - DNA, 20 bp, Artificial Sequence
  Description of Artificial Sequence: Synthetic oligonucleotide
  Target: SCN10A; (-) strand; PAM type: NRG; PAM sequence: CAG
gagattgcaccattgcactc

SEQ ID NO: 18469 - DNA, 20 bp, Artificial Sequence
  Description of Artificial Sequence: Synthetic oligonucleotide
  Target: SCN10A; (-) strand; PAM type: NRG; PAM sequence: GAG
ggcggaggttgcggtgagct

SEQ ID NO: 18470 - DNA, 20 bp, Artificial Sequence
  Description of Artificial Sequence: Synthetic oligonucleotide
  Target: SCN10A; (-) strand; PAM type: NRG; PAM sequence: GAG
cgggaggcggaggttgcggt

SEQ ID NO: 18471 - DNA, 20 bp, Artificial Sequence
  Description of Artificial Sequence: Synthetic oligonucleotide
  Target: SCN10A; (-) strand; PAM type: NRG; PAM sequence: CGG
aacccgggaggcggaggttg

SEQ ID NO: 18472 - DNA, 20 bp, Artificial Sequence
  Description of Artificial Sequence: Synthetic oligonucleotide
  Target: SCN10A; (-) strand; PAM type: NRG; PAM sequence: AGG
tgcttgaacccgggaggcgg

SEQ ID NO: 18473 - DNA, 20 bp, Artificial Sequence
  Description of Artificial Sequence: Synthetic oligonucleotide
  Target: SCN10A; (-) strand; PAM type: NRG; PAM sequence: GAG
ttgcttgaacccgggaggcg

SEQ ID NO: 18474 - DNA, 20 bp, Artificial Sequence
  Description of Artificial Sequence: Synthetic oligonucleotide
  Target: SCN10A; (-) strand; PAM type: NRG; PAM sequence: CGG
aattgcttgaacccgggagg

SEQ ID NO: 18475 - DNA, 20 bp, Artificial Sequence
  Description of Artificial Sequence: Synthetic oligonucleotide
  Target: SCN10A; (-) strand; PAM type: NRG; PAM sequence: AGG
gagaattgcttgaacccggg

SEQ ID NO: 18476 - DNA, 20 bp, Artificial Sequence
  Description of Artificial Sequence: Synthetic oligonucleotide
  Target: SCN10A; (-) strand; PAM type: NRG; PAM sequence: GAG
ggagaattgcttgaacccgg

SEQ ID NO: 18477 - DNA, 20 bp, Artificial Sequence
  Description of Artificial Sequence: Synthetic oligonucleotide
  Target: SCN10A; (-) strand; PAM type: NRG; PAM sequence: GGG
gaggagaattgcttgaaccc

SEQ ID NO: 18478 - DNA, 20 bp, Artificial Sequence
  Description of Artificial Sequence: Synthetic oligonucleotide
  Target: SCN10A; (-) strand; PAM type: NRG; PAM sequence: CGG
ggaggagaattgcttgaacc

SEQ ID NO: 18479 - DNA, 20 bp, Artificial Sequence
  Description of Artificial Sequence: Synthetic oligonucleotide
  Target: SCN10A; (-) strand; PAM type: NRG; PAM sequence: GAG
tacttgggaggctgagggag

SEQ ID NO: 18480 - DNA, 20 bp, Artificial Sequence
  Description of Artificial Sequence: Synthetic oligonucleotide
  Target: SCN10A; (-) strand; PAM type: NRG; PAM sequence: AGG
gctacttgggaggctgaggg

SEQ ID NO: 18481 - DNA, 20 bp, Artificial Sequence
  Description of Artificial Sequence: Synthetic oligonucleotide
  Target: SCN10A; (-) strand; PAM type: NRG; PAM sequence: GAG
agctacttgggaggctgagg

SEQ ID NO: 18482 - DNA, 20 bp, Artificial Sequence
  Description of Artificial Sequence: Synthetic oligonucleotide
  Target: SCN10A; (-) strand; PAM type: NRG; PAM sequence: GGG
ccagctacttgggaggctga

SEQ ID NO: 18483 - DNA, 20 bp, Artificial Sequence
  Description of Artificial Sequence: Synthetic oligonucleotide
  Target: SCN10A; (-) strand; PAM type: NRG; PAM sequence: AGG
cccagctacttgggaggctg

SEQ ID NO: 18484 - DNA, 20 bp, Artificial Sequence
  Description of Artificial Sequence: Synthetic oligonucleotide
  Target: SCN10A; (-) strand; PAM type: NRG; PAM sequence: GAG
tcccagctacttgggaggct

SEQ ID NO: 18485 - DNA, 20 bp, Artificial Sequence
  Description of Artificial Sequence: Synthetic oligonucleotide
  Target: SCN10A; (-) strand; PAM type: NRG; PAM sequence: AGG
tttaatcccagctacttggg

SEQ ID NO: 18486 - DNA, 20 bp, Artificial Sequence
  Description of Artificial Sequence: Synthetic oligonucleotide
  Target: SCN10A; (-) strand; PAM type: NRG; PAM sequence: GAG
ttttaatcccagctacttgg

SEQ ID NO: 18487 - DNA, 20 bp, Artificial Sequence
  Description of Artificial Sequence: Synthetic oligonucleotide
  Target: SCN10A; (-) strand; PAM type: NRG; PAM sequence: GGG
acttttaatcccagctactt

SEQ ID NO: 18488 - DNA, 20 bp, Artificial Sequence
  Description of Artificial Sequence: Synthetic oligonucleotide
  Target: SCN10A; (-) strand; PAM type: NRG; PAM sequence: TGG
tacttttaatcccagctact

SEQ ID NO: 18489 - DNA, 20 bp, Artificial Sequence
  Description of Artificial Sequence: Synthetic oligonucleotide
  Target: SCN10A; (-) strand; PAM type: NRG; PAM sequence: CAG
atggtgcatacttttaatcc

SEQ ID NO: 18490 - DNA, 20 bp, Artificial Sequence
  Description of Artificial Sequence: Synthetic oligonucleotide
  Target: SCN10A; (-) strand; PAM type: NRG; PAM sequence: TGG
acaaaattagccaggtgtga

SEQ ID NO: 18491 - DNA, 20 bp, Artificial Sequence
  Description of Artificial Sequence: Synthetic oligonucleotide
  Target: SCN10A; (-) strand; PAM type: NRG; PAM sequence: AGG
ccaaaaatacaaaattagcc

SEQ ID NO: 18492 - DNA, 20 bp, Artificial Sequence
  Description of Artificial Sequence: Synthetic oligonucleotide
  Target: SCN10A; (-) strand; PAM type: NRG; PAM sequence: CAG
accaaaaatacaaaattagc

SEQ ID NO: 18493 - DNA, 20 bp, Artificial Sequence
  Description of Artificial Sequence: Synthetic oligonucleotide
  Target: SCN10A; (-) strand; PAM type: NRG; PAM sequence: TAG
ctctaccaaaaatacaaaat

SEQ ID NO: 18494 - DNA, 20 bp, Artificial Sequence
  Description of Artificial Sequence: Synthetic oligonucleotide
  Target: SCN10A; (-) strand; PAM type: NRG; PAM sequence: AAG
ccagcctgaccaacatggag

SEQ ID NO: 18495 - DNA, 20 bp, Artificial Sequence
  Description of Artificial Sequence: Synthetic oligonucleotide
  Target: SCN10A; (-) strand; PAM type: NRG; PAM sequence: GAG
agaccagcctgaccaacatg

SEQ ID NO: 18496 - DNA, 20 bp, Artificial Sequence
  Description of Artificial Sequence: Synthetic oligonucleotide
  Target: SCN10A; (-) strand; PAM type: NRG; PAM sequence: TGG
cgagaccagcctgaccaaca

SEQ ID NO: 18497 - DNA, 20 bp, Artificial Sequence
  Description of Artificial Sequence: Synthetic oligonucleotide
  Target: SCN10A; (-) strand; PAM type: NRG; PAM sequence: CAG
tgaggtcgggagttcgagac

SEQ ID NO: 18498 - DNA, 20 bp, Artificial Sequence
  Description of Artificial Sequence: Synthetic oligonucleotide
  Target: SCN10A; (-) strand; PAM type: NRG; PAM sequence: GAG
tcacctgaggtcgggagttc

SEQ ID NO: 18499 - DNA, 20 bp, Artificial Sequence
  Description of Artificial Sequence: Synthetic oligonucleotide
  Target: SCN10A; (-) strand; PAM type: NRG; PAM sequence: GAG
ggcggatcacctgaggtcgg

SEQ ID NO: 18500 - DNA, 20 bp, Artificial Sequence
  Description of Artificial Sequence: Synthetic oligonucleotide
  Target: SCN10A; (-) strand; PAM type: NRG; PAM sequence: GGG
caggcggatcacctgaggtc

SEQ ID NO: 18501 - DNA, 20 bp, Artificial Sequence
  Description of Artificial Sequence: Synthetic oligonucleotide
  Target: SCN10A; (-) strand; PAM type: NRG; PAM sequence: CGG
gcaggcggatcacctgaggt

SEQ ID NO: 18502 - DNA, 20 bp, Artificial Sequence
  Description of Artificial Sequence: Synthetic oligonucleotide
  Target: SCN10A; (-) strand; PAM type: NRG; PAM sequence: AGG
gcaggcaggcggatcacctg

SEQ ID NO: 18503 - DNA, 20 bp, Artificial Sequence
  Description of Artificial Sequence: Synthetic oligonucleotide
  Target: SCN10A; (-) strand; PAM type: NRG; PAM sequence: GAG
cgcaggcaggcggatcacct

SEQ ID NO: 18504 - DNA, 20 bp, Artificial Sequence
  Description of Artificial Sequence: Synthetic oligonucleotide
  Target: SCN10A; (-) strand; PAM type: NRG; PAM sequence: CGG
ctgttggaggcgcaggcagg

SEQ ID NO: 18505 - DNA, 20 bp, Artificial Sequence
  Description of Artificial Sequence: Synthetic oligonucleotide
  Target: SCN10A; (-) strand; PAM type: NRG; PAM sequence: AGG
gcactgttggaggcgcaggc

SEQ ID NO: 18506 - DNA, 20 bp, Artificial Sequence
  Description of Artificial Sequence: Synthetic oligonucleotide
  Target: SCN10A; (-) strand; PAM type: NRG; PAM sequence: CAG
agcactgttggaggcgcagg

SEQ ID NO: 18507 - DNA, 20 bp, Artificial Sequence
  Description of Artificial Sequence: Synthetic oligonucleotide
  Target: SCN10A; (-) strand; PAM type: NRG; PAM sequence: AGG
cccagcactgttggaggcgc

SEQ ID NO: 18508 - DNA, 20 bp, Artificial Sequence
  Description of Artificial Sequence: Synthetic oligonucleotide
  Target: SCN10A; (-) strand; PAM type: NRG; PAM sequence: CAG
tcccagcactgttggaggcg

SEQ ID NO: 18509 - DNA, 20 bp, Artificial Sequence
  Description of Artificial Sequence: Synthetic oligonucleotide
  Target: SCN10A; (-) strand; PAM type: NRG; PAM sequence: AGG
tgtaatcccagcactgttgg

SEQ ID NO: 18510 - DNA, 20 bp, Artificial Sequence
  Description of Artificial Sequence: Synthetic oligonucleotide
  Target: SCN10A; (-) strand; PAM type: NRG; PAM sequence: GAG
ctgtaatcccagcactgttg

SEQ ID NO: 18511 - DNA, 20 bp, Artificial Sequence
  Description of Artificial Sequence: Synthetic oligonucleotide
  Target: SCN10A; (-) strand; PAM type: NRG; PAM sequence: TGG
gcctgtaatcccagcactgt

SEQ ID NO: 18512 - DNA, 20 bp, Artificial Sequence
  Description of Artificial Sequence: Synthetic oligonucleotide
  Target: SCN10A; (-) strand; PAM type: NRG; PAM sequence: CAG
gtggttaatgcctgtaatcc

SEQ ID NO: 18513 - DNA, 20 bp, Artificial Sequence
  Description of Artificial Sequence: Synthetic oligonucleotide
  Target: SCN10A; (-) strand; PAM type: NRG; PAM sequence: TGG
aaaaagaaggccaggggcag

SEQ ID NO: 18514 - DNA, 20 bp, Artificial Sequence
  Description of Artificial Sequence: Synthetic oligonucleotide
  Target: SCN10A; (-) strand; PAM type: NRG; PAM sequence: CAG
aataaaaagaaggccagggg

SEQ ID NO: 18515 - DNA, 20 bp, Artificial Sequence
  Description of Artificial Sequence: Synthetic oligonucleotide
  Target: SCN10A; (-) strand; PAM type: NRG; PAM sequence: GGG
aacaataaaaagaaggccag

SEQ ID NO: 18516 - DNA, 20 bp, Artificial Sequence
  Description of Artificial Sequence: Synthetic oligonucleotide
  Target: SCN10A; (-) strand; PAM type: NRG; PAM sequence: GGG
aaacaataaaaagaaggcca

SEQ ID NO: 18517 - DNA, 20 bp, Artificial Sequence
  Description of Artificial Sequence: Synthetic oligonucleotide
  Target: SCN10A; (-) strand; PAM type: NRG; PAM sequence: AGG
aaaacaataaaaagaaggcc

SEQ ID NO: 18518 - DNA, 20 bp, Artificial Sequence
  Description of Artificial Sequence: Synthetic oligonucleotide
  Target: SCN10A; (-) strand; PAM type: NRG; PAM sequence: CAG
gaaaacaataaaaagaaggc

SEQ ID NO: 18519 - DNA, 20 bp, Artificial Sequence
  Description of Artificial Sequence: Synthetic oligonucleotide
  Target: SCN10A; (-) strand; PAM type: NRG; PAM sequence: AGG
cattgaaaacaataaaaaga

SEQ ID NO: 18520 - DNA, 20 bp, Artificial Sequence
  Description of Artificial Sequence: Synthetic oligonucleotide
  Target: SCN10A; (-) strand; PAM type: NRG; PAM sequence: AAG
tcattgaaaacaataaaaag

SEQ ID NO: 18521 - DNA, 20 bp, Artificial Sequence
  Description of Artificial Sequence: Synthetic oligonucleotide
  Target: SCN10A; (-) strand; PAM type: NRG; PAM sequence: AAG
gtctcattgaaaacaataaa

SEQ ID NO: 18522 - DNA, 20 bp, Artificial Sequence
  Description of Artificial Sequence: Synthetic oligonucleotide
  Target: SCN10A; (-) strand; PAM type: NRG; PAM sequence: GAG
tccagcctgggcaacagagc

SEQ ID NO: 18523 - DNA, 20 bp, Artificial Sequence
  Description of Artificial Sequence: Synthetic oligonucleotide
  Target: SCN10A; (-) strand; PAM type: NRG; PAM sequence: GAG
gcactccagcctgggcaaca

SEQ ID NO: 18524 - DNA, 20 bp, Artificial Sequence
  Description of Artificial Sequence: Synthetic oligonucleotide
  Target: SCN10A; (-) strand; PAM type: NRG; PAM sequence: CAG
ctgcactccagcctgggcaa

SEQ ID NO: 18525 - DNA, 20 bp, Artificial Sequence
  Description of Artificial Sequence: Synthetic oligonucleotide
  Target: SCN10A; (-) strand; PAM type: NRG; PAM sequence: GGG
atgccactgcactccagcct

SEQ ID NO: 18526 - DNA, 20 bp, Artificial Sequence
  Description of Artificial Sequence: Synthetic oligonucleotide
  Target: SCN10A; (-) strand; PAM type: NRG; PAM sequence: TGG
catgccactgcactccagcc

SEQ ID NO: 18527 - DNA, 20 bp, Artificial Sequence
  Description of Artificial Sequence: Synthetic oligonucleotide
  Target: SCN10A; (-) strand; PAM type: NRG; PAM sequence: CAG
gagatcatgccactgcactc

SEQ ID NO: 18528 - DNA, 20 bp, Artificial Sequence
  Description of Artificial Sequence: Synthetic oligonucleotide
  Target: SCN10A; (-) strand; PAM type: NRG; PAM sequence: GAG
gacagaggttgcagtgagct

SEQ ID NO: 18529 - DNA, 20 bp, Artificial Sequence
  Description of Artificial Sequence: Synthetic oligonucleotide
  Target: SCN10A; (-) strand; PAM type: NRG; PAM sequence: GAG
ccagagacagaggttgcagt

SEQ ID NO: 18530 - DNA, 20 bp, Artificial Sequence
  Description of Artificial Sequence: Synthetic oligonucleotide
  Target: SCN10A; (-) strand; PAM type: NRG; PAM sequence: CAG
aatcccagagacagaggttg

SEQ ID NO: 18531 - DNA, 20 bp, Artificial Sequence
  Description of Artificial Sequence: Synthetic oligonucleotide
  Target: SCN10A; (-) strand; PAM type: NRG; PAM sequence: AGG
tgcttgaatcccagagacag

SEQ ID NO: 18532 - DNA, 20 bp, Artificial Sequence
  Description of Artificial Sequence: Synthetic oligonucleotide
  Target: SCN10A; (-) strand; PAM type: NRG; PAM sequence: GAG
ttgcttgaatcccagagaca

SEQ ID NO: 18533 - DNA, 20 bp, Artificial Sequence
  Description of Artificial Sequence: Synthetic oligonucleotide
  Target: SCN10A; (-) strand; PAM type: NRG; PAM sequence: CAG
aattgcttgaatcccagaga

SEQ ID NO: 18534 - DNA, 20 bp, Artificial Sequence
  Description of Artificial Sequence: Synthetic oligonucleotide
  Target: SCN10A; (-) strand; PAM type: NRG; PAM sequence: GAG
tgagaattgcttgaatccca

SEQ ID NO: 18535 - DNA, 20 bp, Artificial Sequence
  Description of Artificial Sequence: Synthetic oligonucleotide
  Target: SCN10A; (-) strand; PAM type: NRG; PAM sequence: CAG
catgagaattgcttgaatcc

SEQ ID NO: 18536 - DNA, 20 bp, Artificial Sequence
  Description of Artificial Sequence: Synthetic oligonucleotide
  Target: SCN10A; (-) strand; PAM type: NRG; PAM sequence: GAG
tactcaggagggtgaggcat

SEQ ID NO: 18537 - DNA, 20 bp, Artificial Sequence
  Description of Artificial Sequence: Synthetic oligonucleotide
  Target: SCN10A; (-) strand; PAM type: NRG; PAM sequence: AGG
cccagctactcaggagggtg

SEQ ID NO: 18538 - DNA, 20 bp, Artificial Sequence
  Description of Artificial Sequence: Synthetic oligonucleotide
  Target: SCN10A; (-) strand; PAM type: NRG; PAM sequence: GAG
tcccagctactcaggagggt

SEQ ID NO: 18539 - DNA, 20 bp, Artificial Sequence
  Description of Artificial Sequence: Synthetic oligonucleotide
  Target: SCN10A; (-) strand; PAM type: NRG; PAM sequence: GGG
gtaatcccagctactcagga

SEQ ID NO: 18540 - DNA, 20 bp, Artificial Sequence
  Description of Artificial Sequence: Synthetic oligonucleotide
  Target: SCN10A; (-) strand; PAM type: NRG; PAM sequence: AGG
tgtaatcccagctactcagg

SEQ ID NO: 18541 - DNA, 20 bp, Artificial Sequence
  Description of Artificial Sequence: Synthetic oligonucleotide
  Target: SCN10A; (-) strand; PAM type: NRG; PAM sequence: GAG
ctgtaatcccagctactcag

SEQ ID NO: 18542 - DNA, 20 bp, Artificial Sequence
  Description of Artificial Sequence: Synthetic oligonucleotide
  Target: SCN10A; (-) strand; PAM type: NRG; PAM sequence: AGG
acctgtaatcccagctactc

SEQ ID NO: 18543 - DNA, 20 bp, Artificial Sequence
  Description of Artificial Sequence: Synthetic oligonucleotide
  Target: SCN10A; (-) strand; PAM type: NRG; PAM sequence: CAG
cacctgtaatcccagctact

SEQ ID NO: 18544 - DNA, 20 bp, Artificial Sequence
  Description of Artificial Sequence: Synthetic oligonucleotide
  Target: SCN10A; (-) strand; PAM type: NRG; PAM sequence: CAG
gtggcacacacctgtaatcc

SEQ ID NO: 18545 - DNA, 20 bp, Artificial Sequence
  Description of Artificial Sequence: Synthetic oligonucleotide
  Target: SCN10A; (-) strand; PAM type: NRG; PAM sequence: TGG
tataaattagctgggtgtgg

SEQ ID NO: 18546 - DNA, 20 bp, Artificial Sequence
  Description of Artificial Sequence: Synthetic oligonucleotide
  Target: SCN10A; (-) strand; PAM type: NRG; PAM sequence: TGG
atatataaattagctgggtg

SEQ ID NO: 18547 - DNA, 20 bp, Artificial Sequence
  Description of Artificial Sequence: Synthetic oligonucleotide
  Target: SCN10A; (-) strand; PAM type: NRG; PAM sequence: GGG
taaaaatatataaattagct

SEQ ID NO: 18548 - DNA, 20 bp, Artificial Sequence
  Description of Artificial Sequence: Synthetic oligonucleotide
  Target: SCN10A; (-) strand; PAM type: NRG; PAM sequence: TGG
ctaaaaatatataaattagc

SEQ ID NO: 18549 - DNA, 20 bp, Artificial Sequence
  Description of Artificial Sequence: Synthetic oligonucleotide
  Target: SCN10A; (-) strand; PAM type: NRG; PAM sequence: TAG
tctactaaaaatatataaat

SEQ ID NO: 18550 - DNA, 20 bp, Artificial Sequence
  Description of Artificial Sequence: Synthetic oligonucleotide
  Target: SCN10A; (-) strand; PAM type: NRG; PAM sequence: GAG
gagaccagcctggccaacag

SEQ ID NO: 18551 - DNA, 20 bp, Artificial Sequence
  Description of Artificial Sequence: Synthetic oligonucleotide
  Target: SCN10A; (-) strand; PAM type: NRG; PAM sequence: AGG
tggagaccagcctggccaac

SEQ ID NO: 18552 - DNA, 20 bp, Artificial Sequence
  Description of Artificial Sequence: Synthetic oligonucleotide
  Target: SCN10A; (-) strand; PAM type: NRG; PAM sequence: CAG
ttggagaccagcctggccaa

SEQ ID NO: 18553 - DNA, 20 bp, Artificial Sequence
  Description of Artificial Sequence: Synthetic oligonucleotide
  Target: SCN10A; (-) strand; PAM type: NRG; PAM sequence: TGG
acaggagttggagaccagcc

SEQ ID NO: 18554 - DNA, 20 bp, Artificial Sequence
  Description of Artificial Sequence: Synthetic oligonucleotide
  Target: SCN10A; (-) strand; PAM type: NRG; PAM sequence: CAG
tgaggacaggagttggagac

SEQ ID NO: 18555 - DNA, 20 bp, Artificial Sequence
  Description of Artificial Sequence: Synthetic oligonucleotide
  Target: SCN10A; (-) strand; PAM type: NRG; PAM sequence: GAG
ttgcttgaggacaggagttg

SEQ ID NO: 18556 - DNA, 20 bp, Artificial Sequence
  Description of Artificial Sequence: Synthetic oligonucleotide
  Target: SCN10A; (-) strand; PAM type: NRG; PAM sequence: TGG
gattgcttgaggacaggagt

SEQ ID NO: 18557 - DNA, 20 bp, Artificial Sequence
  Description of Artificial Sequence: Synthetic oligonucleotide
  Target: SCN10A; (-) strand; PAM type: NRG; PAM sequence: GAG
ggaggattgcttgaggacag

SEQ ID NO: 18558 - DNA, 20 bp, Artificial Sequence
  Description of Artificial Sequence: Synthetic oligonucleotide
  Target: SCN10A; (-) strand; PAM type: NRG; PAM sequence: AGG
tgggaggattgcttgaggac

SEQ ID NO: 18559 - DNA, 20 bp, Artificial Sequence
  Description of Artificial Sequence: Synthetic oligonucleotide
  Target: SCN10A; (-) strand; PAM type: NRG; PAM sequence: CAG
gtgggaggattgcttgagga

SEQ ID NO: 18560 - DNA, 20 bp, Artificial Sequence
  Description of Artificial Sequence: Synthetic oligonucleotide
  Target: SCN10A; (-) strand; PAM type: NRG; PAM sequence: AGG
caaggtgggaggattgcttg

SEQ ID NO: 18561 - DNA, 20 bp, Artificial Sequence
  Description of Artificial Sequence: Synthetic oligonucleotide
  Target: SCN10A; (-) strand; PAM type: NRG; PAM sequence: GAG
ccaaggtgggaggattgctt

SEQ ID NO: 18562 - DNA, 20 bp, Artificial Sequence
  Description of Artificial Sequence: Synthetic oligonucleotide
  Target: SCN10A; (-) strand; PAM type: NRG; PAM sequence: AGG
ttttgggaggccaaggtggg

SEQ ID NO: 18563 - DNA, 20 bp, Artificial Sequence
  Description of Artificial Sequence: Synthetic oligonucleotide
  Target: SCN10A; (-) strand; PAM type: NRG; PAM sequence: GAG
attttgggaggccaaggtgg

SEQ ID NO: 18564 - DNA, 20 bp, Artificial Sequence
  Description of Artificial Sequence: Synthetic oligonucleotide
  Target: SCN10A; (-) strand; PAM type: NRG; PAM sequence: GGG
gaattttgggaggccaaggt

SEQ ID NO: 18565 - DNA, 20 bp, Artificial Sequence
  Description of Artificial Sequence: Synthetic oligonucleotide
  Target: SCN10A; (-) strand; PAM type: NRG; PAM sequence: TGG
agaattttgggaggccaagg

SEQ ID NO: 18566 - DNA, 20 bp, Artificial Sequence
  Description of Artificial Sequence: Synthetic oligonucleotide
  Target: SCN10A; (-) strand; PAM type: NRG; PAM sequence: AGG
cccagaattttgggaggcca

SEQ ID NO: 18567 - DNA, 20 bp, Artificial Sequence
  Description of Artificial Sequence: Synthetic oligonucleotide
  Target: SCN10A; (-) strand; PAM type: NRG; PAM sequence: AAG
tcccagaattttgggaggcc

SEQ ID NO: 18568 - DNA, 20 bp, Artificial Sequence
  Description of Artificial Sequence: Synthetic oligonucleotide
  Target: SCN10A; (-) strand; PAM type: NRG; PAM sequence: AGG
tgtaatcccagaattttggg

SEQ ID NO: 18569 - DNA, 20 bp, Artificial Sequence
  Description of Artificial Sequence: Synthetic oligonucleotide
  Target: SCN10A; (-) strand; PAM type: NRG; PAM sequence: GAG
ctgtaatcccagaattttgg

SEQ ID NO: 18570 - DNA, 20 bp, Artificial Sequence
  Description of Artificial Sequence: Synthetic oligonucleotide
  Target: SCN10A; (-) strand; PAM type: NRG; PAM sequence: GGG
gcctgtaatcccagaatttt

SEQ ID NO: 18571 - DNA, 20 bp, Artificial Sequence
  Description of Artificial Sequence: Synthetic oligonucleotide
  Target: SCN10A; (-) strand; PAM type: NRG; PAM sequence: TGG
cgcctgtaatcccagaattt

SEQ ID NO: 18572 - DNA, 20 bp, Artificial Sequence
  Description of Artificial Sequence: Synthetic oligonucleotide
  Target: SCN10A; (-) strand; PAM type: NRG; PAM sequence: CAG
gtggctcacgcctgtaatcc

SEQ ID NO: 18573 - DNA, 20 bp, Artificial Sequence
  Description of Artificial Sequence: Synthetic oligonucleotide
  Target: SCN10A; (-) strand; PAM type: NRG; PAM sequence: TGG
gccaagggggccaggtgggg

SEQ ID NO: 18574 - DNA, 20 bp, Artificial Sequence
  Description of Artificial Sequence: Synthetic oligonucleotide
  Target: SCN10A; (-) strand; PAM type: NRG; PAM sequence: GGG
aaagccaagggggccaggtg

SEQ ID NO: 18575 - DNA, 20 bp, Artificial Sequence
  Description of Artificial Sequence: Synthetic oligonucleotide
  Target: SCN10A; (-) strand; PAM type: NRG; PAM sequence: GGG
taaagccaagggggccaggt

SEQ ID NO: 18576 - DNA, 20 bp, Artificial Sequence
  Description of Artificial Sequence: Synthetic oligonucleotide
  Target: SCN10A; (-) strand; PAM type: NRG; PAM sequence: TGG
ttaaagccaagggggccagg

SEQ ID NO: 18577 - DNA, 20 bp, Artificial Sequence
  Description of Artificial Sequence: Synthetic oligonucleotide
  Target: SCN10A; (-) strand; PAM type: NRG; PAM sequence: AGG
tttttaaagccaagggggcc

SEQ ID NO: 18578 - DNA, 20 bp, Artificial Sequence
  Description of Artificial Sequence: Synthetic oligonucleotide
  Target: SCN10A; (-) strand; PAM type: NRG; PAM sequence: CAG
ttttttaaagccaagggggc

SEQ ID NO: 18579 - DNA, 20 bp, Artificial Sequence
  Description of Artificial Sequence: Synthetic oligonucleotide
  Target: SCN10A; (-) strand; PAM type: NRG; PAM sequence: GGG
ttttttttttaaagccaagg

SEQ ID NO: 18580 - DNA, 20 bp, Artificial Sequence
  Description of Artificial Sequence: Synthetic oligonucleotide
  Target: SCN10A; (-) strand; PAM type: NRG; PAM sequence: GGG
attttttttttaaagccaag

SEQ ID NO: 18581 - DNA, 20 bp, Artificial Sequence
  Description of Artificial Sequence: Synthetic oligonucleotide
  Target: SCN10A; (-) strand; PAM type: NRG; PAM sequence: GGG
cattttttttttaaagccaa

SEQ ID NO: 18582 - DNA, 20 bp, Artificial Sequence
  Description of Artificial Sequence: Synthetic oligonucleotide
  Target: SCN10A; (-) strand; PAM type: NRG; PAM sequence: AGG
ccattttttttttaaagcca

SEQ ID NO: 18583 - DNA, 20 bp, Artificial Sequence
  Description of Artificial Sequence: Synthetic oligonucleotide
  Target: SCN10A; (-) strand; PAM type: NRG; PAM sequence: AAG
gccattttttttttaaagcc

SEQ ID NO: 18584 - DNA, 20 bp, Artificial Sequence
  Description of Artificial Sequence: Synthetic oligonucleotide
  Target: SCN10A; (-) strand; PAM type: NRG; PAM sequence: AAG
attatgccatttttttttta

SEQ ID NO: 18585 - DNA, 20 bp, Artificial Sequence
  Description of Artificial Sequence: Synthetic oligonucleotide
  Target: SCN10A; (-) strand; PAM type: NRG; PAM sequence: AAG
ggttttggtatcaaggttcc

SEQ ID NO: 18586 - DNA, 20 bp, Artificial Sequence
  Description of Artificial Sequence: Synthetic oligonucleotide
  Target: SCN10A; (-) strand; PAM type: NRG; PAM sequence: AGG
cttgccaggttttggtatca

SEQ ID NO: 18587 - DNA, 20 bp, Artificial Sequence
  Description of Artificial Sequence: Synthetic oligonucleotide
  Target: SCN10A; (-) strand; PAM type: NRG; PAM sequence: AAG
ccttgccaggttttggtatc

SEQ ID NO: 18588 - DNA, 20 bp, Artificial Sequence
  Description of Artificial Sequence: Synthetic oligonucleotide
  Target: SCN10A; (-) strand; PAM type: NRG; PAM sequence: TGG
tcattgtccttgccaggttt

SEQ ID NO: 18589 - DNA, 20 bp, Artificial Sequence
  Description of Artificial Sequence: Synthetic oligonucleotide
  Target: SCN10A; (-) strand; PAM type: NRG; PAM sequence: AGG
tgactttcattgtccttgcc

SEQ ID NO: 18590 - DNA, 20 bp, Artificial Sequence
  Description of Artificial Sequence: Synthetic oligonucleotide
  Target: SCN10A; (-) strand; PAM type: NRG; PAM sequence: CAG
ctgactttcattgtccttgc

SEQ ID NO: 18591 - DNA, 20 bp, Artificial Sequence
  Description of Artificial Sequence: Synthetic oligonucleotide
  Target: SCN10A; (-) strand; PAM type: NRG; PAM sequence: GAG
atttttttatccatatcaat

SEQ ID NO: 18592 - DNA, 20 bp, Artificial Sequence
  Description of Artificial Sequence: Synthetic oligonucleotide
  Target: SCN10A; (-) strand; PAM type: NRG; PAM sequence: AAG
agtttgctaaaaatttgctt

SEQ ID NO: 18593 - DNA, 20 bp, Artificial Sequence
  Description of Artificial Sequence: Synthetic oligonucleotide
  Target: SCN10A; (-) strand; PAM type: NRG; PAM sequence: TAG
ttttaatacattggaagatt

SEQ ID NO: 18594 - DNA, 20 bp, Artificial Sequence
  Description of Artificial Sequence: Synthetic oligonucleotide
  Target: SCN10A; (-) strand; PAM type: NRG; PAM sequence: AAG
tgcattttttaatacattgg

SEQ ID NO: 18595 - DNA, 20 bp, Artificial Sequence
  Description of Artificial Sequence: Synthetic oligonucleotide
  Target: SCN10A; (-) strand; PAM type: NRG; PAM sequence: TGG
tgatgcattttttaatacat

SEQ ID NO: 18596 - DNA, 20 bp, Artificial Sequence
  Description of Artificial Sequence: Synthetic oligonucleotide
  Target: SCN10A; (-) strand; PAM type: NRG; PAM sequence: TAG
ttacattcccagctcaaacc

SEQ ID NO: 18597 - DNA, 20 bp, Artificial Sequence
  Description of Artificial Sequence: Synthetic oligonucleotide
  Target: SCN10A; (-) strand; PAM type: NRG; PAM sequence: CAG
ttaaatcaactttacattcc

SEQ ID NO: 18598 - DNA, 20 bp, Artificial Sequence
  Description of Artificial Sequence: Synthetic oligonucleotide
  Target: SCN10A; (-) strand; PAM type: NRG; PAM sequence: TGG
tctccttcaatctgttaaag

SEQ ID NO: 18599 - DNA, 20 bp, Artificial Sequence
  Description of Artificial Sequence: Synthetic oligonucleotide
  Target: SCN10A; (-) strand; PAM type: NRG; PAM sequence: AAG
ttttctccttcaatctgtta

SEQ ID NO: 18600 - DNA, 20 bp, Artificial Sequence
  Description of Artificial Sequence: Synthetic oligonucleotide
  Target: SCN10A; (-) strand; PAM type: NRG; PAM sequence: GAG
acaattattctacatgtatt

SEQ ID NO: 18601 - DNA, 20 bp, Artificial Sequence
  Description of Artificial Sequence: Synthetic oligonucleotide
  Target: SCN10A; (-) strand; PAM type: NRG; PAM sequence: CAG
gaatggatgtttaattttat

SEQ ID NO: 18602 - DNA, 20 bp, Artificial Sequence
  Description of Artificial Sequence: Synthetic oligonucleotide
  Target: SCN10A; (-) strand; PAM type: NRG; PAM sequence: TGG
tcaagaatatttatcatgaa

SEQ ID NO: 18603 - DNA, 20 bp, Artificial Sequence
  Description of Artificial Sequence: Synthetic oligonucleotide
  Target: SCN10A; (-) strand; PAM type: NRG; PAM sequence: AAG
tcaggaagttctcttttatc

SEQ ID NO: 18604 - DNA, 20 bp, Artificial Sequence
  Description of Artificial Sequence: Synthetic oligonucleotide
  Target: SCN10A; (-) strand; PAM type: NRG; PAM sequence: AAG
gaaatctttatcagttcagg

SEQ ID NO: 18605 - DNA, 20 bp, Artificial Sequence
  Description of Artificial Sequence: Synthetic oligonucleotide
  Target: SCN10A; (-) strand; PAM type: NRG; PAM sequence: AGG
taagaaatctttatcagttc

SEQ ID NO: 18606 - DNA, 20 bp, Artificial Sequence
  Description of Artificial Sequence: Synthetic oligonucleotide
  Target: SCN10A; (-) strand; PAM type: NRG; PAM sequence: CAG
ataagaaatctttatcagtt

SEQ ID NO: 18607 - DNA, 20 bp, Artificial Sequence
  Description of Artificial Sequence: Synthetic oligonucleotide
  Target: SCN10A; (-) strand; PAM type: NRG; PAM sequence: CAG
taaagataagaaatctttat

SEQ ID NO: 18608 - DNA, 20 bp, Artificial Sequence
  Description of Artificial Sequence: Synthetic oligonucleotide
  Target: SCN10A; (-) strand; PAM type: NRG; PAM sequence: AAG
ggcaggctttttttaaagat

SEQ ID NO: 18609 - DNA, 20 bp, Artificial Sequence
  Description of Artificial Sequence: Synthetic oligonucleotide
  Target: SCN10A; (-) strand; PAM type: NRG; PAM sequence: AAG
attgtggcaggcttttttta

SEQ ID NO: 18610 - DNA, 20 bp, Artificial Sequence
  Description of Artificial Sequence: Synthetic oligonucleotide
  Target: SCN10A; (-) strand; PAM type: NRG; PAM sequence: AGG
ccacctctaacaattgtggc

SEQ ID NO: 18611 - DNA, 20 bp, Artificial Sequence
  Description of Artificial Sequence: Synthetic oligonucleotide
  Target: SCN10A; (-) strand; PAM type: NRG; PAM sequence: CAG
accacctctaacaattgtgg

SEQ ID NO: 18612 - DNA, 20 bp, Artificial Sequence
  Description of Artificial Sequence: Synthetic oligonucleotide
  Target: SCN10A; (-) strand; PAM type: NRG; PAM sequence: TGG
ttcaccacctctaacaattg

SEQ ID NO: 18613 - DNA, 20 bp, Artificial Sequence
  Description of Artificial Sequence: Synthetic oligonucleotide
  Target: SCN10A; (-) strand; PAM type: NRG; PAM sequence: AAG
atcaattttctgatcccaaa

SEQ ID NO: 18614 - DNA, 20 bp, Artificial Sequence
  Description of Artificial Sequence: Synthetic oligonucleotide
  Target: SCN10A; (-) strand; PAM type: NRG; PAM sequence: AGG
tgaaaagaagtgttaataac

SEQ ID NO: 18615 - DNA, 20 bp, Artificial Sequence
  Description of Artificial Sequence: Synthetic oligonucleotide
  Target: SCN10A; (-) strand; PAM type: NRG; PAM sequence: CAG
ttgaaaagaagtgttaataa

SEQ ID NO: 18616 - DNA, 20 bp, Artificial Sequence
  Description of Artificial Sequence: Synthetic oligonucleotide
  Target: SCN10A; (-) strand; PAM type: NRG; PAM sequence: AAG
tccagtacactgttgaaaag

SEQ ID NO: 18617 - DNA, 20 bp, Artificial Sequence
  Description of Artificial Sequence: Synthetic oligonucleotide
  Target: SCN10A; (-) strand; PAM type: NRG; PAM sequence: AAG
acatccagtacactgttgaa

SEQ ID NO: 18618 - DNA, 20 bp, Artificial Sequence
  Description of Artificial Sequence: Synthetic oligonucleotide
  Target: SCN10A; (-) strand; PAM type: NRG; PAM sequence: CAG
actgtgctagttaggacatc

SEQ ID NO: 18619 - DNA, 20 bp, Artificial Sequence
  Description of Artificial Sequence: Synthetic oligonucleotide
  Target: SCN10A; (-) strand; PAM type: NRG; PAM sequence: AGG
actagatcactgtgctagtt

SEQ ID NO: 18620 - DNA, 20 bp, Artificial Sequence
  Description of Artificial Sequence: Synthetic oligonucleotide
  Target: SCN10A; (-) strand; PAM type: NRG; PAM sequence: TAG
tactagatcactgtgctagt

SEQ ID NO: 18621 - DNA, 20 bp, Artificial Sequence
  Description of Artificial Sequence: Synthetic oligonucleotide
  Target: SCN10A; (-) strand; PAM type: NRG; PAM sequence: TAG
tttttactagatcactgtgc

SEQ ID NO: 18622 - DNA, 20 bp, Artificial Sequence
  Description of Artificial Sequence: Synthetic oligonucleotide
  Target: SCN10A; (-) strand; PAM type: NRG; PAM sequence: TAG
tgccattaggttctttttac

SEQ ID NO: 18623 - DNA, 20 bp, Artificial Sequence
  Description of Artificial Sequence: Synthetic oligonucleotide
  Target: SCN10A; (-) strand; PAM type: NRG; PAM sequence: AGG
tttctaatccttatgccatt

SEQ ID NO: 18624 - DNA, 20 bp, Artificial Sequence
  Description of Artificial Sequence: Synthetic oligonucleotide
  Target: SCN10A; (-) strand; PAM type: NRG; PAM sequence: TAG
ttttctaatccttatgccat

SEQ ID NO: 18625 - DNA, 20 bp, Artificial Sequence
  Description of Artificial Sequence: Synthetic oligonucleotide
  Target: SCN10A; (-) strand; PAM type: NRG; PAM sequence: CAG
aggcatgagccacccacgcc

SEQ ID NO: 18626 - DNA, 20 bp, Artificial Sequence
  Description of Artificial Sequence: Synthetic oligonucleotide
  Target: SCN10A; (-) strand; PAM type: NRG; PAM sequence: GAG
agtgctgggattacaggcat

SEQ ID NO: 18627 - DNA, 20 bp, Artificial Sequence
  Description of Artificial Sequence: Synthetic oligonucleotide
  Target: SCN10A; (-) strand; PAM type: NRG; PAM sequence: AGG
tcctaaagtgctgggattac

SEQ ID NO: 18628 - DNA, 20 bp, Artificial Sequence
  Description of Artificial Sequence: Synthetic oligonucleotide
  Target: SCN10A; (-) strand; PAM type: NRG; PAM sequence: CAG
ctcctaaagtgctgggatta

SEQ ID NO: 18629 - DNA, 20 bp, Artificial Sequence
  Description of Artificial Sequence: Synthetic oligonucleotide
  Target: SCN10A; (-) strand; PAM type: NRG; PAM sequence: GGG
ccttggcctcctaaagtgct

SEQ ID NO: 18630 - DNA, 20 bp, Artificial Sequence
  Description of Artificial Sequence: Synthetic oligonucleotide
  Target: SCN10A; (-) strand; PAM type: NRG; PAM sequence: TGG
gccttggcctcctaaagtgc

SEQ ID NO: 18631 - DNA, 20 bp, Artificial Sequence
  Description of Artificial Sequence: Synthetic oligonucleotide
  Target: SCN10A; (-) strand; PAM type: NRG; PAM sequence: AAG
ctgcctgccttggcctccta

SEQ ID NO: 18632 - DNA, 20 bp, Artificial Sequence
  Description of Artificial Sequence: Synthetic oligonucleotide
  Target: SCN10A; (-) strand; PAM type: NRG; PAM sequence: TGG
acctcatgatctgcctgcct

SEQ ID NO: 18633 - DNA, 20 bp, Artificial Sequence
  Description of Artificial Sequence: Synthetic oligonucleotide
  Target: SCN10A; (-) strand; PAM type: NRG; PAM sequence: TGG
tttcaccgtgttagccagga

SEQ ID NO: 18634 - DNA, 20 bp, Artificial Sequence
  Description of Artificial Sequence: Synthetic oligonucleotide
  Target: SCN10A; (-) strand; PAM type: NRG; PAM sequence: AGG
ggggtttcaccgtgttagcc

SEQ ID NO: 18635 - DNA, 20 bp, Artificial Sequence
  Description of Artificial Sequence: Synthetic oligonucleotide
  Target: SCN10A; (-) strand; PAM type: NRG; PAM sequence: CAG
cggggtttcaccgtgttagc

SEQ ID NO: 18636 - DNA, 20 bp, Artificial Sequence
  Description of Artificial Sequence: Synthetic oligonucleotide
  Target: SCN10A; (-) strand; PAM type: NRG; PAM sequence: TAG
gagacggggtttcaccgtgt

SEQ ID NO: 18637 - DNA, 20 bp, Artificial Sequence
  Description of Artificial Sequence: Synthetic oligonucleotide
  Target: SCN10A; (-) strand; PAM type: NRG; PAM sequence: GGG
ttgtatttttagtagagacg

SEQ ID NO: 18638 - DNA, 20 bp, Artificial Sequence
  Description of Artificial Sequence: Synthetic oligonucleotide
  Target: SCN10A; (-) strand; PAM type: NRG; PAM sequence: GGG
tttgtatttttagtagagac

SEQ ID NO: 18639 - DNA, 20 bp, Artificial Sequence
  Description of Artificial Sequence: Synthetic oligonucleotide
  Target: SCN10A; (-) strand; PAM type: NRG; PAM sequence: CGG
ctttgtatttttagtagaga

SEQ ID NO: 18640 - DNA, 20 bp, Artificial Sequence
  Description of Artificial Sequence: Synthetic oligonucleotide
  Target: SCN10A; (-) strand; PAM type: NRG; PAM sequence: GAG
aattctttgtatttttagta

SEQ ID NO: 18641 - DNA, 20 bp, Artificial Sequence
  Description of Artificial Sequence: Synthetic oligonucleotide
  Target: SCN10A; (-) strand; PAM type: NRG; PAM sequence: TAG
ctaattctttgtatttttag

SEQ ID NO: 18642 - DNA, 20 bp, Artificial Sequence
  Description of Artificial Sequence: Synthetic oligonucleotide
  Target: SCN10A; (-) strand; PAM type: NRG; PAM sequence: TAG
tggctaattctttgtatttt

SEQ ID NO: 18643 - DNA, 20 bp, Artificial Sequence
  Description of Artificial Sequence: Synthetic oligonucleotide
  Target: SCN10A; (-) strand; PAM type: NRG; PAM sequence: TGG
caggcacccaccaccatgcc

SEQ ID NO: 18644 - DNA, 20 bp, Artificial Sequence
  Description of Artificial Sequence: Synthetic oligonucleotide
  Target: SCN10A; (-) strand; PAM type: NRG; PAM sequence: AGG
tcctgagtagctgggactac

SEQ ID NO: 18645 - DNA, 20 bp, Artificial Sequence
  Description of Artificial Sequence: Synthetic oligonucleotide
  Target: SCN10A; (-) strand; PAM type: NRG; PAM sequence: CAG
ctcctgagtagctgggacta

SEQ ID NO: 18646 - DNA, 20 bp, Artificial Sequence
  Description of Artificial Sequence: Synthetic oligonucleotide
  Target: SCN10A; (-) strand; PAM type: NRG; PAM sequence: GGG
cctcagcctcctgagtagct

SEQ ID NO: 18647 - DNA, 20 bp, Artificial Sequence
  Description of Artificial Sequence: Synthetic oligonucleotide
  Target: SCN10A; (-) strand; PAM type: NRG; PAM sequence: TGG
gcctcagcctcctgagtagc

SEQ ID NO: 18648 - DNA, 20 bp, Artificial Sequence
  Description of Artificial Sequence: Synthetic oligonucleotide
  Target: SCN10A; (-) strand; PAM type: NRG; PAM sequence: TAG
tcctgcctcagcctcctgag

SEQ ID NO: 18649 - DNA, 20 bp, Artificial Sequence
  Description of Artificial Sequence: Synthetic oligonucleotide
  Target: SCN10A; (-) strand; PAM type: NRG; PAM sequence: GAG
ttctcctgcctcagcctcct

SEQ ID NO: 18650 - DNA, 20 bp, Artificial Sequence
  Description of Artificial Sequence: Synthetic oligonucleotide
  Target: SCN10A; (-) strand; PAM type: NRG; PAM sequence: CAG
ttcacgccattctcctgcct

SEQ ID NO: 18651 - DNA, 20 bp, Artificial Sequence
  Description of Artificial Sequence: Synthetic oligonucleotide
  Target: SCN10A; (-) strand; PAM type: NRG; PAM sequence: GGG
cattgccagctccacctccc

SEQ ID NO: 18652 - DNA, 20 bp, Artificial Sequence
  Description of Artificial Sequence: Synthetic oligonucleotide
  Target: SCN10A; (-) strand; PAM type: NRG; PAM sequence: CGG
tcattgccagctccacctcc

SEQ ID NO: 18653 - DNA, 20 bp, Artificial Sequence
  Description of Artificial Sequence: Synthetic oligonucleotide
  Target: SCN10A; (-) strand; PAM type: NRG; PAM sequence: CAG
gcgtgatctcggctcattgc

SEQ ID NO: 18654 - DNA, 20 bp, Artificial Sequence
  Description of Artificial Sequence: Synthetic oligonucleotide
  Target: SCN10A; (-) strand; PAM type: NRG; PAM sequence: CGG
agagtgcagtggcgtgatct

SEQ ID NO: 18655 - DNA, 20 bp, Artificial Sequence
  Description of Artificial Sequence: Synthetic oligonucleotide
  Target: SCN10A; (-) strand; PAM type: NRG; PAM sequence: TGG
tcacccaggctagagtgcag

SEQ ID NO: 18656 - DNA, 20 bp, Artificial Sequence
  Description of Artificial Sequence: Synthetic oligonucleotide
  Target: SCN10A; (-) strand; PAM type: NRG; PAM sequence: CAG
ctgtcacccaggctagagtg

SEQ ID NO: 18657 - DNA, 20 bp, Artificial Sequence
  Description of Artificial Sequence: Synthetic oligonucleotide
  Target: SCN10A; (-) strand; PAM type: NRG; PAM sequence: GAG
tcgctctgtcacccaggcta

SEQ ID NO: 18658 - DNA, 20 bp, Artificial Sequence
  Description of Artificial Sequence: Synthetic oligonucleotide
  Target: SCN10A; (-) strand; PAM type: NRG; PAM sequence: TAG
tctcgctctgtcacccaggc

SEQ ID NO: 18659 - DNA, 20 bp, Artificial Sequence
  Description of Artificial Sequence: Synthetic oligonucleotide
  Target: SCN10A; (-) strand; PAM type: NRG; PAM sequence: AGG
agagtctcgctctgtcaccc

SEQ ID NO: 18660 - DNA, 20 bp, Artificial Sequence
  Description of Artificial Sequence: Synthetic oligonucleotide
  Target: SCN10A; (-) strand; PAM type: NRG; PAM sequence: CAG
cagagtctcgctctgtcacc

SEQ ID NO: 18661 - DNA, 20 bp, Artificial Sequence
  Description of Artificial Sequence: Synthetic oligonucleotide
  Target: SCN10A; (-) strand; PAM type: NRG; PAM sequence: GAG
ttttttttttttttgagaca

SEQ ID NO: 18662 - DNA, 20 bp, Artificial Sequence
  Description of Artificial Sequence: Synthetic oligonucleotide
  Target: SCN10A; (-) strand; PAM type: NRG; PAM sequence: CAG
ttttttttttttttttgaga

SEQ ID NO: 18663 - DNA, 20 bp, Artificial Sequence
  Description of Artificial Sequence: Synthetic oligonucleotide
  Target: SCN10A; (-) strand; PAM type: NRG; PAM sequence: GAG
tttttttttttttttttttt

SEQ ID NO: 18664 - DNA, 20 bp, Artificial Sequence
  Description of Artificial Sequence: Synthetic oligonucleotide
  Target: SCN10A; (-) strand; PAM type: NRG; PAM sequence: GAG
catcatgtgaaaataacaat

SEQ ID NO: 18665 - DNA, 20 bp, Artificial Sequence
  Description of Artificial Sequence: Synthetic oligonucleotide
  Target: SCN10A; (-) strand; PAM type: NRG; PAM sequence: TAG
atatttaacatttttgtatc

SEQ ID NO: 18666 - DNA, 20 bp, Artificial Sequence
  Description of Artificial Sequence: Synthetic oligonucleotide
  Target: SCN10A; (-) strand; PAM type: NRG; PAM sequence: TAG
tcttttctggcatttttggc

SEQ ID NO: 18667 - DNA, 20 bp, Artificial Sequence
  Description of Artificial Sequence: Synthetic oligonucleotide
  Target: SCN10A; (-) strand; PAM type: NRG; PAM sequence: TGG
atgttcttttctggcatttt

SEQ ID NO: 18668 - DNA, 20 bp, Artificial Sequence
  Description of Artificial Sequence: Synthetic oligonucleotide
  Target: SCN10A; (-) strand; PAM type: NRG; PAM sequence: TGG
tcttcttaaatgttcttttc

SEQ ID NO: 18669 - DNA, 20 bp, Artificial Sequence
  Description of Artificial Sequence: Synthetic oligonucleotide
  Target: SCN10A; (-) strand; PAM type: NRG; PAM sequence: AGG
gtttttataattttctccat

SEQ ID NO: 18670 - DNA, 20 bp, Artificial Sequence
  Description of Artificial Sequence: Synthetic oligonucleotide
  Target: SCN10A; (-) strand; PAM type: NRG; PAM sequence: TAG
ggtttttataattttctcca

SEQ ID NO: 18671 - DNA, 20 bp, Artificial Sequence
  Description of Artificial Sequence: Synthetic oligonucleotide
  Target: SCN10A; (-) strand; PAM type: NRG; PAM sequence: AGG
agtttaaaaatgtttccatg

SEQ ID NO: 18672 - DNA, 20 bp, Artificial Sequence
  Description of Artificial Sequence: Synthetic oligonucleotide
  Target: SCN10A; (-) strand; PAM type: NRG; PAM sequence: GAG
aagtttaaaaatgtttccat

SEQ ID NO: 18673 - DNA, 20 bp, Artificial Sequence
  Description of Artificial Sequence: Synthetic oligonucleotide
  Target: SCN10A; (-) strand; PAM type: NRG; PAM sequence: AAG
tgtataccagtctttcaata

SEQ ID NO: 18674 - DNA, 20 bp, Artificial Sequence
  Description of Artificial Sequence: Synthetic oligonucleotide
  Target: SCN10A; (-) strand; PAM type: NRG; PAM sequence: CAG
agatagtatacgctgtatac

SEQ ID NO: 18675 - DNA, 20 bp, Artificial Sequence
  Description of Artificial Sequence: Synthetic oligonucleotide
  Target: SCN10A; (-) strand; PAM type: NRG; PAM sequence: TAG
agtcttctgatctatgaaga

SEQ ID NO: 18676 - DNA, 20 bp, Artificial Sequence
  Description of Artificial Sequence: Synthetic oligonucleotide
  Target: SCN10A; (-) strand; PAM type: NRG; PAM sequence: AAG
attcagtcttctgatctatg

SEQ ID NO: 18677 - DNA, 20 bp, Artificial Sequence
  Description of Artificial Sequence: Synthetic oligonucleotide
  Target: SCN10A; (-) strand; PAM type: NRG; PAM sequence: CAG
cttataatctttacataatt

SEQ ID NO: 18678 - DNA, 20 bp, Artificial Sequence
  Description of Artificial Sequence: Synthetic oligonucleotide
  Target: SCN10A; (-) strand; PAM type: NRG; PAM sequence: AAG
aattgataggtcaatttggg

SEQ ID NO: 18679 - DNA, 20 bp, Artificial Sequence
  Description of Artificial Sequence: Synthetic oligonucleotide
  Target: SCN10A; (-) strand; PAM type: NRG; PAM sequence: GGG
tgtaattgataggtcaattt

SEQ ID NO: 18680 - DNA, 20 bp, Artificial Sequence
  Description of Artificial Sequence: Synthetic oligonucleotide
  Target: SCN10A; (-) strand; PAM type: NRG; PAM sequence: TGG
ctgtaattgataggtcaatt

SEQ ID NO: 18681 - DNA, 20 bp, Artificial Sequence
  Description of Artificial Sequence: Synthetic oligonucleotide
  Target: SCN10A; (-) strand; PAM type: NRG; PAM sequence: AGG
tagggactgctgtaattgat

SEQ ID NO: 18682 - DNA, 20 bp, Artificial Sequence
  Description of Artificial Sequence: Synthetic oligonucleotide
  Target: SCN10A; (-) strand; PAM type: NRG; PAM sequence: TAG
ttagggactgctgtaattga

SEQ ID NO: 18683 - DNA, 20 bp, Artificial Sequence
  Description of Artificial Sequence: Synthetic oligonucleotide
  Target: SCN10A; (-) strand; PAM type: NRG; PAM sequence: GGG
tgctattgtttttcccatta

SEQ ID NO: 18684 - DNA, 20 bp, Artificial Sequence
  Description of Artificial Sequence: Synthetic oligonucleotide
  Target: SCN10A; (-) strand; PAM type: NRG; PAM sequence: AGG
ctgctattgtttttcccatt

SEQ ID NO: 18685 - DNA, 20 bp, Artificial Sequence
  Description of Artificial Sequence: Synthetic oligonucleotide
  Target: SCN10A; (-) strand; PAM type: NRG; PAM sequence: TAG
actgctattgtttttcccat

SEQ ID NO: 18686 - DNA, 20 bp, Artificial Sequence
  Description of Artificial Sequence: Synthetic oligonucleotide
  Target: SCN10A; (-) strand; PAM type: NRG; PAM sequence: AAG
cactttagaattatcttgcc

SEQ ID NO: 18687 - DNA, 20 bp, Artificial Sequence
  Description of Artificial Sequence: Synthetic oligonucleotide
  Target: SCN10A; (-) strand; PAM type: NRG; PAM sequence: TAG
gcacactttcatattcactt

SEQ ID NO: 18688 - DNA, 20 bp, Artificial Sequence
  Description of Artificial Sequence: Synthetic oligonucleotide
  Target: SCN10A; (-) strand; PAM type: NRG; PAM sequence: TGG
aatttacttcaagaatatct

SEQ ID NO: 18689 - DNA, 20 bp, Artificial Sequence
  Description of Artificial Sequence: Synthetic oligonucleotide
  Target: SCN10A; (-) strand; PAM type: NRG; PAM sequence: AAG
taatccacctaatttacttc

SEQ ID NO: 18690 - DNA, 20 bp, Artificial Sequence
  Description of Artificial Sequence: Synthetic oligonucleotide
  Target: SCN10A; (-) strand; PAM type: NRG; PAM sequence: AAG
tatatctgtgtctgtaaatc

SEQ ID NO: 18691 - DNA, 20 bp, Artificial Sequence
  Description of Artificial Sequence: Synthetic oligonucleotide
  Target: SCN10A; (-) strand; PAM type: NRG; PAM sequence: CAG
aatatcagtcttaattatgg

SEQ ID NO: 18692 - DNA, 20 bp, Artificial Sequence
  Description of Artificial Sequence: Synthetic oligonucleotide
  Target: SCN10A; (-) strand; PAM type: NRG; PAM sequence: TGG
accaatatcagtcttaatta

SEQ ID NO: 18693 - DNA, 20 bp, Artificial Sequence
  Description of Artificial Sequence: Synthetic oligonucleotide
  Target: SCN10A; (-) strand; PAM type: NRG; PAM sequence: CAG
gtctatcctggcaccaatat

SEQ ID NO: 18694 - DNA, 20 bp, Artificial Sequence
  Description of Artificial Sequence: Synthetic oligonucleotide
  Target: SCN10A; (-) strand; PAM type: NRG; PAM sequence: TGG
gttagtccattggtctatcc

SEQ ID NO: 18695 - DNA, 20 bp, Artificial Sequence
  Description of Artificial Sequence: Synthetic oligonucleotide
  Target: SCN10A; (-) strand; PAM type: NRG; PAM sequence: TGG
catttgctctgttagtccat

SEQ ID NO: 18696 - DNA, 20 bp, Artificial Sequence
  Description of Artificial Sequence: Synthetic oligonucleotide
  Target: SCN10A; (-) strand; PAM type: NRG; PAM sequence: TAG
ccttgctccatttgctctgt

SEQ ID NO: 18697 - DNA, 20 bp, Artificial Sequence
  Description of Artificial Sequence: Synthetic oligonucleotide
  Target: SCN10A; (-) strand; PAM type: NRG; PAM sequence: AAG
gcttctcctcccgtcactta

SEQ ID NO: 18698 - DNA, 20 bp, Artificial Sequence
  Description of Artificial Sequence: Synthetic oligonucleotide
  Target: SCN10A; (-) strand; PAM type: NRG; PAM sequence: TAG
gtcttccttctctcccaaaa

SEQ ID NO: 18699 - DNA, 20 bp, Artificial Sequence
  Description of Artificial Sequence: Synthetic oligonucleotide
  Target: SCN10A; (-) strand; PAM type: NRG; PAM sequence: AAG
gggaaaaaggaagaaataaa

SEQ ID NO: 18700 - DNA, 20 bp, Artificial Sequence
  Description of Artificial Sequence: Synthetic oligonucleotide
  Target: SCN10A; (-) strand; PAM type: NRG; PAM sequence: AAG
ggaaggtggagggaaaaagg

SEQ ID NO: 18701 - DNA, 20 bp, Artificial Sequence
  Description of Artificial Sequence: Synthetic oligonucleotide
  Target: SCN10A; (-) strand; PAM type: NRG; PAM sequence: AGG
agaggaaggtggagggaaaa

SEQ ID NO: 18702 - DNA, 20 bp, Artificial Sequence
  Description of Artificial Sequence: Synthetic oligonucleotide
  Target: SCN10A; (-) strand; PAM type: NRG; PAM sequence: AAG
gagaggaaggtggagggaaa

SEQ ID NO: 18703 - DNA, 20 bp, Artificial Sequence
  Description of Artificial Sequence: Synthetic oligonucleotide
  Target: SCN10A; (-) strand; PAM type: NRG; PAM sequence: GGG
aagaaagagaggaaggtgga

SEQ ID NO: 18704 - DNA, 20 bp, Artificial Sequence
  Description of Artificial Sequence: Synthetic oligonucleotide
  Target: SCN10A; (-) strand; PAM type: NRG; PAM sequence: AGG
aaagaaagagaggaaggtgg

SEQ ID NO: 18705 - DNA, 20 bp, Artificial Sequence
  Description of Artificial Sequence: Synthetic oligonucleotide
  Target: SCN10A; (-) strand; PAM type: NRG; PAM sequence: GAG
gaaagaaagagaggaaggtg

SEQ ID NO: 18706 - DNA, 20 bp, Artificial Sequence
  Description of Artificial Sequence: Synthetic oligonucleotide
  Target: SCN10A; (-) strand; PAM type: NRG; PAM sequence: TGG
aggaaagaaagagaggaagg

SEQ ID NO: 18707 - DNA, 20 bp, Artificial Sequence
  Description of Artificial Sequence: Synthetic oligonucleotide
  Target: SCN10A; (-) strand; PAM type: NRG; PAM sequence: AGG
ggaaggaaagaaagagagga

SEQ ID NO: 18708 - DNA, 20 bp, Artificial Sequence
  Description of Artificial Sequence: Synthetic oligonucleotide
  Target: SCN10A; (-) strand; PAM type: NRG; PAM sequence: AAG
aggaaggaaagaaagagagg

SEQ ID NO: 18709 - DNA, 20 bp, Artificial Sequence
  Description of Artificial Sequence: Synthetic oligonucleotide
  Target: SCN10A; (-) strand; PAM type: NRG; PAM sequence: AGG
tgaaggaaggaaagaaagag

SEQ ID NO: 18710 - DNA, 20 bp, Artificial Sequence
  Description of Artificial Sequence: Synthetic oligonucleotide
  Target: SCN10A; (-) strand; PAM type: NRG; PAM sequence: GAG
ttgaaggaaggaaagaaaga

SEQ ID NO: 18711 - DNA, 20 bp, Artificial Sequence
  Description of Artificial Sequence: Synthetic oligonucleotide
  Target: SCN10A; (-) strand; PAM type: NRG; PAM sequence: GAG
gattgaaggaaggaaagaaa

SEQ ID NO: 18712 - DNA, 20 bp, Artificial Sequence
  Description of Artificial Sequence: Synthetic oligonucleotide
  Target: SCN10A; (-) strand; PAM type: NRG; PAM sequence: AAG
ttgattgaaggaaggaaaga

SEQ ID NO: 18713 - DNA, 20 bp, Artificial Sequence
  Description of Artificial Sequence: Synthetic oligonucleotide
  Target: SCN10A; (-) strand; PAM type: NRG; PAM sequence: AAG
ttgattgattgaaggaagga

SEQ ID NO: 18714 - DNA, 20 bp, Artificial Sequence
  Description of Artificial Sequence: Synthetic oligonucleotide
  Target: SCN10A; (-) strand; PAM type: NRG; PAM sequence: AGG
cctgttgattgattgaagga

SEQ ID NO: 18715 - DNA, 20 bp, Artificial Sequence
  Description of Artificial Sequence: Synthetic oligonucleotide
  Target: SCN10A; (-) strand; PAM type: NRG; PAM sequence: AAG
acctgttgattgattgaagg

SEQ ID NO: 18716 - DNA, 20 bp, Artificial Sequence
  Description of Artificial Sequence: Synthetic oligonucleotide
  Target: SCN10A; (-) strand; PAM type: NRG; PAM sequence: AGG
aacacctgttgattgattga

SEQ ID NO: 18717 - DNA, 20 bp, Artificial Sequence
  Description of Artificial Sequence: Synthetic oligonucleotide
  Target: SCN10A; (-) strand; PAM type: NRG; PAM sequence: AAG
aaacacctgttgattgattg

SEQ ID NO: 18718 - DNA, 20 bp, Artificial Sequence
  Description of Artificial Sequence: Synthetic oligonucleotide
  Target: SCN10A; (-) strand; PAM type: NRG; PAM sequence: AGG
acaaggcccagcacatacat

SEQ ID NO: 18719 - DNA, 20 bp, Artificial Sequence
  Description of Artificial Sequence: Synthetic oligonucleotide
  Target: SCN10A; (-) strand; PAM type: NRG; PAM sequence: TAG
cacaaggcccagcacataca

SEQ ID NO: 18720 - DNA, 20 bp, Artificial Sequence
  Description of Artificial Sequence: Synthetic oligonucleotide
  Target: SCN10A; (-) strand; PAM type: NRG; PAM sequence: CAG
caagggcctagcacaaggcc

SEQ ID NO: 18721 - DNA, 20 bp, Artificial Sequence
  Description of Artificial Sequence: Synthetic oligonucleotide
  Target: SCN10A; (-) strand; PAM type: NRG; PAM sequence: AGG
tatcccaagggcctagcaca

SEQ ID NO: 18722 - DNA, 20 bp, Artificial Sequence
  Description of Artificial Sequence: Synthetic oligonucleotide
  Target: SCN10A; (-) strand; PAM type: NRG; PAM sequence: AAG
ttatcccaagggcctagcac

SEQ ID NO: 18723 - DNA, 20 bp, Artificial Sequence
  Description of Artificial Sequence: Synthetic oligonucleotide
  Target: SCN10A; (-) strand; PAM type: NRG; PAM sequence: TAG
accgttttatcccaagggcc

SEQ ID NO: 18724 - DNA, 20 bp, Artificial Sequence
  Description of Artificial Sequence: Synthetic oligonucleotide
  Target: SCN10A; (-) strand; PAM type: NRG; PAM sequence: GGG
tgtctaccgttttatcccaa

SEQ ID NO: 18725 - DNA, 20 bp, Artificial Sequence
  Description of Artificial Sequence: Synthetic oligonucleotide
  Target: SCN10A; (-) strand; PAM type: NRG; PAM sequence: AGG
ttgtctaccgttttatccca

SEQ ID NO: 18726 - DNA, 20 bp, Artificial Sequence
  Description of Artificial Sequence: Synthetic oligonucleotide
  Target: SCN10A; (-) strand; PAM type: NRG; PAM sequence: AAG
cttgtctaccgttttatccc

SEQ ID NO: 18727 - DNA, 20 bp, Artificial Sequence
  Description of Artificial Sequence: Synthetic oligonucleotide
  Target: SCN10A; (-) strand; PAM type: NRG; PAM sequence: GAG
atcccatgaggcaaaaacca

SEQ ID NO: 18728 - DNA, 20 bp, Artificial Sequence
  Description of Artificial Sequence: Synthetic oligonucleotide
  Target: SCN10A; (-) strand; PAM type: NRG; PAM sequence: CAG
ctatcccatgaggcaaaaac

SEQ ID NO: 18729 - DNA, 20 bp, Artificial Sequence
  Description of Artificial Sequence: Synthetic oligonucleotide
  Target: SCN10A; (-) strand; PAM type: NRG; PAM sequence: AGG
aattgtcctgctatcccatg

SEQ ID NO: 18730 - DNA, 20 bp, Artificial Sequence
  Description of Artificial Sequence: Synthetic oligonucleotide
  Target: SCN10A; (-) strand; PAM type: NRG; PAM sequence: GAG
caattgtcctgctatcccat

SEQ ID NO: 18731 - DNA, 20 bp, Artificial Sequence
  Description of Artificial Sequence: Synthetic oligonucleotide
  Target: SCN10A; (-) strand; PAM type: NRG; PAM sequence: TGG
attccttcatcaaattaacc

SEQ ID NO: 18732 - DNA, 20 bp, Artificial Sequence
  Description of Artificial Sequence: Synthetic oligonucleotide
  Target: SCN10A; (-) strand; PAM type: NRG; PAM sequence: TGG
ccaaccacactatctaaagt

SEQ ID NO: 18733 - DNA, 20 bp, Artificial Sequence
  Description of Artificial Sequence: Synthetic oligonucleotide
  Target: SCN10A; (-) strand; PAM type: NRG; PAM sequence: AAG
ctccccaaccacactatcta

SEQ ID NO: 18734 - DNA, 20 bp, Artificial Sequence
  Description of Artificial Sequence: Synthetic oligonucleotide
  Target: SCN10A; (-) strand; PAM type: NRG; PAM sequence: GGG
cacttgtcacctccttagag

SEQ ID NO: 18735 - DNA, 20 bp, Artificial Sequence
  Description of Artificial Sequence: Synthetic oligonucleotide
  Target: SCN10A; (-) strand; PAM type: NRG; PAM sequence: GGG
gcacttgtcacctccttaga

SEQ ID NO: 18736 - DNA, 20 bp, Artificial Sequence
  Description of Artificial Sequence: Synthetic oligonucleotide
  Target: SCN10A; (-) strand; PAM type: NRG; PAM sequence: AGG
tgcacttgtcacctccttag

SEQ ID NO: 18737 - DNA, 20 bp, Artificial Sequence
  Description of Artificial Sequence: Synthetic oligonucleotide
  Target: SCN10A; (-) strand; PAM type: NRG; PAM sequence: GAG
atgcacttgtcacctcctta

SEQ ID NO: 18738 - DNA, 20 bp, Artificial Sequence
  Description of Artificial Sequence: Synthetic oligonucleotide
  Target: SCN10A; (-) strand; PAM type: NRG; PAM sequence: TAG
caatgcacttgtcacctcct

SEQ ID NO: 18739 - DNA, 20 bp, Artificial Sequence
  Description of Artificial Sequence: Synthetic oligonucleotide
  Target: SCN10A; (-) strand; PAM type: NRG; PAM sequence: TAG
cttttcctttagtcttcact

SEQ ID NO: 18740 - DNA, 20 bp, Artificial Sequence
  Description of Artificial Sequence: Synthetic oligonucleotide
  Target: SCN10A; (-) strand; PAM type: NRG; PAM sequence: TAG
tgcctggaatacttttcctt

SEQ ID NO: 18741 - DNA, 20 bp, Artificial Sequence
  Description of Artificial Sequence: Synthetic oligonucleotide
  Target: SCN10A; (-) strand; PAM type: NRG; PAM sequence: TGG
gaagtttttttcgctgtgcc

SEQ ID NO: 18742 - DNA, 20 bp, Artificial Sequence
  Description of Artificial Sequence: Synthetic oligonucleotide
  Target: SCN10A; (-) strand; PAM type: NRG; PAM sequence: AAG
ttcttggctttgggcctttg

SEQ ID NO: 18743 - DNA, 20 bp, Artificial Sequence
  Description of Artificial Sequence: Synthetic oligonucleotide
  Target: SCN10A; (-) strand; PAM type: NRG; PAM sequence: GGG
acagagaacttcttggcttt

SEQ ID NO: 18744 - DNA, 20 bp, Artificial Sequence
  Description of Artificial Sequence: Synthetic oligonucleotide
  Target: SCN10A; (-) strand; PAM type: NRG; PAM sequence: TGG
aacagagaacttcttggctt

SEQ ID NO: 18745 - DNA, 20 bp, Artificial Sequence
  Description of Artificial Sequence: Synthetic oligonucleotide
  Target: SCN10A; (-) strand; PAM type: NRG; PAM sequence: TGG
acacataacagagaacttct

SEQ ID NO: 18746 - DNA, 20 bp, Artificial Sequence
  Description of Artificial Sequence: Synthetic oligonucleotide
  Target: SCN10A; (-) strand; PAM type: NRG; PAM sequence: GAG
tctcttcttcacacataaca

SEQ ID NO: 18747 - DNA, 20 bp, Artificial Sequence
  Description of Artificial Sequence: Synthetic oligonucleotide
  Target: SCN10A; (-) strand; PAM type: NRG; PAM sequence: CAG
tctctcttcttcacacataa

SEQ ID NO: 18748 - DNA, 20 bp, Artificial Sequence
  Description of Artificial Sequence: Synthetic oligonucleotide
  Target: SCN10A; (-) strand; PAM type: NRG; PAM sequence: AGG
ccactttgctccagccaaaa

SEQ ID NO: 18749 - DNA, 20 bp, Artificial Sequence
  Description of Artificial Sequence: Synthetic oligonucleotide
  Target: SCN10A; (-) strand; PAM type: NRG; PAM sequence: AAG
cccactttgctccagccaaa

SEQ ID NO: 18750 - DNA, 20 bp, Artificial Sequence
  Description of Artificial Sequence: Synthetic oligonucleotide
  Target: SCN10A; (-) strand; PAM type: NRG; PAM sequence: CAG
ccgtcttgcccactttgctc

SEQ ID NO: 18751 - DNA, 20 bp, Artificial Sequence
  Description of Artificial Sequence: Synthetic oligonucleotide
  Target: SCN10A; (-) strand; PAM type: NRG; PAM sequence: CAG
atcaggacctgccagttcac

SEQ ID NO: 18752 - DNA, 20 bp, Artificial Sequence
  Description of Artificial Sequence: Synthetic oligonucleotide
  Target: SCN10A; (-) strand; PAM type: NRG; PAM sequence: CAG
tctgcataatcaggacctgc

SEQ ID NO: 18753 - DNA, 20 bp, Artificial Sequence
  Description of Artificial Sequence: Synthetic oligonucleotide
  Target: SCN10A; (-) strand; PAM type: NRG; PAM sequence: AGG
gtacaaagttctgcataatc

SEQ ID NO: 18754 - DNA, 20 bp, Artificial Sequence
  Description of Artificial Sequence: Synthetic oligonucleotide
  Target: SCN10A; (-) strand; PAM type: NRG; PAM sequence: CAG
tgtacaaagttctgcataat

SEQ ID NO: 18755 - DNA, 20 bp, Artificial Sequence
  Description of Artificial Sequence: Synthetic oligonucleotide
  Target: SCN10A; (-) strand; PAM type: NRG; PAM sequence: AAG
actcctcatgatggtgtaca

SEQ ID NO: 18756 - DNA, 20 bp, Artificial Sequence
  Description of Artificial Sequence: Synthetic oligonucleotide
  Target: SCN10A; (-) strand; PAM type: NRG; PAM sequence: TGG
aaaatccagactcctcatga

SEQ ID NO: 18757 - DNA, 20 bp, Artificial Sequence
  Description of Artificial Sequence: Synthetic oligonucleotide
  Target: SCN10A; (-) strand; PAM type: NRG; PAM sequence: CAG
attgctctgagaataaaatc

SEQ ID NO: 18758 - DNA, 20 bp, Artificial Sequence
  Description of Artificial Sequence: Synthetic oligonucleotide
  Target: SCN10A; (-) strand; PAM type: NRG; PAM sequence: GAG
cactggtttcccattgctct

SEQ ID NO: 18759 - DNA, 20 bp, Artificial Sequence
  Description of Artificial Sequence: Synthetic oligonucleotide
  Target: SCN10A; (-) strand; PAM type: NRG; PAM sequence: TGG
tttgttacaaataacttcac

SEQ ID NO: 18760 - DNA, 20 bp, Artificial Sequence
  Description of Artificial Sequence: Synthetic oligonucleotide
  Target: SCN10A; (-) strand; PAM type: NRG; PAM sequence: TAG
ctattaccaacatcttatgt

SEQ ID NO: 18761 - DNA, 20 bp, Artificial Sequence
  Description of Artificial Sequence: Synthetic oligonucleotide
  Target: SCN10A; (-) strand; PAM type: NRG; PAM sequence: GAG
cacacacacacacacacaca

SEQ ID NO: 18762 - DNA, 20 bp, Artificial Sequence
  Description of Artificial Sequence: Synthetic oligonucleotide
  Target: SCN10A; (-) strand; PAM type: NRG; PAM sequence: CAG
cacacacacacacacacaca

SEQ ID NO: 18763 - DNA, 20 bp, Artificial Sequence
  Description of Artificial Sequence: Synthetic oligonucleotide
  Target: SCN10A; (-) strand; PAM type: NRG; PAM sequence: AAG
actggagcagattgaacaga

SEQ ID NO: 18764 - DNA, 20 bp, Artificial Sequence
  Description of Artificial Sequence: Synthetic oligonucleotide
  Target: SCN10A; (-) strand; PAM type: NRG; PAM sequence: CAG
gaaaactggagcagattgaa

SEQ ID NO: 18765 - DNA, 20 bp, Artificial Sequence
  Description of Artificial Sequence: Synthetic oligonucleotide
  Target: SCN10A; (-) strand; PAM type: NRG; PAM sequence: CAG
cagttttcagaaaactggag

SEQ ID NO: 18766 - DNA, 20 bp, Artificial Sequence
  Description of Artificial Sequence: Synthetic oligonucleotide
  Target: SCN10A; (-) strand; PAM type: NRG; PAM sequence: GAG
tttcagttttcagaaaactg

SEQ ID NO: 18767 - DNA, 20 bp, Artificial Sequence
  Description of Artificial Sequence: Synthetic oligonucleotide
  Target: SCN10A; (-) strand; PAM type: NRG; PAM sequence: TGG
gttttcagttttcagaaaac

SEQ ID NO: 18768 - DNA, 20 bp, Artificial Sequence
  Description of Artificial Sequence: Synthetic oligonucleotide
  Target: SCN10A; (-) strand; PAM type: NRG; PAM sequence: CAG
tcaggacagttttcagtttt

SEQ ID NO: 18769 - DNA, 20 bp, Artificial Sequence
  Description of Artificial Sequence: Synthetic oligonucleotide
  Target: SCN10A; (-) strand; PAM type: NRG; PAM sequence: CAG
tttattttcaggacagtttt

SEQ ID NO: 18770 - DNA, 20 bp, Artificial Sequence
  Description of Artificial Sequence: Synthetic oligonucleotide
  Target: SCN10A; (-) strand; PAM type: NRG; PAM sequence: CAG
aatagactttattttcagga

SEQ ID NO: 18771 - DNA, 20 bp, Artificial Sequence
  Description of Artificial Sequence: Synthetic oligonucleotide
  Target: SCN10A; (-) strand; PAM type: NRG; PAM sequence: AGG
aattaatagactttattttc

SEQ ID NO: 18772 - DNA, 20 bp, Artificial Sequence
  Description of Artificial Sequence: Synthetic oligonucleotide
  Target: SCN10A; (-) strand; PAM type: NRG; PAM sequence: CAG
taattaatagactttatttt

SEQ ID NO: 18773 - DNA, 20 bp, Artificial Sequence
  Description of Artificial Sequence: Synthetic oligonucleotide
  Target: SCN10A; (-) strand; PAM type: NRG; PAM sequence: TAG
agtttcctggttttaattaa

SEQ ID NO: 18774 - DNA, 20 bp, Artificial Sequence
  Description of Artificial Sequence: Synthetic oligonucleotide
  Target: SCN10A; (-) strand; PAM type: NRG; PAM sequence: TGG
ccgccagctggtcagtttcc

SEQ ID NO: 18775 - DNA, 20 bp, Artificial Sequence
  Description of Artificial Sequence: Synthetic oligonucleotide
  Target: SCN10A; (-) strand; PAM type: NRG; PAM sequence: CAG
aaaaatcaccgccagctggt

SEQ ID NO: 18776 - DNA, 20 bp, Artificial Sequence
  Description of Artificial Sequence: Synthetic oligonucleotide
  Target: SCN10A; (-) strand; PAM type: NRG; PAM sequence: TGG
ggagaaaaatcaccgccagc

SEQ ID NO: 18777 - DNA, 20 bp, Artificial Sequence
  Description of Artificial Sequence: Synthetic oligonucleotide
  Target: SCN10A; (-) strand; PAM type: NRG; PAM sequence: CAG
tgctggagaaaaatcaccgc

SEQ ID NO: 18778 - DNA, 20 bp, Artificial Sequence
  Description of Artificial Sequence: Synthetic oligonucleotide
  Target: SCN10A; (-) strand; PAM type: NRG; PAM sequence: GAG
ctgagctgtgagaaatgctg

SEQ ID NO: 18779 - DNA, 20 bp, Artificial Sequence
  Description of Artificial Sequence: Synthetic oligonucleotide
  Target: SCN10A; (-) strand; PAM type: NRG; PAM sequence: TGG
acctgagctgtgagaaatgc

SEQ ID NO: 18780 - DNA, 20 bp, Artificial Sequence
  Description of Artificial Sequence: Synthetic oligonucleotide
  Target: SCN10A; (-) strand; PAM type: NRG; PAM sequence: GAG
cttgtctgcacctgagctgt

SEQ ID NO: 18781 - DNA, 20 bp, Artificial Sequence
  Description of Artificial Sequence: Synthetic oligonucleotide
  Target: SCN10A; (-) strand; PAM type: NRG; PAM sequence: GAG
tctccaccttgtctgcacct

SEQ ID NO: 18782 - DNA, 20 bp, Artificial Sequence
  Description of Artificial Sequence: Synthetic oligonucleotide
  Target: SCN10A; (-) strand; PAM type: NRG; PAM sequence: AAG
aaaacctcaccggagagtct

SEQ ID NO: 18783 - DNA, 20 bp, Artificial Sequence
  Description of Artificial Sequence: Synthetic oligonucleotide
  Target: SCN10A; (-) strand; PAM type: NRG; PAM sequence: GAG
tttgccaaaacctcaccgga

SEQ ID NO: 18784 - DNA, 20 bp, Artificial Sequence
  Description of Artificial Sequence: Synthetic oligonucleotide
  Target: SCN10A; (-) strand; PAM type: NRG; PAM sequence: GAG
tgtttgccaaaacctcaccg

SEQ ID NO: 18785 - DNA, 20 bp, Artificial Sequence
  Description of Artificial Sequence: Synthetic oligonucleotide
  Target: SCN10A; (-) strand; PAM type: NRG; PAM sequence: CGG
tgtgtttgccaaaacctcac

SEQ ID NO: 18786 - DNA, 20 bp, Artificial Sequence
  Description of Artificial Sequence: Synthetic oligonucleotide
  Target: SCN10A; (-) strand; PAM type: NRG; PAM sequence: CAG
atgacctagcttagatttca

SEQ ID NO: 18787 - DNA, 20 bp, Artificial Sequence
  Description of Artificial Sequence: Synthetic oligonucleotide
  Target: SCN10A; (-) strand; PAM type: NRG; PAM sequence: TAG
acttccctcatgacctagct

SEQ ID NO: 18788 - DNA, 20 bp, Artificial Sequence
  Description of Artificial Sequence: Synthetic oligonucleotide
  Target: SCN10A; (-) strand; PAM type: NRG; PAM sequence: TAG
attccacttccctcatgacc

SEQ ID NO: 18789 - DNA, 20 bp, Artificial Sequence
  Description of Artificial Sequence: Synthetic oligonucleotide
  Target: SCN10A; (-) strand; PAM type: NRG; PAM sequence: GGG
caccaactacacactttctt

SEQ ID NO: 18790 - DNA, 20 bp, Artificial Sequence
  Description of Artificial Sequence: Synthetic oligonucleotide
  Target: SCN10A; (-) strand; PAM type: NRG; PAM sequence: TGG
ccaccaactacacactttct

SEQ ID NO: 18791 - DNA, 20 bp, Artificial Sequence
  Description of Artificial Sequence: Synthetic oligonucleotide
  Target: SCN10A; (-) strand; PAM type: NRG; PAM sequence: CAG
cgctgatttaacatgctgat

SEQ ID NO: 18792 - DNA, 20 bp, Artificial Sequence
  Description of Artificial Sequence: Synthetic oligonucleotide
  Target: SCN10A; (-) strand; PAM type: NRG; PAM sequence: GGG
gcccctacaggattctgcag

SEQ ID NO: 18793 - DNA, 20 bp, Artificial Sequence
  Description of Artificial Sequence: Synthetic oligonucleotide
  Target: SCN10A; (-) strand; PAM type: NRG; PAM sequence: GGG
tgcccctacaggattctgca

SEQ ID NO: 18794 - DNA, 20 bp, Artificial Sequence
  Description of Artificial Sequence: Synthetic oligonucleotide
  Target: SCN10A; (-) strand; PAM type: NRG; PAM sequence: AGG
ctgcccctacaggattctgc

SEQ ID NO: 18795 - DNA, 20 bp, Artificial Sequence
  Description of Artificial Sequence: Synthetic oligonucleotide
  Target: SCN10A; (-) strand; PAM type: NRG; PAM sequence: CAG
tctgcccctacaggattctg

SEQ ID NO: 18796 - DNA, 20 bp, Artificial Sequence
  Description of Artificial Sequence: Synthetic oligonucleotide
  Target: SCN10A; (-) strand; PAM type: NRG; PAM sequence: AGG
acttcacagtctgcccctac

SEQ ID NO: 18797 - DNA, 20 bp, Artificial Sequence
  Description of Artificial Sequence: Synthetic oligonucleotide
  Target: SCN10A; (-) strand; PAM type: NRG; PAM sequence: CAG
tacttcacagtctgccccta

SEQ ID NO: 18798 - DNA, 20 bp, Artificial Sequence
  Description of Artificial Sequence: Synthetic oligonucleotide
  Target: SCN10A; (-) strand; PAM type: NRG; PAM sequence: CAG
aaataggcaagtttacttca

SEQ ID NO: 18799 - DNA, 20 bp, Artificial Sequence
  Description of Artificial Sequence: Synthetic oligonucleotide
  Target: SCN10A; (-) strand; PAM type: NRG; PAM sequence: AAG
ccaaacaaccaaaaataggc

SEQ ID NO: 18800 - DNA, 20 bp, Artificial Sequence
  Description of Artificial Sequence: Synthetic oligonucleotide
  Target: SCN10A; (-) strand; PAM type: NRG; PAM sequence: AGG
agtcccaaacaaccaaaaat

SEQ ID NO: 18801 - DNA, 20 bp, Artificial Sequence
  Description of Artificial Sequence: Synthetic oligonucleotide
  Target: SCN10A; (-) strand; PAM type: NRG; PAM sequence: TAG
aagtcccaaacaaccaaaaa

SEQ ID NO: 18802 - DNA, 20 bp, Artificial Sequence
  Description of Artificial Sequence: Synthetic oligonucleotide
  Target: SCN10A; (-) strand; PAM type: NRG; PAM sequence: AAG
tgttctgatcccacagtcta

SEQ ID NO: 18803 - DNA, 20 bp, Artificial Sequence
  Description of Artificial Sequence: Synthetic oligonucleotide
  Target: SCN10A; (-) strand; PAM type: NRG; PAM sequence: CAG
ctacttttgttctgatccca

SEQ ID NO: 18804 - DNA, 20 bp, Artificial Sequence
  Description of Artificial Sequence: Synthetic oligonucleotide
  Target: SCN10A; (-) strand; PAM type: NRG; PAM sequence: AGG
agcagaagcttagtgtttta

SEQ ID NO: 18805 - DNA, 20 bp, Artificial Sequence
  Description of Artificial Sequence: Synthetic oligonucleotide
  Target: SCN10A; (-) strand; PAM type: NRG; PAM sequence: AAG
aagcagaagcttagtgtttt

SEQ ID NO: 18806 - DNA, 20 bp, Artificial Sequence
  Description of Artificial Sequence: Synthetic oligonucleotide
  Target: SCN10A; (-) strand; PAM type: NRG; PAM sequence: TAG
cacttggggaagcagaagct

SEQ ID NO: 18807 - DNA, 20 bp, Artificial Sequence
  Description of Artificial Sequence: Synthetic oligonucleotide
  Target: SCN10A; (-) strand; PAM type: NRG; PAM sequence: AAG
tgctacacttggggaagcag

SEQ ID NO: 18808 - DNA, 20 bp, Artificial Sequence
  Description of Artificial Sequence: Synthetic oligonucleotide
  Target: SCN10A; (-) strand; PAM type: NRG; PAM sequence: CAG
ttctgctacacttggggaag

SEQ ID NO: 18809 - DNA, 20 bp, Artificial Sequence
  Description of Artificial Sequence: Synthetic oligonucleotide
  Target: SCN10A; (-) strand; PAM type: NRG; PAM sequence: AAG
catttctgctacacttgggg

SEQ ID NO: 18810 - DNA, 20 bp, Artificial Sequence
  Description of Artificial Sequence: Synthetic oligonucleotide
  Target: SCN10A; (-) strand; PAM type: NRG; PAM sequence: GGG
gaacatttctgctacacttg

SEQ ID NO: 18811 - DNA, 20 bp, Artificial Sequence
  Description of Artificial Sequence: Synthetic oligonucleotide
  Target: SCN10A; (-) strand; PAM type: NRG; PAM sequence: GGG
cgaacatttctgctacactt

SEQ ID NO: 18812 - DNA, 20 bp, Artificial Sequence
  Description of Artificial Sequence: Synthetic oligonucleotide
  Target: SCN10A; (-) strand; PAM type: NRG; PAM sequence: TGG
acgaacatttctgctacact

SEQ ID NO: 18813 - DNA, 20 bp, Artificial Sequence
  Description of Artificial Sequence: Synthetic oligonucleotide
  Target: SCN10A; (-) strand; PAM type: NRG; PAM sequence: GGG
tccggcctgggctaaacagc

SEQ ID NO: 18814 - DNA, 20 bp, Artificial Sequence
  Description of Artificial Sequence: Synthetic oligonucleotide
  Target: SCN10A; (-) strand; PAM type: NRG; PAM sequence: CGG
atccggcctgggctaaacag

SEQ ID NO: 18815 - DNA, 20 bp, Artificial Sequence
  Description of Artificial Sequence: Synthetic oligonucleotide
  Target: SCN10A; (-) strand; PAM type: NRG; PAM sequence: CAG
gcaatccggcctgggctaaa

SEQ ID NO: 18816 - DNA, 20 bp, Artificial Sequence
  Description of Artificial Sequence: Synthetic oligonucleotide
  Target: SCN10A; (-) strand; PAM type: NRG; PAM sequence: GGG
gcgccactgcaatccggcct

SEQ ID NO: 18817 - DNA, 20 bp, Artificial Sequence
  Description of Artificial Sequence: Synthetic oligonucleotide
  Target: SCN10A; (-) strand; PAM type: NRG; PAM sequence: TGG
tgcgccactgcaatccggcc

SEQ ID NO: 18818 - DNA, 20 bp, Artificial Sequence
  Description of Artificial Sequence: Synthetic oligonucleotide
  Target: SCN10A; (-) strand; PAM type: NRG; PAM sequence: CGG
gagattgcgccactgcaatc

SEQ ID NO: 18819 - DNA, 20 bp, Artificial Sequence
  Description of Artificial Sequence: Synthetic oligonucleotide
  Target: SCN10A; (-) strand; PAM type: NRG; PAM sequence: GAG
ggcggagcttacagtgagcc

SEQ ID NO: 18820 - DNA, 20 bp, Artificial Sequence
  Description of Artificial Sequence: Synthetic oligonucleotide
  Target: SCN10A; (-) strand; PAM type: NRG; PAM sequence: GAG
tgggaggcggagcttacagt

SEQ ID NO: 18821 - DNA, 20 bp, Artificial Sequence
  Description of Artificial Sequence: Synthetic oligonucleotide
  Target: SCN10A; (-) strand; PAM type: NRG; PAM sequence: CAG
aacctgggaggcggagctta

SEQ ID NO: 18822 - DNA, 20 bp, Artificial Sequence
  Description of Artificial Sequence: Synthetic oligonucleotide
  Target: SCN10A; (-) strand; PAM type: NRG; PAM sequence: GAG
tggcgtgaacctgggaggcg

SEQ ID NO: 18823 - DNA, 20 bp, Artificial Sequence
  Description of Artificial Sequence: Synthetic oligonucleotide
  Target: SCN10A; (-) strand; PAM type: NRG; PAM sequence: CGG
aatggcgtgaacctgggagg

SEQ ID NO: 18824 - DNA, 20 bp, Artificial Sequence
  Description of Artificial Sequence: Synthetic oligonucleotide
  Target: SCN10A; (-) strand; PAM type: NRG; PAM sequence: AGG
gagaatggcgtgaacctggg

SEQ ID NO: 18825 - DNA, 20 bp, Artificial Sequence
  Description of Artificial Sequence: Synthetic oligonucleotide
  Target: SCN10A; (-) strand; PAM type: NRG; PAM sequence: GAG
ggagaatggcgtgaacctgg

SEQ ID NO: 18826 - DNA, 20 bp, Artificial Sequence
  Description of Artificial Sequence: Synthetic oligonucleotide
  Target: SCN10A; (-) strand; PAM type: NRG; PAM sequence: GGG
caggagaatggcgtgaacct

SEQ ID NO: 18827 - DNA, 20 bp, Artificial Sequence
  Description of Artificial Sequence: Synthetic oligonucleotide
  Target: SCN10A; (-) strand; PAM type: NRG; PAM sequence: TGG
gcaggagaatggcgtgaacc

SEQ ID NO: 18828 - DNA, 20 bp, Artificial Sequence
  Description of Artificial Sequence: Synthetic oligonucleotide
  Target: SCN10A; (-) strand; PAM type: NRG; PAM sequence: TGG
gggaggctgaggcaggagaa

SEQ ID NO: 18829 - DNA, 20 bp, Artificial Sequence
  Description of Artificial Sequence: Synthetic oligonucleotide
  Target: SCN10A; (-) strand; PAM type: NRG; PAM sequence: GAG
tactcgggaggctgaggcag

SEQ ID NO: 18830 - DNA, 20 bp, Artificial Sequence
  Description of Artificial Sequence: Synthetic oligonucleotide
  Target: SCN10A; (-) strand; PAM type: NRG; PAM sequence: AGG
gctactcgggaggctgaggc

SEQ ID NO: 18831 - DNA, 20 bp, Artificial Sequence
  Description of Artificial Sequence: Synthetic oligonucleotide
  Target: SCN10A; (-) strand; PAM type: NRG; PAM sequence: CAG
agctactcgggaggctgagg

SEQ ID NO: 18832 - DNA, 20 bp, Artificial Sequence
  Description of Artificial Sequence: Synthetic oligonucleotide
  Target: SCN10A; (-) strand; PAM type: NRG; PAM sequence: AGG
cccagctactcgggaggctg

SEQ ID NO: 18833 - DNA, 20 bp, Artificial Sequence
  Description of Artificial Sequence: Synthetic oligonucleotide
  Target: SCN10A; (-) strand; PAM type: NRG; PAM sequence: GAG
tcccagctactcgggaggct

SEQ ID NO: 18834 - DNA, 20 bp, Artificial Sequence
  Description of Artificial Sequence: Synthetic oligonucleotide
  Target: SCN10A; (-) strand; PAM type: NRG; PAM sequence: AGG
tgtagtcccagctactcggg

SEQ ID NO: 18835 - DNA, 20 bp, Artificial Sequence
  Description of Artificial Sequence: Synthetic oligonucleotide
  Target: SCN10A; (-) strand; PAM type: NRG; PAM sequence: GAG
ctgtagtcccagctactcgg

SEQ ID NO: 18836 - DNA, 20 bp, Artificial Sequence
  Description of Artificial Sequence: Synthetic oligonucleotide
  Target: SCN10A; (-) strand; PAM type: NRG; PAM sequence: GGG
gcctgtagtcccagctactc

SEQ ID NO: 18837 - DNA, 20 bp, Artificial Sequence
  Description of Artificial Sequence: Synthetic oligonucleotide
  Target: SCN10A; (-) strand; PAM type: NRG; PAM sequence: CGG
cgcctgtagtcccagctact

SEQ ID NO: 18838 - DNA, 20 bp, Artificial Sequence
  Description of Artificial Sequence: Synthetic oligonucleotide
  Target: SCN10A; (-) strand; PAM type: NRG; PAM sequence: CAG
gtggcgggcgcctgtagtcc

SEQ ID NO: 18839 - DNA, 20 bp, Artificial Sequence
  Description of Artificial Sequence: Synthetic oligonucleotide
  Target: SCN10A; (-) strand; PAM type: NRG; PAM sequence: TAG
ggcacggtggcgggcgcctg

SEQ ID NO: 18840 - DNA, 20 bp, Artificial Sequence
  Description of Artificial Sequence: Synthetic oligonucleotide
  Target: SCN10A; (-) strand; PAM type: NRG; PAM sequence: GGG
aattagccgggcacggtggc

SEQ ID NO: 18841 - DNA, 20 bp, Artificial Sequence
  Description of Artificial Sequence: Synthetic oligonucleotide
  Target: SCN10A; (-) strand; PAM type: NRG; PAM sequence: CGG
aaattagccgggcacggtgg

SEQ ID NO: 18842 - DNA, 20 bp, Artificial Sequence
  Description of Artificial Sequence: Synthetic oligonucleotide
  Target: SCN10A; (-) strand; PAM type: NRG; PAM sequence: TGG
aaaaaattagccgggcacgg

SEQ ID NO: 18843 - DNA, 20 bp, Artificial Sequence
  Description of Artificial Sequence: Synthetic oligonucleotide
  Target: SCN10A; (-) strand; PAM type: NRG; PAM sequence: CGG
tacaaaaaattagccgggca

SEQ ID NO: 18844 - DNA, 20 bp, Artificial Sequence
  Description of Artificial Sequence: Synthetic oligonucleotide
  Target: SCN10A; (-) strand; PAM type: NRG; PAM sequence: GGG
aaaaatacaaaaaattagcc

SEQ ID NO: 18845 - DNA, 20 bp, Artificial Sequence
  Description of Artificial Sequence: Synthetic oligonucleotide
  Target: SCN10A; (-) strand; PAM type: NRG; PAM sequence: CGG
taaaaatacaaaaaattagc

SEQ ID NO: 18846 - DNA, 20 bp, Artificial Sequence
  Description of Artificial Sequence: Synthetic oligonucleotide
  Target: SCN10A; (-) strand; PAM type: NRG; PAM sequence: TAG
ctactaaaaatacaaaaaat

SEQ ID NO: 18847 - DNA, 20 bp, Artificial Sequence
  Description of Artificial Sequence: Synthetic oligonucleotide
  Target: SCN10A; (-) strand; PAM type: NRG; PAM sequence: CGG
cgagaccatcttggctaaca

SEQ ID NO: 18848 - DNA, 20 bp, Artificial Sequence
  Description of Artificial Sequence: Synthetic oligonucleotide
  Target: SCN10A; (-) strand; PAM type: NRG; PAM sequence: TGG
tcaggagatcgagaccatct

SEQ ID NO: 18849 - DNA, 20 bp, Artificial Sequence
  Description of Artificial Sequence: Synthetic oligonucleotide
  Target: SCN10A; (-) strand; PAM type: NRG; PAM sequence: GAG
gatcacaaggtcaggagatc

SEQ ID NO: 18850 - DNA, 20 bp, Artificial Sequence
  Description of Artificial Sequence: Synthetic oligonucleotide
  Target: SCN10A; (-) strand; PAM type: NRG; PAM sequence: GAG
caggcggatcacaaggtcag

SEQ ID NO: 18851 - DNA, 20 bp, Artificial Sequence
  Description of Artificial Sequence: Synthetic oligonucleotide
  Target: SCN10A; (-) strand; PAM type: NRG; PAM sequence: AGG
ggcaggcggatcacaaggtc

SEQ ID NO: 18852 - DNA, 20 bp, Artificial Sequence
  Description of Artificial Sequence: Synthetic oligonucleotide
  Target: SCN10A; (-) strand; PAM type: NRG; PAM sequence: CAG
aggcaggcggatcacaaggt

SEQ ID NO: 18853 - DNA, 20 bp, Artificial Sequence
  Description of Artificial Sequence: Synthetic oligonucleotide
  Target: SCN10A; (-) strand; PAM type: NRG; PAM sequence: AGG
gccgaggcaggcggatcaca

SEQ ID NO: 18854 - DNA, 20 bp, Artificial Sequence
  Description of Artificial Sequence: Synthetic oligonucleotide
  Target: SCN10A; (-) strand; PAM type: NRG; PAM sequence: AAG
ggccgaggcaggcggatcac

SEQ ID NO: 18855 - DNA, 20 bp, Artificial Sequence
  Description of Artificial Sequence: Synthetic oligonucleotide
  Target: SCN10A; (-) strand; PAM type: NRG; PAM sequence: CGG
ctttgggaggccgaggcagg

SEQ ID NO: 18856 - DNA, 20 bp, Artificial Sequence
  Description of Artificial Sequence: Synthetic oligonucleotide
  Target: SCN10A; (-) strand; PAM type: NRG; PAM sequence: AGG
gcactttgggaggccgaggc

SEQ ID NO: 18857 - DNA, 20 bp, Artificial Sequence
  Description of Artificial Sequence: Synthetic oligonucleotide
  Target: SCN10A; (-) strand; PAM type: NRG; PAM sequence: CAG
agcactttgggaggccgagg

SEQ ID NO: 18858 - DNA, 20 bp, Artificial Sequence
  Description of Artificial Sequence: Synthetic oligonucleotide
  Target: SCN10A; (-) strand; PAM type: NRG; PAM sequence: AGG
cccagcactttgggaggccg

SEQ ID NO: 18859 - DNA, 20 bp, Artificial Sequence
  Description of Artificial Sequence: Synthetic oligonucleotide
  Target: SCN10A; (-) strand; PAM type: NRG; PAM sequence: GAG
tcccagcactttgggaggcc

SEQ ID NO: 18860 - DNA, 20 bp, Artificial Sequence
  Description of Artificial Sequence: Synthetic oligonucleotide
  Target: SCN10A; (-) strand; PAM type: NRG; PAM sequence: AGG
tgtaatcccagcactttggg

SEQ ID NO: 18861 - DNA, 20 bp, Artificial Sequence
  Description of Artificial Sequence: Synthetic oligonucleotide
  Target: SCN10A; (-) strand; PAM type: NRG; PAM sequence: GAG
ctgtaatcccagcactttgg

SEQ ID NO: 18862 - DNA, 20 bp, Artificial Sequence
  Description of Artificial Sequence: Synthetic oligonucleotide
  Target: SCN10A; (-) strand; PAM type: NRG; PAM sequence: GGG
gcctgtaatcccagcacttt

SEQ ID NO: 18863 - DNA, 20 bp, Artificial Sequence
  Description of Artificial Sequence: Synthetic oligonucleotide
  Target: SCN10A; (-) strand; PAM type: NRG; PAM sequence: TGG
cgcctgtaatcccagcactt

SEQ ID NO: 18864 - DNA, 20 bp, Artificial Sequence
  Description of Artificial Sequence: Synthetic oligonucleotide
  Target: SCN10A; (-) strand; PAM type: NRG; PAM sequence: CAG
gtggctcacgcctgtaatcc

SEQ ID NO: 18865 - DNA, 20 bp, Artificial Sequence
  Description of Artificial Sequence: Synthetic oligonucleotide
  Target: SCN10A; (-) strand; PAM type: NRG; PAM sequence: TGG
aaatacgaggctgggcgcgg

SEQ ID NO: 18866 - DNA, 20 bp, Artificial Sequence
  Description of Artificial Sequence: Synthetic oligonucleotide
  Target: SCN10A; (-) strand; PAM type: NRG; PAM sequence: CGG
ataaaatacgaggctgggcg

SEQ ID NO: 18867 - DNA, 20 bp, Artificial Sequence
  Description of Artificial Sequence: Synthetic oligonucleotide
  Target: SCN10A; (-) strand; PAM type: NRG; PAM sequence: GGG
ttctaataaaatacgaggct

SEQ ID NO: 18868 - DNA, 20 bp, Artificial Sequence
  Description of Artificial Sequence: Synthetic oligonucleotide
  Target: SCN10A; (-) strand; PAM type: NRG; PAM sequence: TGG
tttctaataaaatacgaggc

SEQ ID NO: 18869 - DNA, 20 bp, Artificial Sequence
  Description of Artificial Sequence: Synthetic oligonucleotide
  Target: SCN10A; (-) strand; PAM type: NRG; PAM sequence: AGG
tagttttctaataaaatacg

SEQ ID NO: 18870 - DNA, 20 bp, Artificial Sequence
  Description of Artificial Sequence: Synthetic oligonucleotide
  Target: SCN10A; (-) strand; PAM type: NRG; PAM sequence: GAG
ttagttttctaataaaatac

SEQ ID NO: 18871 - DNA, 20 bp, Artificial Sequence
  Description of Artificial Sequence: Synthetic oligonucleotide
  Target: SCN10A; (-) strand; PAM type: NRG; PAM sequence: TAG
taccctggcaggcccacagt

SEQ ID NO: 18872 - DNA, 20 bp, Artificial Sequence
  Description of Artificial Sequence: Synthetic oligonucleotide
  Target: SCN10A; (-) strand; PAM type: NRG; PAM sequence: CAG
cccataccctggcaggccca

SEQ ID NO: 18873 - DNA, 20 bp, Artificial Sequence
  Description of Artificial Sequence: Synthetic oligonucleotide
  Target: SCN10A; (-) strand; PAM type: NRG; PAM sequence: AGG
tcacacccccataccctggc

SEQ ID NO: 18874 - DNA, 20 bp, Artificial Sequence
  Description of Artificial Sequence: Synthetic oligonucleotide
  Target: SCN10A; (-) strand; PAM type: NRG; PAM sequence: CAG
atcacacccccataccctgg

SEQ ID NO: 18875 - DNA, 20 bp, Artificial Sequence
  Description of Artificial Sequence: Synthetic oligonucleotide
  Target: SCN10A; (-) strand; PAM type: NRG; PAM sequence: TGG
gatatcacacccccataccc

SEQ ID NO: 18876 - DNA, 20 bp, Artificial Sequence
  Description of Artificial Sequence: Synthetic oligonucleotide
  Target: SCN10A; (-) strand; PAM type: NRG; PAM sequence: GAG
cacaatcgtcaagagagcag

SEQ ID NO: 18877 - DNA, 20 bp, Artificial Sequence
  Description of Artificial Sequence: Synthetic oligonucleotide
  Target: SCN10A; (-) strand; PAM type: NRG; PAM sequence: AGG
tgcacaatcgtcaagagagc

SEQ ID NO: 18878 - DNA, 20 bp, Artificial Sequence
  Description of Artificial Sequence: Synthetic oligonucleotide
  Target: SCN10A; (-) strand; PAM type: NRG; PAM sequence: CAG
atgcacaatcgtcaagagag

SEQ ID NO: 18879 - DNA, 20 bp, Artificial Sequence
  Description of Artificial Sequence: Synthetic oligonucleotide
  Target: SCN10A; (-) strand; PAM type: NRG; PAM sequence: GAG
cctatgcacaatcgtcaaga

SEQ ID NO: 18880 - DNA, 20 bp, Artificial Sequence
  Description of Artificial Sequence: Synthetic oligonucleotide
  Target: SCN10A; (-) strand; PAM type: NRG; PAM sequence: GAG
tacctatgcacaatcgtcaa

SEQ ID NO: 18881 - DNA, 20 bp, Artificial Sequence
  Description of Artificial Sequence: Synthetic oligonucleotide
  Target: SCN10A; (-) strand; PAM type: NRG; PAM sequence: AAG
ggtacctatgcacaatcgtc

SEQ ID NO: 18882 - DNA, 20 bp, Artificial Sequence
  Description of Artificial Sequence: Synthetic oligonucleotide
  Target: SCN10A; (-) strand; PAM type: NRG; PAM sequence: AGG
ctaagctaatggtcaatata

SEQ ID NO: 18883 - DNA, 20 bp, Artificial Sequence
  Description of Artificial Sequence: Synthetic oligonucleotide
  Target: SCN10A; (-) strand; PAM type: NRG; PAM sequence: AAG
cctaagctaatggtcaatat

SEQ ID NO: 18884 - DNA, 20 bp, Artificial Sequence
  Description of Artificial Sequence: Synthetic oligonucleotide
  Target: SCN10A; (-) strand; PAM type: NRG; PAM sequence: TGG
gatgtaggcccctaagctaa

SEQ ID NO: 18885 - DNA, 20 bp, Artificial Sequence
  Description of Artificial Sequence: Synthetic oligonucleotide
  Target: SCN10A; (-) strand; PAM type: NRG; PAM sequence: AAG
atgtcaagatgtaggcccct

SEQ ID NO: 18886 - DNA, 20 bp, Artificial Sequence
  Description of Artificial Sequence: Synthetic oligonucleotide
  Target: SCN10A; (-) strand; PAM type: NRG; PAM sequence: AGG
agaaattgatgtcaagatgt

SEQ ID NO: 18887 - DNA, 20 bp, Artificial Sequence
  Description of Artificial Sequence: Synthetic oligonucleotide
  Target: SCN10A; (-) strand; PAM type: NRG; PAM sequence: TAG
tagaaattgatgtcaagatg

SEQ ID NO: 18888 - DNA, 20 bp, Artificial Sequence
  Description of Artificial Sequence: Synthetic oligonucleotide
  Target: SCN10A; (-) strand; PAM type: NRG; PAM sequence: AAG
ggtatctagaaattgatgtc

SEQ ID NO: 18889 - DNA, 20 bp, Artificial Sequence
  Description of Artificial Sequence: Synthetic oligonucleotide
  Target: SCN10A; (-) strand; PAM type: NRG; PAM sequence: TAG
gacagatttctctaggtatc

SEQ ID NO: 18890 - DNA, 20 bp, Artificial Sequence
  Description of Artificial Sequence: Synthetic oligonucleotide
  Target: SCN10A; (-) strand; PAM type: NRG; PAM sequence: AGG
ttagaaggacagatttctct

SEQ ID NO: 18891 - DNA, 20 bp, Artificial Sequence
  Description of Artificial Sequence: Synthetic oligonucleotide
  Target: SCN10A; (-) strand; PAM type: NRG; PAM sequence: TAG
tttagaaggacagatttctc

SEQ ID NO: 18892 - DNA, 20 bp, Artificial Sequence
  Description of Artificial Sequence: Synthetic oligonucleotide
  Target: SCN10A; (-) strand; PAM type: NRG; PAM sequence: CAG
aaatcacatttttagaagga

SEQ ID NO: 18893 - DNA, 20 bp, Artificial Sequence
  Description of Artificial Sequence: Synthetic oligonucleotide
  Target: SCN10A; (-) strand; PAM type: NRG; PAM sequence: AGG
aattaaatcacatttttaga

SEQ ID NO: 18894 - DNA, 20 bp, Artificial Sequence
  Description of Artificial Sequence: Synthetic oligonucleotide
  Target: SCN10A; (-) strand; PAM type: NRG; PAM sequence: AAG
gaattaaatcacatttttag

SEQ ID NO: 18895 - DNA, 20 bp, Artificial Sequence
  Description of Artificial Sequence: Synthetic oligonucleotide
  Target: SCN10A; (-) strand; PAM type: NRG; PAM sequence: TAG
tcagaattaaatcacatttt

SEQ ID NO: 18896 - DNA, 20 bp, Artificial Sequence
  Description of Artificial Sequence: Synthetic oligonucleotide
  Target: SCN10A; (-) strand; PAM type: NRG; PAM sequence: CAG
acttgaaaatcttacaaggt

SEQ ID NO: 18897 - DNA, 20 bp, Artificial Sequence
  Description of Artificial Sequence: Synthetic oligonucleotide
  Target: SCN10A; (-) strand; PAM type: NRG; PAM sequence: AGG
cataacttgaaaatcttaca

SEQ ID NO: 18898 - DNA, 20 bp, Artificial Sequence
  Description of Artificial Sequence: Synthetic oligonucleotide
  Target: SCN10A; (-) strand; PAM type: NRG; PAM sequence: AAG
ccataacttgaaaatcttac

SEQ ID NO: 18899 - DNA, 20 bp, Artificial Sequence
  Description of Artificial Sequence: Synthetic oligonucleotide
  Target: SCN10A; (-) strand; PAM type: NRG; PAM sequence: AGG
aagggtagagtaggcctggt

SEQ ID NO: 18900 - DNA, 20 bp, Artificial Sequence
  Description of Artificial Sequence: Synthetic oligonucleotide
  Target: SCN10A; (-) strand; PAM type: NRG; PAM sequence: TAG
gaagggtagagtaggcctgg

SEQ ID NO: 18901 - DNA, 20 bp, Artificial Sequence
  Description of Artificial Sequence: Synthetic oligonucleotide
  Target: SCN10A; (-) strand; PAM type: NRG; PAM sequence: TGG
ggagaagggtagagtaggcc

SEQ ID NO: 18902 - DNA, 20 bp, Artificial Sequence
  Description of Artificial Sequence: Synthetic oligonucleotide
  Target: SCN10A; (-) strand; PAM type: NRG; PAM sequence: AGG
agggaggagaagggtagagt

SEQ ID NO: 18903 - DNA, 20 bp, Artificial Sequence
  Description of Artificial Sequence: Synthetic oligonucleotide
  Target: SCN10A; (-) strand; PAM type: NRG; PAM sequence: TAG
cagggaggagaagggtagag

SEQ ID NO: 18904 - DNA, 20 bp, Artificial Sequence
  Description of Artificial Sequence: Synthetic oligonucleotide
  Target: SCN10A; (-) strand; PAM type: NRG; PAM sequence: GAG
tcccagggaggagaagggta

SEQ ID NO: 18905 - DNA, 20 bp, Artificial Sequence
  Description of Artificial Sequence: Synthetic oligonucleotide
  Target: SCN10A; (-) strand; PAM type: NRG; PAM sequence: TAG
catcccagggaggagaaggg

SEQ ID NO: 18906 - DNA, 20 bp, Artificial Sequence
  Description of Artificial Sequence: Synthetic oligonucleotide
  Target: SCN10A; (-) strand; PAM type: NRG; PAM sequence: GGG
caccatcccagggaggagaa

SEQ ID NO: 18907 - DNA, 20 bp, Artificial Sequence
  Description of Artificial Sequence: Synthetic oligonucleotide
  Target: SCN10A; (-) strand; PAM type: NRG; PAM sequence: AGG
tcaccatcccagggaggaga

SEQ ID NO: 18908 - DNA, 20 bp, Artificial Sequence
  Description of Artificial Sequence: Synthetic oligonucleotide
  Target: SCN10A; (-) strand; PAM type: NRG; PAM sequence: AAG
gtcaccatcccagggaggag

SEQ ID NO: 18909 - DNA, 20 bp, Artificial Sequence
  Description of Artificial Sequence: Synthetic oligonucleotide
  Target: SCN10A; (-) strand; PAM type: NRG; PAM sequence: GAG
actgtcaccatcccagggag

SEQ ID NO: 18910 - DNA, 20 bp, Artificial Sequence
  Description of Artificial Sequence: Synthetic oligonucleotide
  Target: SCN10A; (-) strand; PAM type: NRG; PAM sequence: AGG
gtactgtcaccatcccaggg

SEQ ID NO: 18911 - DNA, 20 bp, Artificial Sequence
  Description of Artificial Sequence: Synthetic oligonucleotide
  Target: SCN10A; (-) strand; PAM type: NRG; PAM sequence: GAG
ggtactgtcaccatcccagg

SEQ ID NO: 18912 - DNA, 20 bp, Artificial Sequence
  Description of Artificial Sequence: Synthetic oligonucleotide
  Target: SCN10A; (-) strand; PAM type: NRG; PAM sequence: GGG
atggtactgtcaccatccca

SEQ ID NO: 18913 - DNA, 20 bp, Artificial Sequence
  Description of Artificial Sequence: Synthetic oligonucleotide
  Target: SCN10A; (-) strand; PAM type: NRG; PAM sequence: AGG
gatggtactgtcaccatccc

SEQ ID NO: 18914 - DNA, 20 bp, Artificial Sequence
  Description of Artificial Sequence: Synthetic oligonucleotide
  Target: SCN10A; (-) strand; PAM type: NRG; PAM sequence: CAG
tgatggtactgtcaccatcc

SEQ ID NO: 18915 - DNA, 20 bp, Artificial Sequence
  Description of Artificial Sequence: Synthetic oligonucleotide
  Target: SCN10A; (-) strand; PAM type: NRG; PAM sequence: TGG
atggcatctgcctaagctga

SEQ ID NO: 18916 - DNA, 20 bp, Artificial Sequence
  Description of Artificial Sequence: Synthetic oligonucleotide
  Target: SCN10A; (-) strand; PAM type: NRG; PAM sequence: AAG
ctggttgatggcatctgcct

SEQ ID NO: 18917 - DNA, 20 bp, Artificial Sequence
  Description of Artificial Sequence: Synthetic oligonucleotide
  Target: SCN10A; (-) strand; PAM type: NRG; PAM sequence: TGG
tgccatgaaacgctggttga

SEQ ID NO: 18918 - DNA, 20 bp, Artificial Sequence
  Description of Artificial Sequence: Synthetic oligonucleotide
  Target: SCN10A; (-) strand; PAM type: NRG; PAM sequence: TGG
acagctgtgccatgaaacgc

SEQ ID NO: 18919 - DNA, 20 bp, Artificial Sequence
  Description of Artificial Sequence: Synthetic oligonucleotide
  Target: SCN10A; (-) strand; PAM type: NRG; PAM sequence: CAG
ataaagcatgtcctgagaca

SEQ ID NO: 18920 - DNA, 20 bp, Artificial Sequence
  Description of Artificial Sequence: Synthetic oligonucleotide
  Target: SCN10A; (-) strand; PAM type: NRG; PAM sequence: GAG
gaccaaataaagcatgtcct

SEQ ID NO: 18921 - DNA, 20 bp, Artificial Sequence
  Description of Artificial Sequence: Synthetic oligonucleotide
  Target: SCN10A; (-) strand; PAM type: NRG; PAM sequence: AAG
aacactctaaagaccaaata

SEQ ID NO: 18922 - DNA, 20 bp, Artificial Sequence
  Description of Artificial Sequence: Synthetic oligonucleotide
  Target: SCN10A; (-) strand; PAM type: NRG; PAM sequence: AAG
cagtttttaaaaacactcta

SEQ ID NO: 18923 - DNA, 20 bp, Artificial Sequence
  Description of Artificial Sequence: Synthetic oligonucleotide
  Target: SCN10A; (-) strand; PAM type: NRG; PAM sequence: CAG
tttaatattggctactaatc

SEQ ID NO: 18924 - DNA, 20 bp, Artificial Sequence
  Description of Artificial Sequence: Synthetic oligonucleotide
  Target: SCN10A; (-) strand; PAM type: NRG; PAM sequence: TGG
tgtgcaaatgtctttaatat

SEQ ID NO: 18925 - DNA, 20 bp, Artificial Sequence
  Description of Artificial Sequence: Synthetic oligonucleotide
  Target: SCN10A; (-) strand; PAM type: NRG; PAM sequence: CAG
ttccaaaaaagtcagaaatc

SEQ ID NO: 18926 - DNA, 20 bp, Artificial Sequence
  Description of Artificial Sequence: Synthetic oligonucleotide
  Target: SCN10A; (-) strand; PAM type: NRG; PAM sequence: CAG
tactaattttccaaaaaagt

SEQ ID NO: 18927 - DNA, 20 bp, Artificial Sequence
  Description of Artificial Sequence: Synthetic oligonucleotide
  Target: SCN10A; (-) strand; PAM type: NRG; PAM sequence: AAG
gagttactaattttccaaaa

SEQ ID NO: 18928 - DNA, 20 bp, Artificial Sequence
  Description of Artificial Sequence: Synthetic oligonucleotide
  Target: SCN10A; (-) strand; PAM type: NRG; PAM sequence: GAG
tggcctgtccattattgtca

SEQ ID NO: 18929 - DNA, 20 bp, Artificial Sequence
  Description of Artificial Sequence: Synthetic oligonucleotide
  Target: SCN10A; (-) strand; PAM type: NRG; PAM sequence: CAG
tatggcctgtccattattgt

SEQ ID NO: 18930 - DNA, 20 bp, Artificial Sequence
  Description of Artificial Sequence: Synthetic oligonucleotide
  Target: SCN10A; (-) strand; PAM type: NRG; PAM sequence: TGG
agggagggaaggacgagcta

SEQ ID NO: 18931 - DNA, 20 bp, Artificial Sequence
  Description of Artificial Sequence: Synthetic oligonucleotide
  Target: SCN10A; (-) strand; PAM type: NRG; PAM sequence: GAG
ggagggagggagggaaggac

SEQ ID NO: 18932 - DNA, 20 bp, Artificial Sequence
  Description of Artificial Sequence: Synthetic oligonucleotide
  Target: SCN10A; (-) strand; PAM type: NRG; PAM sequence: AGG
gagagggagggagggaggga

SEQ ID NO: 18933 - DNA, 20 bp, Artificial Sequence
  Description of Artificial Sequence: Synthetic oligonucleotide
  Target: SCN10A; (-) strand; PAM type: NRG; PAM sequence: AAG
agagagggagggagggaggg

SEQ ID NO: 18934 - DNA, 20 bp, Artificial Sequence
  Description of Artificial Sequence: Synthetic oligonucleotide
  Target: SCN10A; (-) strand; PAM type: NRG; PAM sequence: GGG
gagagagagggagggaggga

SEQ ID NO: 18935 - DNA, 20 bp, Artificial Sequence
  Description of Artificial Sequence: Synthetic oligonucleotide
  Target: SCN10A; (-) strand; PAM type: NRG; PAM sequence: AGG
agagagagagggagggaggg

SEQ ID NO: 18936 - DNA, 20 bp, Artificial Sequence
  Description of Artificial Sequence: Synthetic oligonucleotide
  Target: SCN10A; (-) strand; PAM type: NRG; PAM sequence: GAG
gagagagagagggagggagg

SEQ ID NO: 18937 - DNA, 20 bp, Artificial Sequence
  Description of Artificial Sequence: Synthetic oligonucleotide
  Target: SCN10A; (-) strand; PAM type: NRG; PAM sequence: GGG
gggagagagagagggaggga

SEQ ID NO: 18938 - DNA, 20 bp, Artificial Sequence
  Description of Artificial Sequence: Synthetic oligonucleotide
  Target: SCN10A; (-) strand; PAM type: NRG; PAM sequence: AGG
agggagagagagagggaggg

SEQ ID NO: 18939 - DNA, 20 bp, Artificial Sequence
  Description of Artificial Sequence: Synthetic oligonucleotide
  Target: SCN10A; (-) strand; PAM type: NRG; PAM sequence: GAG
gagggagagagagagggagg

SEQ ID NO: 18940 - DNA, 20 bp, Artificial Sequence
  Description of Artificial Sequence: Synthetic oligonucleotide
  Target: SCN10A; (-) strand; PAM type: NRG; PAM sequence: GGG
gggagggagagagagaggga

SEQ ID NO: 18941 - DNA, 20 bp, Artificial Sequence
  Description of Artificial Sequence: Synthetic oligonucleotide
  Target: SCN10A; (-) strand; PAM type: NRG; PAM sequence: AGG
agggagggagagagagaggg

SEQ ID NO: 18942 - DNA, 20 bp, Artificial Sequence
  Description of Artificial Sequence: Synthetic oligonucleotide
  Target: SCN10A; (-) strand; PAM type: NRG; PAM sequence: GAG
gagggagggagagagagagg

SEQ ID NO: 18943 - DNA, 20 bp, Artificial Sequence
  Description of Artificial Sequence: Synthetic oligonucleotide
  Target: SCN10A; (-) strand; PAM type: NRG; PAM sequence: GGG
gggagggagggagagagaga

SEQ ID NO: 18944 - DNA, 20 bp, Artificial Sequence
  Description of Artificial Sequence: Synthetic oligonucleotide
  Target: SCN10A; (-) strand; PAM type: NRG; PAM sequence: AGG
agggagggagggagagagag

SEQ ID NO: 18945 - DNA, 20 bp, Artificial Sequence
  Description of Artificial Sequence: Synthetic oligonucleotide
  Target: SCN10A; (-) strand; PAM type: NRG; PAM sequence: GAG
gagggagggagggagagaga

SEQ ID NO: 18946 - DNA, 20 bp, Artificial Sequence
  Description of Artificial Sequence: Synthetic oligonucleotide
  Target: SCN10A; (-) strand; PAM type: NRG; PAM sequence: GAG
gggagggagggagggagaga

SEQ ID NO: 18947 - DNA, 20 bp, Artificial Sequence
  Description of Artificial Sequence: Synthetic oligonucleotide
  Target: SCN10A; (-) strand; PAM type: NRG; PAM sequence: GAG
gagggagggagggagggaga

SEQ ID NO: 18948 - DNA, 20 bp, Artificial Sequence
  Description of Artificial Sequence: Synthetic oligonucleotide
  Target: SCN10A; (-) strand; PAM type: NRG; PAM sequence: GAG
gagagggagggagggaggga

SEQ ID NO: 18949 - DNA, 20 bp, Artificial Sequence
  Description of Artificial Sequence: Synthetic oligonucleotide
  Target: SCN10A; (-) strand; PAM type: NRG; PAM sequence: GAG
gagagagggagggagggagg

SEQ ID NO: 18950 - DNA, 20 bp, Artificial Sequence
  Description of Artificial Sequence: Synthetic oligonucleotide
  Target: SCN10A; (-) strand; PAM type: NRG; PAM sequence: GGG
gagagagagggagggaggga

SEQ ID NO: 18951 - DNA, 20 bp, Artificial Sequence
  Description of Artificial Sequence: Synthetic oligonucleotide
  Target: SCN10A; (-) strand; PAM type: NRG; PAM sequence: AGG
agagagagagggagggaggg

SEQ ID NO: 18952 - DNA, 20 bp, Artificial Sequence
  Description of Artificial Sequence: Synthetic oligonucleotide
  Target: SCN10A; (-) strand; PAM type: NRG; PAM sequence: GAG
gagagagagagggagggagg

SEQ ID NO: 18953 - DNA, 20 bp, Artificial Sequence
  Description of Artificial Sequence: Synthetic oligonucleotide
  Target: SCN10A; (-) strand; PAM type: NRG; PAM sequence: GGG
gggagagagagagggaggga

SEQ ID NO: 18954 - DNA, 20 bp, Artificial Sequence
  Description of Artificial Sequence: Synthetic oligonucleotide
  Target: SCN10A; (-) strand; PAM type: NRG; PAM sequence: AGG
agggagagagagagggaggg

SEQ ID NO: 18955 - DNA, 20 bp, Artificial Sequence
  Description of Artificial Sequence: Synthetic oligonucleotide
  Target: SCN10A; (-) strand; PAM type: NRG; PAM sequence: GAG
gagggagagagagagggagg

SEQ ID NO: 18956 - DNA, 20 bp, Artificial Sequence
  Description of Artificial Sequence: Synthetic oligonucleotide
  Target: SCN10A; (-) strand; PAM type: NRG; PAM sequence: GGG
gggagggagagagagaggga

SEQ ID NO: 18957 - DNA, 20 bp, Artificial Sequence
  Description of Artificial Sequence: Synthetic oligonucleotide
  Target: SCN10A; (-) strand; PAM type: NRG; PAM sequence: AGG
agggagggagagagagaggg

SEQ ID NO: 18958 - DNA, 20 bp, Artificial Sequence
  Description of Artificial Sequence: Synthetic oligonucleotide
  Target: SCN10A; (-) strand; PAM type: NRG; PAM sequence: GAG
gagggagggagagagagagg

SEQ ID NO: 18959 - DNA, 20 bp, Artificial Sequence
  Description of Artificial Sequence: Synthetic oligonucleotide
  Target: SCN10A; (-) strand; PAM type: NRG; PAM sequence: GGG
gggagggagggagagagaga

SEQ ID NO: 18960 - DNA, 20 bp, Artificial Sequence
  Description of Artificial Sequence: Synthetic oligonucleotide
  Target: SCN10A; (-) strand; PAM type: NRG; PAM sequence: AGG
agggagggagggagagagag

SEQ ID NO: 18961 - DNA, 20 bp, Artificial Sequence
  Description of Artificial Sequence: Synthetic oligonucleotide
  Target: SCN10A; (-) strand; PAM type: NRG; PAM sequence: GAG
gagggagggagggagagaga

SEQ ID NO: 18962 - DNA, 20 bp, Artificial Sequence
  Description of Artificial Sequence: Synthetic oligonucleotide
  Target: SCN10A; (-) strand; PAM type: NRG; PAM sequence: GAG
gggagggagggagggagaga

SEQ ID NO: 18963 - DNA, 20 bp, Artificial Sequence
  Description of Artificial Sequence: Synthetic oligonucleotide
  Target: SCN10A; (-) strand; PAM type: NRG; PAM sequence: GAG
aagggagggagggagggaga

SEQ ID NO: 18964 - DNA, 20 bp, Artificial Sequence
  Description of Artificial Sequence: Synthetic oligonucleotide
  Target: SCN10A; (-) strand; PAM type: NRG; PAM sequence: GAG
ggaagggagggagggaggga

SEQ ID NO: 18965 - DNA, 20 bp, Artificial Sequence
  Description of Artificial Sequence: Synthetic oligonucleotide
  Target: SCN10A; (-) strand; PAM type: NRG; PAM sequence: GAG
gaggaagggagggagggagg

SEQ ID NO: 18966 - DNA, 20 bp, Artificial Sequence
  Description of Artificial Sequence: Synthetic oligonucleotide
  Target: SCN10A; (-) strand; PAM type: NRG; PAM sequence: GGG
aagaggaagggagggaggga

SEQ ID NO: 18967 - DNA, 20 bp, Artificial Sequence
  Description of Artificial Sequence: Synthetic oligonucleotide
  Target: SCN10A; (-) strand; PAM type: NRG; PAM sequence: AGG
aaagaggaagggagggaggg

SEQ ID NO: 18968 - DNA, 20 bp, Artificial Sequence
  Description of Artificial Sequence: Synthetic oligonucleotide
  Target: SCN10A; (-) strand; PAM type: NRG; PAM sequence: GAG
gaaagaggaagggagggagg

SEQ ID NO: 18969 - DNA, 20 bp, Artificial Sequence
  Description of Artificial Sequence: Synthetic oligonucleotide
  Target: SCN10A; (-) strand; PAM type: NRG; PAM sequence: GGG
aagaaagaggaagggaggga

SEQ ID NO: 18970 - DNA, 20 bp, Artificial Sequence
  Description of Artificial Sequence: Synthetic oligonucleotide
  Target: SCN10A; (-) strand; PAM type: NRG; PAM sequence: AGG
aaagaaagaggaagggaggg

SEQ ID NO: 18971 - DNA, 20 bp, Artificial Sequence
  Description of Artificial Sequence: Synthetic oligonucleotide
  Target: SCN10A; (-) strand; PAM type: NRG; PAM sequence: GAG
gaaagaaagaggaagggagg

SEQ ID NO: 18972 - DNA, 20 bp, Artificial Sequence
  Description of Artificial Sequence: Synthetic oligonucleotide
  Target: SCN10A; (-) strand; PAM type: NRG; PAM sequence: GGG
aagaaagaaagaggaaggga

SEQ ID NO: 18973 - DNA, 20 bp, Artificial Sequence
  Description of Artificial Sequence: Synthetic oligonucleotide
  Target: SCN10A; (-) strand; PAM type: NRG; PAM sequence: AGG
aaagaaagaaagaggaaggg

SEQ ID NO: 18974 - DNA, 20 bp, Artificial Sequence
  Description of Artificial Sequence: Synthetic oligonucleotide
  Target: SCN10A; (-) strand; PAM type: NRG; PAM sequence: GAG
gaaagaaagaaagaggaagg

SEQ ID NO: 18975 - DNA, 20 bp, Artificial Sequence
  Description of Artificial Sequence: Synthetic oligonucleotide
  Target: SCN10A; (-) strand; PAM type: NRG; PAM sequence: GGG
aagaaagaaagaaagaggaa

SEQ ID NO: 18976 - DNA, 20 bp, Artificial Sequence
  Description of Artificial Sequence: Synthetic oligonucleotide
  Target: SCN10A; (-) strand; PAM type: NRG; PAM sequence: AGG
aaagaaagaaagaaagagga

SEQ ID NO: 18977 - DNA, 20 bp, Artificial Sequence
  Description of Artificial Sequence: Synthetic oligonucleotide
  Target: SCN10A; (-) strand; PAM type: NRG; PAM sequence: AAG
gaaagaaagaaagaaagagg

SEQ ID NO: 18978 - DNA, 20 bp, Artificial Sequence
  Description of Artificial Sequence: Synthetic oligonucleotide
  Target: SCN10A; (-) strand; PAM type: NRG; PAM sequence: AGG
aaagaaagaaagaaagaaag

SEQ ID NO: 18979 - DNA, 20 bp, Artificial Sequence
  Description of Artificial Sequence: Synthetic oligonucleotide
  Target: SCN10A; (-) strand; PAM type: NRG; PAM sequence: GAG
gaaagaaagaaagaaagaaa

SEQ ID NO: 18980 - DNA, 20 bp, Artificial Sequence
  Description of Artificial Sequence: Synthetic oligonucleotide
  Target: SCN10A; (-) strand; PAM type: NRG; PAM sequence: AAG
aagaaagaaagaaagaaaga

SEQ ID NO: 18981 - DNA, 20 bp, Artificial Sequence
  Description of Artificial Sequence: Synthetic oligonucleotide
  Target: SCN10A; (-) strand; PAM type: NRG; PAM sequence: AAG
aagaaagaaagaaagaaaga

SEQ ID NO: 18982 - DNA, 20 bp, Artificial Sequence
  Description of Artificial Sequence: Synthetic oligonucleotide
  Target: SCN10A; (-) strand; PAM type: NRG; PAM sequence: AAG
aagaaagaaagaaagaaaga

SEQ ID NO: 18983 - DNA, 20 bp, Artificial Sequence
  Description of Artificial Sequence: Synthetic oligonucleotide
  Target: SCN10A; (-) strand; PAM type: NRG; PAM sequence: AAG
gagaaagaaagaaagaaaga

SEQ ID NO: 18984 - DNA, 20 bp, Artificial Sequence
  Description of Artificial Sequence: Synthetic oligonucleotide
  Target: SCN10A; (-) strand; PAM type: NRG; PAM sequence: AAG
gaaagagaaagaaagaaaga

SEQ ID NO: 18985 - DNA, 20 bp, Artificial Sequence
  Description of Artificial Sequence: Synthetic oligonucleotide
  Target: SCN10A; (-) strand; PAM type: NRG; PAM sequence: AAG
agaagaaagagaaagaaaga

SEQ ID NO: 18986 - DNA, 20 bp, Artificial Sequence
  Description of Artificial Sequence: Synthetic oligonucleotide
  Target: SCN10A; (-) strand; PAM type: NRG; PAM sequence: AAG
agaaagaagaaagagaaaga

SEQ ID NO: 18987 - DNA, 20 bp, Artificial Sequence
  Description of Artificial Sequence: Synthetic oligonucleotide
  Target: SCN10A; (-) strand; PAM type: NRG; PAM sequence: AAG
agaaagaaagaagaaagaga

SEQ ID NO: 18988 - DNA, 20 bp, Artificial Sequence
  Description of Artificial Sequence: Synthetic oligonucleotide
  Target: SCN10A; (-) strand; PAM type: NRG; PAM sequence: GAG
agaaagaaagaaagaagaaa

SEQ ID NO: 18989 - DNA, 20 bp, Artificial Sequence
  Description of Artificial Sequence: Synthetic oligonucleotide
  Target: SCN10A; (-) strand; PAM type: NRG; PAM sequence: AAG
agagaaagaaagaaagaaga

SEQ ID NO: 18990 - DNA, 20 bp, Artificial Sequence
  Description of Artificial Sequence: Synthetic oligonucleotide
  Target: SCN10A; (-) strand; PAM type: NRG; PAM sequence: AAG
aaaaagagaaagaaagaaag

SEQ ID NO: 18991 - DNA, 20 bp, Artificial Sequence
  Description of Artificial Sequence: Synthetic oligonucleotide
  Target: SCN10A; (-) strand; PAM type: NRG; PAM sequence: AAG
aagaaaaagagaaagaaaga

SEQ ID NO: 18992 - DNA, 20 bp, Artificial Sequence
  Description of Artificial Sequence: Synthetic oligonucleotide
  Target: SCN10A; (-) strand; PAM type: NRG; PAM sequence: AAG
gagaaagaaaaagagaaaga

SEQ ID NO: 18993 - DNA, 20 bp, Artificial Sequence
  Description of Artificial Sequence: Synthetic oligonucleotide
  Target: SCN10A; (-) strand; PAM type: NRG; PAM sequence: AAG
gagagagaaagaaaaagaga

SEQ ID NO: 18994 - DNA, 20 bp, Artificial Sequence
  Description of Artificial Sequence: Synthetic oligonucleotide
  Target: SCN10A; (-) strand; PAM type: NRG; PAM sequence: GAG
gagggagagagaaagaaaaa

SEQ ID NO: 18995 - DNA, 20 bp, Artificial Sequence
  Description of Artificial Sequence: Synthetic oligonucleotide
  Target: SCN10A; (-) strand; PAM type: NRG; PAM sequence: AAG
aagagggagagagaaagaaa

SEQ ID NO: 18996 - DNA, 20 bp, Artificial Sequence
  Description of Artificial Sequence: Synthetic oligonucleotide
  Target: SCN10A; (-) strand; PAM type: NRG; PAM sequence: AAG
gagagcaagagggagagaga

SEQ ID NO: 18997 - DNA, 20 bp, Artificial Sequence
  Description of Artificial Sequence: Synthetic oligonucleotide
  Target: SCN10A; (-) strand; PAM type: NRG; PAM sequence: GAG
gagagagagcaagagggaga

SEQ ID NO: 18998 - DNA, 20 bp, Artificial Sequence
  Description of Artificial Sequence: Synthetic oligonucleotide
  Target: SCN10A; (-) strand; PAM type: NRG; PAM sequence: GAG
aagagagagagcaagaggga

SEQ ID NO: 18999 - DNA, 20 bp, Artificial Sequence
  Description of Artificial Sequence: Synthetic oligonucleotide
  Target: SCN10A; (-) strand; PAM type: NRG; PAM sequence: GAG
gaaagagagagagcaagagg

SEQ ID NO: 19000 - DNA, 20 bp, Artificial Sequence
  Description of Artificial Sequence: Synthetic oligonucleotide
  Target: SCN10A; (-) strand; PAM type: NRG; PAM sequence: GGG
aagaaagagagagagcaaga

SEQ ID NO: 19001 - DNA, 20 bp, Artificial Sequence
  Description of Artificial Sequence: Synthetic oligonucleotide
  Target: SCN10A; (-) strand; PAM type: NRG; PAM sequence: AGG
aaagaaagagagagagcaag

SEQ ID NO: 19002 - DNA, 20 bp, Artificial Sequence
  Description of Artificial Sequence: Synthetic oligonucleotide
  Target: SCN10A; (-) strand; PAM type: NRG; PAM sequence: GAG
gaaagaaagagagagagcaa

SEQ ID NO: 19003 - DNA, 20 bp, Artificial Sequence
  Description of Artificial Sequence: Synthetic oligonucleotide
  Target: SCN10A; (-) strand; PAM type: NRG; PAM sequence: AAG
atgaaagaaagagagagagc

SEQ ID NO: 19004 - DNA, 20 bp, Artificial Sequence
  Description of Artificial Sequence: Synthetic oligonucleotide
  Target: SCN10A; (-) strand; PAM type: NRG; PAM sequence: GAG
acagatgaaagaaagagaga

SEQ ID NO: 19005 - DNA, 20 bp, Artificial Sequence
  Description of Artificial Sequence: Synthetic oligonucleotide
  Target: SCN10A; (-) strand; PAM type: NRG; PAM sequence: GAG
agacagatgaaagaaagaga

SEQ ID NO: 19006 - DNA, 20 bp, Artificial Sequence
  Description of Artificial Sequence: Synthetic oligonucleotide
  Target: SCN10A; (-) strand; PAM type: NRG; PAM sequence: GAG
aaagacagatgaaagaaaga

SEQ ID NO: 19007 - DNA, 20 bp, Artificial Sequence
  Description of Artificial Sequence: Synthetic oligonucleotide
  Target: SCN10A; (-) strand; PAM type: NRG; PAM sequence: GAG
agaaagacagatgaaagaaa

SEQ ID NO: 19008 - DNA, 20 bp, Artificial Sequence
  Description of Artificial Sequence: Synthetic oligonucleotide
  Target: SCN10A; (-) strand; PAM type: NRG; PAM sequence: AAG
agagaaagacagatgaaaga

SEQ ID NO: 19009 - DNA, 20 bp, Artificial Sequence
  Description of Artificial Sequence: Synthetic oligonucleotide
  Target: SCN10A; (-) strand; PAM type: NRG; PAM sequence: AAG
agcgagagaaagacagatga

SEQ ID NO: 19010 - DNA, 20 bp, Artificial Sequence
  Description of Artificial Sequence: Synthetic oligonucleotide
  Target: SCN10A; (-) strand; PAM type: NRG; PAM sequence: CAG
tagaaaaagcgagagaaaga

SEQ ID NO: 19011 - DNA, 20 bp, Artificial Sequence
  Description of Artificial Sequence: Synthetic oligonucleotide
  Target: SCN10A; (-) strand; PAM type: NRG; PAM sequence: AAG
aagatagaaaaagcgagaga

SEQ ID NO: 19012 - DNA, 20 bp, Artificial Sequence
  Description of Artificial Sequence: Synthetic oligonucleotide
  Target: SCN10A; (-) strand; PAM type: NRG; PAM sequence: GAG
aataaagatagaaaaagcga

SEQ ID NO: 19013 - DNA, 20 bp, Artificial Sequence
  Description of Artificial Sequence: Synthetic oligonucleotide
  Target: SCN10A; (-) strand; PAM type: NRG; PAM sequence: GAG
ggaataaagatagaaaaagc

SEQ ID NO: 19014 - DNA, 20 bp, Artificial Sequence
  Description of Artificial Sequence: Synthetic oligonucleotide
  Target: SCN10A; (-) strand; PAM type: NRG; PAM sequence: AAG
gagaggaataaagatagaaa

SEQ ID NO: 19015 - DNA, 20 bp, Artificial Sequence
  Description of Artificial Sequence: Synthetic oligonucleotide
  Target: SCN10A; (-) strand; PAM type: NRG; PAM sequence: TAG
cagagagagaggaataaaga

SEQ ID NO: 19016 - DNA, 20 bp, Artificial Sequence
  Description of Artificial Sequence: Synthetic oligonucleotide
  Target: SCN10A; (-) strand; PAM type: NRG; PAM sequence: AAG
gacacagagagagaggaata

SEQ ID NO: 19017 - DNA, 20 bp, Artificial Sequence
  Description of Artificial Sequence: Synthetic oligonucleotide
  Target: SCN10A; (-) strand; PAM type: NRG; PAM sequence: AGG
gaaaggagacacagagagag

SEQ ID NO: 19018 - DNA, 20 bp, Artificial Sequence
  Description of Artificial Sequence: Synthetic oligonucleotide
  Target: SCN10A; (-) strand; PAM type: NRG; PAM sequence: GAG
agaaaggagacacagagaga

SEQ ID NO: 19019 - DNA, 20 bp, Artificial Sequence
  Description of Artificial Sequence: Synthetic oligonucleotide
  Target: SCN10A; (-) strand; PAM type: NRG; PAM sequence: GAG
aaagaaaggagacacagaga

SEQ ID NO: 19020 - DNA, 20 bp, Artificial Sequence
  Description of Artificial Sequence: Synthetic oligonucleotide
  Target: SCN10A; (-) strand; PAM type: NRG; PAM sequence: GAG
aaaaagaaaggagacacaga

SEQ ID NO: 19021 - DNA, 20 bp, Artificial Sequence
  Description of Artificial Sequence: Synthetic oligonucleotide
  Target: SCN10A; (-) strand; PAM type: NRG; PAM sequence: GAG
caaaaaagaaaggagacaca

SEQ ID NO: 19022 - DNA, 20 bp, Artificial Sequence
  Description of Artificial Sequence: Synthetic oligonucleotide
  Target: SCN10A; (-) strand; PAM type: NRG; PAM sequence: CAG
ctcaaaaaagaaaggagaca

SEQ ID NO: 19023 - DNA, 20 bp, Artificial Sequence
  Description of Artificial Sequence: Synthetic oligonucleotide
  Target: SCN10A; (-) strand; PAM type: NRG; PAM sequence: GAG
acctgtctcaaaaaagaaag

SEQ ID NO: 19024 - DNA, 20 bp, Artificial Sequence
  Description of Artificial Sequence: Synthetic oligonucleotide
  Target: SCN10A; (-) strand; PAM type: NRG; PAM sequence: AGG
gaacctgtctcaaaaaagaa

SEQ ID NO: 19025 - DNA, 20 bp, Artificial Sequence
  Description of Artificial Sequence: Synthetic oligonucleotide
  Target: SCN10A; (-) strand; PAM type: NRG; PAM sequence: AAG
agaacctgtctcaaaaaaga

SEQ ID NO: 19026 - DNA, 20 bp, Artificial Sequence
  Description of Artificial Sequence: Synthetic oligonucleotide
  Target: SCN10A; (-) strand; PAM type: NRG; PAM sequence: AAG
agtaagaacctgtctcaaaa

SEQ ID NO: 19027 - DNA, 20 bp, Artificial Sequence
  Description of Artificial Sequence: Synthetic oligonucleotide
  Target: SCN10A; (-) strand; PAM type: NRG; PAM sequence: AAG
tccagcctgggagacagagt

SEQ ID NO: 19028 - DNA, 20 bp, Artificial Sequence
  Description of Artificial Sequence: Synthetic oligonucleotide
  Target: SCN10A; (-) strand; PAM type: NRG; PAM sequence: GAG
gcactccagcctgggagaca

SEQ ID NO: 19029 - DNA, 20 bp, Artificial Sequence
  Description of Artificial Sequence: Synthetic oligonucleotide
  Target: SCN10A; (-) strand; PAM type: NRG; PAM sequence: CAG
ctgcactccagcctgggaga

SEQ ID NO: 19030 - DNA, 20 bp, Artificial Sequence
  Description of Artificial Sequence: Synthetic oligonucleotide
  Target: SCN10A; (-) strand; PAM type: NRG; PAM sequence: GAG
gccactgcactccagcctgg

SEQ ID NO: 19031 - DNA, 20 bp, Artificial Sequence
  Description of Artificial Sequence: Synthetic oligonucleotide
  Target: SCN10A; (-) strand; PAM type: NRG; PAM sequence: GGG
gtgccactgcactccagcct

SEQ ID NO: 19032 - DNA, 20 bp, Artificial Sequence
  Description of Artificial Sequence: Synthetic oligonucleotide
  Target: SCN10A; (-) strand; PAM type: NRG; PAM sequence: TGG
cgtgccactgcactccagcc

SEQ ID NO: 19033 - DNA, 20 bp, Artificial Sequence
  Description of Artificial Sequence: Synthetic oligonucleotide
  Target: SCN10A; (-) strand; PAM type: NRG; PAM sequence: CAG
atgatcgtgccactgcactc

SEQ ID NO: 19034 - DNA, 20 bp, Artificial Sequence
  Description of Artificial Sequence: Synthetic oligonucleotide
  Target: SCN10A; (-) strand; PAM type: NRG; PAM sequence: CAG
gaccagggaggtggaggctg

SEQ ID NO: 19035 - DNA, 20 bp, Artificial Sequence
  Description of Artificial Sequence: Synthetic oligonucleotide
  Target: SCN10A; (-) strand; PAM type: NRG; PAM sequence: AGG
acctgagaccagggaggtgg

SEQ ID NO: 19036 - DNA, 20 bp, Artificial Sequence
  Description of Artificial Sequence: Synthetic oligonucleotide
  Target: SCN10A; (-) strand; PAM type: NRG; PAM sequence: GAG
cacctgagaccagggaggtg

SEQ ID NO: 19037 - DNA, 20 bp, Artificial Sequence
  Description of Artificial Sequence: Synthetic oligonucleotide
  Target: SCN10A; (-) strand; PAM type: NRG; PAM sequence: TGG
atcacctgagaccagggagg

SEQ ID NO: 19038 - DNA, 20 bp, Artificial Sequence
  Description of Artificial Sequence: Synthetic oligonucleotide
  Target: SCN10A; (-) strand; PAM type: NRG; PAM sequence: AGG
aggatcacctgagaccaggg

SEQ ID NO: 19039 - DNA, 20 bp, Artificial Sequence
  Description of Artificial Sequence: Synthetic oligonucleotide
  Target: SCN10A; (-) strand; PAM type: NRG; PAM sequence: GAG
gaggatcacctgagaccagg

SEQ ID NO: 19040 - DNA, 20 bp, Artificial Sequence
  Description of Artificial Sequence: Synthetic oligonucleotide
  Target: SCN10A; (-) strand; PAM type: NRG; PAM sequence: GGG
gggaggatcacctgagacca

SEQ ID NO: 19041 - DNA, 20 bp, Artificial Sequence
  Description of Artificial Sequence: Synthetic oligonucleotide
  Target: SCN10A; (-) strand; PAM type: NRG; PAM sequence: AGG
tgggaggatcacctgagacc

SEQ ID NO: 19042 - DNA, 20 bp, Artificial Sequence
  Description of Artificial Sequence: Synthetic oligonucleotide
  Target: SCN10A; (-) strand; PAM type: NRG; PAM sequence: CAG
gtgggaggatcacctgagac

SEQ ID NO: 19043 - DNA, 20 bp, Artificial Sequence
  Description of Artificial Sequence: Synthetic oligonucleotide
  Target: SCN10A; (-) strand; PAM type: NRG; PAM sequence: GAG
ctgaggtgggaggatcacct

SEQ ID NO: 19044 - DNA, 20 bp, Artificial Sequence
  Description of Artificial Sequence: Synthetic oligonucleotide
  Target: SCN10A; (-) strand; PAM type: NRG; PAM sequence: AGG
actcagaagactgaggtggg

SEQ ID NO: 19045 - DNA, 20 bp, Artificial Sequence
  Description of Artificial Sequence: Synthetic oligonucleotide
  Target: SCN10A; (-) strand; PAM type: NRG; PAM sequence: GAG
tactcagaagactgaggtgg

SEQ ID NO: 19046 - DNA, 20 bp, Artificial Sequence
  Description of Artificial Sequence: Synthetic oligonucleotide
  Target: SCN10A; (-) strand; PAM type: NRG; PAM sequence: GGG
gctactcagaagactgaggt

SEQ ID NO: 19047 - DNA, 20 bp, Artificial Sequence
  Description of Artificial Sequence: Synthetic oligonucleotide
  Target: SCN10A; (-) strand; PAM type: NRG; PAM sequence: TGG
agctactcagaagactgagg

SEQ ID NO: 19048 - DNA, 20 bp, Artificial Sequence
  Description of Artificial Sequence: Synthetic oligonucleotide
  Target: SCN10A; (-) strand; PAM type: NRG; PAM sequence: AGG
cctagctactcagaagactg

SEQ ID NO: 19049 - DNA, 20 bp, Artificial Sequence
  Description of Artificial Sequence: Synthetic oligonucleotide
  Target: SCN10A; (-) strand; PAM type: NRG; PAM sequence: GAG
tcctagctactcagaagact

SEQ ID NO: 19050 - DNA, 20 bp, Artificial Sequence
  Description of Artificial Sequence: Synthetic oligonucleotide
  Target: SCN10A; (-) strand; PAM type: NRG; PAM sequence: AAG
ctgttatcctagctactcag

SEQ ID NO: 19051 - DNA, 20 bp, Artificial Sequence
  Description of Artificial Sequence: Synthetic oligonucleotide
  Target: SCN10A; (-) strand; PAM type: NRG; PAM sequence: CAG
catctgttatcctagctact

SEQ ID NO: 19052 - DNA, 20 bp, Artificial Sequence
  Description of Artificial Sequence: Synthetic oligonucleotide
  Target: SCN10A; (-) strand; PAM type: NRG; PAM sequence: TAG
gtggtgcacatctgttatcc

SEQ ID NO: 19053 - DNA, 20 bp, Artificial Sequence
  Description of Artificial Sequence: Synthetic oligonucleotide
  Target: SCN10A; (-) strand; PAM type: NRG; PAM sequence: TGG
aaaaaattagccaggcatgg

SEQ ID NO: 19054 - DNA, 20 bp, Artificial Sequence
  Description of Artificial Sequence: Synthetic oligonucleotide
  Target: SCN10A; (-) strand; PAM type: NRG; PAM sequence: TGG
atgaaaaaattagccaggca

SEQ ID NO: 19055 - DNA, 20 bp, Artificial Sequence
  Description of Artificial Sequence: Synthetic oligonucleotide
  Target: SCN10A; (-) strand; PAM type: NRG; PAM sequence: AGG
aaaaaatgaaaaaattagcc

SEQ ID NO: 19056 - DNA, 20 bp, Artificial Sequence
  Description of Artificial Sequence: Synthetic oligonucleotide
  Target: SCN10A; (-) strand; PAM type: NRG; PAM sequence: CAG
caaaaaatgaaaaaattagc

SEQ ID NO: 19057 - DNA, 20 bp, Artificial Sequence
  Description of Artificial Sequence: Synthetic oligonucleotide
  Target: SCN10A; (-) strand; PAM type: NRG; PAM sequence: TAG
tctacaaaaaatgaaaaaat

SEQ ID NO: 19058 - DNA, 20 bp, Artificial Sequence
  Description of Artificial Sequence: Synthetic oligonucleotide
  Target: SCN10A; (-) strand; PAM type: NRG; PAM sequence: TGG
ccaggagttcaagggcaaca

SEQ ID NO: 19059 - DNA, 20 bp, Artificial Sequence
  Description of Artificial Sequence: Synthetic oligonucleotide
  Target: SCN10A; (-) strand; PAM type: NRG; PAM sequence: GGG
gcttgagcccaggagttcaa

SEQ ID NO: 19060 - DNA, 20 bp, Artificial Sequence
  Description of Artificial Sequence: Synthetic oligonucleotide
  Target: SCN10A; (-) strand; PAM type: NRG; PAM sequence: AGG
cgcttgagcccaggagttca

SEQ ID NO: 19061 - DNA, 20 bp, Artificial Sequence
  Description of Artificial Sequence: Synthetic oligonucleotide
  Target: SCN10A; (-) strand; PAM type: NRG; PAM sequence: AAG
tcgcttgagcccaggagttc

SEQ ID NO: 19062 - DNA, 20 bp, Artificial Sequence
  Description of Artificial Sequence: Synthetic oligonucleotide
  Target: SCN10A; (-) strand; PAM type: NRG; PAM sequence: GAG
ggcagatcgcttgagcccag

SEQ ID NO: 19063 - DNA, 20 bp, Artificial Sequence
  Description of Artificial Sequence: Synthetic oligonucleotide
  Target: SCN10A; (-) strand; PAM type: NRG; PAM sequence: AGG
caggcagatcgcttgagccc

SEQ ID NO: 19064 - DNA, 20 bp, Artificial Sequence
  Description of Artificial Sequence: Synthetic oligonucleotide
  Target: SCN10A; (-) strand; PAM type: NRG; PAM sequence: CAG
gcaggcagatcgcttgagcc

SEQ ID NO: 19065 - DNA, 20 bp, Artificial Sequence
  Description of Artificial Sequence: Synthetic oligonucleotide
  Target: SCN10A; (-) strand; PAM type: NRG; PAM sequence: GAG
ccgaggcaggcagatcgctt

SEQ ID NO: 19066 - DNA, 20 bp, Artificial Sequence
  Description of Artificial Sequence: Synthetic oligonucleotide
  Target: SCN10A; (-) strand; PAM type: NRG; PAM sequence: CAG
ctttgggaggccgaggcagg

SEQ ID NO: 19067 - DNA, 20 bp, Artificial Sequence
  Description of Artificial Sequence: Synthetic oligonucleotide
  Target: SCN10A; (-) strand; PAM type: NRG; PAM sequence: AGG
gtactttgggaggccgaggc

SEQ ID NO: 19068 - DNA, 20 bp, Artificial Sequence
  Description of Artificial Sequence: Synthetic oligonucleotide
  Target: SCN10A; (-) strand; PAM type: NRG; PAM sequence: CAG
agtactttgggaggccgagg

SEQ ID NO: 19069 - DNA, 20 bp, Artificial Sequence
  Description of Artificial Sequence: Synthetic oligonucleotide
  Target: SCN10A; (-) strand; PAM type: NRG; PAM sequence: AGG
cctagtactttgggaggccg

SEQ ID NO: 19070 - DNA, 20 bp, Artificial Sequence
  Description of Artificial Sequence: Synthetic oligonucleotide
  Target: SCN10A; (-) strand; PAM type: NRG; PAM sequence: GAG
tcctagtactttgggaggcc

SEQ ID NO: 19071 - DNA, 20 bp, Artificial Sequence
  Description of Artificial Sequence: Synthetic oligonucleotide
  Target: SCN10A; (-) strand; PAM type: NRG; PAM sequence: AGG
tgtaatcctagtactttggg

SEQ ID NO: 19072 - DNA, 20 bp, Artificial Sequence
  Description of Artificial Sequence: Synthetic oligonucleotide
  Target: SCN10A; (-) strand; PAM type: NRG; PAM sequence: GAG
ctgtaatcctagtactttgg

SEQ ID NO: 19073 - DNA, 20 bp, Artificial Sequence
  Description of Artificial Sequence: Synthetic oligonucleotide
  Target: SCN10A; (-) strand; PAM type: NRG; PAM sequence: GGG
acctgtaatcctagtacttt

SEQ ID NO: 19074 - DNA, 20 bp, Artificial Sequence
  Description of Artificial Sequence: Synthetic oligonucleotide
  Target: SCN10A; (-) strand; PAM type: NRG; PAM sequence: TGG
cacctgtaatcctagtactt

SEQ ID NO: 19075 - DNA, 20 bp, Artificial Sequence
  Description of Artificial Sequence: Synthetic oligonucleotide
  Target: SCN10A; (-) strand; PAM type: NRG; PAM sequence: TAG
gtggctcacacctgtaatcc

SEQ ID NO: 19076 - DNA, 20 bp, Artificial Sequence
  Description of Artificial Sequence: Synthetic oligonucleotide
  Target: SCN10A; (-) strand; PAM type: NRG; PAM sequence: TGG
ccatctcaggccaggtgcag

SEQ ID NO: 19077 - DNA, 20 bp, Artificial Sequence
  Description of Artificial Sequence: Synthetic oligonucleotide
  Target: SCN10A; (-) strand; PAM type: NRG; PAM sequence: CAG
tgaccatctcaggccaggtg

SEQ ID NO: 19078 - DNA, 20 bp, Artificial Sequence
  Description of Artificial Sequence: Synthetic oligonucleotide
  Target: SCN10A; (-) strand; PAM type: NRG; PAM sequence: AGG
caatgtgaccatctcaggcc

SEQ ID NO: 19079 - DNA, 20 bp, Artificial Sequence
  Description of Artificial Sequence: Synthetic oligonucleotide
  Target: SCN10A; (-) strand; PAM type: NRG; PAM sequence: CAG
tcaatgtgaccatctcaggc

SEQ ID NO: 19080 - DNA, 20 bp, Artificial Sequence
  Description of Artificial Sequence: Synthetic oligonucleotide
  Target: SCN10A; (-) strand; PAM type: NRG; PAM sequence: AGG
gaaatcaatgtgaccatctc

SEQ ID NO: 19081 - DNA, 20 bp, Artificial Sequence
  Description of Artificial Sequence: Synthetic oligonucleotide
  Target: SCN10A; (-) strand; PAM type: NRG; PAM sequence: CAG
agaaatcaatgtgaccatct

SEQ ID NO: 19082 - DNA, 20 bp, Artificial Sequence
  Description of Artificial Sequence: Synthetic oligonucleotide
  Target: SCN10A; (-) strand; PAM type: NRG; PAM sequence: TAG
tcctgggagggatgtttaca

SEQ ID NO: 19083 - DNA, 20 bp, Artificial Sequence
  Description of Artificial Sequence: Synthetic oligonucleotide
  Target: SCN10A; (-) strand; PAM type: NRG; PAM sequence: GGG
gcagtgcacaactcctggga

SEQ ID NO: 19084 - DNA, 20 bp, Artificial Sequence
  Description of Artificial Sequence: Synthetic oligonucleotide
  Target: SCN10A; (-) strand; PAM type: NRG; PAM sequence: AGG
agcagtgcacaactcctggg

SEQ ID NO: 19085 - DNA, 20 bp, Artificial Sequence
  Description of Artificial Sequence: Synthetic oligonucleotide
  Target: SCN10A; (-) strand; PAM type: NRG; PAM sequence: GAG
aagcagtgcacaactcctgg

SEQ ID NO: 19086 - DNA, 20 bp, Artificial Sequence
  Description of Artificial Sequence: Synthetic oligonucleotide
  Target: SCN10A; (-) strand; PAM type: NRG; PAM sequence: GGG
caaagcagtgcacaactcct

SEQ ID NO: 19087 - DNA, 20 bp, Artificial Sequence
  Description of Artificial Sequence: Synthetic oligonucleotide
  Target: SCN10A; (-) strand; PAM type: NRG; PAM sequence: TGG
ccaaagcagtgcacaactcc

SEQ ID NO: 19088 - DNA, 20 bp, Artificial Sequence
  Description of Artificial Sequence: Synthetic oligonucleotide
  Target: SCN10A; (-) strand; PAM type: NRG; PAM sequence: CAG
tcacctaggcagacccaaag

SEQ ID NO: 19089 - DNA, 20 bp, Artificial Sequence
  Description of Artificial Sequence: Synthetic oligonucleotide
  Target: SCN10A; (-) strand; PAM type: NRG; PAM sequence: AAG
atttcacctaggcagaccca

SEQ ID NO: 19090 - DNA, 20 bp, Artificial Sequence
  Description of Artificial Sequence: Synthetic oligonucleotide
  Target: SCN10A; (-) strand; PAM type: NRG; PAM sequence: CAG
atgactccatttcacctagg

SEQ ID NO: 19091 - DNA, 20 bp, Artificial Sequence
  Description of Artificial Sequence: Synthetic oligonucleotide
  Target: SCN10A; (-) strand; PAM type: NRG; PAM sequence: AGG
aagatgactccatttcacct

SEQ ID NO: 19092 - DNA, 20 bp, Artificial Sequence
  Description of Artificial Sequence: Synthetic oligonucleotide
  Target: SCN10A; (-) strand; PAM type: NRG; PAM sequence: TAG
aaagatgactccatttcacc

SEQ ID NO: 19093 - DNA, 20 bp, Artificial Sequence
  Description of Artificial Sequence: Synthetic oligonucleotide
  Target: SCN10A; (-) strand; PAM type: NRG; PAM sequence: AAG
ttgcctcaggtagacaggca

SEQ ID NO: 19094 - DNA, 20 bp, Artificial Sequence
  Description of Artificial Sequence: Synthetic oligonucleotide
  Target: SCN10A; (-) strand; PAM type: NRG; PAM sequence: AGG
gatatttgcctcaggtagac

SEQ ID NO: 19095 - DNA, 20 bp, Artificial Sequence
  Description of Artificial Sequence: Synthetic oligonucleotide
  Target: SCN10A; (-) strand; PAM type: NRG; PAM sequence: CAG
ggatatttgcctcaggtaga

SEQ ID NO: 19096 - DNA, 20 bp, Artificial Sequence
  Description of Artificial Sequence: Synthetic oligonucleotide
  Target: SCN10A; (-) strand; PAM type: NRG; PAM sequence: TAG
cactggatatttgcctcagg

SEQ ID NO: 19097 - DNA, 20 bp, Artificial Sequence
  Description of Artificial Sequence: Synthetic oligonucleotide
  Target: SCN10A; (-) strand; PAM type: NRG; PAM sequence: AGG
gggcactggatatttgcctc

SEQ ID NO: 19098 - DNA, 20 bp, Artificial Sequence
  Description of Artificial Sequence: Synthetic oligonucleotide
  Target: SCN10A; (-) strand; PAM type: NRG; PAM sequence: CAG
tgggcactggatatttgcct

SEQ ID NO: 19099 - DNA, 20 bp, Artificial Sequence
  Description of Artificial Sequence: Synthetic oligonucleotide
  Target: SCN10A; (-) strand; PAM type: NRG; PAM sequence: TGG
catggaagagatgtgggcac

SEQ ID NO: 19100 - DNA, 20 bp, Artificial Sequence
  Description of Artificial Sequence: Synthetic oligonucleotide
  Target: SCN10A; (-) strand; PAM type: NRG; PAM sequence: GGG
gccagccatggaagagatgt

SEQ ID NO: 19101 - DNA, 20 bp, Artificial Sequence
  Description of Artificial Sequence: Synthetic oligonucleotide
  Target: SCN10A; (-) strand; PAM type: NRG; PAM sequence: TGG
agccagccatggaagagatg

SEQ ID NO: 19102 - DNA, 20 bp, Artificial Sequence
  Description of Artificial Sequence: Synthetic oligonucleotide
  Target: SCN10A; (-) strand; PAM type: NRG; PAM sequence: GAG
acatagagccagccatggaa

SEQ ID NO: 19103 - DNA, 20 bp, Artificial Sequence
  Description of Artificial Sequence: Synthetic oligonucleotide
  Target: SCN10A; (-) strand; PAM type: NRG; PAM sequence: AAG
tgacatagagccagccatgg

SEQ ID NO: 19104 - DNA, 20 bp, Artificial Sequence
  Description of Artificial Sequence: Synthetic oligonucleotide
  Target: SCN10A; (-) strand; PAM type: NRG; PAM sequence: TGG
cagtgacatagagccagcca

SEQ ID NO: 19105 - DNA, 20 bp, Artificial Sequence
  Description of Artificial Sequence: Synthetic oligonucleotide
  Target: SCN10A; (-) strand; PAM type: NRG; PAM sequence: CAG
catgtgcagtgacatagagc

SEQ ID NO: 19106 - DNA, 20 bp, Artificial Sequence
  Description of Artificial Sequence: Synthetic oligonucleotide
  Target: SCN10A; (-) strand; PAM type: NRG; PAM sequence: GAG
tgcccatgtgcagtgacata

SEQ ID NO: 19107 - DNA, 20 bp, Artificial Sequence
  Description of Artificial Sequence: Synthetic oligonucleotide
  Target: SCN10A; (-) strand; PAM type: NRG; PAM sequence: TAG
aatgcccatgtgcagtgaca

SEQ ID NO: 19108 - DNA, 20 bp, Artificial Sequence
  Description of Artificial Sequence: Synthetic oligonucleotide
  Target: SCN10A; (-) strand; PAM type: NRG; PAM sequence: CAG
caaactcaaatgcccatgtg

SEQ ID NO: 19109 - DNA, 20 bp, Artificial Sequence
  Description of Artificial Sequence: Synthetic oligonucleotide
  Target: SCN10A; (-) strand; PAM type: NRG; PAM sequence: TGG
tggcgtacctggattagggg

SEQ ID NO: 19110 - DNA, 20 bp, Artificial Sequence
  Description of Artificial Sequence: Synthetic oligonucleotide
  Target: SCN10A; (-) strand; PAM type: NRG; PAM sequence: GGG
acttggcgtacctggattag

SEQ ID NO: 19111 - DNA, 20 bp, Artificial Sequence
  Description of Artificial Sequence: Synthetic oligonucleotide
  Target: SCN10A; (-) strand; PAM type: NRG; PAM sequence: GGG
aacttggcgtacctggatta

SEQ ID NO: 19112 - DNA, 20 bp, Artificial Sequence
  Description of Artificial Sequence: Synthetic oligonucleotide
  Target: SCN10A; (-) strand; PAM type: NRG; PAM sequence: AGG
gaacttggcgtacctggatt

SEQ ID NO: 19113 - DNA, 20 bp, Artificial Sequence
  Description of Artificial Sequence: Synthetic oligonucleotide
  Target: SCN10A; (-) strand; PAM type: NRG; PAM sequence: TAG
tgaacttggcgtacctggat

SEQ ID NO: 19114 - DNA, 20 bp, Artificial Sequence
  Description of Artificial Sequence: Synthetic oligonucleotide
  Target: SCN10A; (-) strand; PAM type: NRG; PAM sequence: TGG
gcccctgaacttggcgtacc

SEQ ID NO: 19115 - DNA, 20 bp, Artificial Sequence
  Description of Artificial Sequence: Synthetic oligonucleotide
  Target: SCN10A; (-) strand; PAM type: NRG; PAM sequence: TGG
cagtgctgagcccctgaact

SEQ ID NO: 19116 - DNA, 20 bp, Artificial Sequence
  Description of Artificial Sequence: Synthetic oligonucleotide
  Target: SCN10A; (-) strand; PAM type: NRG; PAM sequence: GAG
ggggccagtgagacagtgct

SEQ ID NO: 19117 - DNA, 20 bp, Artificial Sequence
  Description of Artificial Sequence: Synthetic oligonucleotide
  Target: SCN10A; (-) strand; PAM type: NRG; PAM sequence: CAG
tatcacaggggccagtgaga

SEQ ID NO: 19118 - DNA, 20 bp, Artificial Sequence
  Description of Artificial Sequence: Synthetic oligonucleotide
  Target: SCN10A; (-) strand; PAM type: NRG; PAM sequence: GAG
accctatcacaggggccagt

SEQ ID NO: 19119 - DNA, 20 bp, Artificial Sequence
  Description of Artificial Sequence: Synthetic oligonucleotide
  Target: SCN10A; (-) strand; PAM type: NRG; PAM sequence: CAG
tgggaccctatcacaggggc

SEQ ID NO: 19120 - DNA, 20 bp, Artificial Sequence
  Description of Artificial Sequence: Synthetic oligonucleotide
  Target: SCN10A; (-) strand; PAM type: NRG; PAM sequence: GGG
tgcttgggaccctatcacag

SEQ ID NO: 19121 - DNA, 20 bp, Artificial Sequence
  Description of Artificial Sequence: Synthetic oligonucleotide
  Target: SCN10A; (-) strand; PAM type: NRG; PAM sequence: GGG
ctgcttgggaccctatcaca

SEQ ID NO: 19122 - DNA, 20 bp, Artificial Sequence
  Description of Artificial Sequence: Synthetic oligonucleotide
  Target: SCN10A; (-) strand; PAM type: NRG; PAM sequence: AGG
tctgcttgggaccctatcac

SEQ ID NO: 19123 - DNA, 20 bp, Artificial Sequence
  Description of Artificial Sequence: Synthetic oligonucleotide
  Target: SCN10A; (-) strand; PAM type: NRG; PAM sequence: CAG
atctgcttgggaccctatca

SEQ ID NO: 19124 - DNA, 20 bp, Artificial Sequence
  Description of Artificial Sequence: Synthetic oligonucleotide
  Target: SCN10A; (-) strand; PAM type: NRG; PAM sequence: GGG
actctaggacagatctgctt

SEQ ID NO: 19125 - DNA, 20 bp, Artificial Sequence
  Description of Artificial Sequence: Synthetic oligonucleotide
  Target: SCN10A; (-) strand; PAM type: NRG; PAM sequence: TGG
gactctaggacagatctgct

SEQ ID NO: 19126 - DNA, 20 bp, Artificial Sequence
  Description of Artificial Sequence: Synthetic oligonucleotide
  Target: SCN10A; (-) strand; PAM type: NRG; PAM sequence: CAG
gaggcaacgagactctagga

SEQ ID NO: 19127 - DNA, 20 bp, Artificial Sequence
  Description of Artificial Sequence: Synthetic oligonucleotide
  Target: SCN10A; (-) strand; PAM type: NRG; PAM sequence: AGG
tcaggaggcaacgagactct

SEQ ID NO: 19128 - DNA, 20 bp, Artificial Sequence
  Description of Artificial Sequence: Synthetic oligonucleotide
  Target: SCN10A; (-) strand; PAM type: NRG; PAM sequence: TAG
ttcaggaggcaacgagactc

SEQ ID NO: 19129 - DNA, 20 bp, Artificial Sequence
  Description of Artificial Sequence: Synthetic oligonucleotide
  Target: SCN10A; (-) strand; PAM type: NRG; PAM sequence: GAG
tgcatggttcaggaggcaac

SEQ ID NO: 19130 - DNA, 20 bp, Artificial Sequence
  Description of Artificial Sequence: Synthetic oligonucleotide
  Target: SCN10A; (-) strand; PAM type: NRG; PAM sequence: AGG
aagggggtgcatggttcagg

SEQ ID NO: 19131 - DNA, 20 bp, Artificial Sequence
  Description of Artificial Sequence: Synthetic oligonucleotide
  Target: SCN10A; (-) strand; PAM type: NRG; PAM sequence: GAG
gaagggggtgcatggttcag

SEQ ID NO: 19132 - DNA, 20 bp, Artificial Sequence
  Description of Artificial Sequence: Synthetic oligonucleotide
  Target: SCN10A; (-) strand; PAM type: NRG; PAM sequence: AGG
ttgaagggggtgcatggttc

SEQ ID NO: 19133 - DNA, 20 bp, Artificial Sequence
  Description of Artificial Sequence: Synthetic oligonucleotide
  Target: SCN10A; (-) strand; PAM type: NRG; PAM sequence: CAG
gttgaagggggtgcatggtt

SEQ ID NO: 19134 - DNA, 20 bp, Artificial Sequence
  Description of Artificial Sequence: Synthetic oligonucleotide
  Target: SCN10A; (-) strand; PAM type: NRG; PAM sequence: TGG
cagaggttgaagggggtgca

SEQ ID NO: 19135 - DNA, 20 bp, Artificial Sequence
  Description of Artificial Sequence: Synthetic oligonucleotide
  Target: SCN10A; (-) strand; PAM type: NRG; PAM sequence: GGG
tggcatccagaggttgaagg

SEQ ID NO: 19136 - DNA, 20 bp, Artificial Sequence
  Description of Artificial Sequence: Synthetic oligonucleotide
  Target: SCN10A; (-) strand; PAM type: NRG; PAM sequence: GGG
ttggcatccagaggttgaag

SEQ ID NO: 19137 - DNA, 20 bp, Artificial Sequence
  Description of Artificial Sequence: Synthetic oligonucleotide
  Target: SCN10A; (-) strand; PAM type: NRG; PAM sequence: GGG
gttggcatccagaggttgaa

SEQ ID NO: 19138 - DNA, 20 bp, Artificial Sequence
  Description of Artificial Sequence: Synthetic oligonucleotide
  Target: SCN10A; (-) strand; PAM type: NRG; PAM sequence: AGG
tgttggcatccagaggttga

SEQ ID NO: 19139 - DNA, 20 bp, Artificial Sequence
  Description of Artificial Sequence: Synthetic oligonucleotide
  Target: SCN10A; (-) strand; PAM type: NRG; PAM sequence: AAG
gtgttggcatccagaggttg

SEQ ID NO: 19140 - DNA, 20 bp, Artificial Sequence
  Description of Artificial Sequence: Synthetic oligonucleotide
  Target: SCN10A; (-) strand; PAM type: NRG; PAM sequence: AGG
tgacaagtgttggcatccag

SEQ ID NO: 19141 - DNA, 20 bp, Artificial Sequence
  Description of Artificial Sequence: Synthetic oligonucleotide
  Target: SCN10A; (-) strand; PAM type: NRG; PAM sequence: GAG
ctgacaagtgttggcatcca

SEQ ID NO: 19142 - DNA, 20 bp, Artificial Sequence
  Description of Artificial Sequence: Synthetic oligonucleotide
  Target: SCN10A; (-) strand; PAM type: NRG; PAM sequence: CAG
tcctgacaagtgttggcatc

SEQ ID NO: 19143 - DNA, 20 bp, Artificial Sequence
  Description of Artificial Sequence: Synthetic oligonucleotide
  Target: SCN10A; (-) strand; PAM type: NRG; PAM sequence: TGG
cccaaggtcctgacaagtgt

SEQ ID NO: 19144 - DNA, 20 bp, Artificial Sequence
  Description of Artificial Sequence: Synthetic oligonucleotide
  Target: SCN10A; (-) strand; PAM type: NRG; PAM sequence: AAG
aatcttcccaaggtcctgac

SEQ ID NO: 19145 - DNA, 20 bp, Artificial Sequence
  Description of Artificial Sequence: Synthetic oligonucleotide
  Target: SCN10A; (-) strand; PAM type: NRG; PAM sequence: AGG
agtatccaacaatcttccca

SEQ ID NO: 19146 - DNA, 20 bp, Artificial Sequence
  Description of Artificial Sequence: Synthetic oligonucleotide
  Target: SCN10A; (-) strand; PAM type: NRG; PAM sequence: AAG
gagtatccaacaatcttccc

SEQ ID NO: 19147 - DNA, 20 bp, Artificial Sequence
  Description of Artificial Sequence: Synthetic oligonucleotide
  Target: SCN10A; (-) strand; PAM type: NRG; PAM sequence: GAG
agaggtgacaaaacaaaggg

SEQ ID NO: 19148 - DNA, 20 bp, Artificial Sequence
  Description of Artificial Sequence: Synthetic oligonucleotide
  Target: SCN10A; (-) strand; PAM type: NRG; PAM sequence: GGG
agagaggtgacaaaacaaag

SEQ ID NO: 19149 - DNA, 20 bp, Artificial Sequence
  Description of Artificial Sequence: Synthetic oligonucleotide
  Target: SCN10A; (-) strand; PAM type: NRG; PAM sequence: GGG
aagagaggtgacaaaacaaa

SEQ ID NO: 19150 - DNA, 20 bp, Artificial Sequence
  Description of Artificial Sequence: Synthetic oligonucleotide
  Target: SCN10A; (-) strand; PAM type: NRG; PAM sequence: AGG
gaagagaggtgacaaaacaa

SEQ ID NO: 19151 - DNA, 20 bp, Artificial Sequence
  Description of Artificial Sequence: Synthetic oligonucleotide
  Target: SCN10A; (-) strand; PAM type: NRG; PAM sequence: AAG
tgaagagaggtgacaaaaca

SEQ ID NO: 19152 - DNA, 20 bp, Artificial Sequence
  Description of Artificial Sequence: Synthetic oligonucleotide
  Target: SCN10A; (-) strand; PAM type: NRG; PAM sequence: AGG
ctgcatctagacttgaagag

SEQ ID NO: 19153 - DNA, 20 bp, Artificial Sequence
  Description of Artificial Sequence: Synthetic oligonucleotide
  Target: SCN10A; (-) strand; PAM type: NRG; PAM sequence: GAG
cctgcatctagacttgaaga

SEQ ID NO: 19154 - DNA, 20 bp, Artificial Sequence
  Description of Artificial Sequence: Synthetic oligonucleotide
  Target: SCN10A; (-) strand; PAM type: NRG; PAM sequence: GAG
gccctgcatctagacttgaa

SEQ ID NO: 19155 - DNA, 20 bp, Artificial Sequence
  Description of Artificial Sequence: Synthetic oligonucleotide
  Target: SCN10A; (-) strand; PAM type: NRG; PAM sequence: AAG
gagccctgcatctagacttg

SEQ ID NO: 19156 - DNA, 20 bp, Artificial Sequence
  Description of Artificial Sequence: Synthetic oligonucleotide
  Target: SCN10A; (-) strand; PAM type: NRG; PAM sequence: TAG
ttaactgggagccctgcatc

SEQ ID NO: 19157 - DNA, 20 bp, Artificial Sequence
  Description of Artificial Sequence: Synthetic oligonucleotide
  Target: SCN10A; (-) strand; PAM type: NRG; PAM sequence: GAG
aatctctcagtattaactgg

SEQ ID NO: 19158 - DNA, 20 bp, Artificial Sequence
  Description of Artificial Sequence: Synthetic oligonucleotide
  Target: SCN10A; (-) strand; PAM type: NRG; PAM sequence: GGG
ggaatctctcagtattaact

SEQ ID NO: 19159 - DNA, 20 bp, Artificial Sequence
  Description of Artificial Sequence: Synthetic oligonucleotide
  Target: SCN10A; (-) strand; PAM type: NRG; PAM sequence: TGG
aggaatctctcagtattaac

SEQ ID NO: 19160 - DNA, 20 bp, Artificial Sequence
  Description of Artificial Sequence: Synthetic oligonucleotide
  Target: SCN10A; (-) strand; PAM type: NRG; PAM sequence: CAG
gcctgctctcaggaatctct

SEQ ID NO: 19161 - DNA, 20 bp, Artificial Sequence
  Description of Artificial Sequence: Synthetic oligonucleotide
  Target: SCN10A; (-) strand; PAM type: NRG; PAM sequence: AGG
agcgcaggccgcctgctctc

SEQ ID NO: 19162 - DNA, 20 bp, Artificial Sequence
  Description of Artificial Sequence: Synthetic oligonucleotide
  Target: SCN10A; (-) strand; PAM type: NRG; PAM sequence: CAG
tagcgcaggccgcctgctct

SEQ ID NO: 19163 - DNA, 20 bp, Artificial Sequence
  Description of Artificial Sequence: Synthetic oligonucleotide
  Target: SCN10A; (-) strand; PAM type: NRG; PAM sequence: AGG
atgtcacggcttgttagcgc

SEQ ID NO: 19164 - DNA, 20 bp, Artificial Sequence
  Description of Artificial Sequence: Synthetic oligonucleotide
  Target: SCN10A; (-) strand; PAM type: NRG; PAM sequence: CAG
aatgtcacggcttgttagcg

SEQ ID NO: 19165 - DNA, 20 bp, Artificial Sequence
  Description of Artificial Sequence: Synthetic oligonucleotide
  Target: SCN10A; (-) strand; PAM type: NRG; PAM sequence: TAG
gaagaaatgtcacggcttgt

SEQ ID NO: 19166 - DNA, 20 bp, Artificial Sequence
  Description of Artificial Sequence: Synthetic oligonucleotide
  Target: SCN10A; (-) strand; PAM type: NRG; PAM sequence: CGG
agaggcctgaagaaatgtca

SEQ ID NO: 19167 - DNA, 20 bp, Artificial Sequence
  Description of Artificial Sequence: Synthetic oligonucleotide
  Target: SCN10A; (-) strand; PAM type: NRG; PAM sequence: AAG
gggaataggaaagaggcctg

SEQ ID NO: 19168 - DNA, 20 bp, Artificial Sequence
  Description of Artificial Sequence: Synthetic oligonucleotide
  Target: SCN10A; (-) strand; PAM type: NRG; PAM sequence: AGG
gactcttgggaataggaaag

SEQ ID NO: 19169 - DNA, 20 bp, Artificial Sequence
  Description of Artificial Sequence: Synthetic oligonucleotide
  Target: SCN10A; (-) strand; PAM type: NRG; PAM sequence: GAG
tgactcttgggaataggaaa

SEQ ID NO: 19170 - DNA, 20 bp, Artificial Sequence
  Description of Artificial Sequence: Synthetic oligonucleotide
  Target: SCN10A; (-) strand; PAM type: NRG; PAM sequence: AAG
actgactcttgggaatagga

SEQ ID NO: 19171 - DNA, 20 bp, Artificial Sequence
  Description of Artificial Sequence: Synthetic oligonucleotide
  Target: SCN10A; (-) strand; PAM type: NRG; PAM sequence: AGG
tctcactgactcttgggaat

SEQ ID NO: 19172 - DNA, 20 bp, Artificial Sequence
  Description of Artificial Sequence: Synthetic oligonucleotide
  Target: SCN10A; (-) strand; PAM type: NRG; PAM sequence: TAG
atctcactgactcttgggaa

SEQ ID NO: 19173 - DNA, 20 bp, Artificial Sequence
  Description of Artificial Sequence: Synthetic oligonucleotide
  Target: SCN10A; (-) strand; PAM type: NRG; PAM sequence: GGG
ttggcatctcactgactctt

SEQ ID NO: 19174 - DNA, 20 bp, Artificial Sequence
  Description of Artificial Sequence: Synthetic oligonucleotide
  Target: SCN10A; (-) strand; PAM type: NRG; PAM sequence: TGG
cttggcatctcactgactct

SEQ ID NO: 19175 - DNA, 20 bp, Artificial Sequence
  Description of Artificial Sequence: Synthetic oligonucleotide
  Target: SCN10A; (-) strand; PAM type: NRG; PAM sequence: TGG
caggccatctggaggaagct

SEQ ID NO: 19176 - DNA, 20 bp, Artificial Sequence
  Description of Artificial Sequence: Synthetic oligonucleotide
  Target: SCN10A; (-) strand; PAM type: NRG; PAM sequence: AAG
gtctccaggccatctggagg

SEQ ID NO: 19177 - DNA, 20 bp, Artificial Sequence
  Description of Artificial Sequence: Synthetic oligonucleotide
  Target: SCN10A; (-) strand; PAM type: NRG; PAM sequence: AGG
taggtctccaggccatctgg

SEQ ID NO: 19178 - DNA, 20 bp, Artificial Sequence
  Description of Artificial Sequence: Synthetic oligonucleotide
  Target: SCN10A; (-) strand; PAM type: NRG; PAM sequence: GAG
ctaggtctccaggccatctg

SEQ ID NO: 19179 - DNA, 20 bp, Artificial Sequence
  Description of Artificial Sequence: Synthetic oligonucleotide
  Target: SCN10A; (-) strand; PAM type: NRG; PAM sequence: TGG
cactaggtctccaggccatc

SEQ ID NO: 19180 - DNA, 20 bp, Artificial Sequence
  Description of Artificial Sequence: Synthetic oligonucleotide
  Target: SCN10A; (-) strand; PAM type: NRG; PAM sequence: AGG
tgtcgggtcactaggtctcc

SEQ ID NO: 19181 - DNA, 20 bp, Artificial Sequence
  Description of Artificial Sequence: Synthetic oligonucleotide
  Target: SCN10A; (-) strand; PAM type: NRG; PAM sequence: CAG
gtgtcgggtcactaggtctc

SEQ ID NO: 19182 - DNA, 20 bp, Artificial Sequence
  Description of Artificial Sequence: Synthetic oligonucleotide
  Target: SCN10A; (-) strand; PAM type: NRG; PAM sequence: AGG
cccaggagtgtcgggtcact

SEQ ID NO: 19183 - DNA, 20 bp, Artificial Sequence
  Description of Artificial Sequence: Synthetic oligonucleotide
  Target: SCN10A; (-) strand; PAM type: NRG; PAM sequence: TAG
tcccaggagtgtcgggtcac

SEQ ID NO: 19184 - DNA, 20 bp, Artificial Sequence
  Description of Artificial Sequence: Synthetic oligonucleotide
  Target: SCN10A; (-) strand; PAM type: NRG; PAM sequence: GGG
gtcagattcccaggagtgtc

SEQ ID NO: 19185 - DNA, 20 bp, Artificial Sequence
  Description of Artificial Sequence: Synthetic oligonucleotide
  Target: SCN10A; (-) strand; PAM type: NRG; PAM sequence: CGG
tgtcagattcccaggagtgt

SEQ ID NO: 19186 - DNA, 20 bp, Artificial Sequence
  Description of Artificial Sequence: Synthetic oligonucleotide
  Target: SCN10A; (-) strand; PAM type: NRG; PAM sequence: GAG
caaacctgtcagattcccag

SEQ ID NO: 19187 - DNA, 20 bp, Artificial Sequence
  Description of Artificial Sequence: Synthetic oligonucleotide
  Target: SCN10A; (-) strand; PAM type: NRG; PAM sequence: AGG
gccaaacctgtcagattccc

SEQ ID NO: 19188 - DNA, 20 bp, Artificial Sequence
  Description of Artificial Sequence: Synthetic oligonucleotide
  Target: SCN10A; (-) strand; PAM type: NRG; PAM sequence: CAG
agccaaacctgtcagattcc

SEQ ID NO: 19189 - DNA, 20 bp, Artificial Sequence
  Description of Artificial Sequence: Synthetic oligonucleotide
  Target: SCN10A; (-) strand; PAM type: NRG; PAM sequence: CAG
ggtttgtcagccaaacctgt

SEQ ID NO: 19190 - DNA, 20 bp, Artificial Sequence
  Description of Artificial Sequence: Synthetic oligonucleotide
  Target: SCN10A; (-) strand; PAM type: NRG; PAM sequence: CAG
tatcagagccacaggtttgt

SEQ ID NO: 19191 - DNA, 20 bp, Artificial Sequence
  Description of Artificial Sequence: Synthetic oligonucleotide
  Target: SCN10A; (-) strand; PAM type: NRG; PAM sequence: AGG
cccacttttatcagagccac

SEQ ID NO: 19192 - DNA, 20 bp, Artificial Sequence
  Description of Artificial Sequence: Synthetic oligonucleotide
  Target: SCN10A; (-) strand; PAM type: NRG; PAM sequence: CAG
acccacttttatcagagcca

SEQ ID NO: 19193 - DNA, 20 bp, Artificial Sequence
  Description of Artificial Sequence: Synthetic oligonucleotide
  Target: SCN10A; (-) strand; PAM type: NRG; PAM sequence: GAG
caggccacccacttttatca

SEQ ID NO: 19194 - DNA, 20 bp, Artificial Sequence
  Description of Artificial Sequence: Synthetic oligonucleotide
  Target: SCN10A; (-) strand; PAM type: NRG; PAM sequence: CAG
cacaggccacccacttttat

SEQ ID NO: 19195 - DNA, 20 bp, Artificial Sequence
  Description of Artificial Sequence: Synthetic oligonucleotide
  Target: SCN10A; (-) strand; PAM type: NRG; PAM sequence: AGG
ctctacaggagaagtgccac

SEQ ID NO: 19196 - DNA, 20 bp, Artificial Sequence
  Description of Artificial Sequence: Synthetic oligonucleotide
  Target: SCN10A; (-) strand; PAM type: NRG; PAM sequence: CAG
cctctacaggagaagtgcca

SEQ ID NO: 19197 - DNA, 20 bp, Artificial Sequence
  Description of Artificial Sequence: Synthetic oligonucleotide
  Target: SCN10A; (-) strand; PAM type: NRG; PAM sequence: AAG
caggacgccctctacaggag

SEQ ID NO: 19198 - DNA, 20 bp, Artificial Sequence
  Description of Artificial Sequence: Synthetic oligonucleotide
  Target: SCN10A; (-) strand; PAM type: NRG; PAM sequence: GAG
ctccaggacgccctctacag

SEQ ID NO: 19199 - DNA, 20 bp, Artificial Sequence
  Description of Artificial Sequence: Synthetic oligonucleotide
  Target: SCN10A; (-) strand; PAM type: NRG; PAM sequence: AGG
agctccaggacgccctctac

SEQ ID NO: 19200 - DNA, 20 bp, Artificial Sequence
  Description of Artificial Sequence: Synthetic oligonucleotide
  Target: SCN10A; (-) strand; PAM type: NRG; PAM sequence: CAG
cagctccaggacgccctcta

SEQ ID NO: 19201 - DNA, 20 bp, Artificial Sequence
  Description of Artificial Sequence: Synthetic oligonucleotide
  Target: SCN10A; (-) strand; PAM type: NRG; PAM sequence: AGG
tcttctctaaactcagctcc

SEQ ID NO: 19202 - DNA, 20 bp, Artificial Sequence
  Description of Artificial Sequence: Synthetic oligonucleotide
  Target: SCN10A; (-) strand; PAM type: NRG; PAM sequence: CAG
ctcttctctaaactcagctc

SEQ ID NO: 19203 - DNA, 20 bp, Artificial Sequence
  Description of Artificial Sequence: Synthetic oligonucleotide
  Target: SCN10A; (-) strand; PAM type: NRG; PAM sequence: CAG
tgatggctcttctctaaact

SEQ ID NO: 19204 - DNA, 20 bp, Artificial Sequence
  Description of Artificial Sequence: Synthetic oligonucleotide
  Target: SCN10A; (-) strand; PAM type: NRG; PAM sequence: TGG
gtctcactcacatgcaatga

SEQ ID NO: 19205 - DNA, 20 bp, Artificial Sequence
  Description of Artificial Sequence: Synthetic oligonucleotide
  Target: SCN10A; (-) strand; PAM type: NRG; PAM sequence: TAG
agcaccttcaacctgcctat

SEQ ID NO: 19206 - DNA, 20 bp, Artificial Sequence
  Description of Artificial Sequence: Synthetic oligonucleotide
  Target: SCN10A; (-) strand; PAM type: NRG; PAM sequence: AAG
aatcacagccccaatgtctc

SEQ ID NO: 19207 - DNA, 20 bp, Artificial Sequence
  Description of Artificial Sequence: Synthetic oligonucleotide
  Target: SCN10A; (-) strand; PAM type: NRG; PAM sequence: CAG
ttcccttgtgcccgaaatca

SEQ ID NO: 19208 - DNA, 20 bp, Artificial Sequence
  Description of Artificial Sequence: Synthetic oligonucleotide
  Target: SCN10A; (-) strand; PAM type: NRG; PAM sequence: AAG
agctccttccagcctcaagg

SEQ ID NO: 19209 - DNA, 20 bp, Artificial Sequence
  Description of Artificial Sequence: Synthetic oligonucleotide
  Target: SCN10A; (-) strand; PAM type: NRG; PAM sequence: AGG
cccagctccttccagcctca

SEQ ID NO: 19210 - DNA, 20 bp, Artificial Sequence
  Description of Artificial Sequence: Synthetic oligonucleotide
  Target: SCN10A; (-) strand; PAM type: NRG; PAM sequence: AAG
ccccagctccttccagcctc

SEQ ID NO: 19211 - DNA, 20 bp, Artificial Sequence
  Description of Artificial Sequence: Synthetic oligonucleotide
  Target: SCN10A; (-) strand; PAM type: NRG; PAM sequence: CAG
tccagagccccagctccttc

SEQ ID NO: 19212 - DNA, 20 bp, Artificial Sequence
  Description of Artificial Sequence: Synthetic oligonucleotide
  Target: SCN10A; (-) strand; PAM type: NRG; PAM sequence: CAG
gttgtctgactccagagccc

SEQ ID NO: 19213 - DNA, 20 bp, Artificial Sequence
  Description of Artificial Sequence: Synthetic oligonucleotide
  Target: SCN10A; (-) strand; PAM type: NRG; PAM sequence: GAG
atccaggttgtctgactcca

SEQ ID NO: 19214 - DNA, 20 bp, Artificial Sequence
  Description of Artificial Sequence: Synthetic oligonucleotide
  Target: SCN10A; (-) strand; PAM type: NRG; PAM sequence: CAG
aaatccaggttgtctgactc

SEQ ID NO: 19215 - DNA, 20 bp, Artificial Sequence
  Description of Artificial Sequence: Synthetic oligonucleotide
  Target: SCN10A; (-) strand; PAM type: NRG; PAM sequence: AGG
cagacctggatctcaaatcc

SEQ ID NO: 19216 - DNA, 20 bp, Artificial Sequence
  Description of Artificial Sequence: Synthetic oligonucleotide
  Target: SCN10A; (-) strand; PAM type: NRG; PAM sequence: CAG
acagacctggatctcaaatc

SEQ ID NO: 19217 - DNA, 20 bp, Artificial Sequence
  Description of Artificial Sequence: Synthetic oligonucleotide
  Target: SCN10A; (-) strand; PAM type: NRG; PAM sequence: TGG
aagcgaataagccacagacc

SEQ ID NO: 19218 - DNA, 20 bp, Artificial Sequence
  Description of Artificial Sequence: Synthetic oligonucleotide
  Target: SCN10A; (-) strand; PAM type: NRG; PAM sequence: CAG
ccaagcaagcgaataagcca

SEQ ID NO: 19219 - DNA, 20 bp, Artificial Sequence
  Description of Artificial Sequence: Synthetic oligonucleotide
  Target: SCN10A; (-) strand; PAM type: NRG; PAM sequence: AAG
catctgccaagcaagcgaat

SEQ ID NO: 19220 - DNA, 20 bp, Artificial Sequence
  Description of Artificial Sequence: Synthetic oligonucleotide
  Target: SCN10A; (-) strand; PAM type: NRG; PAM sequence: AAG
aagtctcccatctgccaagc

SEQ ID NO: 19221 - DNA, 20 bp, Artificial Sequence
  Description of Artificial Sequence: Synthetic oligonucleotide
  Target: SCN10A; (-) strand; PAM type: NRG; PAM sequence: AAG
ccgaaagtctcccatctgcc

SEQ ID NO: 19222 - DNA, 20 bp, Artificial Sequence
  Description of Artificial Sequence: Synthetic oligonucleotide
  Target: SCN10A; (-) strand; PAM type: NRG; PAM sequence: AAG
atggttccatgatgacccga

SEQ ID NO: 19223 - DNA, 20 bp, Artificial Sequence
  Description of Artificial Sequence: Synthetic oligonucleotide
  Target: SCN10A; (-) strand; PAM type: NRG; PAM sequence: TGG
gggtgggtgaggaaaaagaa

SEQ ID NO: 19224 - DNA, 20 bp, Artificial Sequence
  Description of Artificial Sequence: Synthetic oligonucleotide
  Target: SCN10A; (-) strand; PAM type: NRG; PAM sequence: AAG
ctcaggggtgggtgaggaaa

SEQ ID NO: 19225 - DNA, 20 bp, Artificial Sequence
  Description of Artificial Sequence: Synthetic oligonucleotide
  Target: SCN10A; (-) strand; PAM type: NRG; PAM sequence: AGG
aagatcctcaggggtgggtg

SEQ ID NO: 19226 - DNA, 20 bp, Artificial Sequence
  Description of Artificial Sequence: Synthetic oligonucleotide
  Target: SCN10A; (-) strand; PAM type: NRG; PAM sequence: GAG
taagatcctcaggggtgggt

SEQ ID NO: 19227 - DNA, 20 bp, Artificial Sequence
  Description of Artificial Sequence: Synthetic oligonucleotide
  Target: SCN10A; (-) strand; PAM type: NRG; PAM sequence: GGG
tttttaagatcctcaggggt

SEQ ID NO: 19228 - DNA, 20 bp, Artificial Sequence
  Description of Artificial Sequence: Synthetic oligonucleotide
  Target: SCN10A; (-) strand; PAM type: NRG; PAM sequence: TGG
gtttttaagatcctcagggg

SEQ ID NO: 19229 - DNA, 20 bp, Artificial Sequence
  Description of Artificial Sequence: Synthetic oligonucleotide
  Target: SCN10A; (-) strand; PAM type: NRG; PAM sequence: GGG
gtcgtttttaagatcctcag

SEQ ID NO: 19230 - DNA, 20 bp, Artificial Sequence
  Description of Artificial Sequence: Synthetic oligonucleotide
  Target: SCN10A; (-) strand; PAM type: NRG; PAM sequence: GGG
agtcgtttttaagatcctca

SEQ ID NO: 19231 - DNA, 20 bp, Artificial Sequence
  Description of Artificial Sequence: Synthetic oligonucleotide
  Target: SCN10A; (-) strand; PAM type: NRG; PAM sequence: AGG
tagtcgtttttaagatcctc

SEQ ID NO: 19232 - DNA, 20 bp, Artificial Sequence
  Description of Artificial Sequence: Synthetic oligonucleotide
  Target: SCN10A; (-) strand; PAM type: NRG; PAM sequence: CAG
atagtcgtttttaagatcct

SEQ ID NO: 19233 - DNA, 20 bp, Artificial Sequence
  Description of Artificial Sequence: Synthetic oligonucleotide
  Target: SCN10A; (-) strand; PAM type: NRG; PAM sequence: AAG
cctgagagatagtcgttttt

SEQ ID NO: 19234 - DNA, 20 bp, Artificial Sequence
  Description of Artificial Sequence: Synthetic oligonucleotide
  Target: SCN10A; (-) strand; PAM type: NRG; PAM sequence: TAG
ctcacaacaaccctgagaga

SEQ ID NO: 19235 - DNA, 20 bp, Artificial Sequence
  Description of Artificial Sequence: Synthetic oligonucleotide
  Target: SCN10A; (-) strand; PAM type: NRG; PAM sequence: GAG
tatgctcacaacaaccctga

SEQ ID NO: 19236 - DNA, 20 bp, Artificial Sequence
  Description of Artificial Sequence: Synthetic oligonucleotide
  Target: SCN10A; (-) strand; PAM type: NRG; PAM sequence: GAG
tttatgctcacaacaaccct

SEQ ID NO: 19237 - DNA, 20 bp, Artificial Sequence
  Description of Artificial Sequence: Synthetic oligonucleotide
  Target: SCN10A; (-) strand; PAM type: NRG; PAM sequence: TGG
caatgtgtcaggcatagcac

SEQ ID NO: 19238 - DNA, 20 bp, Artificial Sequence
  Description of Artificial Sequence: Synthetic oligonucleotide
  Target: SCN10A; (-) strand; PAM type: NRG; PAM sequence: TAG
cacttacaatgtgtcaggca

SEQ ID NO: 19239 - DNA, 20 bp, Artificial Sequence
  Description of Artificial Sequence: Synthetic oligonucleotide
  Target: SCN10A; (-) strand; PAM type: NRG; PAM sequence: AGG
ctgagcacttacaatgtgtc

SEQ ID NO: 19240 - DNA, 20 bp, Artificial Sequence
  Description of Artificial Sequence: Synthetic oligonucleotide
  Target: SCN10A; (-) strand; PAM type: NRG; PAM sequence: CAG
actgagcacttacaatgtgt

SEQ ID NO: 19241 - DNA, 20 bp, Artificial Sequence
  Description of Artificial Sequence: Synthetic oligonucleotide
  Target: SCN10A; (-) strand; PAM type: NRG; PAM sequence: GAG
cacagcagctaatacttact

SEQ ID NO: 19242 - DNA, 20 bp, Artificial Sequence
  Description of Artificial Sequence: Synthetic oligonucleotide
  Target: SCN10A; (-) strand; PAM type: NRG; PAM sequence: CAG
aataacagcaataatcacag

SEQ ID NO: 19243 - DNA, 20 bp, Artificial Sequence
  Description of Artificial Sequence: Synthetic oligonucleotide
  Target: SCN10A; (-) strand; PAM type: NRG; PAM sequence: CAG
aacaataacagcaataatca

SEQ ID NO: 19244 - DNA, 20 bp, Artificial Sequence
  Description of Artificial Sequence: Synthetic oligonucleotide
  Target: SCN10A; (-) strand; PAM type: NRG; PAM sequence: CAG
ctcttatcaaataacaataa

SEQ ID NO: 19245 - DNA, 20 bp, Artificial Sequence
  Description of Artificial Sequence: Synthetic oligonucleotide
  Target: SCN10A; (-) strand; PAM type: NRG; PAM sequence: AAG
tgcaccaagaggggacttcc

SEQ ID NO: 19246 - DNA, 20 bp, Artificial Sequence
  Description of Artificial Sequence: Synthetic oligonucleotide
  Target: SCN10A; (-) strand; PAM type: NRG; PAM sequence: GGG
tcccttatctgcaccaagag

SEQ ID NO: 19247 - DNA, 20 bp, Artificial Sequence
  Description of Artificial Sequence: Synthetic oligonucleotide
  Target: SCN10A; (-) strand; PAM type: NRG; PAM sequence: GGG
ctcccttatctgcaccaaga

SEQ ID NO: 19248 - DNA, 20 bp, Artificial Sequence
  Description of Artificial Sequence: Synthetic oligonucleotide
  Target: SCN10A; (-) strand; PAM type: NRG; PAM sequence: AGG
gctcccttatctgcaccaag

SEQ ID NO: 19249 - DNA, 20 bp, Artificial Sequence
  Description of Artificial Sequence: Synthetic oligonucleotide
  Target: SCN10A; (-) strand; PAM type: NRG; PAM sequence: GAG
ggctcccttatctgcaccaa

SEQ ID NO: 19250 - DNA, 20 bp, Artificial Sequence
  Description of Artificial Sequence: Synthetic oligonucleotide
  Target: SCN10A; (-) strand; PAM type: NRG; PAM sequence: AAG
ttggctcccttatctgcacc

SEQ ID NO: 19251 - DNA, 20 bp, Artificial Sequence
  Description of Artificial Sequence: Synthetic oligonucleotide
  Target: SCN10A; (-) strand; PAM type: NRG; PAM sequence: TGG
gccttctcctttctgggcct

SEQ ID NO: 19252 - DNA, 20 bp, Artificial Sequence
  Description of Artificial Sequence: Synthetic oligonucleotide
  Target: SCN10A; (-) strand; PAM type: NRG; PAM sequence: GGG
ggacatgccttctcctttct

SEQ ID NO: 19253 - DNA, 20 bp, Artificial Sequence
  Description of Artificial Sequence: Synthetic oligonucleotide
  Target: SCN10A; (-) strand; PAM type: NRG; PAM sequence: TGG
gggacatgccttctcctttc

SEQ ID NO: 19254 - DNA, 20 bp, Artificial Sequence
  Description of Artificial Sequence: Synthetic oligonucleotide
  Target: SCN10A; (-) strand; PAM type: NRG; PAM sequence: GGG
cttttcgctgactcagagtg

SEQ ID NO: 19255 - DNA, 20 bp, Artificial Sequence
  Description of Artificial Sequence: Synthetic oligonucleotide
  Target: SCN10A; (-) strand; PAM type: NRG; PAM sequence: GGG
gcttttcgctgactcagagt

SEQ ID NO: 19256 - DNA, 20 bp, Artificial Sequence
  Description of Artificial Sequence: Synthetic oligonucleotide
  Target: SCN10A; (-) strand; PAM type: NRG; PAM sequence: TGG
agcttttcgctgactcagag

SEQ ID NO: 19257 - DNA, 20 bp, Artificial Sequence
  Description of Artificial Sequence: Synthetic oligonucleotide
  Target: SCN10A; (-) strand; PAM type: NRG; PAM sequence: GAG
cccagcttttcgctgactca

SEQ ID NO: 19258 - DNA, 20 bp, Artificial Sequence
  Description of Artificial Sequence: Synthetic oligonucleotide
  Target: SCN10A; (-) strand; PAM type: NRG; PAM sequence: CAG
gccccagcttttcgctgact

SEQ ID NO: 19259 - DNA, 20 bp, Artificial Sequence
  Description of Artificial Sequence: Synthetic oligonucleotide
  Target: SCN10A; (-) strand; PAM type: NRG; PAM sequence: CAG
gagacttgggtctgtggccc

SEQ ID NO: 19260 - DNA, 20 bp, Artificial Sequence
  Description of Artificial Sequence: Synthetic oligonucleotide
  Target: SCN10A; (-) strand; PAM type: NRG; PAM sequence: TGG
cgactggagacttgggtctg

SEQ ID NO: 19261 - DNA, 20 bp, Artificial Sequence
  Description of Artificial Sequence: Synthetic oligonucleotide
  Target: SCN10A; (-) strand; PAM type: NRG; PAM sequence: GGG
tcctgggcgactggagactt

SEQ ID NO: 19262 - DNA, 20 bp, Artificial Sequence
  Description of Artificial Sequence: Synthetic oligonucleotide
  Target: SCN10A; (-) strand; PAM type: NRG; PAM sequence: TGG
ctcctgggcgactggagact

SEQ ID NO: 19263 - DNA, 20 bp, Artificial Sequence
  Description of Artificial Sequence: Synthetic oligonucleotide
  Target: SCN10A; (-) strand; PAM type: NRG; PAM sequence: GAG
gtctgactcctgggcgactg

SEQ ID NO: 19264 - DNA, 20 bp, Artificial Sequence
  Description of Artificial Sequence: Synthetic oligonucleotide
  Target: SCN10A; (-) strand; PAM type: NRG; PAM sequence: TGG
gggtctgactcctgggcgac

SEQ ID NO: 19265 - DNA, 20 bp, Artificial Sequence
  Description of Artificial Sequence: Synthetic oligonucleotide
  Target: SCN10A; (-) strand; PAM type: NRG; PAM sequence: GGG
gggagcagggtctgactcct

SEQ ID NO: 19266 - DNA, 20 bp, Artificial Sequence
  Description of Artificial Sequence: Synthetic oligonucleotide
  Target: SCN10A; (-) strand; PAM type: NRG; PAM sequence: TGG
agggagcagggtctgactcc

SEQ ID NO: 19267 - DNA, 20 bp, Artificial Sequence
  Description of Artificial Sequence: Synthetic oligonucleotide
  Target: SCN10A; (-) strand; PAM type: NRG; PAM sequence: GGG
tgtccttgtgggagggagca

SEQ ID NO: 19268 - DNA, 20 bp, Artificial Sequence
  Description of Artificial Sequence: Synthetic oligonucleotide
  Target: SCN10A; (-) strand; PAM type: NRG; PAM sequence: AGG
ctgtccttgtgggagggagc

SEQ ID NO: 19269 - DNA, 20 bp, Artificial Sequence
  Description of Artificial Sequence: Synthetic oligonucleotide
  Target: SCN10A; (-) strand; PAM type: NRG; PAM sequence: CAG
cctgtccttgtgggagggag

SEQ ID NO: 19270 - DNA, 20 bp, Artificial Sequence
  Description of Artificial Sequence: Synthetic oligonucleotide
  Target: SCN10A; (-) strand; PAM type: NRG; PAM sequence: GAG
tctcctgtccttgtgggagg

SEQ ID NO: 19271 - DNA, 20 bp, Artificial Sequence
  Description of Artificial Sequence: Synthetic oligonucleotide
  Target: SCN10A; (-) strand; PAM type: NRG; PAM sequence: GGG
cctctcctgtccttgtggga

SEQ ID NO: 19272 - DNA, 20 bp, Artificial Sequence
  Description of Artificial Sequence: Synthetic oligonucleotide
  Target: SCN10A; (-) strand; PAM type: NRG; PAM sequence: AGG
tcctctcctgtccttgtggg

SEQ ID NO: 19273 - DNA, 20 bp, Artificial Sequence
  Description of Artificial Sequence: Synthetic oligonucleotide
  Target: SCN10A; (-) strand; PAM type: NRG; PAM sequence: GAG
ttcctctcctgtccttgtgg

SEQ ID NO: 19274 - DNA, 20 bp, Artificial Sequence
  Description of Artificial Sequence: Synthetic oligonucleotide
  Target: SCN10A; (-) strand; PAM type: NRG; PAM sequence: GGG
ccttcctctcctgtccttgt

SEQ ID NO: 19275 - DNA, 20 bp, Artificial Sequence
  Description of Artificial Sequence: Synthetic oligonucleotide
  Target: SCN10A; (-) strand; PAM type: NRG; PAM sequence: TGG
cccttcctctcctgtccttg

SEQ ID NO: 19276 - DNA, 20 bp, Artificial Sequence
  Description of Artificial Sequence: Synthetic oligonucleotide
  Target: SCN10A; (-) strand; PAM type: NRG; PAM sequence: CAG
gctctggggactgcaccagc

SEQ ID NO: 19277 - DNA, 20 bp, Artificial Sequence
  Description of Artificial Sequence: Synthetic oligonucleotide
  Target: SCN10A; (-) strand; PAM type: NRG; PAM sequence: CAG
ctgtgctctggggactgcac

SEQ ID NO: 19278 - DNA, 20 bp, Artificial Sequence
  Description of Artificial Sequence: Synthetic oligonucleotide
  Target: SCN10A; (-) strand; PAM type: NRG; PAM sequence: GGG
agggaagacactgtgctctg

SEQ ID NO: 19279 - DNA, 20 bp, Artificial Sequence
  Description of Artificial Sequence: Synthetic oligonucleotide
  Target: SCN10A; (-) strand; PAM type: NRG; PAM sequence: GGG
cagggaagacactgtgctct

SEQ ID NO: 19280 - DNA, 20 bp, Artificial Sequence
  Description of Artificial Sequence: Synthetic oligonucleotide
  Target: SCN10A; (-) strand; PAM type: NRG; PAM sequence: TGG
tcagggaagacactgtgctc

SEQ ID NO: 19281 - DNA, 20 bp, Artificial Sequence
  Description of Artificial Sequence: Synthetic oligonucleotide
  Target: SCN10A; (-) strand; PAM type: NRG; PAM sequence: AAG
actcccacccagattcaggg

SEQ ID NO: 19282 - DNA, 20 bp, Artificial Sequence
  Description of Artificial Sequence: Synthetic oligonucleotide
  Target: SCN10A; (-) strand; PAM type: NRG; PAM sequence: GGG
gaaactcccacccagattca

SEQ ID NO: 19283 - DNA, 20 bp, Artificial Sequence
  Description of Artificial Sequence: Synthetic oligonucleotide
  Target: SCN10A; (-) strand; PAM type: NRG; PAM sequence: AGG
ggaaactcccacccagattc

SEQ ID NO: 19284 - DNA, 20 bp, Artificial Sequence
  Description of Artificial Sequence: Synthetic oligonucleotide
  Target: SCN10A; (-) strand; PAM type: NRG; PAM sequence: CAG
gggaaactcccacccagatt

SEQ ID NO: 19285 - DNA, 20 bp, Artificial Sequence
  Description of Artificial Sequence: Synthetic oligonucleotide
  Target: SCN10A; (-) strand; PAM type: NRG; PAM sequence: CAG
ggcttggggaaactcccacc

SEQ ID NO: 19286 - DNA, 20 bp, Artificial Sequence
  Description of Artificial Sequence: Synthetic oligonucleotide
  Target: SCN10A; (-) strand; PAM type: NRG; PAM sequence: GGG
gtttttctcttgatggcttg

SEQ ID NO: 19287 - DNA, 20 bp, Artificial Sequence
  Description of Artificial Sequence: Synthetic oligonucleotide
  Target: SCN10A; (-) strand; PAM type: NRG; PAM sequence: GGG
tgtttttctcttgatggctt

SEQ ID NO: 19288 - DNA, 20 bp, Artificial Sequence
  Description of Artificial Sequence: Synthetic oligonucleotide
  Target: SCN10A; (-) strand; PAM type: NRG; PAM sequence: TGG
atgtttttctcttgatggct

SEQ ID NO: 19289 - DNA, 20 bp, Artificial Sequence
  Description of Artificial Sequence: Synthetic oligonucleotide
  Target: SCN10A; (-) strand; PAM type: NRG; PAM sequence: TGG
tggtaatgtttttctcttga

SEQ ID NO: 19290 - DNA, 20 bp, Artificial Sequence
  Description of Artificial Sequence: Synthetic oligonucleotide
  Target: SCN10A; (-) strand; PAM type: NRG; PAM sequence: TGG
tgtgctgcggagcttccgct

SEQ ID NO: 19291 - DNA, 20 bp, Artificial Sequence
  Description of Artificial Sequence: Synthetic oligonucleotide
  Target: SCN10A; (-) strand; PAM type: NRG; PAM sequence: GAG
ggaagcctgtctgtgctgcg

SEQ ID NO: 19292 - DNA, 20 bp, Artificial Sequence
  Description of Artificial Sequence: Synthetic oligonucleotide
  Target: SCN10A; (-) strand; PAM type: NRG; PAM sequence: CGG
agggaagcctgtctgtgctg

SEQ ID NO: 19293 - DNA, 20 bp, Artificial Sequence
  Description of Artificial Sequence: Synthetic oligonucleotide
  Target: SCN10A; (-) strand; PAM type: NRG; PAM sequence: AAG
ctgggcgtggccaagaaggg

SEQ ID NO: 19294 - DNA, 20 bp, Artificial Sequence
  Description of Artificial Sequence: Synthetic oligonucleotide
  Target: SCN10A; (-) strand; PAM type: NRG; PAM sequence: GGG
gagctgggcgtggccaagaa

SEQ ID NO: 19295 - DNA, 20 bp, Artificial Sequence
  Description of Artificial Sequence: Synthetic oligonucleotide
  Target: SCN10A; (-) strand; PAM type: NRG; PAM sequence: AGG
agagctgggcgtggccaaga

SEQ ID NO: 19296 - DNA, 20 bp, Artificial Sequence
  Description of Artificial Sequence: Synthetic oligonucleotide
  Target: SCN10A; (-) strand; PAM type: NRG; PAM sequence: AAG
tagagctgggcgtggccaag

SEQ ID NO: 19297 - DNA, 20 bp, Artificial Sequence
  Description of Artificial Sequence: Synthetic oligonucleotide
  Target: SCN10A; (-) strand; PAM type: NRG; PAM sequence: AAG
tgctagagctgggcgtggcc

SEQ ID NO: 19298 - DNA, 20 bp, Artificial Sequence
  Description of Artificial Sequence: Synthetic oligonucleotide
  Target: SCN10A; (-) strand; PAM type: NRG; PAM sequence: TGG
gagtctgctagagctgggcg

SEQ ID NO: 19299 - DNA, 20 bp, Artificial Sequence
  Description of Artificial Sequence: Synthetic oligonucleotide
  Target: SCN10A; (-) strand; PAM type: NRG; PAM sequence: GGG
actgtgagtctgctagagct

SEQ ID NO: 19300 - DNA, 20 bp, Artificial Sequence
  Description of Artificial Sequence: Synthetic oligonucleotide
  Target: SCN10A; (-) strand; PAM type: NRG; PAM sequence: TGG
cactgtgagtctgctagagc

SEQ ID NO: 19301 - DNA, 20 bp, Artificial Sequence
  Description of Artificial Sequence: Synthetic oligonucleotide
  Target: SCN10A; (-) strand; PAM type: NRG; PAM sequence: GAG
tcgtcactgtgagtctgcta

SEQ ID NO: 19302 - DNA, 20 bp, Artificial Sequence
  Description of Artificial Sequence: Synthetic oligonucleotide
  Target: SCN10A; (-) strand; PAM type: NRG; PAM sequence: TAG
catcgtcactgtgagtctgc

SEQ ID NO: 19303 - DNA, 20 bp, Artificial Sequence
  Description of Artificial Sequence: Synthetic oligonucleotide
  Target: SCN10A; (-) strand; PAM type: NRG; PAM sequence: GAG
gactgcatcatcgtcactgt

SEQ ID NO: 19304 - DNA, 20 bp, Artificial Sequence
  Description of Artificial Sequence: Synthetic oligonucleotide
  Target: SCN10A; (-) strand; PAM type: NRG; PAM sequence: TGG
actattatttccagaagaag

SEQ ID NO: 19305 - DNA, 20 bp, Artificial Sequence
  Description of Artificial Sequence: Synthetic oligonucleotide
  Target: SCN10A; (-) strand; PAM type: NRG; PAM sequence: AAG
catactattatttccagaag

SEQ ID NO: 19306 - DNA, 20 bp, Artificial Sequence
  Description of Artificial Sequence: Synthetic oligonucleotide
  Target: SCN10A; (-) strand; PAM type: NRG; PAM sequence: AAG
acccatactattatttccag

SEQ ID NO: 19307 - DNA, 20 bp, Artificial Sequence
  Description of Artificial Sequence: Synthetic oligonucleotide
  Target: SCN10A; (-) strand; PAM type: NRG; PAM sequence: CAG
tcgacccatactattatttc

SEQ ID NO: 19308 - DNA, 20 bp, Artificial Sequence
  Description of Artificial Sequence: Synthetic oligonucleotide
  Target: SCN10A; (-) strand; PAM type: NRG; PAM sequence: TGG
catattttttactgctgaaa

SEQ ID NO: 19309 - DNA, 20 bp, Artificial Sequence
  Description of Artificial Sequence: Synthetic oligonucleotide
  Target: SCN10A; (-) strand; PAM type: NRG; PAM sequence: AGG
gaaagcttgtttccactcct

SEQ ID NO: 19310 - DNA, 20 bp, Artificial Sequence
  Description of Artificial Sequence: Synthetic oligonucleotide
  Target: SCN10A; (-) strand; PAM type: NRG; PAM sequence: TAG
tgaaagcttgtttccactcc

SEQ ID NO: 19311 - DNA, 20 bp, Artificial Sequence
  Description of Artificial Sequence: Synthetic oligonucleotide
  Target: SCN10A; (-) strand; PAM type: NRG; PAM sequence: AAG
cacagatcccactgtgatga

SEQ ID NO: 19312 - DNA, 20 bp, Artificial Sequence
  Description of Artificial Sequence: Synthetic oligonucleotide
  Target: SCN10A; (-) strand; PAM type: NRG; PAM sequence: CAG
tatcattgcctccgacccca

SEQ ID NO: 19313 - DNA, 20 bp, Artificial Sequence
  Description of Artificial Sequence: Synthetic oligonucleotide
  Target: SCN10A; (-) strand; PAM type: NRG; PAM sequence: AAG
ggattttctattttgtaaat

SEQ ID NO: 19314 - DNA, 20 bp, Artificial Sequence
  Description of Artificial Sequence: Synthetic oligonucleotide
  Target: SCN10A; (-) strand; PAM type: NRG; PAM sequence: AGG
tagcaactgaacaaaacaaa

SEQ ID NO: 19315 - DNA, 20 bp, Artificial Sequence
  Description of Artificial Sequence: Synthetic oligonucleotide
  Target: SCN10A; (-) strand; PAM type: NRG; PAM sequence: AAG
atagcaactgaacaaaacaa

SEQ ID NO: 19316 - DNA, 20 bp, Artificial Sequence
  Description of Artificial Sequence: Synthetic oligonucleotide
  Target: SCN10A; (-) strand; PAM type: NRG; PAM sequence: TAG
tcaggagcccacagataaca

SEQ ID NO: 19317 - DNA, 20 bp, Artificial Sequence
  Description of Artificial Sequence: Synthetic oligonucleotide
  Target: SCN10A; (-) strand; PAM type: NRG; PAM sequence: CAG
ggccaatcctcaggagccca

SEQ ID NO: 19318 - DNA, 20 bp, Artificial Sequence
  Description of Artificial Sequence: Synthetic oligonucleotide
  Target: SCN10A; (-) strand; PAM type: NRG; PAM sequence: GAG
ttaccctggccaatcctcag

SEQ ID NO: 19319 - DNA, 20 bp, Artificial Sequence
  Description of Artificial Sequence: Synthetic oligonucleotide
  Target: SCN10A; (-) strand; PAM type: NRG; PAM sequence: AGG
tgttaccctggccaatcctc

SEQ ID NO: 19320 - DNA, 20 bp, Artificial Sequence
  Description of Artificial Sequence: Synthetic oligonucleotide
  Target: SCN10A; (-) strand; PAM type: NRG; PAM sequence: CAG
ctgttaccctggccaatcct

SEQ ID NO: 19321 - DNA, 20 bp, Artificial Sequence
  Description of Artificial Sequence: Synthetic oligonucleotide
  Target: SCN10A; (-) strand; PAM type: NRG; PAM sequence: TGG
tgtcacgttgactgttaccc

SEQ ID NO: 19322 - DNA, 20 bp, Artificial Sequence
  Description of Artificial Sequence: Synthetic oligonucleotide
  Target: SCN10A; (-) strand; PAM type: NRG; PAM sequence: CAG
cacagcccctgagaatggtg

SEQ ID NO: 19323 - DNA, 20 bp, Artificial Sequence
  Description of Artificial Sequence: Synthetic oligonucleotide
  Target: SCN10A; (-) strand; PAM type: NRG; PAM sequence: TGG
gcatgcacagcccctgagaa

SEQ ID NO: 19324 - DNA, 20 bp, Artificial Sequence
  Description of Artificial Sequence: Synthetic oligonucleotide
  Target: SCN10A; (-) strand; PAM type: NRG; PAM sequence: GAG
ctgcagcatgcacagcccct

SEQ ID NO: 19325 - DNA, 20 bp, Artificial Sequence
  Description of Artificial Sequence: Synthetic oligonucleotide
  Target: SCN10A; (-) strand; PAM type: NRG; PAM sequence: CAG
tggaaaaactgcagcatgca

SEQ ID NO: 19326 - DNA, 20 bp, Artificial Sequence
  Description of Artificial Sequence: Synthetic oligonucleotide
  Target: SCN10A; (-) strand; PAM type: NRG; PAM sequence: CAG
ccattcacgtggaaaaactg

SEQ ID NO: 19327 - DNA, 20 bp, Artificial Sequence
  Description of Artificial Sequence: Synthetic oligonucleotide
  Target: SCN10A; (-) strand; PAM type: NRG; PAM sequence: TGG
cactcccaccaccattcacg

SEQ ID NO: 19328 - DNA, 20 bp, Artificial Sequence
  Description of Artificial Sequence: Synthetic oligonucleotide
  Target: SCN10A; (-) strand; PAM type: NRG; PAM sequence: AAG
atattataataatgatctta

SEQ ID NO: 19329 - DNA, 20 bp, Artificial Sequence
  Description of Artificial Sequence: Synthetic oligonucleotide
  Target: SCN10A; (-) strand; PAM type: NRG; PAM sequence: CAG
acacgttttaactactgaac

SEQ ID NO: 19330 - DNA, 20 bp, Artificial Sequence
  Description of Artificial Sequence: Synthetic oligonucleotide
  Target: SCN10A; (-) strand; PAM type: NRG; PAM sequence: AGG
ctgggctgggattttaatcc

SEQ ID NO: 19331 - DNA, 20 bp, Artificial Sequence
  Description of Artificial Sequence: Synthetic oligonucleotide
  Target: SCN10A; (-) strand; PAM type: NRG; PAM sequence: CAG
tctgggctgggattttaatc

SEQ ID NO: 19332 - DNA, 20 bp, Artificial Sequence
  Description of Artificial Sequence: Synthetic oligonucleotide
  Target: SCN10A; (-) strand; PAM type: NRG; PAM sequence: GGG
agctaggaaatgtctgggct

SEQ ID NO: 19333 - DNA, 20 bp, Artificial Sequence
  Description of Artificial Sequence: Synthetic oligonucleotide
  Target: SCN10A; (-) strand; PAM type: NRG; PAM sequence: TGG
aagctaggaaatgtctgggc

SEQ ID NO: 19334 - DNA, 20 bp, Artificial Sequence
  Description of Artificial Sequence: Synthetic oligonucleotide
  Target: SCN10A; (-) strand; PAM type: NRG; PAM sequence: GGG
acataagctaggaaatgtct

SEQ ID NO: 19335 - DNA, 20 bp, Artificial Sequence
  Description of Artificial Sequence: Synthetic oligonucleotide
  Target: SCN10A; (-) strand; PAM type: NRG; PAM sequence: TGG
tacataagctaggaaatgtc

SEQ ID NO: 19336 - DNA, 20 bp, Artificial Sequence
  Description of Artificial Sequence: Synthetic oligonucleotide
  Target: SCN10A; (-) strand; PAM type: NRG; PAM sequence: AGG
tgtccaagcttacataagct

SEQ ID NO: 19337 - DNA, 20 bp, Artificial Sequence
  Description of Artificial Sequence: Synthetic oligonucleotide
  Target: SCN10A; (-) strand; PAM type: NRG; PAM sequence: TAG
ttgtccaagcttacataagc

SEQ ID NO: 19338 - DNA, 20 bp, Artificial Sequence
  Description of Artificial Sequence: Synthetic oligonucleotide
  Target: SCN10A; (-) strand; PAM type: NRG; PAM sequence: AAG
ttatttgtccaagcttacat

SEQ ID NO: 19339 - DNA, 20 bp, Artificial Sequence
  Description of Artificial Sequence: Synthetic oligonucleotide
  Target: SCN10A; (-) strand; PAM type: NRG; PAM sequence: AAG
gaaggatgcattatttgtcc

SEQ ID NO: 19340 - DNA, 20 bp, Artificial Sequence
  Description of Artificial Sequence: Synthetic oligonucleotide
  Target: SCN10A; (-) strand; PAM type: NRG; PAM sequence: AGG
gaggaaattgaggtacagga

SEQ ID NO: 19341 - DNA, 20 bp, Artificial Sequence
  Description of Artificial Sequence: Synthetic oligonucleotide
  Target: SCN10A; (-) strand; PAM type: NRG; PAM sequence: AAG
tgaggaaattgaggtacagg

SEQ ID NO: 19342 - DNA, 20 bp, Artificial Sequence
  Description of Artificial Sequence: Synthetic oligonucleotide
  Target: SCN10A; (-) strand; PAM type: NRG; PAM sequence: AGG
agatgaggaaattgaggtac

SEQ ID NO: 19343 - DNA, 20 bp, Artificial Sequence
  Description of Artificial Sequence: Synthetic oligonucleotide
  Target: SCN10A; (-) strand; PAM type: NRG; PAM sequence: CAG
cagatgaggaaattgaggta

SEQ ID NO: 19344 - DNA, 20 bp, Artificial Sequence
  Description of Artificial Sequence: Synthetic oligonucleotide
  Target: SCN10A; (-) strand; PAM type: NRG; PAM sequence: AGG
ttatacagatgaggaaattg

SEQ ID NO: 19345 - DNA, 20 bp, Artificial Sequence
  Description of Artificial Sequence: Synthetic oligonucleotide
  Target: SCN10A; (-) strand; PAM type: NRG; PAM sequence: GAG
attatacagatgaggaaatt

SEQ ID NO: 19346 - DNA, 20 bp, Artificial Sequence
  Description of Artificial Sequence: Synthetic oligonucleotide
  Target: SCN10A; (-) strand; PAM type: NRG; PAM sequence: AGG
ttatgcccattatacagatg

SEQ ID NO: 19347 - DNA, 20 bp, Artificial Sequence
  Description of Artificial Sequence: Synthetic oligonucleotide
  Target: SCN10A; (-) strand; PAM type: NRG; PAM sequence: GAG
tttatgcccattatacagat

SEQ ID NO: 19348 - DNA, 20 bp, Artificial Sequence
  Description of Artificial Sequence: Synthetic oligonucleotide
  Target: SCN10A; (-) strand; PAM type: NRG; PAM sequence: CAG
ctcattttatgcccattata

SEQ ID NO: 19349 - DNA, 20 bp, Artificial Sequence
  Description of Artificial Sequence: Synthetic oligonucleotide
  Target: SCN10A; (-) strand; PAM type: NRG; PAM sequence: TGG
gttaagaactgcacatgcat

SEQ ID NO: 19350 - DNA, 20 bp, Artificial Sequence
  Description of Artificial Sequence: Synthetic oligonucleotide
  Target: SCN10A; (-) strand; PAM type: NRG; PAM sequence: AAG
tgtctgccaggccctttgtt

SEQ ID NO: 19351 - DNA, 20 bp, Artificial Sequence
  Description of Artificial Sequence: Synthetic oligonucleotide
  Target: SCN10A; (-) strand; PAM type: NRG; PAM sequence: AGG
tgaatgaattactgtctgcc

SEQ ID NO: 19352 - DNA, 20 bp, Artificial Sequence
  Description of Artificial Sequence: Synthetic oligonucleotide
  Target: SCN10A; (-) strand; PAM type: NRG; PAM sequence: CAG
atgaatgaattactgtctgc

SEQ ID NO: 19353 - DNA, 20 bp, Artificial Sequence
  Description of Artificial Sequence: Synthetic oligonucleotide
  Target: SCN10A; (-) strand; PAM type: NRG; PAM sequence: TAG
caatgaatcattgttcttac

SEQ ID NO: 19354 - DNA, 20 bp, Artificial Sequence
  Description of Artificial Sequence: Synthetic oligonucleotide
  Target: SCN10A; (-) strand; PAM type: NRG; PAM sequence: AGG
agagcctaaaagaatcttag

SEQ ID NO: 19355 - DNA, 20 bp, Artificial Sequence
  Description of Artificial Sequence: Synthetic oligonucleotide
  Target: SCN10A; (-) strand; PAM type: NRG; PAM sequence: GAG
cagagcctaaaagaatctta

SEQ ID NO: 19356 - DNA, 20 bp, Artificial Sequence
  Description of Artificial Sequence: Synthetic oligonucleotide
  Target: SCN10A; (-) strand; PAM type: NRG; PAM sequence: TAG
cacagagcctaaaagaatct

SEQ ID NO: 19357 - DNA, 20 bp, Artificial Sequence
  Description of Artificial Sequence: Synthetic oligonucleotide
  Target: SCN10A; (-) strand; PAM type: NRG; PAM sequence: AAG
tagagacacacagagcctaa

SEQ ID NO: 19358 - DNA, 20 bp, Artificial Sequence
  Description of Artificial Sequence: Synthetic oligonucleotide
  Target: SCN10A; (-) strand; PAM type: NRG; PAM sequence: GAG
aagacaattagagacacaca

SEQ ID NO: 19359 - DNA, 20 bp, Artificial Sequence
  Description of Artificial Sequence: Synthetic oligonucleotide
  Target: SCN10A; (-) strand; PAM type: NRG; PAM sequence: CAG
ttaagacaattagagacaca

SEQ ID NO: 19360 - DNA, 20 bp, Artificial Sequence
  Description of Artificial Sequence: Synthetic oligonucleotide
  Target: SCN10A; (-) strand; PAM type: NRG; PAM sequence: GAG
tgtcctatttaagacaatta

SEQ ID NO: 19361 - DNA, 20 bp, Artificial Sequence
  Description of Artificial Sequence: Synthetic oligonucleotide
  Target: SCN10A; (-) strand; PAM type: NRG; PAM sequence: TAG
tctgtcctatttaagacaat

SEQ ID NO: 19362 - DNA, 20 bp, Artificial Sequence
  Description of Artificial Sequence: Synthetic oligonucleotide
  Target: SCN10A; (-) strand; PAM type: NRG; PAM sequence: AAG
gtcagaattctgtcctattt

SEQ ID NO: 19363 - DNA, 20 bp, Artificial Sequence
  Description of Artificial Sequence: Synthetic oligonucleotide
  Target: SCN10A; (-) strand; PAM type: NRG; PAM sequence: CAG
gttctgacctctctcagtgt

SEQ ID NO: 19364 - DNA, 20 bp, Artificial Sequence
  Description of Artificial Sequence: Synthetic oligonucleotide
  Target: SCN10A; (-) strand; PAM type: NRG; PAM sequence: CAG
agcctggttctgacctctct

SEQ ID NO: 19365 - DNA, 20 bp, Artificial Sequence
  Description of Artificial Sequence: Synthetic oligonucleotide
  Target: SCN10A; (-) strand; PAM type: NRG; PAM sequence: TGG
gttgttgtgttacccgagcc

SEQ ID NO: 19366 - DNA, 20 bp, Artificial Sequence
  Description of Artificial Sequence: Synthetic oligonucleotide
  Target: SCN10A; (-) strand; PAM type: NRG; PAM sequence: GAG
tgctggttgttgtgttaccc

SEQ ID NO: 19367 - DNA, 20 bp, Artificial Sequence
  Description of Artificial Sequence: Synthetic oligonucleotide
  Target: SCN10A; (-) strand; PAM type: NRG; PAM sequence: TGG
tctctgtctcccttccctgc

SEQ ID NO: 19368 - DNA, 20 bp, Artificial Sequence
  Description of Artificial Sequence: Synthetic oligonucleotide
  Target: SCN10A; (-) strand; PAM type: NRG; PAM sequence: TGG
gaaggaaaagcacctgaccc

SEQ ID NO: 19369 - DNA, 20 bp, Artificial Sequence
  Description of Artificial Sequence: Synthetic oligonucleotide
  Target: SCN10A; (-) strand; PAM type: NRG; PAM sequence: AAG
gataaaaagatatgaaggaa

SEQ ID NO: 19370 - DNA, 20 bp, Artificial Sequence
  Description of Artificial Sequence: Synthetic oligonucleotide
  Target: SCN10A; (-) strand; PAM type: NRG; PAM sequence: AGG
gctcagataaaaagatatga

SEQ ID NO: 19371 - DNA, 20 bp, Artificial Sequence
  Description of Artificial Sequence: Synthetic oligonucleotide
  Target: SCN10A; (-) strand; PAM type: NRG; PAM sequence: AAG
ggctcagataaaaagatatg

SEQ ID NO: 19372 - DNA, 20 bp, Artificial Sequence
  Description of Artificial Sequence: Synthetic oligonucleotide
  Target: SCN10A; (-) strand; PAM type: NRG; PAM sequence: AAG
tggtgaggggctcagataaa

SEQ ID NO: 19373 - DNA, 20 bp, Artificial Sequence
  Description of Artificial Sequence: Synthetic oligonucleotide
  Target: SCN10A; (-) strand; PAM type: NRG; PAM sequence: CAG
tctcaggctggtgaggggct

SEQ ID NO: 19374 - DNA, 20 bp, Artificial Sequence
  Description of Artificial Sequence: Synthetic oligonucleotide
  Target: SCN10A; (-) strand; PAM type: NRG; PAM sequence: GGG
ctgtttctcaggctggtgag

SEQ ID NO: 19375 - DNA, 20 bp, Artificial Sequence
  Description of Artificial Sequence: Synthetic oligonucleotide
  Target: SCN10A; (-) strand; PAM type: NRG; PAM sequence: GGG
tctgtttctcaggctggtga

SEQ ID NO: 19376 - DNA, 20 bp, Artificial Sequence
  Description of Artificial Sequence: Synthetic oligonucleotide
  Target: SCN10A; (-) strand; PAM type: NRG; PAM sequence: AGG
gtctgtttctcaggctggtg

SEQ ID NO: 19377 - DNA, 20 bp, Artificial Sequence
  Description of Artificial Sequence: Synthetic oligonucleotide
  Target: SCN10A; (-) strand; PAM type: NRG; PAM sequence: GAG
tgtctgtttctcaggctggt

SEQ ID NO: 19378 - DNA, 20 bp, Artificial Sequence
  Description of Artificial Sequence: Synthetic oligonucleotide
  Target: SCN10A; (-) strand; PAM type: NRG; PAM sequence: TGG
gcattgtctgtttctcaggc

SEQ ID NO: 19379 - DNA, 20 bp, Artificial Sequence
  Description of Artificial Sequence: Synthetic oligonucleotide
  Target: SCN10A; (-) strand; PAM type: NRG; PAM sequence: AGG
ggatgcattgtctgtttctc

SEQ ID NO: 19380 - DNA, 20 bp, Artificial Sequence
  Description of Artificial Sequence: Synthetic oligonucleotide
  Target: SCN10A; (-) strand; PAM type: NRG; PAM sequence: CAG
aggatgcattgtctgtttct

SEQ ID NO: 19381 - DNA, 20 bp, Artificial Sequence
  Description of Artificial Sequence: Synthetic oligonucleotide
  Target: SCN10A; (-) strand; PAM type: NRG; PAM sequence: AGG
ctgttttcttctccataaga

SEQ ID NO: 19382 - DNA, 20 bp, Artificial Sequence
  Description of Artificial Sequence: Synthetic oligonucleotide
  Target: SCN10A; (-) strand; PAM type: NRG; PAM sequence: AAG
cctgttttcttctccataag

SEQ ID NO: 19383 - DNA, 20 bp, Artificial Sequence
  Description of Artificial Sequence: Synthetic oligonucleotide
  Target: SCN10A; (-) strand; PAM type: NRG; PAM sequence: AAG
cagcctgttttcttctccat

SEQ ID NO: 19384 - DNA, 20 bp, Artificial Sequence
  Description of Artificial Sequence: Synthetic oligonucleotide
  Target: SCN10A; (-) strand; PAM type: NRG; PAM sequence: CAG
gagaaagtcacttaaactct

SEQ ID NO: 19385 - DNA, 20 bp, Artificial Sequence
  Description of Artificial Sequence: Synthetic oligonucleotide
  Target: SCN10A; (-) strand; PAM type: NRG; PAM sequence: AAG
atcagtcttgtggcatgaga

SEQ ID NO: 19386 - DNA, 20 bp, Artificial Sequence
  Description of Artificial Sequence: Synthetic oligonucleotide
  Target: SCN10A; (-) strand; PAM type: NRG; PAM sequence: GAG
ttgaatcagtcttgtggcat

SEQ ID NO: 19387 - DNA, 20 bp, Artificial Sequence
  Description of Artificial Sequence: Synthetic oligonucleotide
  Target: SCN10A; (-) strand; PAM type: NRG; PAM sequence: TGG
tactctttgaatcagtcttg

SEQ ID NO: 19388 - DNA, 20 bp, Artificial Sequence
  Description of Artificial Sequence: Synthetic oligonucleotide
  Target: SCN10A; (-) strand; PAM type: NRG; PAM sequence: CAG
tccatagatactctttgaat

SEQ ID NO: 19389 - DNA, 20 bp, Artificial Sequence
  Description of Artificial Sequence: Synthetic oligonucleotide
  Target: SCN10A; (-) strand; PAM type: NRG; PAM sequence: TAG
tgcctacaagggacactcca

SEQ ID NO: 19390 - DNA, 20 bp, Artificial Sequence
  Description of Artificial Sequence: Synthetic oligonucleotide
  Target: SCN10A; (-) strand; PAM type: NRG; PAM sequence: GGG
ccacactgacttgcctacaa

SEQ ID NO: 19391 - DNA, 20 bp, Artificial Sequence
  Description of Artificial Sequence: Synthetic oligonucleotide
  Target: SCN10A; (-) strand; PAM type: NRG; PAM sequence: AGG
accacactgacttgcctaca

SEQ ID NO: 19392 - DNA, 20 bp, Artificial Sequence
  Description of Artificial Sequence: Synthetic oligonucleotide
  Target: SCN10A; (-) strand; PAM type: NRG; PAM sequence: AAG
caccacactgacttgcctac

SEQ ID NO: 19393 - DNA, 20 bp, Artificial Sequence
  Description of Artificial Sequence: Synthetic oligonucleotide
  Target: SCN10A; (-) strand; PAM type: NRG; PAM sequence: AAG
cccaggtctctggaagacac

SEQ ID NO: 19394 - DNA, 20 bp, Artificial Sequence
  Description of Artificial Sequence: Synthetic oligonucleotide
  Target: SCN10A; (-) strand; PAM type: NRG; PAM sequence: AAG
gggtggacccaggtctctgg

SEQ ID NO: 19395 - DNA, 20 bp, Artificial Sequence
  Description of Artificial Sequence: Synthetic oligonucleotide
  Target: SCN10A; (-) strand; PAM type: NRG; PAM sequence: TGG
ccagggtggacccaggtctc

SEQ ID NO: 19396 - DNA, 20 bp, Artificial Sequence
  Description of Artificial Sequence: Synthetic oligonucleotide
  Target: SCN10A; (-) strand; PAM type: NRG; PAM sequence: AGG
ggtggatccagggtggaccc

SEQ ID NO: 19397 - DNA, 20 bp, Artificial Sequence
  Description of Artificial Sequence: Synthetic oligonucleotide
  Target: SCN10A; (-) strand; PAM type: NRG; PAM sequence: CAG
gggtggatccagggtggacc

SEQ ID NO: 19398 - DNA, 20 bp, Artificial Sequence
  Description of Artificial Sequence: Synthetic oligonucleotide
  Target: SCN10A; (-) strand; PAM type: NRG; PAM sequence: TGG
tggtgagggtggatccaggg

SEQ ID NO: 19399 - DNA, 20 bp, Artificial Sequence
  Description of Artificial Sequence: Synthetic oligonucleotide
  Target: SCN10A; (-) strand; PAM type: NRG; PAM sequence: GGG
agctggtgagggtggatcca

SEQ ID NO: 19400 - DNA, 20 bp, Artificial Sequence
  Description of Artificial Sequence: Synthetic oligonucleotide
  Target: SCN10A; (-) strand; PAM type: NRG; PAM sequence: AGG
tagctggtgagggtggatcc

SEQ ID NO: 19401 - DNA, 20 bp, Artificial Sequence
  Description of Artificial Sequence: Synthetic oligonucleotide
  Target: SCN10A; (-) strand; PAM type: NRG; PAM sequence: CAG
atagctggtgagggtggatc

SEQ ID NO: 19402 - DNA, 20 bp, Artificial Sequence
  Description of Artificial Sequence: Synthetic oligonucleotide
  Target: SCN10A; (-) strand; PAM type: NRG; PAM sequence: TGG
aattgtatagctggtgaggg

SEQ ID NO: 19403 - DNA, 20 bp, Artificial Sequence
  Description of Artificial Sequence: Synthetic oligonucleotide
  Target: SCN10A; (-) strand; PAM type: NRG; PAM sequence: GGG
caaaattgtatagctggtga

SEQ ID NO: 19404 - DNA, 20 bp, Artificial Sequence
  Description of Artificial Sequence: Synthetic oligonucleotide
  Target: SCN10A; (-) strand; PAM type: NRG; PAM sequence: AGG
ccaaaattgtatagctggtg

SEQ ID NO: 19405 - DNA, 20 bp, Artificial Sequence
  Description of Artificial Sequence: Synthetic oligonucleotide
  Target: SCN10A; (-) strand; PAM type: NRG; PAM sequence: GAG
cccaaaattgtatagctggt

SEQ ID NO: 19406 - DNA, 20 bp, Artificial Sequence
  Description of Artificial Sequence: Synthetic oligonucleotide
  Target: SCN10A; (-) strand; PAM type: NRG; PAM sequence: TGG
cctgcccaaaattgtatagc

SEQ ID NO: 19407 - DNA, 20 bp, Artificial Sequence
  Description of Artificial Sequence: Synthetic oligonucleotide
  Target: SCN10A; (-) strand; PAM type: NRG; PAM sequence: TAG
atatcctgcccaaaattgta

SEQ ID NO: 19408 - DNA, 20 bp, Artificial Sequence
  Description of Artificial Sequence: Synthetic oligonucleotide
  Target: SCN10A; (-) strand; PAM type: NRG; PAM sequence: AGG
gagagcactaagactcagag

SEQ ID NO: 19409 - DNA, 20 bp, Artificial Sequence
  Description of Artificial Sequence: Synthetic oligonucleotide
  Target: SCN10A; (-) strand; PAM type: NRG; PAM sequence: GAG
agagagcactaagactcaga

SEQ ID NO: 19410 - DNA, 20 bp, Artificial Sequence
  Description of Artificial Sequence: Synthetic oligonucleotide
  Target: SCN10A; (-) strand; PAM type: NRG; PAM sequence: GAG
aaagagagcactaagactca

SEQ ID NO: 19411 - DNA, 20 bp, Artificial Sequence
  Description of Artificial Sequence: Synthetic oligonucleotide
  Target: SCN10A; (-) strand; PAM type: NRG; PAM sequence: CAG
caaaagagagcactaagact

SEQ ID NO: 19412 - DNA, 20 bp, Artificial Sequence
  Description of Artificial Sequence: Synthetic oligonucleotide
  Target: SCN10A; (-) strand; PAM type: NRG; PAM sequence: AAG
acatgacaaaagagagcact

SEQ ID NO: 19413 - DNA, 20 bp, Artificial Sequence
  Description of Artificial Sequence: Synthetic oligonucleotide
  Target: SCN10A; (-) strand; PAM type: NRG; PAM sequence: GAG
caccctcacatgacaaaaga

SEQ ID NO: 19414 - DNA, 20 bp, Artificial Sequence
  Description of Artificial Sequence: Synthetic oligonucleotide
  Target: SCN10A; (-) strand; PAM type: NRG; PAM sequence: GAG
atcaccctcacatgacaaaa

SEQ ID NO: 19415 - DNA, 20 bp, Artificial Sequence
  Description of Artificial Sequence: Synthetic oligonucleotide
  Target: SCN10A; (-) strand; PAM type: NRG; PAM sequence: AAG
acatcaccctcacatgacaa

SEQ ID NO: 19416 - DNA, 20 bp, Artificial Sequence
  Description of Artificial Sequence: Synthetic oligonucleotide
  Target: SCN10A; (-) strand; PAM type: NRG; PAM sequence: AGG
agtgtcacaacaacattatg

SEQ ID NO: 19417 - DNA, 20 bp, Artificial Sequence
  Description of Artificial Sequence: Synthetic oligonucleotide
  Target: SCN10A; (-) strand; PAM type: NRG; PAM sequence: GAG
cagtgtcacaacaacattat

SEQ ID NO: 19418 - DNA, 20 bp, Artificial Sequence
  Description of Artificial Sequence: Synthetic oligonucleotide
  Target: SCN10A; (-) strand; PAM type: NRG; PAM sequence: CAG
gtgctttatgaatgttattt

SEQ ID NO: 19419 - DNA, 20 bp, Artificial Sequence
  Description of Artificial Sequence: Synthetic oligonucleotide
  Target: SCN10A; (-) strand; PAM type: NRG; PAM sequence: AGG
cttggtgcctgcaatgagtc

SEQ ID NO: 19420 - DNA, 20 bp, Artificial Sequence
  Description of Artificial Sequence: Synthetic oligonucleotide
  Target: SCN10A; (-) strand; PAM type: NRG; PAM sequence: CAG
gcttggtgcctgcaatgagt

SEQ ID NO: 19421 - DNA, 20 bp, Artificial Sequence
  Description of Artificial Sequence: Synthetic oligonucleotide
  Target: SCN10A; (-) strand; PAM type: NRG; PAM sequence: GAG
atgtgcttggtgcctgcaat

SEQ ID NO: 19422 - DNA, 20 bp, Artificial Sequence
  Description of Artificial Sequence: Synthetic oligonucleotide
  Target: SCN10A; (-) strand; PAM type: NRG; PAM sequence: TGG
aagcaagaaagtcatgtgct

SEQ ID NO: 19423 - DNA, 20 bp, Artificial Sequence
  Description of Artificial Sequence: Synthetic oligonucleotide
  Target: SCN10A; (-) strand; PAM type: NRG; PAM sequence: AAG
gccacttttttaaagcaaga

SEQ ID NO: 19424 - DNA, 20 bp, Artificial Sequence
  Description of Artificial Sequence: Synthetic oligonucleotide
  Target: SCN10A; (-) strand; PAM type: NRG; PAM sequence: AAG
aagtgccacttttttaaagc

SEQ ID NO: 19425 - DNA, 20 bp, Artificial Sequence
  Description of Artificial Sequence: Synthetic oligonucleotide
  Target: SCN10A; (-) strand; PAM type: NRG; PAM sequence: AAG
aggaaagtgccactttttta

SEQ ID NO: 19426 - DNA, 20 bp, Artificial Sequence
  Description of Artificial Sequence: Synthetic oligonucleotide
  Target: SCN10A; (-) strand; PAM type: NRG; PAM sequence: AAG
tttcccacagtgtcagagga

SEQ ID NO: 19427 - DNA, 20 bp, Artificial Sequence
  Description of Artificial Sequence: Synthetic oligonucleotide
  Target: SCN10A; (-) strand; PAM type: NRG; PAM sequence: AGG
ggcctttcccacagtgtcag

SEQ ID NO: 19428 - DNA, 20 bp, Artificial Sequence
  Description of Artificial Sequence: Synthetic oligonucleotide
  Target: SCN10A; (-) strand; PAM type: NRG; PAM sequence: GAG
aggcctttcccacagtgtca

SEQ ID NO: 19429 - DNA, 20 bp, Artificial Sequence
  Description of Artificial Sequence: Synthetic oligonucleotide
  Target: SCN10A; (-) strand; PAM type: NRG; PAM sequence: CAG
aaaggcctttcccacagtgt

SEQ ID NO: 19430 - DNA, 20 bp, Artificial Sequence
  Description of Artificial Sequence: Synthetic oligonucleotide
  Target: SCN10A; (-) strand; PAM type: NRG; PAM sequence: CAG
gagagaaaaggcctttccca

SEQ ID NO: 19431 - DNA, 20 bp, Artificial Sequence
  Description of Artificial Sequence: Synthetic oligonucleotide
  Target: SCN10A; (-) strand; PAM type: NRG; PAM sequence: AGG
gtggaagcaagagagagaaa

SEQ ID NO: 19432 - DNA, 20 bp, Artificial Sequence
  Description of Artificial Sequence: Synthetic oligonucleotide
  Target: SCN10A; (-) strand; PAM type: NRG; PAM sequence: AAG
agtggaagcaagagagagaa

SEQ ID NO: 19433 - DNA, 20 bp, Artificial Sequence
  Description of Artificial Sequence: Synthetic oligonucleotide
  Target: SCN10A; (-) strand; PAM type: NRG; PAM sequence: GAG
agaaaagtggaagcaagaga

SEQ ID NO: 19434 - DNA, 20 bp, Artificial Sequence
  Description of Artificial Sequence: Synthetic oligonucleotide
  Target: SCN10A; (-) strand; PAM type: NRG; PAM sequence: GAG
ttagaaaagtggaagcaaga

SEQ ID NO: 19435 - DNA, 20 bp, Artificial Sequence
  Description of Artificial Sequence: Synthetic oligonucleotide
  Target: SCN10A; (-) strand; PAM type: NRG; PAM sequence: GAG
agttagaaaagtggaagcaa

SEQ ID NO: 19436 - DNA, 20 bp, Artificial Sequence
  Description of Artificial Sequence: Synthetic oligonucleotide
  Target: SCN10A; (-) strand; PAM type: NRG; PAM sequence: AAG
acagttagaaaagtggaagc

SEQ ID NO: 19437 - DNA, 20 bp, Artificial Sequence
  Description of Artificial Sequence: Synthetic oligonucleotide
  Target: SCN10A; (-) strand; PAM type: NRG; PAM sequence: AAG
ttctacagttagaaaagtgg

SEQ ID NO: 19438 - DNA, 20 bp, Artificial Sequence
  Description of Artificial Sequence: Synthetic oligonucleotide
  Target: SCN10A; (-) strand; PAM type: NRG; PAM sequence: TGG
tcattctacagttagaaaag

SEQ ID NO: 19439 - DNA, 20 bp, Artificial Sequence
  Description of Artificial Sequence: Synthetic oligonucleotide
  Target: SCN10A; (-) strand; PAM type: NRG; PAM sequence: AAG
ccctcattctacagttagaa

SEQ ID NO: 19440 - DNA, 20 bp, Artificial Sequence
  Description of Artificial Sequence: Synthetic oligonucleotide
  Target: SCN10A; (-) strand; PAM type: NRG; PAM sequence: TAG
ccacaccctcattctacagt

SEQ ID NO: 19441 - DNA, 20 bp, Artificial Sequence
  Description of Artificial Sequence: Synthetic oligonucleotide
  Target: SCN10A; (-) strand; PAM type: NRG; PAM sequence: CAG
gagcccacaccctcattcta

SEQ ID NO: 19442 - DNA, 20 bp, Artificial Sequence
  Description of Artificial Sequence: Synthetic oligonucleotide
  Target: SCN10A; (-) strand; PAM type: NRG; PAM sequence: GAG
gccttatggaatagacattt

SEQ ID NO: 19443 - DNA, 20 bp, Artificial Sequence
  Description of Artificial Sequence: Synthetic oligonucleotide
  Target: SCN10A; (-) strand; PAM type: NRG; PAM sequence: TAG
ccacagagggccttatggaa

SEQ ID NO: 19444 - DNA, 20 bp, Artificial Sequence
  Description of Artificial Sequence: Synthetic oligonucleotide
  Target: SCN10A; (-) strand; PAM type: NRG; PAM sequence: TGG
taagaccacagagggcctta

SEQ ID NO: 19445 - DNA, 20 bp, Artificial Sequence
  Description of Artificial Sequence: Synthetic oligonucleotide
  Target: SCN10A; (-) strand; PAM type: NRG; PAM sequence: GGG
agtcagcctaagaccacaga

SEQ ID NO: 19446 - DNA, 20 bp, Artificial Sequence
  Description of Artificial Sequence: Synthetic oligonucleotide
  Target: SCN10A; (-) strand; PAM type: NRG; PAM sequence: AGG
aagtcagcctaagaccacag

SEQ ID NO: 19447 - DNA, 20 bp, Artificial Sequence
  Description of Artificial Sequence: Synthetic oligonucleotide
  Target: SCN10A; (-) strand; PAM type: NRG; PAM sequence: GAG
gaagtcagcctaagaccaca

SEQ ID NO: 19448 - DNA, 20 bp, Artificial Sequence
  Description of Artificial Sequence: Synthetic oligonucleotide
  Target: SCN10A; (-) strand; PAM type: NRG; PAM sequence: CAG
aagaagtcagcctaagacca

SEQ ID NO: 19449 - DNA, 20 bp, Artificial Sequence
  Description of Artificial Sequence: Synthetic oligonucleotide
  Target: SCN10A; (-) strand; PAM type: NRG; PAM sequence: AAG
tattcccaagaagtcagcct

SEQ ID NO: 19450 - DNA, 20 bp, Artificial Sequence
  Description of Artificial Sequence: Synthetic oligonucleotide
  Target: SCN10A; (-) strand; PAM type: NRG; PAM sequence: CAG
aatgcttattcccaagaagt

SEQ ID NO: 19451 - DNA, 20 bp, Artificial Sequence
  Description of Artificial Sequence: Synthetic oligonucleotide
  Target: SCN10A; (-) strand; PAM type: NRG; PAM sequence: AAG
agagaatgcttattcccaag

SEQ ID NO: 19452 - DNA, 20 bp, Artificial Sequence
  Description of Artificial Sequence: Synthetic oligonucleotide
  Target: SCN10A; (-) strand; PAM type: NRG; PAM sequence: AAG
agaagagaatgcttattccc

SEQ ID NO: 19453 - DNA, 20 bp, Artificial Sequence
  Description of Artificial Sequence: Synthetic oligonucleotide
  Target: SCN10A; (-) strand; PAM type: NRG; PAM sequence: GAG
aaggaaaaatggaaagagaa

SEQ ID NO: 19454 - DNA, 20 bp, Artificial Sequence
  Description of Artificial Sequence: Synthetic oligonucleotide
  Target: SCN10A; (-) strand; PAM type: NRG; PAM sequence: AAG
aaaaggaaaaatggaaagag

SEQ ID NO: 19455 - DNA, 20 bp, Artificial Sequence
  Description of Artificial Sequence: Synthetic oligonucleotide
  Target: SCN10A; (-) strand; PAM type: NRG; PAM sequence: GAG
atgaaaaggaaaaatggaaa

SEQ ID NO: 19456 - DNA, 20 bp, Artificial Sequence
  Description of Artificial Sequence: Synthetic oligonucleotide
  Target: SCN10A; (-) strand; PAM type: NRG; PAM sequence: AAG
atatgaaaaggaaaaatgga

SEQ ID NO: 19457 - DNA, 20 bp, Artificial Sequence
  Description of Artificial Sequence: Synthetic oligonucleotide
  Target: SCN10A; (-) strand; PAM type: NRG; PAM sequence: TGG
gttgatatgaaaaggaaaaa

SEQ ID NO: 19458 - DNA, 20 bp, Artificial Sequence
  Description of Artificial Sequence: Synthetic oligonucleotide
  Target: SCN10A; (-) strand; PAM type: NRG; PAM sequence: AGG
atcctaaagttgatatgaaa

SEQ ID NO: 19459 - DNA, 20 bp, Artificial Sequence
  Description of Artificial Sequence: Synthetic oligonucleotide
  Target: SCN10A; (-) strand; PAM type: NRG; PAM sequence: AAG
catcctaaagttgatatgaa

SEQ ID NO: 19460 - DNA, 20 bp, Artificial Sequence
  Description of Artificial Sequence: Synthetic oligonucleotide
  Target: SCN10A; (-) strand; PAM type: NRG; PAM sequence: AAG
taggctgaggtcacatccta

SEQ ID NO: 19461 - DNA, 20 bp, Artificial Sequence
  Description of Artificial Sequence: Synthetic oligonucleotide
  Target: SCN10A; (-) strand; PAM type: NRG; PAM sequence: AGG
ttttggcagcacctaggctg

SEQ ID NO: 19462 - DNA, 20 bp, Artificial Sequence
  Description of Artificial Sequence: Synthetic oligonucleotide
  Target: SCN10A; (-) strand; PAM type: NRG; PAM sequence: GAG
gttttggcagcacctaggct

SEQ ID NO: 19463 - DNA, 20 bp, Artificial Sequence
  Description of Artificial Sequence: Synthetic oligonucleotide
  Target: SCN10A; (-) strand; PAM type: NRG; PAM sequence: AGG
ctcatgttttggcagcacct

SEQ ID NO: 19464 - DNA, 20 bp, Artificial Sequence
  Description of Artificial Sequence: Synthetic oligonucleotide
  Target: SCN10A; (-) strand; PAM type: NRG; PAM sequence: TAG
cctcatgttttggcagcacc

SEQ ID NO: 19465 - DNA, 20 bp, Artificial Sequence
  Description of Artificial Sequence: Synthetic oligonucleotide
  Target: SCN10A; (-) strand; PAM type: NRG; PAM sequence: CAG
cagcatgcctcatgttttgg

SEQ ID NO: 19466 - DNA, 20 bp, Artificial Sequence
  Description of Artificial Sequence: Synthetic oligonucleotide
  Target: SCN10A; (-) strand; PAM type: NRG; PAM sequence: TGG
aatcagcatgcctcatgttt

SEQ ID NO: 19467 - DNA, 20 bp, Artificial Sequence
  Description of Artificial Sequence: Synthetic oligonucleotide
  Target: SCN10A; (-) strand; PAM type: NRG; PAM sequence: CAG
gttctggaacatggtggaat

SEQ ID NO: 19468 - DNA, 20 bp, Artificial Sequence
  Description of Artificial Sequence: Synthetic oligonucleotide
  Target: SCN10A; (-) strand; PAM type: NRG; PAM sequence: TGG
cagtaggttctggaacatgg

SEQ ID NO: 19469 - DNA, 20 bp, Artificial Sequence
  Description of Artificial Sequence: Synthetic oligonucleotide
  Target: SCN10A; (-) strand; PAM type: NRG; PAM sequence: TGG
cagcagtaggttctggaaca

SEQ ID NO: 19470 - DNA, 20 bp, Artificial Sequence
  Description of Artificial Sequence: Synthetic oligonucleotide
  Target: SCN10A; (-) strand; PAM type: NRG; PAM sequence: TGG
aaaggggcagcagtaggttc

SEQ ID NO: 19471 - DNA, 20 bp, Artificial Sequence
  Description of Artificial Sequence: Synthetic oligonucleotide
  Target: SCN10A; (-) strand; PAM type: NRG; PAM sequence: AGG
gctgtgaaaggggcagcagt

SEQ ID NO: 19472 - DNA, 20 bp, Artificial Sequence
  Description of Artificial Sequence: Synthetic oligonucleotide
  Target: SCN10A; (-) strand; PAM type: NRG; PAM sequence: TAG
ggctgtgaaaggggcagcag

SEQ ID NO: 19473 - DNA, 20 bp, Artificial Sequence
  Description of Artificial Sequence: Synthetic oligonucleotide
  Target: SCN10A; (-) strand; PAM type: NRG; PAM sequence: CAG
cagggctgtgaaaggggcag

SEQ ID NO: 19474 - DNA, 20 bp, Artificial Sequence
  Description of Artificial Sequence: Synthetic oligonucleotide
  Target: SCN10A; (-) strand; PAM type: NRG; PAM sequence: CAG
atccagggctgtgaaagggg

SEQ ID NO: 19475 - DNA, 20 bp, Artificial Sequence
  Description of Artificial Sequence: Synthetic oligonucleotide
  Target: SCN10A; (-) strand; PAM type: NRG; PAM sequence: GGG
ataatccagggctgtgaaag

SEQ ID NO: 19476 - DNA, 20 bp, Artificial Sequence
  Description of Artificial Sequence: Synthetic oligonucleotide
  Target: SCN10A; (-) strand; PAM type: NRG; PAM sequence: GGG
cataatccagggctgtgaaa

SEQ ID NO: 19477 - DNA, 20 bp, Artificial Sequence
  Description of Artificial Sequence: Synthetic oligonucleotide
  Target: SCN10A; (-) strand; PAM type: NRG; PAM sequence: AGG
ccataatccagggctgtgaa

SEQ ID NO: 19478 - DNA, 20 bp, Artificial Sequence
  Description of Artificial Sequence: Synthetic oligonucleotide
  Target: SCN10A; (-) strand; PAM type: NRG; PAM sequence: AAG
gccataatccagggctgtga

SEQ ID NO: 19479 - DNA, 20 bp, Artificial Sequence
  Description of Artificial Sequence: Synthetic oligonucleotide
  Target: SCN10A; (-) strand; PAM type: NRG; PAM sequence: GGG
actccctccgccataatcca

SEQ ID NO: 19480 - DNA, 20 bp, Artificial Sequence
  Description of Artificial Sequence: Synthetic oligonucleotide
  Target: SCN10A; (-) strand; PAM type: NRG; PAM sequence: AGG
cactccctccgccataatcc

SEQ ID NO: 19481 - DNA, 20 bp, Artificial Sequence
  Description of Artificial Sequence: Synthetic oligonucleotide
  Target: SCN10A; (-) strand; PAM type: NRG; PAM sequence: CAG
ccactccctccgccataatc

SEQ ID NO: 19482 - DNA, 20 bp, Artificial Sequence
  Description of Artificial Sequence: Synthetic oligonucleotide
  Target: SCN10A; (-) strand; PAM type: NRG; PAM sequence: TAG
gaaatgtgactacttgtccc

SEQ ID NO: 19483 - DNA, 20 bp, Artificial Sequence
  Description of Artificial Sequence: Synthetic oligonucleotide
  Target: SCN10A; (-) strand; PAM type: NRG; PAM sequence: AGG
ggtggagggggaaggcccag

SEQ ID NO: 19484 - DNA, 20 bp, Artificial Sequence
  Description of Artificial Sequence: Synthetic oligonucleotide
  Target: SCN10A; (-) strand; PAM type: NRG; PAM sequence: GAG
aggtggagggggaaggccca

SEQ ID NO: 19485 - DNA, 20 bp, Artificial Sequence
  Description of Artificial Sequence: Synthetic oligonucleotide
  Target: SCN10A; (-) strand; PAM type: NRG; PAM sequence: CAG
ttaggtggagggggaaggcc

SEQ ID NO: 19486 - DNA, 20 bp, Artificial Sequence
  Description of Artificial Sequence: Synthetic oligonucleotide
  Target: SCN10A; (-) strand; PAM type: NRG; PAM sequence: AGG
cagacttaggtggaggggga

SEQ ID NO: 19487 - DNA, 20 bp, Artificial Sequence
  Description of Artificial Sequence: Synthetic oligonucleotide
  Target: SCN10A; (-) strand; PAM type: NRG; PAM sequence: AAG
gcagacttaggtggaggggg

SEQ ID NO: 19488 - DNA, 20 bp, Artificial Sequence
  Description of Artificial Sequence: Synthetic oligonucleotide
  Target: SCN10A; (-) strand; PAM type: NRG; PAM sequence: GGG
gctgcagacttaggtggagg

SEQ ID NO: 19489 - DNA, 20 bp, Artificial Sequence
  Description of Artificial Sequence: Synthetic oligonucleotide
  Target: SCN10A; (-) strand; PAM type: NRG; PAM sequence: GGG
ggctgcagacttaggtggag

SEQ ID NO: 19490 - DNA, 20 bp, Artificial Sequence
  Description of Artificial Sequence: Synthetic oligonucleotide
  Target: SCN10A; (-) strand; PAM type: NRG; PAM sequence: GGG
aggctgcagacttaggtgga

SEQ ID NO: 19491 - DNA, 20 bp, Artificial Sequence
  Description of Artificial Sequence: Synthetic oligonucleotide
  Target: SCN10A; (-) strand; PAM type: NRG; PAM sequence: AGG
taggctgcagacttaggtgg

SEQ ID NO: 19492 - DNA, 20 bp, Artificial Sequence
  Description of Artificial Sequence: Synthetic oligonucleotide
  Target: SCN10A; (-) strand; PAM type: NRG; PAM sequence: GAG
ataggctgcagacttaggtg

SEQ ID NO: 19493 - DNA, 20 bp, Artificial Sequence
  Description of Artificial Sequence: Synthetic oligonucleotide
  Target: SCN10A; (-) strand; PAM type: NRG; PAM sequence: TGG
ttataggctgcagacttagg

SEQ ID NO: 19494 - DNA, 20 bp, Artificial Sequence
  Description of Artificial Sequence: Synthetic oligonucleotide
  Target: SCN10A; (-) strand; PAM type: NRG; PAM sequence: AGG
ttcttataggctgcagactt

SEQ ID NO: 19495 - DNA, 20 bp, Artificial Sequence
  Description of Artificial Sequence: Synthetic oligonucleotide
  Target: SCN10A; (-) strand; PAM type: NRG; PAM sequence: TAG
cttcttataggctgcagact

SEQ ID NO: 19496 - DNA, 20 bp, Artificial Sequence
  Description of Artificial Sequence: Synthetic oligonucleotide
  Target: SCN10A; (-) strand; PAM type: NRG; PAM sequence: CAG
gtccagcttcttataggctg

SEQ ID NO: 19497 - DNA, 20 bp, Artificial Sequence
  Description of Artificial Sequence: Synthetic oligonucleotide
  Target: SCN10A; (-) strand; PAM type: NRG; PAM sequence: AGG
tttggggtccagcttcttat

SEQ ID NO: 19498 - DNA, 20 bp, Artificial Sequence
  Description of Artificial Sequence: Synthetic oligonucleotide
  Target: SCN10A; (-) strand; PAM type: NRG; PAM sequence: TAG
ctttggggtccagcttctta

SEQ ID NO: 19499 - DNA, 20 bp, Artificial Sequence
  Description of Artificial Sequence: Synthetic oligonucleotide
  Target: SCN10A; (-) strand; PAM type: NRG; PAM sequence: CAG
aactgtctggctttggggtc

SEQ ID NO: 19500 - DNA, 20 bp, Artificial Sequence
  Description of Artificial Sequence: Synthetic oligonucleotide
  Target: SCN10A; (-) strand; PAM type: NRG; PAM sequence: GGG
accagaactgtctggctttg

SEQ ID NO: 19501 - DNA, 20 bp, Artificial Sequence
  Description of Artificial Sequence: Synthetic oligonucleotide
  Target: SCN10A; (-) strand; PAM type: NRG; PAM sequence: GGG
caccagaactgtctggcttt

SEQ ID NO: 19502 - DNA, 20 bp, Artificial Sequence
  Description of Artificial Sequence: Synthetic oligonucleotide
  Target: SCN10A; (-) strand; PAM type: NRG; PAM sequence: TGG
tcaccagaactgtctggctt

SEQ ID NO: 19503 - DNA, 20 bp, Artificial Sequence
  Description of Artificial Sequence: Synthetic oligonucleotide
  Target: SCN10A; (-) strand; PAM type: NRG; PAM sequence: TGG
ctggattcaccagaactgtc

SEQ ID NO: 19504 - DNA, 20 bp, Artificial Sequence
  Description of Artificial Sequence: Synthetic oligonucleotide
  Target: SCN10A; (-) strand; PAM type: NRG; PAM sequence: CAG
aggtgacctactggattcac

SEQ ID NO: 19505 - DNA, 20 bp, Artificial Sequence
  Description of Artificial Sequence: Synthetic oligonucleotide
  Target: SCN10A; (-) strand; PAM type: NRG; PAM sequence: TGG
ccaagctggaggtgacctac

SEQ ID NO: 19506 - DNA, 20 bp, Artificial Sequence
  Description of Artificial Sequence: Synthetic oligonucleotide
  Target: SCN10A; (-) strand; PAM type: NRG; PAM sequence: AGG
agcagggtccaccaagctgg

SEQ ID NO: 19507 - DNA, 20 bp, Artificial Sequence
  Description of Artificial Sequence: Synthetic oligonucleotide
  Target: SCN10A; (-) strand; PAM type: NRG; PAM sequence: GAG
cagcagggtccaccaagctg

SEQ ID NO: 19508 - DNA, 20 bp, Artificial Sequence
  Description of Artificial Sequence: Synthetic oligonucleotide
  Target: SCN10A; (-) strand; PAM type: NRG; PAM sequence: TGG
cgcagcagggtccaccaagc

SEQ ID NO: 19509 - DNA, 20 bp, Artificial Sequence
  Description of Artificial Sequence: Synthetic oligonucleotide
  Target: SCN10A; (-) strand; PAM type: NRG; PAM sequence: AAG
tgtccgcagcagggtccacc

SEQ ID NO: 19510 - DNA, 20 bp, Artificial Sequence
  Description of Artificial Sequence: Synthetic oligonucleotide
  Target: SCN10A; (-) strand; PAM type: NRG; PAM sequence: GGG
ctgccttcatgtccgcagca

SEQ ID NO: 19511 - DNA, 20 bp, Artificial Sequence
  Description of Artificial Sequence: Synthetic oligonucleotide
  Target: SCN10A; (-) strand; PAM type: NRG; PAM sequence: AGG
cctgccttcatgtccgcagc

SEQ ID NO: 19512 - DNA, 20 bp, Artificial Sequence
  Description of Artificial Sequence: Synthetic oligonucleotide
  Target: SCN10A; (-) strand; PAM type: NRG; PAM sequence: CAG
tcctgccttcatgtccgcag

SEQ ID NO: 19513 - DNA, 20 bp, Artificial Sequence
  Description of Artificial Sequence: Synthetic oligonucleotide
  Target: SCN10A; (-) strand; PAM type: NRG; PAM sequence: CAG
gcatcctgccttcatgtccg

SEQ ID NO: 19514 - DNA, 20 bp, Artificial Sequence
  Description of Artificial Sequence: Synthetic oligonucleotide
  Target: SCN10A; (-) strand; PAM type: NRG; PAM sequence: CAG
aggcagaagctagaaagggt

SEQ ID NO: 19515 - DNA, 20 bp, Artificial Sequence
  Description of Artificial Sequence: Synthetic oligonucleotide
  Target: SCN10A; (-) strand; PAM type: NRG; PAM sequence: GGG
tgataggcagaagctagaaa

SEQ ID NO: 19516 - DNA, 20 bp, Artificial Sequence
  Description of Artificial Sequence: Synthetic oligonucleotide
  Target: SCN10A; (-) strand; PAM type: NRG; PAM sequence: AGG
atgataggcagaagctagaa

SEQ ID NO: 19517 - DNA, 20 bp, Artificial Sequence
  Description of Artificial Sequence: Synthetic oligonucleotide
  Target: SCN10A; (-) strand; PAM type: NRG; PAM sequence: AAG
catgataggcagaagctaga

SEQ ID NO: 19518 - DNA, 20 bp, Artificial Sequence
  Description of Artificial Sequence: Synthetic oligonucleotide
  Target: SCN10A; (-) strand; PAM type: NRG; PAM sequence: TAG
cacacatgataggcagaagc

SEQ ID NO: 19519 - DNA, 20 bp, Artificial Sequence
  Description of Artificial Sequence: Synthetic oligonucleotide
  Target: SCN10A; (-) strand; PAM type: NRG; PAM sequence: AAG
cacgcacacatgataggcag

SEQ ID NO: 19520 - DNA, 20 bp, Artificial Sequence
  Description of Artificial Sequence: Synthetic oligonucleotide
  Target: SCN10A; (-) strand; PAM type: NRG; PAM sequence: CAG
acacacgcacacatgatagg

SEQ ID NO: 19521 - DNA, 20 bp, Artificial Sequence
  Description of Artificial Sequence: Synthetic oligonucleotide
  Target: SCN10A; (-) strand; PAM type: NRG; PAM sequence: AGG
caaacacacgcacacatgat

SEQ ID NO: 19522 - DNA, 20 bp, Artificial Sequence
  Description of Artificial Sequence: Synthetic oligonucleotide
  Target: SCN10A; (-) strand; PAM type: NRG; PAM sequence: TAG
tcaaacacacgcacacatga

SEQ ID NO: 19523 - DNA, 20 bp, Artificial Sequence
  Description of Artificial Sequence: Synthetic oligonucleotide
  Target: SCN10A; (-) strand; PAM type: NRG; PAM sequence: AAG
cctgaattaagccacctcac

SEQ ID NO: 19524 - DNA, 20 bp, Artificial Sequence
  Description of Artificial Sequence: Synthetic oligonucleotide
  Target: SCN10A; (-) strand; PAM type: NRG; PAM sequence: AAG
cttttcttaacccctgaatt

SEQ ID NO: 19525 - DNA, 20 bp, Artificial Sequence
  Description of Artificial Sequence: Synthetic oligonucleotide
  Target: SCN10A; (-) strand; PAM type: NRG; PAM sequence: AAG
acccagacagaccggctgcc

SEQ ID NO: 19526 - DNA, 20 bp, Artificial Sequence
  Description of Artificial Sequence: Synthetic oligonucleotide
  Target: SCN10A; (-) strand; PAM type: NRG; PAM sequence: CGG
gaatttgaacccagacagac

SEQ ID NO: 19527 - DNA, 20 bp, Artificial Sequence
  Description of Artificial Sequence: Synthetic oligonucleotide
  Target: SCN10A; (-) strand; PAM type: NRG; PAM sequence: CAG
catcagaatttgaacccaga

SEQ ID NO: 19528 - DNA, 20 bp, Artificial Sequence
  Description of Artificial Sequence: Synthetic oligonucleotide
  Target: SCN10A; (-) strand; PAM type: NRG; PAM sequence: CAG
gccacatcagaatttgaacc

SEQ ID NO: 19529 - DNA, 20 bp, Artificial Sequence
  Description of Artificial Sequence: Synthetic oligonucleotide
  Target: SCN10A; (-) strand; PAM type: NRG; PAM sequence: CAG
gttgagtttagtggccacat

SEQ ID NO: 19530 - DNA, 20 bp, Artificial Sequence
  Description of Artificial Sequence: Synthetic oligonucleotide
  Target: SCN10A; (-) strand; PAM type: NRG; PAM sequence: TGG
gatcatagagttgagtttag

SEQ ID NO: 19531 - DNA, 20 bp, Artificial Sequence
  Description of Artificial Sequence: Synthetic oligonucleotide
  Target: SCN10A; (-) strand; PAM type: NRG; PAM sequence: TAG
caagatcatagagttgagtt

SEQ ID NO: 19532 - DNA, 20 bp, Artificial Sequence
  Description of Artificial Sequence: Synthetic oligonucleotide
  Target: SCN10A; (-) strand; PAM type: NRG; PAM sequence: GAG
cttcccaagatcatagagtt

SEQ ID NO: 19533 - DNA, 20 bp, Artificial Sequence
  Description of Artificial Sequence: Synthetic oligonucleotide
  Target: SCN10A; (-) strand; PAM type: NRG; PAM sequence: GAG
ataatcttcccaagatcata

SEQ ID NO: 19534 - DNA, 20 bp, Artificial Sequence
  Description of Artificial Sequence: Synthetic oligonucleotide
  Target: SCN10A; (-) strand; PAM type: NRG; PAM sequence: TAG
aaataatcttcccaagatca

SEQ ID NO: 19535 - DNA, 20 bp, Artificial Sequence
  Description of Artificial Sequence: Synthetic oligonucleotide
  Target: SCN10A; (-) strand; PAM type: NRG; PAM sequence: AAG
aaaggttaaataatcttccc

SEQ ID NO: 19536 - DNA, 20 bp, Artificial Sequence
  Description of Artificial Sequence: Synthetic oligonucleotide
  Target: SCN10A; (-) strand; PAM type: NRG; PAM sequence: AGG
tggaaaaatggagatgcaaa

SEQ ID NO: 19537 - DNA, 20 bp, Artificial Sequence
  Description of Artificial Sequence: Synthetic oligonucleotide
  Target: SCN10A; (-) strand; PAM type: NRG; PAM sequence: AAG
atggaaaaatggagatgcaa

SEQ ID NO: 19538 - DNA, 20 bp, Artificial Sequence
  Description of Artificial Sequence: Synthetic oligonucleotide
  Target: SCN10A; (-) strand; PAM type: NRG; PAM sequence: GAG
ctttcccagatggaaaaatg

SEQ ID NO: 19539 - DNA, 20 bp, Artificial Sequence
  Description of Artificial Sequence: Synthetic oligonucleotide
  Target: SCN10A; (-) strand; PAM type: NRG; PAM sequence: TGG
ccctttcccagatggaaaaa

SEQ ID NO: 19540 - DNA, 20 bp, Artificial Sequence
  Description of Artificial Sequence: Synthetic oligonucleotide
  Target: SCN10A; (-) strand; PAM type: NRG; PAM sequence: TGG
ttgttattccctttcccaga

SEQ ID NO: 19541 - DNA, 20 bp, Artificial Sequence
  Description of Artificial Sequence: Synthetic oligonucleotide
  Target: SCN10A; (-) strand; PAM type: NRG; PAM sequence: CAG
actcttgttattccctttcc

SEQ ID NO: 19542 - DNA, 20 bp, Artificial Sequence
  Description of Artificial Sequence: Synthetic oligonucleotide
  Target: SCN10A; (-) strand; PAM type: NRG; PAM sequence: AGG
tcacaacaaccctacatggt

SEQ ID NO: 19543 - DNA, 20 bp, Artificial Sequence
  Description of Artificial Sequence: Synthetic oligonucleotide
  Target: SCN10A; (-) strand; PAM type: NRG; PAM sequence: TAG
ttcacaacaaccctacatgg

SEQ ID NO: 19544 - DNA, 20 bp, Artificial Sequence
  Description of Artificial Sequence: Synthetic oligonucleotide
  Target: SCN10A; (-) strand; PAM type: NRG; PAM sequence: TGG
attttcacaacaaccctaca

SEQ ID NO: 19545 - DNA, 20 bp, Artificial Sequence
  Description of Artificial Sequence: Synthetic oligonucleotide
  Target: SCN10A; (-) strand; PAM type: NRG; PAM sequence: TGG
taatactcagatgcttctca

SEQ ID NO: 19546 - DNA, 20 bp, Artificial Sequence
  Description of Artificial Sequence: Synthetic oligonucleotide
  Target: SCN10A; (-) strand; PAM type: NRG; PAM sequence: CAG
acaggaatagtaataatact

SEQ ID NO: 19547 - DNA, 20 bp, Artificial Sequence
  Description of Artificial Sequence: Synthetic oligonucleotide
  Target: SCN10A; (-) strand; PAM type: NRG; PAM sequence: TAG
ccttgccccacccacaggaa

SEQ ID NO: 19548 - DNA, 20 bp, Artificial Sequence
  Description of Artificial Sequence: Synthetic oligonucleotide
  Target: SCN10A; (-) strand; PAM type: NRG; PAM sequence: AGG
tccaaccttgccccacccac

SEQ ID NO: 19549 - DNA, 20 bp, Artificial Sequence
  Description of Artificial Sequence: Synthetic oligonucleotide
  Target: SCN10A; (-) strand; PAM type: NRG; PAM sequence: CAG
ctccaaccttgccccaccca

SEQ ID NO: 19550 - DNA, 20 bp, Artificial Sequence
  Description of Artificial Sequence: Synthetic oligonucleotide
  Target: SCN10A; (-) strand; PAM type: NRG; PAM sequence: GGG
gataaagtatctgactcaga

SEQ ID NO: 19551 - DNA, 20 bp, Artificial Sequence
  Description of Artificial Sequence: Synthetic oligonucleotide
  Target: SCN10A; (-) strand; PAM type: NRG; PAM sequence: AGG
ggataaagtatctgactcag

SEQ ID NO: 19552 - DNA, 20 bp, Artificial Sequence
  Description of Artificial Sequence: Synthetic oligonucleotide
  Target: SCN10A; (-) strand; PAM type: NRG; PAM sequence: GAG
tggataaagtatctgactca

SEQ ID NO: 19553 - DNA, 20 bp, Artificial Sequence
  Description of Artificial Sequence: Synthetic oligonucleotide
  Target: SCN10A; (-) strand; PAM type: NRG; PAM sequence: CAG
actggataaagtatctgact

SEQ ID NO: 19554 - DNA, 20 bp, Artificial Sequence
  Description of Artificial Sequence: Synthetic oligonucleotide
  Target: SCN10A; (-) strand; PAM type: NRG; PAM sequence: AAG
atttcactatatactggata

SEQ ID NO: 19555 - DNA, 20 bp, Artificial Sequence
  Description of Artificial Sequence: Synthetic oligonucleotide
  Target: SCN10A; (-) strand; PAM type: NRG; PAM sequence: TGG
tactggatttcactatatac

SEQ ID NO: 19556 - DNA, 20 bp, Artificial Sequence
  Description of Artificial Sequence: Synthetic oligonucleotide
  Target: SCN10A; (-) strand; PAM type: NRG; PAM sequence: TGG
taacaagatacaatccatac

SEQ ID NO: 19557 - DNA, 20 bp, Artificial Sequence
  Description of Artificial Sequence: Synthetic oligonucleotide
  Target: SCN10A; (-) strand; PAM type: NRG; PAM sequence: AAG
tagtattatttactcttaac

SEQ ID NO: 19558 - DNA, 20 bp, Artificial Sequence
  Description of Artificial Sequence: Synthetic oligonucleotide
  Target: SCN10A; (-) strand; PAM type: NRG; PAM sequence: TAG
aattttcctccatcacttgt

SEQ ID NO: 19559 - DNA, 20 bp, Artificial Sequence
  Description of Artificial Sequence: Synthetic oligonucleotide
  Target: SCN10A; (-) strand; PAM type: NRG; PAM sequence: TAG
cttttctttggcatctagtt

SEQ ID NO: 19560 - DNA, 20 bp, Artificial Sequence
  Description of Artificial Sequence: Synthetic oligonucleotide
  Target: SCN10A; (-) strand; PAM type: NRG; PAM sequence: TAG
cggaacttttctttggcatc

SEQ ID NO: 19561 - DNA, 20 bp, Artificial Sequence
  Description of Artificial Sequence: Synthetic oligonucleotide
  Target: SCN10A; (-) strand; PAM type: NRG; PAM sequence: TGG
aggaagtcggaacttttctt

SEQ ID NO: 19562 - DNA, 20 bp, Artificial Sequence
  Description of Artificial Sequence: Synthetic oligonucleotide
  Target: SCN10A; (-) strand; PAM type: NRG; PAM sequence: CGG
taacaaaagcatcaggaagt

SEQ ID NO: 19563 - DNA, 20 bp, Artificial Sequence
  Description of Artificial Sequence: Synthetic oligonucleotide
  Target: SCN10A; (-) strand; PAM type: NRG; PAM sequence: AAG
gttgtaacaaaagcatcagg

SEQ ID NO: 19564 - DNA, 20 bp, Artificial Sequence
  Description of Artificial Sequence: Synthetic oligonucleotide
  Target: SCN10A; (-) strand; PAM type: NRG; PAM sequence: AGG
gctgttgtaacaaaagcatc

SEQ ID NO: 19565 - DNA, 20 bp, Artificial Sequence
  Description of Artificial Sequence: Synthetic oligonucleotide
  Target: SCN10A; (-) strand; PAM type: NRG; PAM sequence: CAG
tgctgttgtaacaaaagcat

SEQ ID NO: 19566 - DNA, 20 bp, Artificial Sequence
  Description of Artificial Sequence: Synthetic oligonucleotide
  Target: SCN10A; (-) strand; PAM type: NRG; PAM sequence: AAG
caaggttgctgttgtaacaa

SEQ ID NO: 19567 - DNA, 20 bp, Artificial Sequence
  Description of Artificial Sequence: Synthetic oligonucleotide
  Target: SCN10A; (-) strand; PAM type: NRG; PAM sequence: AGG
agggaggaaacatggaaaca

SEQ ID NO: 19568 - DNA, 20 bp, Artificial Sequence
  Description of Artificial Sequence: Synthetic oligonucleotide
  Target: SCN10A; (-) strand; PAM type: NRG; PAM sequence: AAG
aagggaggaaacatggaaac

SEQ ID NO: 19569 - DNA, 20 bp, Artificial Sequence
  Description of Artificial Sequence: Synthetic oligonucleotide
  Target: SCN10A; (-) strand; PAM type: NRG; PAM sequence: TGG
acagtggaagggaggaaaca

SEQ ID NO: 19570 - DNA, 20 bp, Artificial Sequence
  Description of Artificial Sequence: Synthetic oligonucleotide
  Target: SCN10A; (-) strand; PAM type: NRG; PAM sequence: AGG
aggggaagacagtggaaggg

SEQ ID NO: 19571 - DNA, 20 bp, Artificial Sequence
  Description of Artificial Sequence: Synthetic oligonucleotide
  Target: SCN10A; (-) strand; PAM type: NRG; PAM sequence: GAG
aaggggaagacagtggaagg

SEQ ID NO: 19572 - DNA, 20 bp, Artificial Sequence
  Description of Artificial Sequence: Synthetic oligonucleotide
  Target: SCN10A; (-) strand; PAM type: NRG; PAM sequence: GGG
ggaaggggaagacagtggaa

SEQ ID NO: 19573 - DNA, 20 bp, Artificial Sequence
  Description of Artificial Sequence: Synthetic oligonucleotide
  Target: SCN10A; (-) strand; PAM type: NRG; PAM sequence: AGG
gggaaggggaagacagtgga

SEQ ID NO: 19574 - DNA, 20 bp, Artificial Sequence
  Description of Artificial Sequence: Synthetic oligonucleotide
  Target: SCN10A; (-) strand; PAM type: NRG; PAM sequence: AAG
agggaaggggaagacagtgg

SEQ ID NO: 19575 - DNA, 20 bp, Artificial Sequence
  Description of Artificial Sequence: Synthetic oligonucleotide
  Target: SCN10A; (-) strand; PAM type: NRG; PAM sequence: TGG
gggagggaaggggaagacag

SEQ ID NO: 19576 - DNA, 20 bp, Artificial Sequence
  Description of Artificial Sequence: Synthetic oligonucleotide
  Target: SCN10A; (-) strand; PAM type: NRG; PAM sequence: CAG
ttggggagggaaggggaaga

SEQ ID NO: 19577 - DNA, 20 bp, Artificial Sequence
  Description of Artificial Sequence: Synthetic oligonucleotide
  Target: SCN10A; (-) strand; PAM type: NRG; PAM sequence: AAG
agagttggggagggaagggg

SEQ ID NO: 19578 - DNA, 20 bp, Artificial Sequence
  Description of Artificial Sequence: Synthetic oligonucleotide
  Target: SCN10A; (-) strand; PAM type: NRG; PAM sequence: GGG
aaaagagttggggagggaag

SEQ ID NO: 19579 - DNA, 20 bp, Artificial Sequence
  Description of Artificial Sequence: Synthetic oligonucleotide
  Target: SCN10A; (-) strand; PAM type: NRG; PAM sequence: GGG
aaaaagagttggggagggaa

SEQ ID NO: 19580 - DNA, 20 bp, Artificial Sequence
  Description of Artificial Sequence: Synthetic oligonucleotide
  Target: SCN10A; (-) strand; PAM type: NRG; PAM sequence: AGG
gaaaaagagttggggaggga

SEQ ID NO: 19581 - DNA, 20 bp, Artificial Sequence
  Description of Artificial Sequence: Synthetic oligonucleotide
  Target: SCN10A; (-) strand; PAM type: NRG; PAM sequence: AAG
agaaaaagagttggggaggg

SEQ ID NO: 19582 - DNA, 20 bp, Artificial Sequence
  Description of Artificial Sequence: Synthetic oligonucleotide
  Target: SCN10A; (-) strand; PAM type: NRG; PAM sequence: GGG
aggagaaaaagagttgggga

SEQ ID NO: 19583 - DNA, 20 bp, Artificial Sequence
  Description of Artificial Sequence: Synthetic oligonucleotide
  Target: SCN10A; (-) strand; PAM type: NRG; PAM sequence: AGG
aaggagaaaaagagttgggg

SEQ ID NO: 19584 - DNA, 20 bp, Artificial Sequence
  Description of Artificial Sequence: Synthetic oligonucleotide
  Target: SCN10A; (-) strand; PAM type: NRG; PAM sequence: GAG
taaggagaaaaagagttggg

SEQ ID NO: 19585 - DNA, 20 bp, Artificial Sequence
  Description of Artificial Sequence: Synthetic oligonucleotide
  Target: SCN10A; (-) strand; PAM type: NRG; PAM sequence: GGG
cttaaggagaaaaagagttg

SEQ ID NO: 19586 - DNA, 20 bp, Artificial Sequence
  Description of Artificial Sequence: Synthetic oligonucleotide
  Target: SCN10A; (-) strand; PAM type: NRG; PAM sequence: GGG
acttaaggagaaaaagagtt

SEQ ID NO: 19587 - DNA, 20 bp, Artificial Sequence
  Description of Artificial Sequence: Synthetic oligonucleotide
  Target: SCN10A; (-) strand; PAM type: NRG; PAM sequence: TGG
cacttaaggagaaaaagagt

SEQ ID NO: 19588 - DNA, 20 bp, Artificial Sequence
  Description of Artificial Sequence: Synthetic oligonucleotide
  Target: SCN10A; (-) strand; PAM type: NRG; PAM sequence: GAG
ttgtcacttaaggagaaaaa

SEQ ID NO: 19589 - DNA, 20 bp, Artificial Sequence
  Description of Artificial Sequence: Synthetic oligonucleotide
  Target: SCN10A; (-) strand; PAM type: NRG; PAM sequence: AAG
tgttgtcacttaaggagaaa

SEQ ID NO: 19590 - DNA, 20 bp, Artificial Sequence
  Description of Artificial Sequence: Synthetic oligonucleotide
  Target: SCN10A; (-) strand; PAM type: NRG; PAM sequence: GAG
tttcaatgttgtcacttaag

SEQ ID NO: 19591 - DNA, 20 bp, Artificial Sequence
  Description of Artificial Sequence: Synthetic oligonucleotide
  Target: SCN10A; (-) strand; PAM type: NRG; PAM sequence: AGG
attttcaatgttgtcactta

SEQ ID NO: 19592 - DNA, 20 bp, Artificial Sequence
  Description of Artificial Sequence: Synthetic oligonucleotide
  Target: SCN10A; (-) strand; PAM type: NRG; PAM sequence: AAG
gattttcaatgttgtcactt

SEQ ID NO: 19593 - DNA, 20 bp, Artificial Sequence
  Description of Artificial Sequence: Synthetic oligonucleotide
  Target: SCN10A; (-) strand; PAM type: NRG; PAM sequence: TAG
tttatgaccacaattaacag

SEQ ID NO: 19594 - DNA, 20 bp, Artificial Sequence
  Description of Artificial Sequence: Synthetic oligonucleotide
  Target: SCN10A; (-) strand; PAM type: NRG; PAM sequence: CAG
acttttatgaccacaattaa

SEQ ID NO: 19595 - DNA, 20 bp, Artificial Sequence
  Description of Artificial Sequence: Synthetic oligonucleotide
  Target: SCN10A; (-) strand; PAM type: NRG; PAM sequence: TGG
ttttatctaaagacaatctt

SEQ ID NO: 19596 - DNA, 20 bp, Artificial Sequence
  Description of Artificial Sequence: Synthetic oligonucleotide
  Target: SCN10A; (-) strand; PAM type: NRG; PAM sequence: AAG
aaatgtcacttttttatcta

SEQ ID NO: 19597 - DNA, 20 bp, Artificial Sequence
  Description of Artificial Sequence: Synthetic oligonucleotide
  Target: SCN10A; (-) strand; PAM type: NRG; PAM sequence: AGG
gttgcctctaccttgaaatg

SEQ ID NO: 19598 - DNA, 20 bp, Artificial Sequence
  Description of Artificial Sequence: Synthetic oligonucleotide
  Target: SCN10A; (-) strand; PAM type: NRG; PAM sequence: GAG
agttgcctctaccttgaaat

SEQ ID NO: 19599 - DNA, 20 bp, Artificial Sequence
  Description of Artificial Sequence: Synthetic oligonucleotide
  Target: SCN10A; (-) strand; PAM type: NRG; PAM sequence: CAG
cacttgaattttctggatct

SEQ ID NO: 19600 - DNA, 20 bp, Artificial Sequence
  Description of Artificial Sequence: Synthetic oligonucleotide
  Target: SCN10A; (-) strand; PAM type: NRG; PAM sequence: TGG
ggacaaccacttgaattttc

SEQ ID NO: 19601 - DNA, 20 bp, Artificial Sequence
  Description of Artificial Sequence: Synthetic oligonucleotide
  Target: SCN10A; (-) strand; PAM type: NRG; PAM sequence: AGG
agttgccctttacaaaacat

SEQ ID NO: 19602 - DNA, 20 bp, Artificial Sequence
  Description of Artificial Sequence: Synthetic oligonucleotide
  Target: SCN10A; (-) strand; PAM type: NRG; PAM sequence: TAG
tagttgccctttacaaaaca

SEQ ID NO: 19603 - DNA, 20 bp, Artificial Sequence
  Description of Artificial Sequence: Synthetic oligonucleotide
  Target: SCN10A; (-) strand; PAM type: NRG; PAM sequence: TAG
agcctggagccagaggcagc

SEQ ID NO: 19604 - DNA, 20 bp, Artificial Sequence
  Description of Artificial Sequence: Synthetic oligonucleotide
  Target: SCN10A; (-) strand; PAM type: NRG; PAM sequence: CAG
ggagagcctggagccagagg

SEQ ID NO: 19605 - DNA, 20 bp, Artificial Sequence
  Description of Artificial Sequence: Synthetic oligonucleotide
  Target: SCN10A; (-) strand; PAM type: NRG; PAM sequence: AGG
ccaggagagcctggagccag

SEQ ID NO: 19606 - DNA, 20 bp, Artificial Sequence
  Description of Artificial Sequence: Synthetic oligonucleotide
  Target: SCN10A; (-) strand; PAM type: NRG; PAM sequence: GAG
accaggagagcctggagcca

SEQ ID NO: 19607 - DNA, 20 bp, Artificial Sequence
  Description of Artificial Sequence: Synthetic oligonucleotide
  Target: SCN10A; (-) strand; PAM type: NRG; PAM sequence: CAG
gaaccaggagagcctggagc

SEQ ID NO: 19608 - DNA, 20 bp, Artificial Sequence
  Description of Artificial Sequence: Synthetic oligonucleotide
  Target: SCN10A; (-) strand; PAM type: NRG; PAM sequence: GAG
aagtgaaccaggagagcctg

SEQ ID NO: 19609 - DNA, 20 bp, Artificial Sequence
  Description of Artificial Sequence: Synthetic oligonucleotide
  Target: SCN10A; (-) strand; PAM type: NRG; PAM sequence: TGG
gaaagtgaaccaggagagcc

SEQ ID NO: 19610 - DNA, 20 bp, Artificial Sequence
  Description of Artificial Sequence: Synthetic oligonucleotide
  Target: SCN10A; (-) strand; PAM type: NRG; PAM sequence: GAG
cacaggaaagtgaaccagga

SEQ ID NO: 19611 - DNA, 20 bp, Artificial Sequence
  Description of Artificial Sequence: Synthetic oligonucleotide
  Target: SCN10A; (-) strand; PAM type: NRG; PAM sequence: GAG
agcacaggaaagtgaaccag

SEQ ID NO: 19612 - DNA, 20 bp, Artificial Sequence
  Description of Artificial Sequence: Synthetic oligonucleotide
  Target: SCN10A; (-) strand; PAM type: NRG; PAM sequence: AGG
caagcacaggaaagtgaacc

SEQ ID NO: 19613 - DNA, 20 bp, Artificial Sequence
  Description of Artificial Sequence: Synthetic oligonucleotide
  Target: SCN10A; (-) strand; PAM type: NRG; PAM sequence: CAG
acaagcacaggaaagtgaac

SEQ ID NO: 19614 - DNA, 20 bp, Artificial Sequence
  Description of Artificial Sequence: Synthetic oligonucleotide
  Target: SCN10A; (-) strand; PAM type: NRG; PAM sequence: AAG
tgggatgaacaagcacagga

SEQ ID NO: 19615 - DNA, 20 bp, Artificial Sequence
  Description of Artificial Sequence: Synthetic oligonucleotide
  Target: SCN10A; (-) strand; PAM type: NRG; PAM sequence: AGG
gctttgggatgaacaagcac

SEQ ID NO: 19616 - DNA, 20 bp, Artificial Sequence
  Description of Artificial Sequence: Synthetic oligonucleotide
  Target: SCN10A; (-) strand; PAM type: NRG; PAM sequence: CAG
ggctttgggatgaacaagca

SEQ ID NO: 19617 - DNA, 20 bp, Artificial Sequence
  Description of Artificial Sequence: Synthetic oligonucleotide
  Target: SCN10A; (-) strand; PAM type: NRG; PAM sequence: AAG
ggaatggctttgggatgaac

SEQ ID NO: 19618 - DNA, 20 bp, Artificial Sequence
  Description of Artificial Sequence: Synthetic oligonucleotide
  Target: SCN10A; (-) strand; PAM type: NRG; PAM sequence: GGG
gagctggtgggaatggcttt

SEQ ID NO: 19619 - DNA, 20 bp, Artificial Sequence
  Description of Artificial Sequence: Synthetic oligonucleotide
  Target: SCN10A; (-) strand; PAM type: NRG; PAM sequence: TGG
tgagctggtgggaatggctt

SEQ ID NO: 19620 - DNA, 20 bp, Artificial Sequence
  Description of Artificial Sequence: Synthetic oligonucleotide
  Target: SCN10A; (-) strand; PAM type: NRG; PAM sequence: TGG
ccaggctgagctggtgggaa

SEQ ID NO: 19621 - DNA, 20 bp, Artificial Sequence
  Description of Artificial Sequence: Synthetic oligonucleotide
  Target: SCN10A; (-) strand; PAM type: NRG; PAM sequence: GGG
aggacccaggctgagctggt

SEQ ID NO: 19622 - DNA, 20 bp, Artificial Sequence
  Description of Artificial Sequence: Synthetic oligonucleotide
  Target: SCN10A; (-) strand; PAM type: NRG; PAM sequence: TGG
gaggacccaggctgagctgg

SEQ ID NO: 19623 - DNA, 20 bp, Artificial Sequence
  Description of Artificial Sequence: Synthetic oligonucleotide
  Target: SCN10A; (-) strand; PAM type: NRG; PAM sequence: TGG
tgggaggacccaggctgagc

SEQ ID NO: 19624 - DNA, 20 bp, Artificial Sequence
  Description of Artificial Sequence: Synthetic oligonucleotide
  Target: SCN10A; (-) strand; PAM type: NRG; PAM sequence: GAG
agtgtgggaggacccaggct

SEQ ID NO: 19625 - DNA, 20 bp, Artificial Sequence
  Description of Artificial Sequence: Synthetic oligonucleotide
  Target: SCN10A; (-) strand; PAM type: NRG; PAM sequence: AGG
ggtcaagtgtgggaggaccc

SEQ ID NO: 19626 - DNA, 20 bp, Artificial Sequence
  Description of Artificial Sequence: Synthetic oligonucleotide
  Target: SCN10A; (-) strand; PAM type: NRG; PAM sequence: CAG
aggtcaagtgtgggaggacc

SEQ ID NO: 19627 - DNA, 20 bp, Artificial Sequence
  Description of Artificial Sequence: Synthetic oligonucleotide
  Target: SCN10A; (-) strand; PAM type: NRG; PAM sequence: AGG
ttcaggaggtcaagtgtggg

SEQ ID NO: 19628 - DNA, 20 bp, Artificial Sequence
  Description of Artificial Sequence: Synthetic oligonucleotide
  Target: SCN10A; (-) strand; PAM type: NRG; PAM sequence: GAG
gttcaggaggtcaagtgtgg

SEQ ID NO: 19629 - DNA, 20 bp, Artificial Sequence
  Description of Artificial Sequence: Synthetic oligonucleotide
  Target: SCN10A; (-) strand; PAM type: NRG; PAM sequence: GGG
gggttcaggaggtcaagtgt

SEQ ID NO: 19630 - DNA, 20 bp, Artificial Sequence
  Description of Artificial Sequence: Synthetic oligonucleotide
  Target: SCN10A; (-) strand; PAM type: NRG; PAM sequence: TGG
tgggttcaggaggtcaagtg

SEQ ID NO: 19631 - DNA, 20 bp, Artificial Sequence
  Description of Artificial Sequence: Synthetic oligonucleotide
  Target: SCN10A; (-) strand; PAM type: NRG; PAM sequence: AAG
gacactgggttcaggaggtc

SEQ ID NO: 19632 - DNA, 20 bp, Artificial Sequence
  Description of Artificial Sequence: Synthetic oligonucleotide
  Target: SCN10A; (-) strand; PAM type: NRG; PAM sequence: AGG
atgtggacactgggttcagg

SEQ ID NO: 19633 - DNA, 20 bp, Artificial Sequence
  Description of Artificial Sequence: Synthetic oligonucleotide
  Target: SCN10A; (-) strand; PAM type: NRG; PAM sequence: GAG
catgtggacactgggttcag

SEQ ID NO: 19634 - DNA, 20 bp, Artificial Sequence
  Description of Artificial Sequence: Synthetic oligonucleotide
  Target: SCN10A; (-) strand; PAM type: NRG; PAM sequence: AGG
gacatgtggacactgggttc

SEQ ID NO: 19635 - DNA, 20 bp, Artificial Sequence
  Description of Artificial Sequence: Synthetic oligonucleotide
  Target: SCN10A; (-) strand; PAM type: NRG; PAM sequence: CAG
agacatgtggacactgggtt

SEQ ID NO: 19636 - DNA, 20 bp, Artificial Sequence
  Description of Artificial Sequence: Synthetic oligonucleotide
  Target: SCN10A; (-) strand; PAM type: NRG; PAM sequence: GGG
gcaggagacatgtggacact

SEQ ID NO: 19637 - DNA, 20 bp, Artificial Sequence
  Description of Artificial Sequence: Synthetic oligonucleotide
  Target: SCN10A; (-) strand; PAM type: NRG; PAM sequence: TGG
tgcaggagacatgtggacac

SEQ ID NO: 19638 - DNA, 20 bp, Artificial Sequence
  Description of Artificial Sequence: Synthetic oligonucleotide
  Target: SCN10A; (-) strand; PAM type: NRG; PAM sequence: TGG
gcagcagtgcaggagacatg

SEQ ID NO: 19639 - DNA, 20 bp, Artificial Sequence
  Description of Artificial Sequence: Synthetic oligonucleotide
  Target: SCN10A; (-) strand; PAM type: NRG; PAM sequence: GAG
agagcagagcagcagtgcag

SEQ ID NO: 19640 - DNA, 20 bp, Artificial Sequence
  Description of Artificial Sequence: Synthetic oligonucleotide
  Target: SCN10A; (-) strand; PAM type: NRG; PAM sequence: AGG
tgagagcagagcagcagtgc

SEQ ID NO: 19641 - DNA, 20 bp, Artificial Sequence
  Description of Artificial Sequence: Synthetic oligonucleotide
  Target: SCN10A; (-) strand; PAM type: NRG; PAM sequence: CAG
ctgagagcagagcagcagtg

SEQ ID NO: 19642 - DNA, 20 bp, Artificial Sequence
  Description of Artificial Sequence: Synthetic oligonucleotide
  Target: SCN10A; (-) strand; PAM type: NRG; PAM sequence: CAG
gttagctgagagcagagcag

SEQ ID NO: 19643 - DNA, 20 bp, Artificial Sequence
  Description of Artificial Sequence: Synthetic oligonucleotide
  Target: SCN10A; (-) strand; PAM type: NRG; PAM sequence: CAG
ccagttagctgagagcagag

SEQ ID NO: 19644 - DNA, 20 bp, Artificial Sequence
  Description of Artificial Sequence: Synthetic oligonucleotide
  Target: SCN10A; (-) strand; PAM type: NRG; PAM sequence: GAG
gagccagttagctgagagca

SEQ ID NO: 19645 - DNA, 20 bp, Artificial Sequence
  Description of Artificial Sequence: Synthetic oligonucleotide
  Target: SCN10A; (-) strand; PAM type: NRG; PAM sequence: CAG
ttgagccagttagctgagag

SEQ ID NO: 19646 - DNA, 20 bp, Artificial Sequence
  Description of Artificial Sequence: Synthetic oligonucleotide
  Target: SCN10A; (-) strand; PAM type: NRG; PAM sequence: GAG
gtgttgagccagttagctga

SEQ ID NO: 19647 - DNA, 20 bp, Artificial Sequence
  Description of Artificial Sequence: Synthetic oligonucleotide
  Target: SCN10A; (-) strand; PAM type: NRG; PAM sequence: GAG
gtgtgttgagccagttagct

SEQ ID NO: 19648 - DNA, 20 bp, Artificial Sequence
  Description of Artificial Sequence: Synthetic oligonucleotide
  Target: SCN10A; (-) strand; PAM type: NRG; PAM sequence: TAG
ggttagtgtgttgagccagt

SEQ ID NO: 19649 - DNA, 20 bp, Artificial Sequence
  Description of Artificial Sequence: Synthetic oligonucleotide
  Target: SCN10A; (-) strand; PAM type: NRG; PAM sequence: CAG
tattggttagtgtgttgagc

SEQ ID NO: 19650 - DNA, 20 bp, Artificial Sequence
  Description of Artificial Sequence: Synthetic oligonucleotide
  Target: SCN10A; (-) strand; PAM type: NRG; PAM sequence: GAG
cccttattggttagtgtgtt

SEQ ID NO: 19651 - DNA, 20 bp, Artificial Sequence
  Description of Artificial Sequence: Synthetic oligonucleotide
  Target: SCN10A; (-) strand; PAM type: NRG; PAM sequence: TAG
tggggcatgcccttattggt

SEQ ID NO: 19652 - DNA, 20 bp, Artificial Sequence
  Description of Artificial Sequence: Synthetic oligonucleotide
  Target: SCN10A; (-) strand; PAM type: NRG; PAM sequence: TGG
ggggtggggcatgcccttat

SEQ ID NO: 19653 - DNA, 20 bp, Artificial Sequence
  Description of Artificial Sequence: Synthetic oligonucleotide
  Target: SCN10A; (-) strand; PAM type: NRG; PAM sequence: GGG
ggtgcagttcgggtggggtg

SEQ ID NO: 19654 - DNA, 20 bp, Artificial Sequence
  Description of Artificial Sequence: Synthetic oligonucleotide
  Target: SCN10A; (-) strand; PAM type: NRG; PAM sequence: GGG
gggtgcagttcgggtggggt

SEQ ID NO: 19655 - DNA, 20 bp, Artificial Sequence
  Description of Artificial Sequence: Synthetic oligonucleotide
  Target: SCN10A; (-) strand; PAM type: NRG; PAM sequence: TGG
agggtgcagttcgggtgggg

SEQ ID NO: 19656 - DNA, 20 bp, Artificial Sequence
  Description of Artificial Sequence: Synthetic oligonucleotide
  Target: SCN10A; (-) strand; PAM type: NRG; PAM sequence: GGG
ggcagggtgcagttcgggtg

SEQ ID NO: 19657 - DNA, 20 bp, Artificial Sequence
  Description of Artificial Sequence: Synthetic oligonucleotide
  Target: SCN10A; (-) strand; PAM type: NRG; PAM sequence: GGG
tggcagggtgcagttcgggt

SEQ ID NO: 19658 - DNA, 20 bp, Artificial Sequence
  Description of Artificial Sequence: Synthetic oligonucleotide
  Target: SCN10A; (-) strand; PAM type: NRG; PAM sequence: TGG
atggcagggtgcagttcggg

SEQ ID NO: 19659 - DNA, 20 bp, Artificial Sequence
  Description of Artificial Sequence: Synthetic oligonucleotide
  Target: SCN10A; (-) strand; PAM type: NRG; PAM sequence: GGG
atgatggcagggtgcagttc

SEQ ID NO: 19660 - DNA, 20 bp, Artificial Sequence
  Description of Artificial Sequence: Synthetic oligonucleotide
  Target: SCN10A; (-) strand; PAM type: NRG; PAM sequence: CGG
gatgatggcagggtgcagtt

SEQ ID NO: 19661 - DNA, 20 bp, Artificial Sequence
  Description of Artificial Sequence: Synthetic oligonucleotide
  Target: SCN10A; (-) strand; PAM type: NRG; PAM sequence: CAG
gtggggatgatggcagggtg

SEQ ID NO: 19662 - DNA, 20 bp, Artificial Sequence
  Description of Artificial Sequence: Synthetic oligonucleotide
  Target: SCN10A; (-) strand; PAM type: NRG; PAM sequence: GGG
gcggggtggggatgatggca

SEQ ID NO: 19663 - DNA, 20 bp, Artificial Sequence
  Description of Artificial Sequence: Synthetic oligonucleotide
  Target: SCN10A; (-) strand; PAM type: NRG; PAM sequence: AGG
ggcggggtggggatgatggc

SEQ ID NO: 19664 - DNA, 20 bp, Artificial Sequence
  Description of Artificial Sequence: Synthetic oligonucleotide
  Target: SCN10A; (-) strand; PAM type: NRG; PAM sequence: CAG
gggcggggtggggatgatgg

SEQ ID NO: 19665 - DNA, 20 bp, Artificial Sequence
  Description of Artificial Sequence: Synthetic oligonucleotide
  Target: SCN10A; (-) strand; PAM type: NRG; PAM sequence: TGG
tcggggcggggtggggatga

SEQ ID NO: 19666 - DNA, 20 bp, Artificial Sequence
  Description of Artificial Sequence: Synthetic oligonucleotide
  Target: SCN10A; (-) strand; PAM type: NRG; PAM sequence: GGG
ggcgtggtcggggcggggtg

SEQ ID NO: 19667 - DNA, 20 bp, Artificial Sequence
  Description of Artificial Sequence: Synthetic oligonucleotide
  Target: SCN10A; (-) strand; PAM type: NRG; PAM sequence: GGG
tggcgtggtcggggcggggt

SEQ ID NO: 19668 - DNA, 20 bp, Artificial Sequence
  Description of Artificial Sequence: Synthetic oligonucleotide
  Target: SCN10A; (-) strand; PAM type: NRG; PAM sequence: TGG
ctggcgtggtcggggcgggg

SEQ ID NO: 19669 - DNA, 20 bp, Artificial Sequence
  Description of Artificial Sequence: Synthetic oligonucleotide
  Target: SCN10A; (-) strand; PAM type: NRG; PAM sequence: GGG
tcactggcgtggtcggggcg

SEQ ID NO: 19670 - DNA, 20 bp, Artificial Sequence
  Description of Artificial Sequence: Synthetic oligonucleotide
  Target: SCN10A; (-) strand; PAM type: NRG; PAM sequence: GGG
ctcactggcgtggtcggggc

SEQ ID NO: 19671 - DNA, 20 bp, Artificial Sequence
  Description of Artificial Sequence: Synthetic oligonucleotide
  Target: SCN10A; (-) strand; PAM type: NRG; PAM sequence: CGG
cctcactggcgtggtcgggg

SEQ ID NO: 19672 - DNA, 20 bp, Artificial Sequence
  Description of Artificial Sequence: Synthetic oligonucleotide
  Target: SCN10A; (-) strand; PAM type: NRG; PAM sequence: GGG
tgccctcactggcgtggtcg

SEQ ID NO: 19673 - DNA, 20 bp, Artificial Sequence
  Description of Artificial Sequence: Synthetic oligonucleotide
  Target: SCN10A; (-) strand; PAM type: NRG; PAM sequence: GGG
ctgccctcactggcgtggtc

SEQ ID NO: 19674 - DNA, 20 bp, Artificial Sequence
  Description of Artificial Sequence: Synthetic oligonucleotide
  Target: SCN10A; (-) strand; PAM type: NRG; PAM sequence: CGG
actgccctcactggcgtggt

SEQ ID NO: 19675 - DNA, 20 bp, Artificial Sequence
  Description of Artificial Sequence: Synthetic oligonucleotide
  Target: SCN10A; (-) strand; PAM type: NRG; PAM sequence: TGG
tggtactgccctcactggcg

SEQ ID NO: 19676 - DNA, 20 bp, Artificial Sequence
  Description of Artificial Sequence: Synthetic oligonucleotide
  Target: SCN10A; (-) strand; PAM type: NRG; PAM sequence: TGG
ctggctggtactgccctcac

SEQ ID NO: 19677 - DNA, 20 bp, Artificial Sequence
  Description of Artificial Sequence: Synthetic oligonucleotide
  Target: SCN10A; (-) strand; PAM type: NRG; PAM sequence: TGG
aacatcgtgagtgctctggc

SEQ ID NO: 19678 - DNA, 20 bp, Artificial Sequence
  Description of Artificial Sequence: Synthetic oligonucleotide
  Target: SCN10A; (-) strand; PAM type: NRG; PAM sequence: TGG
aggcaacatcgtgagtgctc

SEQ ID NO: 19679 - DNA, 20 bp, Artificial Sequence
  Description of Artificial Sequence: Synthetic oligonucleotide
  Target: SCN10A; (-) strand; PAM type: NRG; PAM sequence: GAG
ctccagataggcaacatcgt

SEQ ID NO: 19680 - DNA, 20 bp, Artificial Sequence
  Description of Artificial Sequence: Synthetic oligonucleotide
  Target: SCN10A; (-) strand; PAM type: NRG; PAM sequence: AGG
ttcgaagccatgctccagat

SEQ ID NO: 19681 - DNA, 20 bp, Artificial Sequence
  Description of Artificial Sequence: Synthetic oligonucleotide
  Target: SCN10A; (-) strand; PAM type: NRG; PAM sequence: TAG
cttcgaagccatgctccaga

SEQ ID NO: 19682 - DNA, 20 bp, Artificial Sequence
  Description of Artificial Sequence: Synthetic oligonucleotide
  Target: SCN10A; (-) strand; PAM type: NRG; PAM sequence: CAG
ctaccttcgaagccatgctc

SEQ ID NO: 19683 - DNA, 20 bp, Artificial Sequence
  Description of Artificial Sequence: Synthetic oligonucleotide
  Target: SCN10A; (-) strand; PAM type: NRG; PAM sequence: AAG
tggcatgagccctaccttcg

SEQ ID NO: 19684 - DNA, 20 bp, Artificial Sequence
  Description of Artificial Sequence: Synthetic oligonucleotide
  Target: SCN10A; (-) strand; PAM type: NRG; PAM sequence: GAG
gccatggagcaccatggcat

SEQ ID NO: 19685 - DNA, 20 bp, Artificial Sequence
  Description of Artificial Sequence: Synthetic oligonucleotide
  Target: SCN10A; (-) strand; PAM type: NRG; PAM sequence: TGG
ttcatggccatggagcacca

SEQ ID NO: 19686 - DNA, 20 bp, Artificial Sequence
  Description of Artificial Sequence: Synthetic oligonucleotide
  Target: SCN10A; (-) strand; PAM type: NRG; PAM sequence: GAG
acaccatcttcatggccatg

SEQ ID NO: 19687 - DNA, 20 bp, Artificial Sequence
  Description of Artificial Sequence: Synthetic oligonucleotide
  Target: SCN10A; (-) strand; PAM type: NRG; PAM sequence: TGG
gaacaccatcttcatggcca

SEQ ID NO: 19688 - DNA, 20 bp, Artificial Sequence
  Description of Artificial Sequence: Synthetic oligonucleotide
  Target: SCN10A; (-) strand; PAM type: NRG; PAM sequence: TGG
cgtggtgaacaccatcttca

SEQ ID NO: 19689 - DNA, 20 bp, Artificial Sequence
  Description of Artificial Sequence: Synthetic oligonucleotide
  Target: SCN10A; (-) strand; PAM type: NRG; PAM sequence: TGG
caccatcaccttgtgcatcg

SEQ ID NO: 19690 - DNA, 20 bp, Artificial Sequence
  Description of Artificial Sequence: Synthetic oligonucleotide
  Target: SCN10A; (-) strand; PAM type: NRG; PAM sequence: GAG
ttgtgacggatccctttgca

SEQ ID NO: 19691 - DNA, 20 bp, Artificial Sequence
  Description of Artificial Sequence: Synthetic oligonucleotide
  Target: SCN10A; (-) strand; PAM type: NRG; PAM sequence: CAG
gcttgtgacggatccctttg

SEQ ID NO: 19692 - DNA, 20 bp, Artificial Sequence
  Description of Artificial Sequence: Synthetic oligonucleotide
  Target: SCN10A; (-) strand; PAM type: NRG; PAM sequence: CGG
aattctctttgggcttgtga

SEQ ID NO: 19693 - DNA, 20 bp, Artificial Sequence
  Description of Artificial Sequence: Synthetic oligonucleotide
  Target: SCN10A; (-) strand; PAM type: NRG; PAM sequence: GGG
agctcaagacaattctcttt

SEQ ID NO: 19694 - DNA, 20 bp, Artificial Sequence
  Description of Artificial Sequence: Synthetic oligonucleotide
  Target: SCN10A; (-) strand; PAM type: NRG; PAM sequence: TGG
aagctcaagacaattctctt

SEQ ID NO: 19695 - DNA, 20 bp, Artificial Sequence
  Description of Artificial Sequence: Synthetic oligonucleotide
  Target: SCN10A; (-) strand; PAM type: NRG; PAM sequence: AAG
gccccatgtgggtgaagctc

SEQ ID NO: 19696 - DNA, 20 bp, Artificial Sequence
  Description of Artificial Sequence: Synthetic oligonucleotide
  Target: SCN10A; (-) strand; PAM type: NRG; PAM sequence: AAG
attgctgccccatgtgggtg

SEQ ID NO: 19697 - DNA, 20 bp, Artificial Sequence
  Description of Artificial Sequence: Synthetic oligonucleotide
  Target: SCN10A; (-) strand; PAM type: NRG; PAM sequence: GGG
ctgggattgctgccccatgt

SEQ ID NO: 19698 - DNA, 20 bp, Artificial Sequence
  Description of Artificial Sequence: Synthetic oligonucleotide
  Target: SCN10A; (-) strand; PAM type: NRG; PAM sequence: TGG
tctgggattgctgccccatg

SEQ ID NO: 19699 - DNA, 20 bp, Artificial Sequence
  Description of Artificial Sequence: Synthetic oligonucleotide
  Target: SCN10A; (-) strand; PAM type: NRG; PAM sequence: GGG
gtctcagaagtatctgatct

SEQ ID NO: 19700 - DNA, 20 bp, Artificial Sequence
  Description of Artificial Sequence: Synthetic oligonucleotide
  Target: SCN10A; (-) strand; PAM type: NRG; PAM sequence: TGG
tgtctcagaagtatctgatc

SEQ ID NO: 19701 - DNA, 20 bp, Artificial Sequence
  Description of Artificial Sequence: Synthetic oligonucleotide
  Target: SCN10A; (-) strand; PAM type: NRG; PAM sequence: AAG
gcttgaccagcttgtctcag

SEQ ID NO: 19702 - DNA, 20 bp, Artificial Sequence
  Description of Artificial Sequence: Synthetic oligonucleotide
  Target: SCN10A; (-) strand; PAM type: NRG; PAM sequence: CAG
cctgcttgaccagcttgtct

SEQ ID NO: 19703 - DNA, 20 bp, Artificial Sequence
  Description of Artificial Sequence: Synthetic oligonucleotide
  Target: SCN10A; (-) strand; PAM type: NRG; PAM sequence: CAG
aagtgcccaccctgcttgac

SEQ ID NO: 19704 - DNA, 20 bp, Artificial Sequence
  Description of Artificial Sequence: Synthetic oligonucleotide
  Target: SCN10A; (-) strand; PAM type: NRG; PAM sequence: AAG
aactcgaggagtctgaacag

SEQ ID NO: 19705 - DNA, 20 bp, Artificial Sequence
  Description of Artificial Sequence: Synthetic oligonucleotide
  Target: SCN10A; (-) strand; PAM type: NRG; PAM sequence: CAG
cagaactcgaggagtctgaa

SEQ ID NO: 19706 - DNA, 20 bp, Artificial Sequence
  Description of Artificial Sequence: Synthetic oligonucleotide
  Target: SCN10A; (-) strand; PAM type: NRG; PAM sequence: GAG
actataatgcagaactcgag

SEQ ID NO: 19707 - DNA, 20 bp, Artificial Sequence
  Description of Artificial Sequence: Synthetic oligonucleotide
  Target: SCN10A; (-) strand; PAM type: NRG; PAM sequence: AGG
acactataatgcagaactcg

SEQ ID NO: 19708 - DNA, 20 bp, Artificial Sequence
  Description of Artificial Sequence: Synthetic oligonucleotide
  Target: SCN10A; (-) strand; PAM type: NRG; PAM sequence: GAG
cacactataatgcagaactc

SEQ ID NO: 19709 - DNA, 20 bp, Artificial Sequence
  Description of Artificial Sequence: Synthetic oligonucleotide
  Target: SCN10A; (-) strand; PAM type: NRG; PAM sequence: CAG
tcattgaccacactataatg

SEQ ID NO: 19710 - DNA, 20 bp, Artificial Sequence
  Description of Artificial Sequence: Synthetic oligonucleotide
  Target: SCN10A; (-) strand; PAM type: NRG; PAM sequence: CAG
ccaaggtgacacatggctga

SEQ ID NO: 19711 - DNA, 20 bp, Artificial Sequence
  Description of Artificial Sequence: Synthetic oligonucleotide
  Target: SCN10A; (-) strand; PAM type: NRG; PAM sequence: TGG
ttggggtccaaggtgacaca

SEQ ID NO: 19712 - DNA, 20 bp, Artificial Sequence
  Description of Artificial Sequence: Synthetic oligonucleotide
  Target: SCN10A; (-) strand; PAM type: NRG; PAM sequence: AGG
gaccgcagaattggggtcca

SEQ ID NO: 19713 - DNA, 20 bp, Artificial Sequence
  Description of Artificial Sequence: Synthetic oligonucleotide
  Target: SCN10A; (-) strand; PAM type: NRG; PAM sequence: AAG
tgaccgcagaattggggtcc

SEQ ID NO: 19714 - DNA, 20 bp, Artificial Sequence
  Description of Artificial Sequence: Synthetic oligonucleotide
  Target: SCN10A; (-) strand; PAM type: NRG; PAM sequence: GGG
agaggatgaccgcagaattg

SEQ ID NO: 19715 - DNA, 20 bp, Artificial Sequence
  Description of Artificial Sequence: Synthetic oligonucleotide
  Target: SCN10A; (-) strand; PAM type: NRG; PAM sequence: GGG
tagaggatgaccgcagaatt

SEQ ID NO: 19716 - DNA, 20 bp, Artificial Sequence
  Description of Artificial Sequence: Synthetic oligonucleotide
  Target: SCN10A; (-) strand; PAM type: NRG; PAM sequence: TGG
ctagaggatgaccgcagaat

SEQ ID NO: 19717 - DNA, 20 bp, Artificial Sequence
  Description of Artificial Sequence: Synthetic oligonucleotide
  Target: SCN10A; (-) strand; PAM type: NRG; PAM sequence: CAG
caaggtctagaggatgaccg

SEQ ID NO: 19718 - DNA, 20 bp, Artificial Sequence
  Description of Artificial Sequence: Synthetic oligonucleotide
  Target: SCN10A; (-) strand; PAM type: NRG; PAM sequence: AGG
ttattaacaacaaggtctag

SEQ ID NO: 19719 - DNA, 20 bp, Artificial Sequence
  Description of Artificial Sequence: Synthetic oligonucleotide
  Target: SCN10A; (-) strand; PAM type: NRG; PAM sequence: GAG
attattaacaacaaggtcta

SEQ ID NO: 19720 - DNA, 20 bp, Artificial Sequence
  Description of Artificial Sequence: Synthetic oligonucleotide
  Target: SCN10A; (-) strand; PAM type: NRG; PAM sequence: TAG
ttattattaacaacaaggtc

SEQ ID NO: 19721 - DNA, 20 bp, Artificial Sequence
  Description of Artificial Sequence: Synthetic oligonucleotide
  Target: SCN10A; (-) strand; PAM type: NRG; PAM sequence: AGG
ggtacttattattaacaaca

SEQ ID NO: 19722 - DNA, 20 bp, Artificial Sequence
  Description of Artificial Sequence: Synthetic oligonucleotide
  Target: SCN10A; (-) strand; PAM type: NRG; PAM sequence: AAG
tggtacttattattaacaac

SEQ ID NO: 19723 - DNA, 20 bp, Artificial Sequence
  Description of Artificial Sequence: Synthetic oligonucleotide
  Target: SCN10A; (-) strand; PAM type: NRG; PAM sequence: TGG
tgaagtcaaaatgttggagg

SEQ ID NO: 19724 - DNA, 20 bp, Artificial Sequence
  Description of Artificial Sequence: Synthetic oligonucleotide
  Target: SCN10A; (-) strand; PAM type: NRG; PAM sequence: AGG
ggctgaagtcaaaatgttgg

SEQ ID NO: 19725 - DNA, 20 bp, Artificial Sequence
  Description of Artificial Sequence: Synthetic oligonucleotide
  Target: SCN10A; (-) strand; PAM type: NRG; PAM sequence: GAG
gggctgaagtcaaaatgttg

SEQ ID NO: 19726 - DNA, 20 bp, Artificial Sequence
  Description of Artificial Sequence: Synthetic oligonucleotide
  Target: SCN10A; (-) strand; PAM type: NRG; PAM sequence: TGG
gagggctgaagtcaaaatgt

SEQ ID NO: 19727 - DNA, 20 bp, Artificial Sequence
  Description of Artificial Sequence: Synthetic oligonucleotide
  Target: SCN10A; (-) strand; PAM type: NRG; PAM sequence: AAG
cagagacagagagagggctg

SEQ ID NO: 19728 - DNA, 20 bp, Artificial Sequence
  Description of Artificial Sequence: Synthetic oligonucleotide
  Target: SCN10A; (-) strand; PAM type: NRG; PAM sequence: GGG
gaataccagagacagagaga

SEQ ID NO: 19729 - DNA, 20 bp, Artificial Sequence
  Description of Artificial Sequence: Synthetic oligonucleotide
  Target: SCN10A; (-) strand; PAM type: NRG; PAM sequence: AGG
tgaataccagagacagagag

SEQ ID NO: 19730 - DNA, 20 bp, Artificial Sequence
  Description of Artificial Sequence: Synthetic oligonucleotide
  Target: SCN10A; (-) strand; PAM type: NRG; PAM sequence: GAG
atgaataccagagacagaga

SEQ ID NO: 19731 - DNA, 20 bp, Artificial Sequence
  Description of Artificial Sequence: Synthetic oligonucleotide
  Target: SCN10A; (-) strand; PAM type: NRG; PAM sequence: GAG
aaatgaataccagagacaga

SEQ ID NO: 19732 - DNA, 20 bp, Artificial Sequence
  Description of Artificial Sequence: Synthetic oligonucleotide
  Target: SCN10A; (-) strand; PAM type: NRG; PAM sequence: GAG
ggaaatgaataccagagaca

SEQ ID NO: 19733 - DNA, 20 bp, Artificial Sequence
  Description of Artificial Sequence: Synthetic oligonucleotide
  Target: SCN10A; (-) strand; PAM type: NRG; PAM sequence: CAG
taggaaatgaataccagaga

SEQ ID NO: 19734 - DNA, 20 bp, Artificial Sequence
  Description of Artificial Sequence: Synthetic oligonucleotide
  Target: SCN10A; (-) strand; PAM type: NRG; PAM sequence: GAG
aatataggaaatgaatacca

SEQ ID NO: 19735 - DNA, 20 bp, Artificial Sequence
  Description of Artificial Sequence: Synthetic oligonucleotide
  Target: SCN10A; (-) strand; PAM type: NRG; PAM sequence: CAG
aaaatataggaaatgaatac

SEQ ID NO: 19736 - DNA, 20 bp, Artificial Sequence
  Description of Artificial Sequence: Synthetic oligonucleotide
  Target: SCN10A; (-) strand; PAM type: NRG; PAM sequence: AGG
actaaaggagttcaaaatat

SEQ ID NO: 19737 - DNA, 20 bp, Artificial Sequence
  Description of Artificial Sequence: Synthetic oligonucleotide
  Target: SCN10A; (-) strand; PAM type: NRG; PAM sequence: TAG
gactaaaggagttcaaaata

SEQ ID NO: 19738 - DNA, 20 bp, Artificial Sequence
  Description of Artificial Sequence: Synthetic oligonucleotide
  Target: SCN10A; (-) strand; PAM type: NRG; PAM sequence: GAG
ttggagttgcaggactaaag

SEQ ID NO: 19739 - DNA, 20 bp, Artificial Sequence
  Description of Artificial Sequence: Synthetic oligonucleotide
  Target: SCN10A; (-) strand; PAM type: NRG; PAM sequence: AGG
aattggagttgcaggactaa

SEQ ID NO: 19740 - DNA, 20 bp, Artificial Sequence
  Description of Artificial Sequence: Synthetic oligonucleotide
  Target: SCN10A; (-) strand; PAM type: NRG; PAM sequence: AAG
taattggagttgcaggacta

SEQ ID NO: 19741 - DNA, 20 bp, Artificial Sequence
  Description of Artificial Sequence: Synthetic oligonucleotide
  Target: SCN10A; (-) strand; PAM type: NRG; PAM sequence: AGG
cagatattaattggagttgc

SEQ ID NO: 19742 - DNA, 20 bp, Artificial Sequence
  Description of Artificial Sequence: Synthetic oligonucleotide
  Target: SCN10A; (-) strand; PAM type: NRG; PAM sequence: CAG
gcagatattaattggagttg

SEQ ID NO: 19743 - DNA, 20 bp, Artificial Sequence
  Description of Artificial Sequence: Synthetic oligonucleotide
  Target: SCN10A; (-) strand; PAM type: NRG; PAM sequence: GAG
gatggggcagatattaattg

SEQ ID NO: 19744 - DNA, 20 bp, Artificial Sequence
  Description of Artificial Sequence: Synthetic oligonucleotide
  Target: SCN10A; (-) strand; PAM type: NRG; PAM sequence: TGG
tggatggggcagatattaat

SEQ ID NO: 19745 - DNA, 20 bp, Artificial Sequence
  Description of Artificial Sequence: Synthetic oligonucleotide
  Target: SCN10A; (-) strand; PAM type: NRG; PAM sequence: CAG
gtttaaaggactggatgggg

SEQ ID NO: 19746 - DNA, 20 bp, Artificial Sequence
  Description of Artificial Sequence: Synthetic oligonucleotide
  Target: SCN10A; (-) strand; PAM type: NRG; PAM sequence: GGG
gcagtttaaaggactggatg

SEQ ID NO: 19747 - DNA, 20 bp, Artificial Sequence
  Description of Artificial Sequence: Synthetic oligonucleotide
  Target: SCN10A; (-) strand; PAM type: NRG; PAM sequence: GGG
agcagtttaaaggactggat

SEQ ID NO: 19748 - DNA, 20 bp, Artificial Sequence
  Description of Artificial Sequence: Synthetic oligonucleotide
  Target: SCN10A; (-) strand; PAM type: NRG; PAM sequence: TGG
cagcagtttaaaggactgga

SEQ ID NO: 19749 - DNA, 20 bp, Artificial Sequence
  Description of Artificial Sequence: Synthetic oligonucleotide
  Target: SCN10A; (-) strand; PAM type: NRG; PAM sequence: TGG
atgtcagcagtttaaaggac

SEQ ID NO: 19750 - DNA, 20 bp, Artificial Sequence
  Description of Artificial Sequence: Synthetic oligonucleotide
  Target: SCN10A; (-) strand; PAM type: NRG; PAM sequence: AGG
atgtaatgtcagcagtttaa

SEQ ID NO: 19751 - DNA, 20 bp, Artificial Sequence
  Description of Artificial Sequence: Synthetic oligonucleotide
  Target: SCN10A; (-) strand; PAM type: NRG; PAM sequence: AAG
tatgtaatgtcagcagttta

SEQ ID NO: 19752 - DNA, 20 bp, Artificial Sequence
  Description of Artificial Sequence: Synthetic oligonucleotide
  Target: SCN10A; (-) strand; PAM type: NRG; PAM sequence: CAG
gtaaaaatatgtaatgtcag

SEQ ID NO: 19753 - DNA, 20 bp, Artificial Sequence
  Description of Artificial Sequence: Synthetic oligonucleotide
  Target: SCN10A; (-) strand; PAM type: NRG; PAM sequence: CAG
gcagtaaaaatatgtaatgt

SEQ ID NO: 19754 - DNA, 20 bp, Artificial Sequence
  Description of Artificial Sequence: Synthetic oligonucleotide
  Target: SCN10A; (-) strand; PAM type: NRG; PAM sequence: CAG
gacatgatataggtgatggg

SEQ ID NO: 19755 - DNA, 20 bp, Artificial Sequence
  Description of Artificial Sequence: Synthetic oligonucleotide
  Target: SCN10A; (-) strand; PAM type: NRG; PAM sequence: GGG
aaggacatgatataggtgat

SEQ ID NO: 19756 - DNA, 20 bp, Artificial Sequence
  Description of Artificial Sequence: Synthetic oligonucleotide
  Target: SCN10A; (-) strand; PAM type: NRG; PAM sequence: TGG
taaggacatgatataggtga

SEQ ID NO: 19757 - DNA, 20 bp, Artificial Sequence
  Description of Artificial Sequence: Synthetic oligonucleotide
  Target: SCN10A; (-) strand; PAM type: NRG; PAM sequence: AGG
gagaagtaaggacatgatat

SEQ ID NO: 19758 - DNA, 20 bp, Artificial Sequence
  Description of Artificial Sequence: Synthetic oligonucleotide
  Target: SCN10A; (-) strand; PAM type: NRG; PAM sequence: TAG
tgagaagtaaggacatgata

SEQ ID NO: 19759 - DNA, 20 bp, Artificial Sequence
  Description of Artificial Sequence: Synthetic oligonucleotide
  Target: SCN10A; (-) strand; PAM type: NRG; PAM sequence: AGG
gctgggcaaattgagaagta

SEQ ID NO: 19760 - DNA, 20 bp, Artificial Sequence
  Description of Artificial Sequence: Synthetic oligonucleotide
  Target: SCN10A; (-) strand; PAM type: NRG; PAM sequence: AAG
agctgggcaaattgagaagt

SEQ ID NO: 19761 - DNA, 20 bp, Artificial Sequence
  Description of Artificial Sequence: Synthetic oligonucleotide
  Target: SCN10A; (-) strand; PAM type: NRG; PAM sequence: AAG
tctaagctgggcaaattgag

SEQ ID NO: 19762 - DNA, 20 bp, Artificial Sequence
  Description of Artificial Sequence: Synthetic oligonucleotide
  Target: SCN10A; (-) strand; PAM type: NRG; PAM sequence: GAG
aaatctaagctgggcaaatt

SEQ ID NO: 19763 - DNA, 20 bp, Artificial Sequence
  Description of Artificial Sequence: Synthetic oligonucleotide
  Target: SCN10A; (-) strand; PAM type: NRG; PAM sequence: GGG
atggatgtgaaatctaagct

SEQ ID NO: 19764 - DNA, 20 bp, Artificial Sequence
  Description of Artificial Sequence: Synthetic oligonucleotide
  Target: SCN10A; (-) strand; PAM type: NRG; PAM sequence: TGG
gatggatgtgaaatctaagc

SEQ ID NO: 19765 - DNA, 20 bp, Artificial Sequence
  Description of Artificial Sequence: Synthetic oligonucleotide
  Target: SCN10A; (-) strand; PAM type: NRG; PAM sequence: AAG
gagagatggatgtgaaatct

SEQ ID NO: 19766 - DNA, 20 bp, Artificial Sequence
  Description of Artificial Sequence: Synthetic oligonucleotide
  Target: SCN10A; (-) strand; PAM type: NRG; PAM sequence: TGG
caagggagtagttagagaga

SEQ ID NO: 19767 - DNA, 20 bp, Artificial Sequence
  Description of Artificial Sequence: Synthetic oligonucleotide
  Target: SCN10A; (-) strand; PAM type: NRG; PAM sequence: GAG
cctacaagggagtagttaga

SEQ ID NO: 19768 - DNA, 20 bp, Artificial Sequence
  Description of Artificial Sequence: Synthetic oligonucleotide
  Target: SCN10A; (-) strand; PAM type: NRG; PAM sequence: GAG
tgcctacaagggagtagtta

SEQ ID NO: 19769 - DNA, 20 bp, Artificial Sequence
  Description of Artificial Sequence: Synthetic oligonucleotide
  Target: SCN10A; (-) strand; PAM type: NRG; PAM sequence: TAG
ggtgcctacaagggagtagt

SEQ ID NO: 19770 - DNA, 20 bp, Artificial Sequence
  Description of Artificial Sequence: Synthetic oligonucleotide
  Target: SCN10A; (-) strand; PAM type: NRG; PAM sequence: TAG
tgagggtgcctacaagggag

SEQ ID NO: 19771 - DNA, 20 bp, Artificial Sequence
  Description of Artificial Sequence: Synthetic oligonucleotide
  Target: SCN10A; (-) strand; PAM type: NRG; PAM sequence: GAG
aattgagggtgcctacaagg

SEQ ID NO: 19772 - DNA, 20 bp, Artificial Sequence
  Description of Artificial Sequence: Synthetic oligonucleotide
  Target: SCN10A; (-) strand; PAM type: NRG; PAM sequence: GGG
ggaattgagggtgcctacaa

SEQ ID NO: 19773 - DNA, 20 bp, Artificial Sequence
  Description of Artificial Sequence: Synthetic oligonucleotide
  Target: SCN10A; (-) strand; PAM type: NRG; PAM sequence: AGG
aggaattgagggtgcctaca

SEQ ID NO: 19774 - DNA, 20 bp, Artificial Sequence
  Description of Artificial Sequence: Synthetic oligonucleotide
  Target: SCN10A; (-) strand; PAM type: NRG; PAM sequence: AAG
aaggaattgagggtgcctac

SEQ ID NO: 19775 - DNA, 20 bp, Artificial Sequence
  Description of Artificial Sequence: Synthetic oligonucleotide
  Target: SCN10A; (-) strand; PAM type: NRG; PAM sequence: GGG
gagaggggcaaaggaattga

SEQ ID NO: 19776 - DNA, 20 bp, Artificial Sequence
  Description of Artificial Sequence: Synthetic oligonucleotide
  Target: SCN10A; (-) strand; PAM type: NRG; PAM sequence: AGG
ggagaggggcaaaggaattg

SEQ ID NO: 19777 - DNA, 20 bp, Artificial Sequence
  Description of Artificial Sequence: Synthetic oligonucleotide
  Target: SCN10A; (-) strand; PAM type: NRG; PAM sequence: GAG
aggagaggggcaaaggaatt

SEQ ID NO: 19778 - DNA, 20 bp, Artificial Sequence
  Description of Artificial Sequence: Synthetic oligonucleotide
  Target: SCN10A; (-) strand; PAM type: NRG; PAM sequence: AGG
atgaaggaggagaggggcaa

SEQ ID NO: 19779 - DNA, 20 bp, Artificial Sequence
  Description of Artificial Sequence: Synthetic oligonucleotide
  Target: SCN10A; (-) strand; PAM type: NRG; PAM sequence: AAG
aatgaaggaggagaggggca

SEQ ID NO: 19780 - DNA, 20 bp, Artificial Sequence
  Description of Artificial Sequence: Synthetic oligonucleotide
  Target: SCN10A; (-) strand; PAM type: NRG; PAM sequence: GGG
agtacaatgaaggaggagag

SEQ ID NO: 19781 - DNA, 20 bp, Artificial Sequence
  Description of Artificial Sequence: Synthetic oligonucleotide
  Target: SCN10A; (-) strand; PAM type: NRG; PAM sequence: GGG
aagtacaatgaaggaggaga

SEQ ID NO: 19782 - DNA, 20 bp, Artificial Sequence
  Description of Artificial Sequence: Synthetic oligonucleotide
  Target: SCN10A; (-) strand; PAM type: NRG; PAM sequence: AGG
caagtacaatgaaggaggag

SEQ ID NO: 19783 - DNA, 20 bp, Artificial Sequence
  Description of Artificial Sequence: Synthetic oligonucleotide
  Target: SCN10A; (-) strand; PAM type: NRG; PAM sequence: GAG
gcaagtacaatgaaggagga

SEQ ID NO: 19784 - DNA, 20 bp, Artificial Sequence
  Description of Artificial Sequence: Synthetic oligonucleotide
  Target: SCN10A; (-) strand; PAM type: NRG; PAM sequence: GAG
aggcaagtacaatgaaggag

SEQ ID NO: 19785 - DNA, 20 bp, Artificial Sequence
  Description of Artificial Sequence: Synthetic oligonucleotide
  Target: SCN10A; (-) strand; PAM type: NRG; PAM sequence: AGG
ccaggcaagtacaatgaagg

SEQ ID NO: 19786 - DNA, 20 bp, Artificial Sequence
  Description of Artificial Sequence: Synthetic oligonucleotide
  Target: SCN10A; (-) strand; PAM type: NRG; PAM sequence: GAG
gccaggcaagtacaatgaag

SEQ ID NO: 19787 - DNA, 20 bp, Artificial Sequence
  Description of Artificial Sequence: Synthetic oligonucleotide
  Target: SCN10A; (-) strand; PAM type: NRG; PAM sequence: AGG
ttgccaggcaagtacaatga

SEQ ID NO: 19788 - DNA, 20 bp, Artificial Sequence
  Description of Artificial Sequence: Synthetic oligonucleotide
  Target: SCN10A; (-) strand; PAM type: NRG; PAM sequence: AAG
tttgccaggcaagtacaatg

SEQ ID NO: 19789 - DNA, 20 bp, Artificial Sequence
  Description of Artificial Sequence: Synthetic oligonucleotide
  Target: SCN10A; (-) strand; PAM type: NRG; PAM sequence: AAG
cagttcaggttttgccaggc

SEQ ID NO: 19790 - DNA, 20 bp, Artificial Sequence
  Description of Artificial Sequence: Synthetic oligonucleotide
  Target: SCN10A; (-) strand; PAM type: NRG; PAM sequence: AGG
ttcacagttcaggttttgcc

SEQ ID NO: 19791 - DNA, 20 bp, Artificial Sequence
  Description of Artificial Sequence: Synthetic oligonucleotide
  Target: SCN10A; (-) strand; PAM type: NRG; PAM sequence: CAG
attcacagttcaggttttgc

SEQ ID NO: 19792 - DNA, 20 bp, Artificial Sequence
  Description of Artificial Sequence: Synthetic oligonucleotide
  Target: SCN10A; (-) strand; PAM type: NRG; PAM sequence: AGG
attgggtctattcacagttc

SEQ ID NO: 19793 - DNA, 20 bp, Artificial Sequence
  Description of Artificial Sequence: Synthetic oligonucleotide
  Target: SCN10A; (-) strand; PAM type: NRG; PAM sequence: CAG
aattgggtctattcacagtt

SEQ ID NO: 19794 - DNA, 20 bp, Artificial Sequence
  Description of Artificial Sequence: Synthetic oligonucleotide
  Target: SCN10A; (-) strand; PAM type: NRG; PAM sequence: CAG
ctacaaattgggtctattca

SEQ ID NO: 19795 - DNA, 20 bp, Artificial Sequence
  Description of Artificial Sequence: Synthetic oligonucleotide
  Target: SCN10A; (-) strand; PAM type: NRG; PAM sequence: GGG
tacagagtagtctacaaatt

SEQ ID NO: 19796 - DNA, 20 bp, Artificial Sequence
  Description of Artificial Sequence: Synthetic oligonucleotide
  Target: SCN10A; (-) strand; PAM type: NRG; PAM sequence: TGG
gtacagagtagtctacaaat

SEQ ID NO: 19797 - DNA, 20 bp, Artificial Sequence
  Description of Artificial Sequence: Synthetic oligonucleotide
  Target: SCN10A; (-) strand; PAM type: NRG; PAM sequence: TAG
ggttgggtgcaagtacagag

SEQ ID NO: 19798 - DNA, 20 bp, Artificial Sequence
  Description of Artificial Sequence: Synthetic oligonucleotide
  Target: SCN10A; (-) strand; PAM type: NRG; PAM sequence: GAG
gctggttgggtgcaagtaca

SEQ ID NO: 19799 - DNA, 20 bp, Artificial Sequence
  Description of Artificial Sequence: Synthetic oligonucleotide
  Target: SCN10A; (-) strand; PAM type: NRG; PAM sequence: CAG
cagctggttgggtgcaagta

SEQ ID NO: 19800 - DNA, 20 bp, Artificial Sequence
  Description of Artificial Sequence: Synthetic oligonucleotide
  Target: SCN10A; (-) strand; PAM type: NRG; PAM sequence: AAG
aggtccagctggttgggtgc

SEQ ID NO: 19801 - DNA, 20 bp, Artificial Sequence
  Description of Artificial Sequence: Synthetic oligonucleotide
  Target: SCN10A; (-) strand; PAM type: NRG; PAM sequence: GGG
ccagccaggtccagctggtt

SEQ ID NO: 19802 - DNA, 20 bp, Artificial Sequence
  Description of Artificial Sequence: Synthetic oligonucleotide
  Target: SCN10A; (-) strand; PAM type: NRG; PAM sequence: TGG
tccagccaggtccagctggt

SEQ ID NO: 19803 - DNA, 20 bp, Artificial Sequence
  Description of Artificial Sequence: Synthetic oligonucleotide
  Target: SCN10A; (-) strand; PAM type: NRG; PAM sequence: TGG
tttttccagccaggtccagc

SEQ ID NO: 19804 - DNA, 20 bp, Artificial Sequence
  Description of Artificial Sequence: Synthetic oligonucleotide
  Target: SCN10A; (-) strand; PAM type: NRG; PAM sequence: CAG
gtattttttccagccaggtc

SEQ ID NO: 19805 - DNA, 20 bp, Artificial Sequence
  Description of Artificial Sequence: Synthetic oligonucleotide
  Target: SCN10A; (-) strand; PAM type: NRG; PAM sequence: AGG
gttgtgtattttttccagcc

SEQ ID NO: 19806 - DNA, 20 bp, Artificial Sequence
  Description of Artificial Sequence: Synthetic oligonucleotide
  Target: SCN10A; (-) strand; PAM type: NRG; PAM sequence: CAG
agttgtgtattttttccagc

SEQ ID NO: 19807 - DNA, 20 bp, Artificial Sequence
  Description of Artificial Sequence: Synthetic oligonucleotide
  Target: SCN10A; (-) strand; PAM type: NRG; PAM sequence: CAG
gcatagttgtgtattttttc

SEQ ID NO: 19808 - DNA, 20 bp, Artificial Sequence
  Description of Artificial Sequence: Synthetic oligonucleotide
  Target: SCN10A; (-) strand; PAM type: NRG; PAM sequence: TAG
tctaggagggttggtaagca

SEQ ID NO: 19809 - DNA, 20 bp, Artificial Sequence
  Description of Artificial Sequence: Synthetic oligonucleotide
  Target: SCN10A; (-) strand; PAM type: NRG; PAM sequence: AAG
agatctctaggagggttggt

SEQ ID NO: 19810 - DNA, 20 bp, Artificial Sequence
  Description of Artificial Sequence: Synthetic oligonucleotide
  Target: SCN10A; (-) strand; PAM type: NRG; PAM sequence: TGG
tcacagatctctaggagggt

SEQ ID NO: 19811 - DNA, 20 bp, Artificial Sequence
  Description of Artificial Sequence: Synthetic oligonucleotide
  Target: SCN10A; (-) strand; PAM type: NRG; PAM sequence: GGG
gggctcacagatctctagga

SEQ ID NO: 19812 - DNA, 20 bp, Artificial Sequence
  Description of Artificial Sequence: Synthetic oligonucleotide
  Target: SCN10A; (-) strand; PAM type: NRG; PAM sequence: AGG
ggggctcacagatctctagg

SEQ ID NO: 19813 - DNA, 20 bp, Artificial Sequence
  Description of Artificial Sequence: Synthetic oligonucleotide
  Target: SCN10A; (-) strand; PAM type: NRG; PAM sequence: GAG
tggggctcacagatctctag

SEQ ID NO: 19814 - DNA, 20 bp, Artificial Sequence
  Description of Artificial Sequence: Synthetic oligonucleotide
  Target: SCN10A; (-) strand; PAM type: NRG; PAM sequence: AGG
gctggggctcacagatctct

SEQ ID NO: 19815 - DNA, 20 bp, Artificial Sequence
  Description of Artificial Sequence: Synthetic oligonucleotide
  Target: SCN10A; (-) strand; PAM type: NRG; PAM sequence: TAG
ggctggggctcacagatctc

SEQ ID NO: 19816 - DNA, 20 bp, Artificial Sequence
  Description of Artificial Sequence: Synthetic oligonucleotide
  Target: SCN10A; (-) strand; PAM type: NRG; PAM sequence: CAG
cagggcaaggctggggctca

SEQ ID NO: 19817 - DNA, 20 bp, Artificial Sequence
  Description of Artificial Sequence: Synthetic oligonucleotide
  Target: SCN10A; (-) strand; PAM type: NRG; PAM sequence: GGG
ttctgggcagggcaaggctg

SEQ ID NO: 19818 - DNA, 20 bp, Artificial Sequence
  Description of Artificial Sequence: Synthetic oligonucleotide
  Target: SCN10A; (-) strand; PAM type: NRG; PAM sequence: GGG
tttctgggcagggcaaggct

SEQ ID NO: 19819 - DNA, 20 bp, Artificial Sequence
  Description of Artificial Sequence: Synthetic oligonucleotide
  Target: SCN10A; (-) strand; PAM type: NRG; PAM sequence: TGG
atttctgggcagggcaaggc

SEQ ID NO: 19820 - DNA, 20 bp, Artificial Sequence
  Description of Artificial Sequence: Synthetic oligonucleotide
  Target: SCN10A; (-) strand; PAM type: NRG; PAM sequence: AGG
ccagatttctgggcagggca

SEQ ID NO: 19821 - DNA, 20 bp, Artificial Sequence
  Description of Artificial Sequence: Synthetic oligonucleotide
  Target: SCN10A; (-) strand; PAM type: NRG; PAM sequence: AAG
gccagatttctgggcagggc

SEQ ID NO: 19822 - DNA, 20 bp, Artificial Sequence
  Description of Artificial Sequence: Synthetic oligonucleotide
  Target: SCN10A; (-) strand; PAM type: NRG; PAM sequence: GGG
cacagccagatttctgggca

SEQ ID NO: 19823 - DNA, 20 bp, Artificial Sequence
  Description of Artificial Sequence: Synthetic oligonucleotide
  Target: SCN10A; (-) strand; PAM type: NRG; PAM sequence: AGG
acacagccagatttctgggc

SEQ ID NO: 19824 - DNA, 20 bp, Artificial Sequence
  Description of Artificial Sequence: Synthetic oligonucleotide
  Target: SCN10A; (-) strand; PAM type: NRG; PAM sequence: CAG
aacacagccagatttctggg

SEQ ID NO: 19825 - DNA, 20 bp, Artificial Sequence
  Description of Artificial Sequence: Synthetic oligonucleotide
  Target: SCN10A; (-) strand; PAM type: NRG; PAM sequence: GGG
agaaacacagccagatttct

SEQ ID NO: 19826 - DNA, 20 bp, Artificial Sequence
  Description of Artificial Sequence: Synthetic oligonucleotide
  Target: SCN10A; (-) strand; PAM type: NRG; PAM sequence: TGG
tagaaacacagccagatttc

SEQ ID NO: 19827 - DNA, 20 bp, Artificial Sequence
  Description of Artificial Sequence: Synthetic oligonucleotide
  Target: SCN10A; (-) strand; PAM type: NRG; PAM sequence: CAG
atataatatagaaacacagc

SEQ ID NO: 19828 - DNA, 20 bp, Artificial Sequence
  Description of Artificial Sequence: Synthetic oligonucleotide
  Target: SCN10A; (-) strand; PAM type: NRG; PAM sequence: CAG
tggaatataatatagaaaca

SEQ ID NO: 19829 - DNA, 20 bp, Artificial Sequence
  Description of Artificial Sequence: Synthetic oligonucleotide
  Target: SCN10A; (-) strand; PAM type: NRG; PAM sequence: TAG
tgaaggaatggaatataata

SEQ ID NO: 19830 - DNA, 20 bp, Artificial Sequence
  Description of Artificial Sequence: Synthetic oligonucleotide
  Target: SCN10A; (-) strand; PAM type: NRG; PAM sequence: TGG
catctggaagaatgaaggaa

SEQ ID NO: 19831 - DNA, 20 bp, Artificial Sequence
  Description of Artificial Sequence: Synthetic oligonucleotide
  Target: SCN10A; (-) strand; PAM type: NRG; PAM sequence: AGG
acagtcatctggaagaatga

SEQ ID NO: 19832 - DNA, 20 bp, Artificial Sequence
  Description of Artificial Sequence: Synthetic oligonucleotide
  Target: SCN10A; (-) strand; PAM type: NRG; PAM sequence: AAG
aacagtcatctggaagaatg

SEQ ID NO: 19833 - DNA, 20 bp, Artificial Sequence
  Description of Artificial Sequence: Synthetic oligonucleotide
  Target: SCN10A; (-) strand; PAM type: NRG; PAM sequence: AAG
agtgagaaacagtcatctgg

SEQ ID NO: 19834 - DNA, 20 bp, Artificial Sequence
  Description of Artificial Sequence: Synthetic oligonucleotide
  Target: SCN10A; (-) strand; PAM type: NRG; PAM sequence: TGG
ggaagtgagaaacagtcatc

SEQ ID NO: 19835 - DNA, 20 bp, Artificial Sequence
  Description of Artificial Sequence: Synthetic oligonucleotide
  Target: SCN10A; (-) strand; PAM type: NRG; PAM sequence: CAG
ggggaagaggaagtgagaaa

SEQ ID NO: 19836 - DNA, 20 bp, Artificial Sequence
  Description of Artificial Sequence: Synthetic oligonucleotide
  Target: SCN10A; (-) strand; PAM type: NRG; PAM sequence: GAG
tagacgggggaagaggaagt

SEQ ID NO: 19837 - DNA, 20 bp, Artificial Sequence
  Description of Artificial Sequence: Synthetic oligonucleotide
  Target: SCN10A; (-) strand; PAM type: NRG; PAM sequence: AAG
aggttagacgggggaagagg

SEQ ID NO: 19838 - DNA, 20 bp, Artificial Sequence
  Description of Artificial Sequence: Synthetic oligonucleotide
  Target: SCN10A; (-) strand; PAM type: NRG; PAM sequence: AGG
cggaggttagacgggggaag

SEQ ID NO: 19839 - DNA, 20 bp, Artificial Sequence
  Description of Artificial Sequence: Synthetic oligonucleotide
  Target: SCN10A; (-) strand; PAM type: NRG; PAM sequence: GAG
ccggaggttagacgggggaa

SEQ ID NO: 19840 - DNA, 20 bp, Artificial Sequence
  Description of Artificial Sequence: Synthetic oligonucleotide
  Target: SCN10A; (-) strand; PAM type: NRG; PAM sequence: AAG
agccggaggttagacggggg

SEQ ID NO: 19841 - DNA, 20 bp, Artificial Sequence
  Description of Artificial Sequence: Synthetic oligonucleotide
  Target: SCN10A; (-) strand; PAM type: NRG; PAM sequence: GGG
aagagccggaggttagacgg

SEQ ID NO: 19842 - DNA, 20 bp, Artificial Sequence
  Description of Artificial Sequence: Synthetic oligonucleotide
  Target: SCN10A; (-) strand; PAM type: NRG; PAM sequence: GGG
gaagagccggaggttagacg

SEQ ID NO: 19843 - DNA, 20 bp, Artificial Sequence
  Description of Artificial Sequence: Synthetic oligonucleotide
  Target: SCN10A; (-) strand; PAM type: NRG; PAM sequence: GGG
agaagagccggaggttagac

SEQ ID NO: 19844 - DNA, 20 bp, Artificial Sequence
  Description of Artificial Sequence: Synthetic oligonucleotide
  Target: SCN10A; (-) strand; PAM type: NRG; PAM sequence: CGG
aagaagagccggaggttaga

SEQ ID NO: 19845 - DNA, 20 bp, Artificial Sequence
  Description of Artificial Sequence: Synthetic oligonucleotide
  Target: SCN10A; (-) strand; PAM type: NRG; PAM sequence: TAG
tagaaagaagagccggaggt

SEQ ID NO: 19846 - DNA, 20 bp, Artificial Sequence
  Description of Artificial Sequence: Synthetic oligonucleotide
  Target: SCN10A; (-) strand; PAM type: NRG; PAM sequence: AGG
taagtagaaagaagagccgg

SEQ ID NO: 19847 - DNA, 20 bp, Artificial Sequence
  Description of Artificial Sequence: Synthetic oligonucleotide
  Target: SCN10A; (-) strand; PAM type: NRG; PAM sequence: GAG
gtaagtagaaagaagagccg

SEQ ID NO: 19848 - DNA, 20 bp, Artificial Sequence
  Description of Artificial Sequence: Synthetic oligonucleotide
  Target: SCN10A; (-) strand; PAM type: NRG; PAM sequence: CGG
gagtaagtagaaagaagagc

SEQ ID NO: 19849 - DNA, 20 bp, Artificial Sequence
  Description of Artificial Sequence: Synthetic oligonucleotide
  Target: SCN10A; (-) strand; PAM type: NRG; PAM sequence: GAG
cagagagtaagtagaaagaa

SEQ ID NO: 19850 - DNA, 20 bp, Artificial Sequence
  Description of Artificial Sequence: Synthetic oligonucleotide
  Target: SCN10A; (-) strand; PAM type: NRG; PAM sequence: AAG
aacagagagtaagtagaaag

SEQ ID NO: 19851 - DNA, 20 bp, Artificial Sequence
  Description of Artificial Sequence: Synthetic oligonucleotide
  Target: SCN10A; (-) strand; PAM type: NRG; PAM sequence: AAG
atcaacagagagtaagtaga

SEQ ID NO: 19852 - DNA, 20 bp, Artificial Sequence
  Description of Artificial Sequence: Synthetic oligonucleotide
  Target: SCN10A; (-) strand; PAM type: NRG; PAM sequence: TAG
gctcatcaacagagagtaag

SEQ ID NO: 19853 - DNA, 20 bp, Artificial Sequence
  Description of Artificial Sequence: Synthetic oligonucleotide
  Target: SCN10A; (-) strand; PAM type: NRG; PAM sequence: AAG
ggagctcatcaacagagagt

SEQ ID NO: 19854 - DNA, 20 bp, Artificial Sequence
  Description of Artificial Sequence: Synthetic oligonucleotide
  Target: SCN10A; (-) strand; PAM type: NRG; PAM sequence: GAG
aaagggagctcatcaacaga

SEQ ID NO: 19855 - DNA, 20 bp, Artificial Sequence
  Description of Artificial Sequence: Synthetic oligonucleotide
  Target: SCN10A; (-) strand; PAM type: NRG; PAM sequence: GAG
taaaagggagctcatcaaca

SEQ ID NO: 19856 - DNA, 20 bp, Artificial Sequence
  Description of Artificial Sequence: Synthetic oligonucleotide
  Target: SCN10A; (-) strand; PAM type: NRG; PAM sequence: CAG
aataaaagggagctcatcaa

SEQ ID NO: 19857 - DNA, 20 bp, Artificial Sequence
  Description of Artificial Sequence: Synthetic oligonucleotide
  Target: SCN10A; (-) strand; PAM type: NRG; PAM sequence: GAG
attctgagtgaaataaaagg

SEQ ID NO: 19858 - DNA, 20 bp, Artificial Sequence
  Description of Artificial Sequence: Synthetic oligonucleotide
  Target: SCN10A; (-) strand; PAM type: NRG; PAM sequence: GGG
atattctgagtgaaataaaa

SEQ ID NO: 19859 - DNA, 20 bp, Artificial Sequence
  Description of Artificial Sequence: Synthetic oligonucleotide
  Target: SCN10A; (-) strand; PAM type: NRG; PAM sequence: AGG
tatattctgagtgaaataaa

SEQ ID NO: 19860 - DNA, 20 bp, Artificial Sequence
  Description of Artificial Sequence: Synthetic oligonucleotide
  Target: SCN10A; (-) strand; PAM type: NRG; PAM sequence: AAG
ctatattctgagtgaaataa

SEQ ID NO: 19861 - DNA, 20 bp, Artificial Sequence
  Description of Artificial Sequence: Synthetic oligonucleotide
  Target: SCN10A; (-) strand; PAM type: NRG; PAM sequence: GAG
tgtgaactagtctatattct

SEQ ID NO: 19862 - DNA, 20 bp, Artificial Sequence
  Description of Artificial Sequence: Synthetic oligonucleotide
  Target: SCN10A; (-) strand; PAM type: NRG; PAM sequence: TAG
ggggaagttcttttgtgaac

SEQ ID NO: 19863 - DNA, 20 bp, Artificial Sequence
  Description of Artificial Sequence: Synthetic oligonucleotide
  Target: SCN10A; (-) strand; PAM type: NRG; PAM sequence: AAG
ttagtggtaggaagaagggg

SEQ ID NO: 19864 - DNA, 20 bp, Artificial Sequence
  Description of Artificial Sequence: Synthetic oligonucleotide
  Target: SCN10A; (-) strand; PAM type: NRG; PAM sequence: GGG
gatttagtggtaggaagaag

SEQ ID NO: 19865 - DNA, 20 bp, Artificial Sequence
  Description of Artificial Sequence: Synthetic oligonucleotide
  Target: SCN10A; (-) strand; PAM type: NRG; PAM sequence: GGG
agatttagtggtaggaagaa

SEQ ID NO: 19866 - DNA, 20 bp, Artificial Sequence
  Description of Artificial Sequence: Synthetic oligonucleotide
  Target: SCN10A; (-) strand; PAM type: NRG; PAM sequence: AGG
gagatttagtggtaggaaga

SEQ ID NO: 19867 - DNA, 20 bp, Artificial Sequence
  Description of Artificial Sequence: Synthetic oligonucleotide
  Target: SCN10A; (-) strand; PAM type: NRG; PAM sequence: AAG
agagatttagtggtaggaag

SEQ ID NO: 19868 - DNA, 20 bp, Artificial Sequence
  Description of Artificial Sequence: Synthetic oligonucleotide
  Target: SCN10A; (-) strand; PAM type: NRG; PAM sequence: AAG
gccagagatttagtggtagg

SEQ ID NO: 19869 - DNA, 20 bp, Artificial Sequence
  Description of Artificial Sequence: Synthetic oligonucleotide
  Target: SCN10A; (-) strand; PAM type: NRG; PAM sequence: AGG
tatgccagagatttagtggt

SEQ ID NO: 19870 - DNA, 20 bp, Artificial Sequence
  Description of Artificial Sequence: Synthetic oligonucleotide
  Target: SCN10A; (-) strand; PAM type: NRG; PAM sequence: TAG
atatgccagagatttagtgg

SEQ ID NO: 19871 - DNA, 20 bp, Artificial Sequence
  Description of Artificial Sequence: Synthetic oligonucleotide
  Target: SCN10A; (-) strand; PAM type: NRG; PAM sequence: TGG
cagatatgccagagatttag

SEQ ID NO: 19872 - DNA, 20 bp, Artificial Sequence
  Description of Artificial Sequence: Synthetic oligonucleotide
  Target: SCN10A; (-) strand; PAM type: NRG; PAM sequence: TAG
ttgcagatatgccagagatt

SEQ ID NO: 19873 - DNA, 20 bp, Artificial Sequence
  Description of Artificial Sequence: Synthetic oligonucleotide
  Target: SCN10A; (-) strand; PAM type: NRG; PAM sequence: GAG
gtggacttgcagatatgcca

SEQ ID NO: 19874 - DNA, 20 bp, Artificial Sequence
  Description of Artificial Sequence: Synthetic oligonucleotide
  Target: SCN10A; (-) strand; PAM type: NRG; PAM sequence: CAG
aggtggacttgcagatatgc

SEQ ID NO: 19875 - DNA, 20 bp, Artificial Sequence
  Description of Artificial Sequence: Synthetic oligonucleotide
  Target: SCN10A; (-) strand; PAM type: NRG; PAM sequence: CAG
cagaataccaggtggacttg

SEQ ID NO: 19876 - DNA, 20 bp, Artificial Sequence
  Description of Artificial Sequence: Synthetic oligonucleotide
  Target: SCN10A; (-) strand; PAM type: NRG; PAM sequence: TGG
cacgaagacagaataccagg

SEQ ID NO: 19877 - DNA, 20 bp, Artificial Sequence
  Description of Artificial Sequence: Synthetic oligonucleotide
  Target: SCN10A; (-) strand; PAM type: NRG; PAM sequence: AGG
gggcacgaagacagaatacc

SEQ ID NO: 19878 - DNA, 20 bp, Artificial Sequence
  Description of Artificial Sequence: Synthetic oligonucleotide
  Target: SCN10A; (-) strand; PAM type: NRG; PAM sequence: CAG
ggggcacgaagacagaatac

SEQ ID NO: 19879 - DNA, 20 bp, Artificial Sequence
  Description of Artificial Sequence: Synthetic oligonucleotide
  Target: SCN10A; (-) strand; PAM type: NRG; PAM sequence: CAG
cactgtgtggggcacgaaga

SEQ ID NO: 19880 - DNA, 20 bp, Artificial Sequence
  Description of Artificial Sequence: Synthetic oligonucleotide
  Target: SCN10A; (-) strand; PAM type: NRG; PAM sequence: AAG
cacgcactgtgtggggcacg

SEQ ID NO: 19881 - DNA, 20 bp, Artificial Sequence
  Description of Artificial Sequence: Synthetic oligonucleotide
  Target: SCN10A; (-) strand; PAM type: NRG; PAM sequence: GGG
agccacccacgcactgtgtg

SEQ ID NO: 19882 - DNA, 20 bp, Artificial Sequence
  Description of Artificial Sequence: Synthetic oligonucleotide
  Target: SCN10A; (-) strand; PAM type: NRG; PAM sequence: GGG
gagccacccacgcactgtgt

SEQ ID NO: 19883 - DNA, 20 bp, Artificial Sequence
  Description of Artificial Sequence: Synthetic oligonucleotide
  Target: SCN10A; (-) strand; PAM type: NRG; PAM sequence: TGG
agagccacccacgcactgtg

SEQ ID NO: 19884 - DNA, 20 bp, Artificial Sequence
  Description of Artificial Sequence: Synthetic oligonucleotide
  Target: SCN10A; (-) strand; PAM type: NRG; PAM sequence: GAG
cggcacaagtgggaggggta

SEQ ID NO: 19885 - DNA, 20 bp, Artificial Sequence
  Description of Artificial Sequence: Synthetic oligonucleotide
  Target: SCN10A; (-) strand; PAM type: NRG; PAM sequence: TAG
cccggcacaagtgggagggg

SEQ ID NO: 19886 - DNA, 20 bp, Artificial Sequence
  Description of Artificial Sequence: Synthetic oligonucleotide
  Target: SCN10A; (-) strand; PAM type: NRG; PAM sequence: GGG
gagcccggcacaagtgggag

SEQ ID NO: 19887 - DNA, 20 bp, Artificial Sequence
  Description of Artificial Sequence: Synthetic oligonucleotide
  Target: SCN10A; (-) strand; PAM type: NRG; PAM sequence: GGG
agagcccggcacaagtggga

SEQ ID NO: 19888 - DNA, 20 bp, Artificial Sequence
  Description of Artificial Sequence: Synthetic oligonucleotide
  Target: SCN10A; (-) strand; PAM type: NRG; PAM sequence: AGG
aagagcccggcacaagtggg

SEQ ID NO: 19889 - DNA, 20 bp, Artificial Sequence
  Description of Artificial Sequence: Synthetic oligonucleotide
  Target: SCN10A; (-) strand; PAM type: NRG; PAM sequence: GAG
aaagagcccggcacaagtgg

SEQ ID NO: 19890 - DNA, 20 bp, Artificial Sequence
  Description of Artificial Sequence: Synthetic oligonucleotide
  Target: SCN10A; (-) strand; PAM type: NRG; PAM sequence: GGG
ggaaagagcccggcacaagt

SEQ ID NO: 19891 - DNA, 20 bp, Artificial Sequence
  Description of Artificial Sequence: Synthetic oligonucleotide
  Target: SCN10A; (-) strand; PAM type: NRG; PAM sequence: TGG
aggaaagagcccggcacaag

SEQ ID NO: 19892 - DNA, 20 bp, Artificial Sequence
  Description of Artificial Sequence: Synthetic oligonucleotide
  Target: SCN10A; (-) strand; PAM type: NRG; PAM sequence: AAG
gagaggaaagagcccggcac

SEQ ID NO: 19893 - DNA, 20 bp, Artificial Sequence
  Description of Artificial Sequence: Synthetic oligonucleotide
  Target: SCN10A; (-) strand; PAM type: NRG; PAM sequence: CGG
aggtgggagaggaaagagcc

SEQ ID NO: 19894 - DNA, 20 bp, Artificial Sequence
  Description of Artificial Sequence: Synthetic oligonucleotide
  Target: SCN10A; (-) strand; PAM type: NRG; PAM sequence: GAG
tgaataggtgggagaggaaa

SEQ ID NO: 19895 - DNA, 20 bp, Artificial Sequence
  Description of Artificial Sequence: Synthetic oligonucleotide
  Target: SCN10A; (-) strand; PAM type: NRG; PAM sequence: AAG
cttgaataggtgggagagga

SEQ ID NO: 19896 - DNA, 20 bp, Artificial Sequence
  Description of Artificial Sequence: Synthetic oligonucleotide
  Target: SCN10A; (-) strand; PAM type: NRG; PAM sequence: AGG
aggccttgaataggtgggag

SEQ ID NO: 19897 - DNA, 20 bp, Artificial Sequence
  Description of Artificial Sequence: Synthetic oligonucleotide
  Target: SCN10A; (-) strand; PAM type: NRG; PAM sequence: GAG
caggccttgaataggtggga

SEQ ID NO: 19898 - DNA, 20 bp, Artificial Sequence
  Description of Artificial Sequence: Synthetic oligonucleotide
  Target: SCN10A; (-) strand; PAM type: NRG; PAM sequence: GAG
tgcaggccttgaataggtgg

SEQ ID NO: 19899 - DNA, 20 bp, Artificial Sequence
  Description of Artificial Sequence: Synthetic oligonucleotide
  Target: SCN10A; (-) strand; PAM type: NRG; PAM sequence: GGG
gatgcaggccttgaataggt

SEQ ID NO: 19900 - DNA, 20 bp, Artificial Sequence
  Description of Artificial Sequence: Synthetic oligonucleotide
  Target: SCN10A; (-) strand; PAM type: NRG; PAM sequence: TGG
tgatgcaggccttgaatagg

SEQ ID NO: 19901 - DNA, 20 bp, Artificial Sequence
  Description of Artificial Sequence: Synthetic oligonucleotide
  Target: SCN10A; (-) strand; PAM type: NRG; PAM sequence: AGG
ggatgatgcaggccttgaat

SEQ ID NO: 19902 - DNA, 20 bp, Artificial Sequence
  Description of Artificial Sequence: Synthetic oligonucleotide
  Target: SCN10A; (-) strand; PAM type: NRG; PAM sequence: TAG
tggatgatgcaggccttgaa

SEQ ID NO: 19903 - DNA, 20 bp, Artificial Sequence
  Description of Artificial Sequence: Synthetic oligonucleotide
  Target: SCN10A; (-) strand; PAM type: NRG; PAM sequence: AGG
gagacaggtctggatgatgc

SEQ ID NO: 19904 - DNA, 20 bp, Artificial Sequence
  Description of Artificial Sequence: Synthetic oligonucleotide
  Target: SCN10A; (-) strand; PAM type: NRG; PAM sequence: CAG
ggagacaggtctggatgatg

SEQ ID NO: 19905 - DNA, 20 bp, Artificial Sequence
  Description of Artificial Sequence: Synthetic oligonucleotide
  Target: SCN10A; (-) strand; PAM type: NRG; PAM sequence: TGG
gtctggaagggagacaggtc

SEQ ID NO: 19906 - DNA, 20 bp, Artificial Sequence
  Description of Artificial Sequence: Synthetic oligonucleotide
  Target: SCN10A; (-) strand; PAM type: NRG; PAM sequence: AGG
caatggtctggaagggagac

SEQ ID NO: 19907 - DNA, 20 bp, Artificial Sequence
  Description of Artificial Sequence: Synthetic oligonucleotide
  Target: SCN10A; (-) strand; PAM type: NRG; PAM sequence: CAG
gcaatggtctggaagggaga

SEQ ID NO: 19908 - DNA, 20 bp, Artificial Sequence
  Description of Artificial Sequence: Synthetic oligonucleotide
  Target: SCN10A; (-) strand; PAM type: NRG; PAM sequence: GAG
catggcaatggtctggaagg

SEQ ID NO: 19909 - DNA, 20 bp, Artificial Sequence
  Description of Artificial Sequence: Synthetic oligonucleotide
  Target: SCN10A; (-) strand; PAM type: NRG; PAM sequence: GGG
ctcatggcaatggtctggaa

SEQ ID NO: 19910 - DNA, 20 bp, Artificial Sequence
  Description of Artificial Sequence: Synthetic oligonucleotide
  Target: SCN10A; (-) strand; PAM type: NRG; PAM sequence: AGG
gctcatggcaatggtctgga

SEQ ID NO: 19911 - DNA, 20 bp, Artificial Sequence
  Description of Artificial Sequence: Synthetic oligonucleotide
  Target: SCN10A; (-) strand; PAM type: NRG; PAM sequence: AAG
tgctcatggcaatggtctgg

SEQ ID NO: 19912 - DNA, 20 bp, Artificial Sequence
  Description of Artificial Sequence: Synthetic oligonucleotide
  Target: SCN10A; (-) strand; PAM type: NRG; PAM sequence: TGG
acctgctcatggcaatggtc

SEQ ID NO: 19913 - DNA, 20 bp, Artificial Sequence
  Description of Artificial Sequence: Synthetic oligonucleotide
  Target: SCN10A; (-) strand; PAM type: NRG; PAM sequence: TGG
tgtttacctgctcatggcaa

SEQ ID NO: 19914 - DNA, 20 bp, Artificial Sequence
  Description of Artificial Sequence: Synthetic oligonucleotide
  Target: SCN10A; (-) strand; PAM type: NRG; PAM sequence: TGG
aaagcatgtttacctgctca

SEQ ID NO: 19915 - DNA, 20 bp, Artificial Sequence
  Description of Artificial Sequence: Synthetic oligonucleotide
  Target: SCN10A; (-) strand; PAM type: NRG; PAM sequence: AAG
tcaaagccgcgagataatta

SEQ ID NO: 19916 - DNA, 20 bp, Artificial Sequence
  Description of Artificial Sequence: Synthetic oligonucleotide
  Target: SCN10A; (-) strand; PAM type: NRG; PAM sequence: GAG
agagactttttcaaagccgc

SEQ ID NO: 19917 - DNA, 20 bp, Artificial Sequence
  Description of Artificial Sequence: Synthetic oligonucleotide
  Target: SCN10A; (-) strand; PAM type: NRG; PAM sequence: AAG
ggtccagagagactttttca

SEQ ID NO: 19918 - DNA, 20 bp, Artificial Sequence
  Description of Artificial Sequence: Synthetic oligonucleotide
  Target: SCN10A; (-) strand; PAM type: NRG; PAM sequence: GAG
aagagagcatggggtccaga

SEQ ID NO: 19919 - DNA, 20 bp, Artificial Sequence
  Description of Artificial Sequence: Synthetic oligonucleotide
  Target: SCN10A; (-) strand; PAM type: NRG; PAM sequence: GAG
gaaagagagcatggggtcca

SEQ ID NO: 19920 - DNA, 20 bp, Artificial Sequence
  Description of Artificial Sequence: Synthetic oligonucleotide
  Target: SCN10A; (-) strand; PAM type: NRG; PAM sequence: CAG
atgaaagagagcatggggtc

SEQ ID NO: 19921 - DNA, 20 bp, Artificial Sequence
  Description of Artificial Sequence: Synthetic oligonucleotide
  Target: SCN10A; (-) strand; PAM type: NRG; PAM sequence: GGG
cagtaatgaaagagagcatg

SEQ ID NO: 19922 - DNA, 20 bp, Artificial Sequence
  Description of Artificial Sequence: Synthetic oligonucleotide
  Target: SCN10A; (-) strand; PAM type: NRG; PAM sequence: GGG
gcagtaatgaaagagagcat

SEQ ID NO: 19923 - DNA, 20 bp, Artificial Sequence
  Description of Artificial Sequence: Synthetic oligonucleotide
  Target: SCN10A; (-) strand; PAM type: NRG; PAM sequence: TGG
agcagtaatgaaagagagca

SEQ ID NO: 19924 - DNA, 20 bp, Artificial Sequence
  Description of Artificial Sequence: Synthetic oligonucleotide
  Target: SCN10A; (-) strand; PAM type: NRG; PAM sequence: GAG
aaagaagcagtaatgaaaga

SEQ ID NO: 19925 - DNA, 20 bp, Artificial Sequence
  Description of Artificial Sequence: Synthetic oligonucleotide
  Target: SCN10A; (-) strand; PAM type: NRG; PAM sequence: GAG
tcaaagaagcagtaatgaaa

SEQ ID NO: 19926 - DNA, 20 bp, Artificial Sequence
  Description of Artificial Sequence: Synthetic oligonucleotide
  Target: SCN10A; (-) strand; PAM type: NRG; PAM sequence: AAG
tgtcaaagaagcagtaatga

SEQ ID NO: 19927 - DNA, 20 bp, Artificial Sequence
  Description of Artificial Sequence: Synthetic oligonucleotide
  Target: SCN10A; (-) strand; PAM type: NRG; PAM sequence: CAG
gaattttactgtcaaagaag

SEQ ID NO: 19928 - DNA, 20 bp, Artificial Sequence
  Description of Artificial Sequence: Synthetic oligonucleotide
  Target: SCN10A; (-) strand; PAM type: NRG; PAM sequence: AAG
aaggaattttactgtcaaag

SEQ ID NO: 19929 - DNA, 20 bp, Artificial Sequence
  Description of Artificial Sequence: Synthetic oligonucleotide
  Target: SCN10A; (-) strand; PAM type: NRG; PAM sequence: AAG
tgcaaggaattttactgtca

SEQ ID NO: 19930 - DNA, 20 bp, Artificial Sequence
  Description of Artificial Sequence: Synthetic oligonucleotide
  Target: SCN10A; (-) strand; PAM type: NRG; PAM sequence: AGG
aagtgtagaaaactcttgca

SEQ ID NO: 19931 - DNA, 20 bp, Artificial Sequence
  Description of Artificial Sequence: Synthetic oligonucleotide
  Target: SCN10A; (-) strand; PAM type: NRG; PAM sequence: AAG
taagtgtagaaaactcttgc

SEQ ID NO: 19932 - DNA, 20 bp, Artificial Sequence
  Description of Artificial Sequence: Synthetic oligonucleotide
  Target: SCN10A; (-) strand; PAM type: NRG; PAM sequence: TAG
gagctgtagaaggttaagtg

SEQ ID NO: 19933 - DNA, 20 bp, Artificial Sequence
  Description of Artificial Sequence: Synthetic oligonucleotide
  Target: SCN10A; (-) strand; PAM type: NRG; PAM sequence: AAG
gtaaggagctgtagaaggtt

SEQ ID NO: 19934 - DNA, 20 bp, Artificial Sequence
  Description of Artificial Sequence: Synthetic oligonucleotide
  Target: SCN10A; (-) strand; PAM type: NRG; PAM sequence: AGG
aagaggtaaggagctgtaga

SEQ ID NO: 19935 - DNA, 20 bp, Artificial Sequence
  Description of Artificial Sequence: Synthetic oligonucleotide
  Target: SCN10A; (-) strand; PAM type: NRG; PAM sequence: AAG
aaagaggtaaggagctgtag

SEQ ID NO: 19936 - DNA, 20 bp, Artificial Sequence
  Description of Artificial Sequence: Synthetic oligonucleotide
  Target: SCN10A; (-) strand; PAM type: NRG; PAM sequence: TAG
aaaaaagaggtaaggagctg

SEQ ID NO: 19937 - DNA, 20 bp, Artificial Sequence
  Description of Artificial Sequence: Synthetic oligonucleotide
  Target: SCN10A; (-) strand; PAM type: NRG; PAM sequence: GAG
cagagaaaaaaagaggtaag

SEQ ID NO: 19938 - DNA, 20 bp, Artificial Sequence
  Description of Artificial Sequence: Synthetic oligonucleotide
  Target: SCN10A; (-) strand; PAM type: NRG; PAM sequence: AGG
tgcagagaaaaaaagaggta

SEQ ID NO: 19939 - DNA, 20 bp, Artificial Sequence
  Description of Artificial Sequence: Synthetic oligonucleotide
  Target: SCN10A; (-) strand; PAM type: NRG; PAM sequence: AAG
ctgcagagaaaaaaagaggt

SEQ ID NO: 19940 - DNA, 20 bp, Artificial Sequence
  Description of Artificial Sequence: Synthetic oligonucleotide
  Target: SCN10A; (-) strand; PAM type: NRG; PAM sequence: AGG
ggggctgcagagaaaaaaag

SEQ ID NO: 19941 - DNA, 20 bp, Artificial Sequence
  Description of Artificial Sequence: Synthetic oligonucleotide
  Target: SCN10A; (-) strand; PAM type: NRG; PAM sequence: GAG
aggggctgcagagaaaaaaa

SEQ ID NO: 19942 - DNA, 20 bp, Artificial Sequence
  Description of Artificial Sequence: Synthetic oligonucleotide
  Target: SCN10A; (-) strand; PAM type: NRG; PAM sequence: AAG
ccaggggctgcagagaaaaa

SEQ ID NO: 19943 - DNA, 20 bp, Artificial Sequence
  Description of Artificial Sequence: Synthetic oligonucleotide
  Target: SCN10A; (-) strand; PAM type: NRG; PAM sequence: GAG
gtcagattccaggggctgca

SEQ ID NO: 19944 - DNA, 20 bp, Artificial Sequence
  Description of Artificial Sequence: Synthetic oligonucleotide
  Target: SCN10A; (-) strand; PAM type: NRG; PAM sequence: CAG
aagtcagattccaggggctg

SEQ ID NO: 19945 - DNA, 20 bp, Artificial Sequence
  Description of Artificial Sequence: Synthetic oligonucleotide
  Target: SCN10A; (-) strand; PAM type: NRG; PAM sequence: GGG
cagttaaagtcagattccag

SEQ ID NO: 19946 - DNA, 20 bp, Artificial Sequence
  Description of Artificial Sequence: Synthetic oligonucleotide
  Target: SCN10A; (-) strand; PAM type: NRG; PAM sequence: GGG
gcagttaaagtcagattcca

SEQ ID NO: 19947 - DNA, 20 bp, Artificial Sequence
  Description of Artificial Sequence: Synthetic oligonucleotide
  Target: SCN10A; (-) strand; PAM type: NRG; PAM sequence: AGG
agcagttaaagtcagattcc

SEQ ID NO: 19948 - DNA, 20 bp, Artificial Sequence
  Description of Artificial Sequence: Synthetic oligonucleotide
  Target: SCN10A; (-) strand; PAM type: NRG; PAM sequence: CAG
aagcagttaaagtcagattc

SEQ ID NO: 19949 - DNA, 20 bp, Artificial Sequence
  Description of Artificial Sequence: Synthetic oligonucleotide
  Target: SCN10A; (-) strand; PAM type: NRG; PAM sequence: CAG
aatttggaagcagttaaagt

SEQ ID NO: 19950 - DNA, 20 bp, Artificial Sequence
  Description of Artificial Sequence: Synthetic oligonucleotide
  Target: SCN10A; (-) strand; PAM type: NRG; PAM sequence: AAG
tttgaatttggaagcagtta

SEQ ID NO: 19951 - DNA, 20 bp, Artificial Sequence
  Description of Artificial Sequence: Synthetic oligonucleotide
  Target: SCN10A; (-) strand; PAM type: NRG; PAM sequence: CAG
caattatttgaatttggaag

SEQ ID NO: 19952 - DNA, 20 bp, Artificial Sequence
  Description of Artificial Sequence: Synthetic oligonucleotide
  Target: SCN10A; (-) strand; PAM type: NRG; PAM sequence: AAG
aatcaattatttgaatttgg

SEQ ID NO: 19953 - DNA, 20 bp, Artificial Sequence
  Description of Artificial Sequence: Synthetic oligonucleotide
  Target: SCN10A; (-) strand; PAM type: NRG; PAM sequence: TGG
ggaaatcaattatttgaatt

SEQ ID NO: 19954 - DNA, 20 bp, Artificial Sequence
  Description of Artificial Sequence: Synthetic oligonucleotide
  Target: SCN10A; (-) strand; PAM type: NRG; PAM sequence: TGG
tataagggtaagatgagaac

SEQ ID NO: 19955 - DNA, 20 bp, Artificial Sequence
  Description of Artificial Sequence: Synthetic oligonucleotide
  Target: SCN10A; (-) strand; PAM type: NRG; PAM sequence: GAG
aaatgttataagggtaagat

SEQ ID NO: 19956 - DNA, 20 bp, Artificial Sequence
  Description of Artificial Sequence: Synthetic oligonucleotide
  Target: SCN10A; (-) strand; PAM type: NRG; PAM sequence: AAG
ctgtcaaatgttataagggt

SEQ ID NO: 19957 - DNA, 20 bp, Artificial Sequence
  Description of Artificial Sequence: Synthetic oligonucleotide
  Target: SCN10A; (-) strand; PAM type: NRG; PAM sequence: GGG
aattctgtcaaatgttataa

SEQ ID NO: 19958 - DNA, 20 bp, Artificial Sequence
  Description of Artificial Sequence: Synthetic oligonucleotide
  Target: SCN10A; (-) strand; PAM type: NRG; PAM sequence: AGG
aaattctgtcaaatgttata

SEQ ID NO: 19959 - DNA, 20 bp, Artificial Sequence
  Description of Artificial Sequence: Synthetic oligonucleotide
  Target: SCN10A; (-) strand; PAM type: NRG; PAM sequence: AAG
taaattctgtcaaatgttat

SEQ ID NO: 19960 - DNA, 20 bp, Artificial Sequence
  Description of Artificial Sequence: Synthetic oligonucleotide
  Target: SCN10A; (-) strand; PAM type: NRG; PAM sequence: GAG
aaatgaacactggtttcaaa

SEQ ID NO: 19961 - DNA, 20 bp, Artificial Sequence
  Description of Artificial Sequence: Synthetic oligonucleotide
  Target: SCN10A; (-) strand; PAM type: NRG; PAM sequence: AAG
ccaaatgaacactggtttca

SEQ ID NO: 19962 - DNA, 20 bp, Artificial Sequence
  Description of Artificial Sequence: Synthetic oligonucleotide
  Target: SCN10A; (-) strand; PAM type: NRG; PAM sequence: TGG
ccccagagccaaatgaacac

SEQ ID NO: 19963 - DNA, 20 bp, Artificial Sequence
  Description of Artificial Sequence: Synthetic oligonucleotide
  Target: SCN10A; (-) strand; PAM type: NRG; PAM sequence: GAG
aagagatgatgcagtcccca

SEQ ID NO: 19964 - DNA, 20 bp, Artificial Sequence
  Description of Artificial Sequence: Synthetic oligonucleotide
  Target: SCN10A; (-) strand; PAM type: NRG; PAM sequence: CAG
gcaagagatgatgcagtccc

SEQ ID NO: 19965 - DNA, 20 bp, Artificial Sequence
  Description of Artificial Sequence: Synthetic oligonucleotide
  Target: SCN10A; (-) strand; PAM type: NRG; PAM sequence: CAG
agaaaaagcaagagatgatg

SEQ ID NO: 19966 - DNA, 20 bp, Artificial Sequence
  Description of Artificial Sequence: Synthetic oligonucleotide
  Target: SCN10A; (-) strand; PAM type: NRG; PAM sequence: GAG
aaatatgggagaaaaagcaa

SEQ ID NO: 19967 - DNA, 20 bp, Artificial Sequence
  Description of Artificial Sequence: Synthetic oligonucleotide
  Target: SCN10A; (-) strand; PAM type: NRG; PAM sequence: AAG
agaaatatgggagaaaaagc

SEQ ID NO: 19968 - DNA, 20 bp, Artificial Sequence
  Description of Artificial Sequence: Synthetic oligonucleotide
  Target: SCN10A; (-) strand; PAM type: NRG; PAM sequence: AAG
gtggagaaatatgggagaaa

SEQ ID NO: 19969 - DNA, 20 bp, Artificial Sequence
  Description of Artificial Sequence: Synthetic oligonucleotide
  Target: SCN10A; (-) strand; PAM type: NRG; PAM sequence: GAG
aaagaagtggagaaatatgg

SEQ ID NO: 19970 - DNA, 20 bp, Artificial Sequence
  Description of Artificial Sequence: Synthetic oligonucleotide
  Target: SCN10A; (-) strand; PAM type: NRG; PAM sequence: GGG
gaaaagaagtggagaaatat

SEQ ID NO: 19971 - DNA, 20 bp, Artificial Sequence
  Description of Artificial Sequence: Synthetic oligonucleotide
  Target: SCN10A; (-) strand; PAM type: NRG; PAM sequence: TGG
tgaaaagaagtggagaaata

SEQ ID NO: 19972 - DNA, 20 bp, Artificial Sequence
  Description of Artificial Sequence: Synthetic oligonucleotide
  Target: SCN10A; (-) strand; PAM type: NRG; PAM sequence: GAG
acagaaagtgaaaagaagtg

SEQ ID NO: 19973 - DNA, 20 bp, Artificial Sequence
  Description of Artificial Sequence: Synthetic oligonucleotide
  Target: SCN10A; (-) strand; PAM type: NRG; PAM sequence: TGG
aaacagaaagtgaaaagaag

SEQ ID NO: 19974 - DNA, 20 bp, Artificial Sequence
  Description of Artificial Sequence: Synthetic oligonucleotide
  Target: SCN10A; (-) strand; PAM type: NRG; PAM sequence: AAG
caaaaacagaaagtgaaaag

SEQ ID NO: 19975 - DNA, 20 bp, Artificial Sequence
  Description of Artificial Sequence: Synthetic oligonucleotide
  Target: SCN10A; (-) strand; PAM type: NRG; PAM sequence: AAG
agacaaaaacagaaagtgaa

SEQ ID NO: 19976 - DNA, 20 bp, Artificial Sequence
  Description of Artificial Sequence: Synthetic oligonucleotide
  Target: SCN10A; (-) strand; PAM type: NRG; PAM sequence: AAG
aaaagggagacaaaaacaga

SEQ ID NO: 19977 - DNA, 20 bp, Artificial Sequence
  Description of Artificial Sequence: Synthetic oligonucleotide
  Target: SCN10A; (-) strand; PAM type: NRG; PAM sequence: CAG
aaggaaaagggagacaaaaa

SEQ ID NO: 19978 - DNA, 20 bp, Artificial Sequence
  Description of Artificial Sequence: Synthetic oligonucleotide
  Target: SCN10A; (-) strand; PAM type: NRG; PAM sequence: GAG
acaagcaggaaaggaaaagg

SEQ ID NO: 19979 - DNA, 20 bp, Artificial Sequence
  Description of Artificial Sequence: Synthetic oligonucleotide
  Target: SCN10A; (-) strand; PAM type: NRG; PAM sequence: GGG
ttacaagcaggaaaggaaaa

SEQ ID NO: 19980 - DNA, 20 bp, Artificial Sequence
  Description of Artificial Sequence: Synthetic oligonucleotide
  Target: SCN10A; (-) strand; PAM type: NRG; PAM sequence: AGG
tttacaagcaggaaaggaaa

SEQ ID NO: 19981 - DNA, 20 bp, Artificial Sequence
  Description of Artificial Sequence: Synthetic oligonucleotide
  Target: SCN10A; (-) strand; PAM type: NRG; PAM sequence: AAG
atttacaagcaggaaaggaa

SEQ ID NO: 19982 - DNA, 20 bp, Artificial Sequence
  Description of Artificial Sequence: Synthetic oligonucleotide
  Target: SCN10A; (-) strand; PAM type: NRG; PAM sequence: AGG
tcaacatttacaagcaggaa

SEQ ID NO: 19983 - DNA, 20 bp, Artificial Sequence
  Description of Artificial Sequence: Synthetic oligonucleotide
  Target: SCN10A; (-) strand; PAM type: NRG; PAM sequence: AAG
ttcaacatttacaagcagga

SEQ ID NO: 19984 - DNA, 20 bp, Artificial Sequence
  Description of Artificial Sequence: Synthetic oligonucleotide
  Target: SCN10A; (-) strand; PAM type: NRG; PAM sequence: AGG
gttattcaacatttacaagc

SEQ ID NO: 19985 - DNA, 20 bp, Artificial Sequence
  Description of Artificial Sequence: Synthetic oligonucleotide
  Target: SCN10A; (-) strand; PAM type: NRG; PAM sequence: CAG
agttattcaacatttacaag

SEQ ID NO: 19986 - DNA, 20 bp, Artificial Sequence
  Description of Artificial Sequence: Synthetic oligonucleotide
  Target: SCN10A; (-) strand; PAM type: NRG; PAM sequence: AAG
ttgagttattcaacatttac

SEQ ID NO: 19987 - DNA, 20 bp, Artificial Sequence
  Description of Artificial Sequence: Synthetic oligonucleotide
  Target: SCN10A; (-) strand; PAM type: NRG; PAM sequence: GAG
aagctaaggtgagaatgctt

SEQ ID NO: 19988 - DNA, 20 bp, Artificial Sequence
  Description of Artificial Sequence: Synthetic oligonucleotide
  Target: SCN10A; (-) strand; PAM type: NRG; PAM sequence: GAG
aaacacagagaagctaaggt

SEQ ID NO: 19989 - DNA, 20 bp, Artificial Sequence
  Description of Artificial Sequence: Synthetic oligonucleotide
  Target: SCN10A; (-) strand; PAM type: NRG; PAM sequence: AGG
tcaaaaacacagagaagcta

SEQ ID NO: 19990 - DNA, 20 bp, Artificial Sequence
  Description of Artificial Sequence: Synthetic oligonucleotide
  Target: SCN10A; (-) strand; PAM type: NRG; PAM sequence: AAG
ttcaaaaacacagagaagct

SEQ ID NO: 19991 - DNA, 20 bp, Artificial Sequence
  Description of Artificial Sequence: Synthetic oligonucleotide
  Target: SCN10A; (-) strand; PAM type: NRG; PAM sequence: AAG
tgagattcaaaaacacagag

SEQ ID NO: 19992 - DNA, 20 bp, Artificial Sequence
  Description of Artificial Sequence: Synthetic oligonucleotide
  Target: SCN10A; (-) strand; PAM type: NRG; PAM sequence: GAG
ctatgagattcaaaaacaca

SEQ ID NO: 19993 - DNA, 20 bp, Artificial Sequence
  Description of Artificial Sequence: Synthetic oligonucleotide
  Target: SCN10A; (-) strand; PAM type: NRG; PAM sequence: CAG
ggctatgagattcaaaaaca

SEQ ID NO: 19994 - DNA, 20 bp, Artificial Sequence
  Description of Artificial Sequence: Synthetic oligonucleotide
  Target: SCN10A; (-) strand; PAM type: NRG; PAM sequence: GAG
agatggttttttagggctat

SEQ ID NO: 19995 - DNA, 20 bp, Artificial Sequence
  Description of Artificial Sequence: Synthetic oligonucleotide
  Target: SCN10A; (-) strand; PAM type: NRG; PAM sequence: GGG
ggcatagagatggtttttta

SEQ ID NO: 19996 - DNA, 20 bp, Artificial Sequence
  Description of Artificial Sequence: Synthetic oligonucleotide
  Target: SCN10A; (-) strand; PAM type: NRG; PAM sequence: AGG
tggcatagagatggtttttt

SEQ ID NO: 19997 - DNA, 20 bp, Artificial Sequence
  Description of Artificial Sequence: Synthetic oligonucleotide
  Target: SCN10A; (-) strand; PAM type: NRG; PAM sequence: TAG
ttggcatagagatggttttt

SEQ ID NO: 19998 - DNA, 20 bp, Artificial Sequence
  Description of Artificial Sequence: Synthetic oligonucleotide
  Target: SCN10A; (-) strand; PAM type: NRG; PAM sequence: TGG
ggtgggaattggcatagaga

SEQ ID NO: 19999 - DNA, 20 bp, Artificial Sequence
  Description of Artificial Sequence: Synthetic oligonucleotide
  Target: SCN10A; (-) strand; PAM type: NRG; PAM sequence: GAG
atttggtgggaattggcata

SEQ ID NO: 20000 - DNA, 20 bp, Artificial Sequence
  Description of Artificial Sequence: Synthetic oligonucleotide
  Target: SCN10A; (-) strand; PAM type: NRG; PAM sequence: TAG
taatttggtgggaattggca

SEQ ID NO: 20001 - DNA, 20 bp, Artificial Sequence
  Description of Artificial Sequence: Synthetic oligonucleotide
  Target: SCN10A; (-) strand; PAM type: NRG; PAM sequence: TGG
acacataatttggtgggaat

SEQ ID NO: 20002 - DNA, 20 bp, Artificial Sequence
  Description of Artificial Sequence: Synthetic oligonucleotide
  Target: SCN10A; (-) strand; PAM type: NRG; PAM sequence: GGG
aattggacacataatttggt

SEQ ID NO: 20003 - DNA, 20 bp, Artificial Sequence
  Description of Artificial Sequence: Synthetic oligonucleotide
  Target: SCN10A; (-) strand; PAM type: NRG; PAM sequence: TGG
aaattggacacataatttgg

SEQ ID NO: 20004 - DNA, 20 bp, Artificial Sequence
  Description of Artificial Sequence: Synthetic oligonucleotide
  Target: SCN10A; (-) strand; PAM type: NRG; PAM sequence: TGG
cagaaattggacacataatt

SEQ ID NO: 20005 - DNA, 20 bp, Artificial Sequence
  Description of Artificial Sequence: Synthetic oligonucleotide
  Target: SCN10A; (-) strand; PAM type: NRG; PAM sequence: TGG
ttcaggaagggatcagaaat

SEQ ID NO: 20006 - DNA, 20 bp, Artificial Sequence
  Description of Artificial Sequence: Synthetic oligonucleotide
  Target: SCN10A; (-) strand; PAM type: NRG; PAM sequence: CAG
cctagtgttcaggaagggat

SEQ ID NO: 20007 - DNA, 20 bp, Artificial Sequence
  Description of Artificial Sequence: Synthetic oligonucleotide
  Target: SCN10A; (-) strand; PAM type: NRG; PAM sequence: GGG
ataagcctagtgttcaggaa

SEQ ID NO: 20008 - DNA, 20 bp, Artificial Sequence
  Description of Artificial Sequence: Synthetic oligonucleotide
  Target: SCN10A; (-) strand; PAM type: NRG; PAM sequence: AGG
gataagcctagtgttcagga

SEQ ID NO: 20009 - DNA, 20 bp, Artificial Sequence
  Description of Artificial Sequence: Synthetic oligonucleotide
  Target: SCN10A; (-) strand; PAM type: NRG; PAM sequence: AAG
agataagcctagtgttcagg

SEQ ID NO: 20010 - DNA, 20 bp, Artificial Sequence
  Description of Artificial Sequence: Synthetic oligonucleotide
  Target: SCN10A; (-) strand; PAM type: NRG; PAM sequence: AGG
gagagataagcctagtgttc

SEQ ID NO: 20011 - DNA, 20 bp, Artificial Sequence
  Description of Artificial Sequence: Synthetic oligonucleotide
  Target: SCN10A; (-) strand; PAM type: NRG; PAM sequence: CAG
agagagataagcctagtgtt

SEQ ID NO: 20012 - DNA, 20 bp, Artificial Sequence
  Description of Artificial Sequence: Synthetic oligonucleotide
  Target: SCN10A; (-) strand; PAM type: NRG; PAM sequence: TAG
ggcaggtagagagataagcc

SEQ ID NO: 20013 - DNA, 20 bp, Artificial Sequence
  Description of Artificial Sequence: Synthetic oligonucleotide
  Target: SCN10A; (-) strand; PAM type: NRG; PAM sequence: AAG
acggaggcaggtagagagat

SEQ ID NO: 20014 - DNA, 20 bp, Artificial Sequence
  Description of Artificial Sequence: Synthetic oligonucleotide
  Target: SCN10A; (-) strand; PAM type: NRG; PAM sequence: GAG
atttaacggaggcaggtaga

SEQ ID NO: 20015 - DNA, 20 bp, Artificial Sequence
  Description of Artificial Sequence: Synthetic oligonucleotide
  Target: SCN10A; (-) strand; PAM type: NRG; PAM sequence: GAG
agatttaacggaggcaggta

SEQ ID NO: 20016 - DNA, 20 bp, Artificial Sequence
  Description of Artificial Sequence: Synthetic oligonucleotide
  Target: SCN10A; (-) strand; PAM type: NRG; PAM sequence: TAG
ggagatttaacggaggcagg

SEQ ID NO: 20017 - DNA, 20 bp, Artificial Sequence
  Description of Artificial Sequence: Synthetic oligonucleotide
  Target: SCN10A; (-) strand; PAM type: NRG; PAM sequence: AGG
catggagatttaacggaggc

SEQ ID NO: 20018 - DNA, 20 bp, Artificial Sequence
  Description of Artificial Sequence: Synthetic oligonucleotide
  Target: SCN10A; (-) strand; PAM type: NRG; PAM sequence: CAG
acatggagatttaacggagg

SEQ ID NO: 20019 - DNA, 20 bp, Artificial Sequence
  Description of Artificial Sequence: Synthetic oligonucleotide
  Target: SCN10A; (-) strand; PAM type: NRG; PAM sequence: AGG
tccacatggagatttaacgg

SEQ ID NO: 20020 - DNA, 20 bp, Artificial Sequence
  Description of Artificial Sequence: Synthetic oligonucleotide
  Target: SCN10A; (-) strand; PAM type: NRG; PAM sequence: GAG
atccacatggagatttaacg

SEQ ID NO: 20021 - DNA, 20 bp, Artificial Sequence
  Description of Artificial Sequence: Synthetic oligonucleotide
  Target: SCN10A; (-) strand; PAM type: NRG; PAM sequence: CGG
acatccacatggagatttaa

SEQ ID NO: 20022 - DNA, 20 bp, Artificial Sequence
  Description of Artificial Sequence: Synthetic oligonucleotide
  Target: SCN10A; (-) strand; PAM type: NRG; PAM sequence: GAG
cacagttacacatccacatg

SEQ ID NO: 20023 - DNA, 20 bp, Artificial Sequence
  Description of Artificial Sequence: Synthetic oligonucleotide
  Target: SCN10A; (-) strand; PAM type: NRG; PAM sequence: TGG
aacacagttacacatccaca

SEQ ID NO: 20024 - DNA, 20 bp, Artificial Sequence
  Description of Artificial Sequence: Synthetic oligonucleotide
  Target: SCN10A; (-) strand; PAM type: NRG; PAM sequence: CAG
gccctccatcgaggtgaaca

SEQ ID NO: 20025 - DNA, 20 bp, Artificial Sequence
  Description of Artificial Sequence: Synthetic oligonucleotide
  Target: SCN10A; (-) strand; PAM type: NRG; PAM sequence: AGG
taagaaattgccctccatcg

SEQ ID NO: 20026 - DNA, 20 bp, Artificial Sequence
  Description of Artificial Sequence: Synthetic oligonucleotide
  Target: SCN10A; (-) strand; PAM type: NRG; PAM sequence: GAG
ctaagaaattgccctccatc

SEQ ID NO: 20027 - DNA, 20 bp, Artificial Sequence
  Description of Artificial Sequence: Synthetic oligonucleotide
  Target: SCN10A; (-) strand; PAM type: NRG; PAM sequence: AAG
ttatagataaacctaaagct

SEQ ID NO: 20028 - DNA, 20 bp, Artificial Sequence
  Description of Artificial Sequence: Synthetic oligonucleotide
  Target: SCN10A; (-) strand; PAM type: NRG; PAM sequence: AAG
ggaatttatagataaaccta

SEQ ID NO: 20029 - DNA, 20 bp, Artificial Sequence
  Description of Artificial Sequence: Synthetic oligonucleotide
  Target: SCN10A; (-) strand; PAM type: NRG; PAM sequence: TAG
atgtcttgccgaggaattta

SEQ ID NO: 20030 - DNA, 20 bp, Artificial Sequence
  Description of Artificial Sequence: Synthetic oligonucleotide
  Target: SCN10A; (-) strand; PAM type: NRG; PAM sequence: AGG
tcaagatgcatgtcttgccg

SEQ ID NO: 20031 - DNA, 20 bp, Artificial Sequence
  Description of Artificial Sequence: Synthetic oligonucleotide
  Target: SCN10A; (-) strand; PAM type: NRG; PAM sequence: GAG
ttcaagatgcatgtcttgcc

SEQ ID NO: 20032 - DNA, 20 bp, Artificial Sequence
  Description of Artificial Sequence: Synthetic oligonucleotide
  Target: SCN10A; (-) strand; PAM type: NRG; PAM sequence: AAG
acataggctgatatctgttc

SEQ ID NO: 20033 - DNA, 20 bp, Artificial Sequence
  Description of Artificial Sequence: Synthetic oligonucleotide
  Target: SCN10A; (-) strand; PAM type: NRG; PAM sequence: AGG
tcatctttctttgcccacat

SEQ ID NO: 20034 - DNA, 20 bp, Artificial Sequence
  Description of Artificial Sequence: Synthetic oligonucleotide
  Target: SCN10A; (-) strand; PAM type: NRG; PAM sequence: TAG
atcatctttctttgcccaca

SEQ ID NO: 20035 - DNA, 20 bp, Artificial Sequence
  Description of Artificial Sequence: Synthetic oligonucleotide
  Target: SCN10A; (-) strand; PAM type: NRG; PAM sequence: TGG
tccattattattataaacaa

SEQ ID NO: 20036 - DNA, 20 bp, Artificial Sequence
  Description of Artificial Sequence: Synthetic oligonucleotide
  Target: SCN10A; (-) strand; PAM type: NRG; PAM sequence: CAG
cacaatgtattatgctttat

SEQ ID NO: 20037 - DNA, 20 bp, Artificial Sequence
  Description of Artificial Sequence: Synthetic oligonucleotide
  Target: SCN10A; (-) strand; PAM type: NRG; PAM sequence: AAG
gcaatgttctatgcatatat

SEQ ID NO: 20038 - DNA, 20 bp, Artificial Sequence
  Description of Artificial Sequence: Synthetic oligonucleotide
  Target: SCN10A; (-) strand; PAM type: NRG; PAM sequence: AAG
cagtttatcttatattcttc

SEQ ID NO: 20039 - DNA, 20 bp, Artificial Sequence
  Description of Artificial Sequence: Synthetic oligonucleotide
  Target: SCN10A; (-) strand; PAM type: NRG; PAM sequence: CAG
ggtgcacccccctcccactc

SEQ ID NO: 20040 - DNA, 20 bp, Artificial Sequence
  Description of Artificial Sequence: Synthetic oligonucleotide
  Target: SCN10A; (-) strand; PAM type: NRG; PAM sequence: TGG
cttcctgctccccagactcc

SEQ ID NO: 20041 - DNA, 20 bp, Artificial Sequence
  Description of Artificial Sequence: Synthetic oligonucleotide
  Target: SCN10A; (-) strand; PAM type: NRG; PAM sequence: CAG
tatagacccttcctgctccc

SEQ ID NO: 20042 - DNA, 20 bp, Artificial Sequence
  Description of Artificial Sequence: Synthetic oligonucleotide
  Target: SCN10A; (-) strand; PAM type: NRG; PAM sequence: TAG
actatgtctccttcccacta

SEQ ID NO: 20043 - DNA, 20 bp, Artificial Sequence
  Description of Artificial Sequence: Synthetic oligonucleotide
  Target: SCN10A; (-) strand; PAM type: NRG; PAM sequence: AAG
aaaaaaaccctaaacactgc

SEQ ID NO: 20044 - DNA, 20 bp, Artificial Sequence
  Description of Artificial Sequence: Synthetic oligonucleotide
  Target: SCN10A; (-) strand; PAM type: NRG; PAM sequence: TAG
actgatttttcaagtgcata

SEQ ID NO: 20045 - DNA, 20 bp, Artificial Sequence
  Description of Artificial Sequence: Synthetic oligonucleotide
  Target: SCN10A; (-) strand; PAM type: NRG; PAM sequence: AAG
tttctctaaactgatttttc

SEQ ID NO: 20046 - DNA, 20 bp, Artificial Sequence
  Description of Artificial Sequence: Synthetic oligonucleotide
  Target: SCN10A; (-) strand; PAM type: NRG; PAM sequence: CAG
tagcaaaatttgggggcaca

SEQ ID NO: 20047 - DNA, 20 bp, Artificial Sequence
  Description of Artificial Sequence: Synthetic oligonucleotide
  Target: SCN10A; (-) strand; PAM type: NRG; PAM sequence: GGG
acactgttagcaaaatttgg

SEQ ID NO: 20048 - DNA, 20 bp, Artificial Sequence
  Description of Artificial Sequence: Synthetic oligonucleotide
  Target: SCN10A; (-) strand; PAM type: NRG; PAM sequence: GGG
aacactgttagcaaaatttg

SEQ ID NO: 20049 - DNA, 20 bp, Artificial Sequence
  Description of Artificial Sequence: Synthetic oligonucleotide
  Target: SCN10A; (-) strand; PAM type: NRG; PAM sequence: GGG
aaacactgttagcaaaattt

SEQ ID NO: 20050 - DNA, 20 bp, Artificial Sequence
  Description of Artificial Sequence: Synthetic oligonucleotide
  Target: SCN10A; (-) strand; PAM type: NRG; PAM sequence: TGG
aaaacactgttagcaaaatt

SEQ ID NO: 20051 - DNA, 20 bp, Artificial Sequence
  Description of Artificial Sequence: Synthetic oligonucleotide
  Target: SCN10A; (-) strand; PAM type: NRG; PAM sequence: TAG
ttatcaggaaaaaacactgt

SEQ ID NO: 20052 - DNA, 20 bp, Artificial Sequence
  Description of Artificial Sequence: Synthetic oligonucleotide
  Target: SCN10A; (-) strand; PAM type: NRG; PAM sequence: AGG
atacacatttttaaattatc

SEQ ID NO: 20053 - DNA, 20 bp, Artificial Sequence
  Description of Artificial Sequence: Synthetic oligonucleotide
  Target: SCN10A; (-) strand; PAM type: NRG; PAM sequence: CAG
catacacatttttaaattat

SEQ ID NO: 20054 - DNA, 20 bp, Artificial Sequence
  Description of Artificial Sequence: Synthetic oligonucleotide
  Target: SCN10A; (-) strand; PAM type: NRG; PAM sequence: AAG
atgaagaaaattgaaaaaaa

SEQ ID NO: 20055 - DNA, 20 bp, Artificial Sequence
  Description of Artificial Sequence: Synthetic oligonucleotide
  Target: SCN10A; (-) strand; PAM type: NRG; PAM sequence: AAG
aaatttaaaataaaaaaatg

SEQ ID NO: 20056 - DNA, 20 bp, Artificial Sequence
  Description of Artificial Sequence: Synthetic oligonucleotide
  Target: SCN10A; (-) strand; PAM type: NRG; PAM sequence: AAG
cttaaagtataatttaaaaa

SEQ ID NO: 20057 - DNA, 20 bp, Artificial Sequence
  Description of Artificial Sequence: Synthetic oligonucleotide
  Target: SCN10A; (-) strand; PAM type: NRG; PAM sequence: AAG
cacatttaccctaaaactta

SEQ ID NO: 20058 - DNA, 20 bp, Artificial Sequence
  Description of Artificial Sequence: Synthetic oligonucleotide
  Target: SCN10A; (-) strand; PAM type: NRG; PAM sequence: TGG
gtaaggcatgtatgcatatg

SEQ ID NO: 20059 - DNA, 20 bp, Artificial Sequence
  Description of Artificial Sequence: Synthetic oligonucleotide
  Target: SCN10A; (-) strand; PAM type: NRG; PAM sequence: AGG
tgagaaaagcttcatatgta

SEQ ID NO: 20060 - DNA, 20 bp, Artificial Sequence
  Description of Artificial Sequence: Synthetic oligonucleotide
  Target: SCN10A; (-) strand; PAM type: NRG; PAM sequence: AAG
gtgagaaaagcttcatatgt

SEQ ID NO: 20061 - DNA, 20 bp, Artificial Sequence
  Description of Artificial Sequence: Synthetic oligonucleotide
  Target: SCN10A; (-) strand; PAM type: NRG; PAM sequence: AAG
tccaagccttgtagtgagaa

SEQ ID NO: 20062 - DNA, 20 bp, Artificial Sequence
  Description of Artificial Sequence: Synthetic oligonucleotide
  Target: SCN10A; (-) strand; PAM type: NRG; PAM sequence: GAG
tattttccaagccttgtagt

SEQ ID NO: 20063 - DNA, 20 bp, Artificial Sequence
  Description of Artificial Sequence: Synthetic oligonucleotide
  Target: SCN10A; (-) strand; PAM type: NRG; PAM sequence: TAG
aaggtattttccaagccttg

SEQ ID NO: 20064 - DNA, 20 bp, Artificial Sequence
  Description of Artificial Sequence: Synthetic oligonucleotide
  Target: SCN10A; (-) strand; PAM type: NRG; PAM sequence: AAG
acatggagaaggtattttcc

SEQ ID NO: 20065 - DNA, 20 bp, Artificial Sequence
  Description of Artificial Sequence: Synthetic oligonucleotide
  Target: SCN10A; (-) strand; PAM type: NRG; PAM sequence: AGG
gaaagaaaaaaacatggaga

SEQ ID NO: 20066 - DNA, 20 bp, Artificial Sequence
  Description of Artificial Sequence: Synthetic oligonucleotide
  Target: SCN10A; (-) strand; PAM type: NRG; PAM sequence: AAG
agaaagaaaaaaacatggag

SEQ ID NO: 20067 - DNA, 20 bp, Artificial Sequence
  Description of Artificial Sequence: Synthetic oligonucleotide
  Target: SCN10A; (-) strand; PAM type: NRG; PAM sequence: GAG
aaaagaaagaaaaaaacatg

SEQ ID NO: 20068 - DNA, 20 bp, Artificial Sequence
  Description of Artificial Sequence: Synthetic oligonucleotide
  Target: SCN10A; (-) strand; PAM type: NRG; PAM sequence: TGG
acaaaagaaagaaaaaaaca

SEQ ID NO: 20069 - DNA, 20 bp, Artificial Sequence
  Description of Artificial Sequence: Synthetic oligonucleotide
  Target: SCN10A; (-) strand; PAM type: NRG; PAM sequence: AAG
aaaagtgaaactacaaaaga

SEQ ID NO: 20070 - DNA, 20 bp, Artificial Sequence
  Description of Artificial Sequence: Synthetic oligonucleotide
  Target: SCN10A; (-) strand; PAM type: NRG; PAM sequence: AAG
tgaaaaaagtgaaactacaa

SEQ ID NO: 20071 - DNA, 20 bp, Artificial Sequence
  Description of Artificial Sequence: Synthetic oligonucleotide
  Target: SCN10A; (-) strand; PAM type: NRG; PAM sequence: AAG
accaaagttttaagtgaaaa

SEQ ID NO: 20072 - DNA, 20 bp, Artificial Sequence
  Description of Artificial Sequence: Synthetic oligonucleotide
  Target: SCN10A; (-) strand; PAM type: NRG; PAM sequence: AAG
ttcaaatgcaccaaagtttt

SEQ ID NO: 20073 - DNA, 20 bp, Artificial Sequence
  Description of Artificial Sequence: Synthetic oligonucleotide
  Target: SCN10A; (-) strand; PAM type: NRG; PAM sequence: AAG
aataaatttcaaatgcacca

SEQ ID NO: 20074 - DNA, 20 bp, Artificial Sequence
  Description of Artificial Sequence: Synthetic oligonucleotide
  Target: SCN10A; (-) strand; PAM type: NRG; PAM sequence: AGG
tgatataaataatcagagac

SEQ ID NO: 20075 - DNA, 20 bp, Artificial Sequence
  Description of Artificial Sequence: Synthetic oligonucleotide
  Target: SCN10A; (-) strand; PAM type: NRG; PAM sequence: CAG
ttgatataaataatcagaga

SEQ ID NO: 20076 - DNA, 20 bp, Artificial Sequence
  Description of Artificial Sequence: Synthetic oligonucleotide
  Target: SCN10A; (-) strand; PAM type: NRG; PAM sequence: GAG
aatgttgatataaataatca

SEQ ID NO: 20077 - DNA, 20 bp, Artificial Sequence
  Description of Artificial Sequence: Synthetic oligonucleotide
  Target: SCN10A; (-) strand; PAM type: NRG; PAM sequence: CAG
gtaatgttgatataaataat

SEQ ID NO: 20078 - DNA, 20 bp, Artificial Sequence
  Description of Artificial Sequence: Synthetic oligonucleotide
  Target: SCN10A; (-) strand; PAM type: NRG; PAM sequence: AAG
aaaatgaaaaattattcaat

SEQ ID NO: 20079 - DNA, 20 bp, Artificial Sequence
  Description of Artificial Sequence: Synthetic oligonucleotide
  Target: SCN10A; (-) strand; PAM type: NRG; PAM sequence: GGG
aaaatgacatttcaaatctt

SEQ ID NO: 20080 - DNA, 20 bp, Artificial Sequence
  Description of Artificial Sequence: Synthetic oligonucleotide
  Target: SCN10A; (-) strand; PAM type: NRG; PAM sequence: TGG
aaaaatgacatttcaaatct

SEQ ID NO: 20081 - DNA, 20 bp, Artificial Sequence
  Description of Artificial Sequence: Synthetic oligonucleotide
  Target: SCN10A; (-) strand; PAM type: NRG; PAM sequence: TGG
tgaaaacacatgaacataaa

SEQ ID NO: 20082 - DNA, 20 bp, Artificial Sequence
  Description of Artificial Sequence: Synthetic oligonucleotide
  Target: SCN10A; (-) strand; PAM type: NRG; PAM sequence: TGG
tctgatctgtggaagagaaa

SEQ ID NO: 20083 - DNA, 20 bp, Artificial Sequence
  Description of Artificial Sequence: Synthetic oligonucleotide
  Target: SCN10A; (-) strand; PAM type: NRG; PAM sequence: GAG
aaatagtctgatctgtggaa

SEQ ID NO: 20084 - DNA, 20 bp, Artificial Sequence
  Description of Artificial Sequence: Synthetic oligonucleotide
  Target: SCN10A; (-) strand; PAM type: NRG; PAM sequence: AAG
ataaatagtctgatctgtgg

SEQ ID NO: 20085 - DNA, 20 bp, Artificial Sequence
  Description of Artificial Sequence: Synthetic oligonucleotide
  Target: SCN10A; (-) strand; PAM type: NRG; PAM sequence: TGG
aaaataaatagtctgatctg

SEQ ID NO: 20086 - DNA, 20 bp, Artificial Sequence
  Description of Artificial Sequence: Synthetic oligonucleotide
  Target: SCN10A; (-) strand; PAM type: NRG; PAM sequence: TAG
agcatgacagtgaaaataaa

SEQ ID NO: 20087 - DNA, 20 bp, Artificial Sequence
  Description of Artificial Sequence: Synthetic oligonucleotide
  Target: SCN10A; (-) strand; PAM type: NRG; PAM sequence: CAG
cagtgattaaaacagcatga

SEQ ID NO: 20088 - DNA, 20 bp, Artificial Sequence
  Description of Artificial Sequence: Synthetic oligonucleotide
  Target: SCN10A; (-) strand; PAM type: NRG; PAM sequence: CAG
aatccagtcagtgattaaaa

SEQ ID NO: 20089 - DNA, 20 bp, Artificial Sequence
  Description of Artificial Sequence: Synthetic oligonucleotide
  Target: SCN10A; (-) strand; PAM type: NRG; PAM sequence: CAG
tgtagtttctaaaatccagt

SEQ ID NO: 20090 - DNA, 20 bp, Artificial Sequence
  Description of Artificial Sequence: Synthetic oligonucleotide
  Target: SCN10A; (-) strand; PAM type: NRG; PAM sequence: CAG
catctgtagtttctaaaatc

SEQ ID NO: 20091 - DNA, 20 bp, Artificial Sequence
  Description of Artificial Sequence: Synthetic oligonucleotide
  Target: SCN10A; (-) strand; PAM type: NRG; PAM sequence: TAG
tttgccagtttggacatctg

SEQ ID NO: 20092 - DNA, 20 bp, Artificial Sequence
  Description of Artificial Sequence: Synthetic oligonucleotide
  Target: SCN10A; (-) strand; PAM type: NRG; PAM sequence: TGG
agaactatgctttgccagtt

SEQ ID NO: 20093 - DNA, 20 bp, Artificial Sequence
  Description of Artificial Sequence: Synthetic oligonucleotide
  Target: SCN10A; (-) strand; PAM type: NRG; PAM sequence: CAG
tttagagaactatgctttgc

SEQ ID NO: 20094 - DNA, 20 bp, Artificial Sequence
  Description of Artificial Sequence: Synthetic oligonucleotide
  Target: SCN10A; (-) strand; PAM type: NRG; PAM sequence: GAG
aggatgtgccaacttcttta

SEQ ID NO: 20095 - DNA, 20 bp, Artificial Sequence
  Description of Artificial Sequence: Synthetic oligonucleotide
  Target: SCN10A; (-) strand; PAM type: NRG; PAM sequence: TAG
ccaggatgtgccaacttctt

SEQ ID NO: 20096 - DNA, 20 bp, Artificial Sequence
  Description of Artificial Sequence: Synthetic oligonucleotide
  Target: SCN10A; (-) strand; PAM type: NRG; PAM sequence: AGG
ggattgttgattttggtccc

SEQ ID NO: 20097 - DNA, 20 bp, Artificial Sequence
  Description of Artificial Sequence: Synthetic oligonucleotide
  Target: SCN10A; (-) strand; PAM type: NRG; PAM sequence: CAG
gggattgttgattttggtcc

SEQ ID NO: 20098 - DNA, 20 bp, Artificial Sequence
  Description of Artificial Sequence: Synthetic oligonucleotide
  Target: SCN10A; (-) strand; PAM type: NRG; PAM sequence: TGG
caaacagggattgttgattt

SEQ ID NO: 20099 - DNA, 20 bp, Artificial Sequence
  Description of Artificial Sequence: Synthetic oligonucleotide
  Target: SCN10A; (-) strand; PAM type: NRG; PAM sequence: GGG
tcttgcttttgttccaaaca

SEQ ID NO: 20100 - DNA, 20 bp, Artificial Sequence
  Description of Artificial Sequence: Synthetic oligonucleotide
  Target: SCN10A; (-) strand; PAM type: NRG; PAM sequence: AGG
ttcttgcttttgttccaaac

SEQ ID NO: 20101 - DNA, 20 bp, Artificial Sequence
  Description of Artificial Sequence: Synthetic oligonucleotide
  Target: SCN10A; (-) strand; PAM type: NRG; PAM sequence: CAG
gttcttgcttttgttccaaa

SEQ ID NO: 20102 - DNA, 20 bp, Artificial Sequence
  Description of Artificial Sequence: Synthetic oligonucleotide
  Target: SCN10A; (-) strand; PAM type: NRG; PAM sequence: AAG
gtgccaaaataggtccaggg

SEQ ID NO: 20103 - DNA, 20 bp, Artificial Sequence
  Description of Artificial Sequence: Synthetic oligonucleotide
  Target: SCN10A; (-) strand; PAM type: NRG; PAM sequence: GGG
ttagtgccaaaataggtcca

SEQ ID NO: 20104 - DNA, 20 bp, Artificial Sequence
  Description of Artificial Sequence: Synthetic oligonucleotide
  Target: SCN10A; (-) strand; PAM type: NRG; PAM sequence: AGG
tttagtgccaaaataggtcc

SEQ ID NO: 20105 - DNA, 20 bp, Artificial Sequence
  Description of Artificial Sequence: Synthetic oligonucleotide
  Target: SCN10A; (-) strand; PAM type: NRG; PAM sequence: CAG
ttttagtgccaaaataggtc

SEQ ID NO: 20106 - DNA, 20 bp, Artificial Sequence
  Description of Artificial Sequence: Synthetic oligonucleotide
  Target: SCN10A; (-) strand; PAM type: NRG; PAM sequence: AGG
cttctttttagtgccaaaat

SEQ ID NO: 20107 - DNA, 20 bp, Artificial Sequence
  Description of Artificial Sequence: Synthetic oligonucleotide
  Target: SCN10A; (-) strand; PAM type: NRG; PAM sequence: TAG
gcttctttttagtgccaaaa

SEQ ID NO: 20108 - DNA, 20 bp, Artificial Sequence
  Description of Artificial Sequence: Synthetic oligonucleotide
  Target: SCN10A; (-) strand; PAM type: NRG; PAM sequence: TAG
ctacttcctgtgcttctttt

SEQ ID NO: 20109 - DNA, 20 bp, Artificial Sequence
  Description of Artificial Sequence: Synthetic oligonucleotide
  Target: SCN10A; (-) strand; PAM type: NRG; PAM sequence: AAG
ctgccaaaatggcacatcta

SEQ ID NO: 20110 - DNA, 20 bp, Artificial Sequence
  Description of Artificial Sequence: Synthetic oligonucleotide
  Target: SCN10A; (-) strand; PAM type: NRG; PAM sequence: TGG
gtggctgcttcctgccaaaa

SEQ ID NO: 20111 - DNA, 20 bp, Artificial Sequence
  Description of Artificial Sequence: Synthetic oligonucleotide
  Target: SCN10A; (-) strand; PAM type: NRG; PAM sequence: TGG
ttcccatcatgcctcacagg

SEQ ID NO: 20112 - DNA, 20 bp, Artificial Sequence
  Description of Artificial Sequence: Synthetic oligonucleotide
  Target: SCN10A; (-) strand; PAM type: NRG; PAM sequence: AGG
cttttcccatcatgcctcac

SEQ ID NO: 20113 - DNA, 20 bp, Artificial Sequence
  Description of Artificial Sequence: Synthetic oligonucleotide
  Target: SCN10A; (-) strand; PAM type: NRG; PAM sequence: CAG
tcttttcccatcatgcctca

SEQ ID NO: 20114 - DNA, 20 bp, Artificial Sequence
  Description of Artificial Sequence: Synthetic oligonucleotide
  Target: SCN10A; (-) strand; PAM type: NRG; PAM sequence: AAG
caatgtcaaggctgtttaca

SEQ ID NO: 20115 - DNA, 20 bp, Artificial Sequence
  Description of Artificial Sequence: Synthetic oligonucleotide
  Target: SCN10A; (-) strand; PAM type: NRG; PAM sequence: AGG
aatcaagttcaacaatgtca

SEQ ID NO: 20116 - DNA, 20 bp, Artificial Sequence
  Description of Artificial Sequence: Synthetic oligonucleotide
  Target: SCN10A; (-) strand; PAM type: NRG; PAM sequence: AAG
caatcaagttcaacaatgtc

SEQ ID NO: 20117 - DNA, 20 bp, Artificial Sequence
  Description of Artificial Sequence: Synthetic oligonucleotide
  Target: SCN10A; (-) strand; PAM type: NRG; PAM sequence: AAG
ctgtgtctctgcaatcaatc

SEQ ID NO: 20118 - DNA, 20 bp, Artificial Sequence
  Description of Artificial Sequence: Synthetic oligonucleotide
  Target: SCN10A; (-) strand; PAM type: NRG; PAM sequence: TAG
agctggcaagtagatacttt

SEQ ID NO: 20119 - DNA, 20 bp, Artificial Sequence
  Description of Artificial Sequence: Synthetic oligonucleotide
  Target: SCN10A; (-) strand; PAM type: NRG; PAM sequence: TAG
tcatgttttaagctggcaag

SEQ ID NO: 20120 - DNA, 20 bp, Artificial Sequence
  Description of Artificial Sequence: Synthetic oligonucleotide
  Target: SCN10A; (-) strand; PAM type: NRG; PAM sequence: AAG
tggtcatgttttaagctggc

SEQ ID NO: 20121 - DNA, 20 bp, Artificial Sequence
  Description of Artificial Sequence: Synthetic oligonucleotide
  Target: SCN10A; (-) strand; PAM type: NRG; PAM sequence: TGG
gccatggtcatgttttaagc

SEQ ID NO: 20122 - DNA, 20 bp, Artificial Sequence
  Description of Artificial Sequence: Synthetic oligonucleotide
  Target: SCN10A; (-) strand; PAM type: NRG; PAM sequence: AAG
tggggccatggtcatgtttt

SEQ ID NO: 20123 - DNA, 20 bp, Artificial Sequence
  Description of Artificial Sequence: Synthetic oligonucleotide
  Target: SCN10A; (-) strand; PAM type: NRG; PAM sequence: TGG
atccttttgaggtggggcca

SEQ ID NO: 20124 - DNA, 20 bp, Artificial Sequence
  Description of Artificial Sequence: Synthetic oligonucleotide
  Target: SCN10A; (-) strand; PAM type: NRG; PAM sequence: GGG
taggagatccttttgaggtg

SEQ ID NO: 20125 - DNA, 20 bp, Artificial Sequence
  Description of Artificial Sequence: Synthetic oligonucleotide
  Target: SCN10A; (-) strand; PAM type: NRG; PAM sequence: GGG
ataggagatccttttgaggt

SEQ ID NO: 20126 - DNA, 20 bp, Artificial Sequence
  Description of Artificial Sequence: Synthetic oligonucleotide
  Target: SCN10A; (-) strand; PAM type: NRG; PAM sequence: TGG
tataggagatccttttgagg

SEQ ID NO: 20127 - DNA, 20 bp, Artificial Sequence
  Description of Artificial Sequence: Synthetic oligonucleotide
  Target: SCN10A; (-) strand; PAM type: NRG; PAM sequence: AGG
ttatataggagatccttttg

SEQ ID NO: 20128 - DNA, 20 bp, Artificial Sequence
  Description of Artificial Sequence: Synthetic oligonucleotide
  Target: SCN10A; (-) strand; PAM type: NRG; PAM sequence: GAG
tttatataggagatcctttt

SEQ ID NO: 20129 - DNA, 20 bp, Artificial Sequence
  Description of Artificial Sequence: Synthetic oligonucleotide
  Target: SCN10A; (-) strand; PAM type: NRG; PAM sequence: GAG
ctgttatcaattttatatag

SEQ ID NO: 20130 - DNA, 20 bp, Artificial Sequence
  Description of Artificial Sequence: Synthetic oligonucleotide
  Target: SCN10A; (-) strand; PAM type: NRG; PAM sequence: AGG
ctctgttatcaattttatat

SEQ ID NO: 20131 - DNA, 20 bp, Artificial Sequence
  Description of Artificial Sequence: Synthetic oligonucleotide
  Target: SCN10A; (-) strand; PAM type: NRG; PAM sequence: TAG
tctctgttatcaattttata

SEQ ID NO: 20132 - DNA, 20 bp, Artificial Sequence
  Description of Artificial Sequence: Synthetic oligonucleotide
  Target: SCN10A; (-) strand; PAM type: NRG; PAM sequence: AAG
gtaacaggatgaagggagga

SEQ ID NO: 20133 - DNA, 20 bp, Artificial Sequence
  Description of Artificial Sequence: Synthetic oligonucleotide
  Target: SCN10A; (-) strand; PAM type: NRG; PAM sequence: AGG
aagcgtaacaggatgaaggg

SEQ ID NO: 20134 - DNA, 20 bp, Artificial Sequence
  Description of Artificial Sequence: Synthetic oligonucleotide
  Target: SCN10A; (-) strand; PAM type: NRG; PAM sequence: GAG
taagcgtaacaggatgaagg

SEQ ID NO: 20135 - DNA, 20 bp, Artificial Sequence
  Description of Artificial Sequence: Synthetic oligonucleotide
  Target: SCN10A; (-) strand; PAM type: NRG; PAM sequence: GGG
tttaagcgtaacaggatgaa

SEQ ID NO: 20136 - DNA, 20 bp, Artificial Sequence
  Description of Artificial Sequence: Synthetic oligonucleotide
  Target: SCN10A; (-) strand; PAM type: NRG; PAM sequence: AGG
ctttaagcgtaacaggatga

SEQ ID NO: 20137 - DNA, 20 bp, Artificial Sequence
  Description of Artificial Sequence: Synthetic oligonucleotide
  Target: SCN10A; (-) strand; PAM type: NRG; PAM sequence: AAG
tctttaagcgtaacaggatg

SEQ ID NO: 20138 - DNA, 20 bp, Artificial Sequence
  Description of Artificial Sequence: Synthetic oligonucleotide
  Target: SCN10A; (-) strand; PAM type: NRG; PAM sequence: AGG
gggacctctttaagcgtaac

SEQ ID NO: 20139 - DNA, 20 bp, Artificial Sequence
  Description of Artificial Sequence: Synthetic oligonucleotide
  Target: SCN10A; (-) strand; PAM type: NRG; PAM sequence: CAG
ggggacctctttaagcgtaa

SEQ ID NO: 20140 - DNA, 20 bp, Artificial Sequence
  Description of Artificial Sequence: Synthetic oligonucleotide
  Target: SCN10A; (-) strand; PAM type: NRG; PAM sequence: AAG
aggagcagggggacctcttt

SEQ ID NO: 20141 - DNA, 20 bp, Artificial Sequence
  Description of Artificial Sequence: Synthetic oligonucleotide
  Target: SCN10A; (-) strand; PAM type: NRG; PAM sequence: GGG
ctggtgttaacaggagcagg

SEQ ID NO: 20142 - DNA, 20 bp, Artificial Sequence
  Description of Artificial Sequence: Synthetic oligonucleotide
  Target: SCN10A; (-) strand; PAM type: NRG; PAM sequence: GGG
actggtgttaacaggagcag

SEQ ID NO: 20143 - DNA, 20 bp, Artificial Sequence
  Description of Artificial Sequence: Synthetic oligonucleotide
  Target: SCN10A; (-) strand; PAM type: NRG; PAM sequence: GGG
cactggtgttaacaggagca

SEQ ID NO: 20144 - DNA, 20 bp, Artificial Sequence
  Description of Artificial Sequence: Synthetic oligonucleotide
  Target: SCN10A; (-) strand; PAM type: NRG; PAM sequence: AGG
acactggtgttaacaggagc

SEQ ID NO: 20145 - DNA, 20 bp, Artificial Sequence
  Description of Artificial Sequence: Synthetic oligonucleotide
  Target: SCN10A; (-) strand; PAM type: NRG; PAM sequence: CAG
gacactggtgttaacaggag

SEQ ID NO: 20146 - DNA, 20 bp, Artificial Sequence
  Description of Artificial Sequence: Synthetic oligonucleotide
  Target: SCN10A; (-) strand; PAM type: NRG; PAM sequence: GAG
ggagacactggtgttaacag

SEQ ID NO: 20147 - DNA, 20 bp, Artificial Sequence
  Description of Artificial Sequence: Synthetic oligonucleotide
  Target: SCN10A; (-) strand; PAM type: NRG; PAM sequence: AGG
gtggagacactggtgttaac

SEQ ID NO: 20148 - DNA, 20 bp, Artificial Sequence
  Description of Artificial Sequence: Synthetic oligonucleotide
  Target: SCN10A; (-) strand; PAM type: NRG; PAM sequence: CAG
agtggagacactggtgttaa

SEQ ID NO: 20149 - DNA, 20 bp, Artificial Sequence
  Description of Artificial Sequence: Synthetic oligonucleotide
  Target: SCN10A; (-) strand; PAM type: NRG; PAM sequence: TGG
agaatgcacagtggagacac

SEQ ID NO: 20150 - DNA, 20 bp, Artificial Sequence
  Description of Artificial Sequence: Synthetic oligonucleotide
  Target: SCN10A; (-) strand; PAM type: NRG; PAM sequence: GAG
gcaggagagaatgcacagtg

SEQ ID NO: 20151 - DNA, 20 bp, Artificial Sequence
  Description of Artificial Sequence: Synthetic oligonucleotide
  Target: SCN10A; (-) strand; PAM type: NRG; PAM sequence: TGG
tggcaggagagaatgcacag

SEQ ID NO: 20152 - DNA, 20 bp, Artificial Sequence
  Description of Artificial Sequence: Synthetic oligonucleotide
  Target: SCN10A; (-) strand; PAM type: NRG; PAM sequence: CAG
cagtggcaggagagaatgca

SEQ ID NO: 20153 - DNA, 20 bp, Artificial Sequence
  Description of Artificial Sequence: Synthetic oligonucleotide
  Target: SCN10A; (-) strand; PAM type: NRG; PAM sequence: GAG
agactcctgcagtggcagga

SEQ ID NO: 20154 - DNA, 20 bp, Artificial Sequence
  Description of Artificial Sequence: Synthetic oligonucleotide
  Target: SCN10A; (-) strand; PAM type: NRG; PAM sequence: GAG
acagactcctgcagtggcag

SEQ ID NO: 20155 - DNA, 20 bp, Artificial Sequence
  Description of Artificial Sequence: Synthetic oligonucleotide
  Target: SCN10A; (-) strand; PAM type: NRG; PAM sequence: AGG
caacagactcctgcagtggc

SEQ ID NO: 20156 - DNA, 20 bp, Artificial Sequence
  Description of Artificial Sequence: Synthetic oligonucleotide
  Target: SCN10A; (-) strand; PAM type: NRG; PAM sequence: CAG
tcaacagactcctgcagtgg

SEQ ID NO: 20157 - DNA, 20 bp, Artificial Sequence
  Description of Artificial Sequence: Synthetic oligonucleotide
  Target: SCN10A; (-) strand; PAM type: NRG; PAM sequence: TGG
tattcaacagactcctgcag

SEQ ID NO: 20158 - DNA, 20 bp, Artificial Sequence
  Description of Artificial Sequence: Synthetic oligonucleotide
  Target: SCN10A; (-) strand; PAM type: NRG; PAM sequence: CAG
gtatattcaacagactcctg

SEQ ID NO: 20159 - DNA, 20 bp, Artificial Sequence
  Description of Artificial Sequence: Synthetic oligonucleotide
  Target: SCN10A; (-) strand; PAM type: NRG; PAM sequence: CAG
ggaagaaagggtatattcaa

SEQ ID NO: 20160 - DNA, 20 bp, Artificial Sequence
  Description of Artificial Sequence: Synthetic oligonucleotide
  Target: SCN10A; (-) strand; PAM type: NRG; PAM sequence: GGG
ctgaagattaagggaagaaa

SEQ ID NO: 20161 - DNA, 20 bp, Artificial Sequence
  Description of Artificial Sequence: Synthetic oligonucleotide
  Target: SCN10A; (-) strand; PAM type: NRG; PAM sequence: AGG
actgaagattaagggaagaa

SEQ ID NO: 20162 - DNA, 20 bp, Artificial Sequence
  Description of Artificial Sequence: Synthetic oligonucleotide
  Target: SCN10A; (-) strand; PAM type: NRG; PAM sequence: AAG
gactgaagattaagggaaga

SEQ ID NO: 20163 - DNA, 20 bp, Artificial Sequence
  Description of Artificial Sequence: Synthetic oligonucleotide
  Target: SCN10A; (-) strand; PAM type: NRG; PAM sequence: AAG
gagagactgaagattaaggg

SEQ ID NO: 20164 - DNA, 20 bp, Artificial Sequence
  Description of Artificial Sequence: Synthetic oligonucleotide
  Target: SCN10A; (-) strand; PAM type: NRG; PAM sequence: GGG
taagagagactgaagattaa

SEQ ID NO: 20165 - DNA, 20 bp, Artificial Sequence
  Description of Artificial Sequence: Synthetic oligonucleotide
  Target: SCN10A; (-) strand; PAM type: NRG; PAM sequence: AGG
ataagagagactgaagatta

SEQ ID NO: 20166 - DNA, 20 bp, Artificial Sequence
  Description of Artificial Sequence: Synthetic oligonucleotide
  Target: SCN10A; (-) strand; PAM type: NRG; PAM sequence: AAG
aataagagagactgaagatt

SEQ ID NO: 20167 - DNA, 20 bp, Artificial Sequence
  Description of Artificial Sequence: Synthetic oligonucleotide
  Target: SCN10A; (-) strand; PAM type: NRG; PAM sequence: AAG
tgggagaataagagagactg

SEQ ID NO: 20168 - DNA, 20 bp, Artificial Sequence
  Description of Artificial Sequence: Synthetic oligonucleotide
  Target: SCN10A; (-) strand; PAM type: NRG; PAM sequence: GAG
aaggatctgggagaataaga

SEQ ID NO: 20169 - DNA, 20 bp, Artificial Sequence
  Description of Artificial Sequence: Synthetic oligonucleotide
  Target: SCN10A; (-) strand; PAM type: NRG; PAM sequence: GAG
ggaaggatctgggagaataa

SEQ ID NO: 20170 - DNA, 20 bp, Artificial Sequence
  Description of Artificial Sequence: Synthetic oligonucleotide
  Target: SCN10A; (-) strand; PAM type: NRG; PAM sequence: AAG
tgggaaggatctgggagaat

SEQ ID NO: 20171 - DNA, 20 bp, Artificial Sequence
  Description of Artificial Sequence: Synthetic oligonucleotide
  Target: SCN10A; (-) strand; PAM type: NRG; PAM sequence: GAG
tgctaatgggaaggatctgg

SEQ ID NO: 20172 - DNA, 20 bp, Artificial Sequence
  Description of Artificial Sequence: Synthetic oligonucleotide
  Target: SCN10A; (-) strand; PAM type: NRG; PAM sequence: GGG
catgctaatgggaaggatct

SEQ ID NO: 20173 - DNA, 20 bp, Artificial Sequence
  Description of Artificial Sequence: Synthetic oligonucleotide
  Target: SCN10A; (-) strand; PAM type: NRG; PAM sequence: TGG
gcatgctaatgggaaggatc

SEQ ID NO: 20174 - DNA, 20 bp, Artificial Sequence
  Description of Artificial Sequence: Synthetic oligonucleotide
  Target: SCN10A; (-) strand; PAM type: NRG; PAM sequence: AGG
atatttgcatgctaatggga

SEQ ID NO: 20175 - DNA, 20 bp, Artificial Sequence
  Description of Artificial Sequence: Synthetic oligonucleotide
  Target: SCN10A; (-) strand; PAM type: NRG; PAM sequence: AAG
catatttgcatgctaatggg

SEQ ID NO: 20176 - DNA, 20 bp, Artificial Sequence
  Description of Artificial Sequence: Synthetic oligonucleotide
  Target: SCN10A; (-) strand; PAM type: NRG; PAM sequence: GGG
gagcatatttgcatgctaat

SEQ ID NO: 20177 - DNA, 20 bp, Artificial Sequence
  Description of Artificial Sequence: Synthetic oligonucleotide
  Target: SCN10A; (-) strand; PAM type: NRG; PAM sequence: TGG
tgagcatatttgcatgctaa

SEQ ID NO: 20178 - DNA, 20 bp, Artificial Sequence
  Description of Artificial Sequence: Synthetic oligonucleotide
  Target: SCN10A; (-) strand; PAM type: NRG; PAM sequence: GAG
tttgtttgtttgtttgtttt

SEQ ID NO: 20179 - DNA, 20 bp, Artificial Sequence
  Description of Artificial Sequence: Synthetic oligonucleotide
  Target: SCN10A; (-) strand; PAM type: NRG; PAM sequence: GAG
tttggtttttgtgtttgggg

SEQ ID NO: 20180 - DNA, 20 bp, Artificial Sequence
  Description of Artificial Sequence: Synthetic oligonucleotide
  Target: SCN10A; (-) strand; PAM type: NRG; PAM sequence: GGG
tttttggtttttgtgtttgg

SEQ ID NO: 20181 - DNA, 20 bp, Artificial Sequence
  Description of Artificial Sequence: Synthetic oligonucleotide
  Target: SCN10A; (-) strand; PAM type: NRG; PAM sequence: GGG
ctttttggtttttgtgtttg

SEQ ID NO: 20182 - DNA, 20 bp, Artificial Sequence
  Description of Artificial Sequence: Synthetic oligonucleotide
  Target: SCN10A; (-) strand; PAM type: NRG; PAM sequence: GGG
actttttggtttttgtgttt

SEQ ID NO: 20183 - DNA, 20 bp, Artificial Sequence
  Description of Artificial Sequence: Synthetic oligonucleotide
  Target: SCN10A; (-) strand; PAM type: NRG; PAM sequence: TGG
gactttttggtttttgtgtt

SEQ ID NO: 20184 - DNA, 20 bp, Artificial Sequence
  Description of Artificial Sequence: Synthetic oligonucleotide
  Target: SCN10A; (-) strand; PAM type: NRG; PAM sequence: TGG
agaattgaaagaagactttt

SEQ ID NO: 20185 - DNA, 20 bp, Artificial Sequence
  Description of Artificial Sequence: Synthetic oligonucleotide
  Target: SCN10A; (-) strand; PAM type: NRG; PAM sequence: AAG
ggagtagggagaattgaaag

SEQ ID NO: 20186 - DNA, 20 bp, Artificial Sequence
  Description of Artificial Sequence: Synthetic oligonucleotide
  Target: SCN10A; (-) strand; PAM type: NRG; PAM sequence: AAG
tagggagtagggagaattga

SEQ ID NO: 20187 - DNA, 20 bp, Artificial Sequence
  Description of Artificial Sequence: Synthetic oligonucleotide
  Target: SCN10A; (-) strand; PAM type: NRG; PAM sequence: GAG
agatggcactagggagtagg

SEQ ID NO: 20188 - DNA, 20 bp, Artificial Sequence
  Description of Artificial Sequence: Synthetic oligonucleotide
  Target: SCN10A; (-) strand; PAM type: NRG; PAM sequence: GGG
taagatggcactagggagta

SEQ ID NO: 20189 - DNA, 20 bp, Artificial Sequence
  Description of Artificial Sequence: Synthetic oligonucleotide
  Target: SCN10A; (-) strand; PAM type: NRG; PAM sequence: AGG
gtaagatggcactagggagt

SEQ ID NO: 20190 - DNA, 20 bp, Artificial Sequence
  Description of Artificial Sequence: Synthetic oligonucleotide
  Target: SCN10A; (-) strand; PAM type: NRG; PAM sequence: TAG
agtaagatggcactagggag

SEQ ID NO: 20191 - DNA, 20 bp, Artificial Sequence
  Description of Artificial Sequence: Synthetic oligonucleotide
  Target: SCN10A; (-) strand; PAM type: NRG; PAM sequence: GAG
gatagtaagatggcactagg

SEQ ID NO: 20192 - DNA, 20 bp, Artificial Sequence
  Description of Artificial Sequence: Synthetic oligonucleotide
  Target: SCN10A; (-) strand; PAM type: NRG; PAM sequence: GGG
gagatagtaagatggcacta

SEQ ID NO: 20193 - DNA, 20 bp, Artificial Sequence
  Description of Artificial Sequence: Synthetic oligonucleotide
  Target: SCN10A; (-) strand; PAM type: NRG; PAM sequence: AGG
ggagatagtaagatggcact

SEQ ID NO: 20194 - DNA, 20 bp, Artificial Sequence
  Description of Artificial Sequence: Synthetic oligonucleotide
  Target: SCN10A; (-) strand; PAM type: NRG; PAM sequence: TAG
aggagatagtaagatggcac

SEQ ID NO: 20195 - DNA, 20 bp, Artificial Sequence
  Description of Artificial Sequence: Synthetic oligonucleotide
  Target: SCN10A; (-) strand; PAM type: NRG; PAM sequence: TGG
aggaaaaggagatagtaaga

SEQ ID NO: 20196 - DNA, 20 bp, Artificial Sequence
  Description of Artificial Sequence: Synthetic oligonucleotide
  Target: SCN10A; (-) strand; PAM type: NRG; PAM sequence: AAG
tgtgaggaaaaggagatagt

SEQ ID NO: 20197 - DNA, 20 bp, Artificial Sequence
  Description of Artificial Sequence: Synthetic oligonucleotide
  Target: SCN10A; (-) strand; PAM type: NRG; PAM sequence: TAG
tgcctgtgaggaaaaggaga

SEQ ID NO: 20198 - DNA, 20 bp, Artificial Sequence
  Description of Artificial Sequence: Synthetic oligonucleotide
  Target: SCN10A; (-) strand; PAM type: NRG; PAM sequence: GAG
agtttgcctgtgaggaaaag

SEQ ID NO: 20199 - DNA, 20 bp, Artificial Sequence
  Description of Artificial Sequence: Synthetic oligonucleotide
  Target: SCN10A; (-) strand; PAM type: NRG; PAM sequence: AGG
gaagtttgcctgtgaggaaa

SEQ ID NO: 20200 - DNA, 20 bp, Artificial Sequence
  Description of Artificial Sequence: Synthetic oligonucleotide
  Target: SCN10A; (-) strand; PAM type: NRG; PAM sequence: AAG
agaagtttgcctgtgaggaa

SEQ ID NO: 20201 - DNA, 20 bp, Artificial Sequence
  Description of Artificial Sequence: Synthetic oligonucleotide
  Target: SCN10A; (-) strand; PAM type: NRG; PAM sequence: AGG
tttcaagaagtttgcctgtg

SEQ ID NO: 20202 - DNA, 20 bp, Artificial Sequence
  Description of Artificial Sequence: Synthetic oligonucleotide
  Target: SCN10A; (-) strand; PAM type: NRG; PAM sequence: GAG
ttttcaagaagtttgcctgt

SEQ ID NO: 20203 - DNA, 20 bp, Artificial Sequence
  Description of Artificial Sequence: Synthetic oligonucleotide
  Target: SCN10A; (-) strand; PAM type: NRG; PAM sequence: AAG
gtacagacaattttttcaag

SEQ ID NO: 20204 - DNA, 20 bp, Artificial Sequence
  Description of Artificial Sequence: Synthetic oligonucleotide
  Target: SCN10A; (-) strand; PAM type: NRG; PAM sequence: AAG
ggtgtacagacaattttttc

SEQ ID NO: 20205 - DNA, 20 bp, Artificial Sequence
  Description of Artificial Sequence: Synthetic oligonucleotide
  Target: SCN10A; (-) strand; PAM type: NRG; PAM sequence: CAG
agaaatggagatatggtgta

SEQ ID NO: 20206 - DNA, 20 bp, Artificial Sequence
  Description of Artificial Sequence: Synthetic oligonucleotide
  Target: SCN10A; (-) strand; PAM type: NRG; PAM sequence: TGG
gaggtgaagaaatggagata

SEQ ID NO: 20207 - DNA, 20 bp, Artificial Sequence
  Description of Artificial Sequence: Synthetic oligonucleotide
  Target: SCN10A; (-) strand; PAM type: NRG; PAM sequence: GAG
gggtgagaggtgaagaaatg

SEQ ID NO: 20208 - DNA, 20 bp, Artificial Sequence
  Description of Artificial Sequence: Synthetic oligonucleotide
  Target: SCN10A; (-) strand; PAM type: NRG; PAM sequence: TGG
gcgggtgagaggtgaagaaa

SEQ ID NO: 20209 - DNA, 20 bp, Artificial Sequence
  Description of Artificial Sequence: Synthetic oligonucleotide
  Target: SCN10A; (-) strand; PAM type: NRG; PAM sequence: AAG
taaagagcgggtgagaggtg

SEQ ID NO: 20210 - DNA, 20 bp, Artificial Sequence
  Description of Artificial Sequence: Synthetic oligonucleotide
  Target: SCN10A; (-) strand; PAM type: NRG; PAM sequence: AGG
gggcttaaagagcgggtgag

SEQ ID NO: 20211 - DNA, 20 bp, Artificial Sequence
  Description of Artificial Sequence: Synthetic oligonucleotide
  Target: SCN10A; (-) strand; PAM type: NRG; PAM sequence: GAG
ggggcttaaagagcgggtga

SEQ ID NO: 20212 - DNA, 20 bp, Artificial Sequence
  Description of Artificial Sequence: Synthetic oligonucleotide
  Target: SCN10A; (-) strand; PAM type: NRG; PAM sequence: GAG
aaggggcttaaagagcgggt

SEQ ID NO: 20213 - DNA, 20 bp, Artificial Sequence
  Description of Artificial Sequence: Synthetic oligonucleotide
  Target: SCN10A; (-) strand; PAM type: NRG; PAM sequence: GGG
attgaaggggcttaaagagc

SEQ ID NO: 20214 - DNA, 20 bp, Artificial Sequence
  Description of Artificial Sequence: Synthetic oligonucleotide
  Target: SCN10A; (-) strand; PAM type: NRG; PAM sequence: CGG
tattgaaggggcttaaagag

SEQ ID NO: 20215 - DNA, 20 bp, Artificial Sequence
  Description of Artificial Sequence: Synthetic oligonucleotide
  Target: SCN10A; (-) strand; PAM type: NRG; PAM sequence: GAG
tcatattgaaggggcttaaa

SEQ ID NO: 20216 - DNA, 20 bp, Artificial Sequence
  Description of Artificial Sequence: Synthetic oligonucleotide
  Target: SCN10A; (-) strand; PAM type: NRG; PAM sequence: AAG
ggtcatattgaaggggctta

SEQ ID NO: 20217 - DNA, 20 bp, Artificial Sequence
  Description of Artificial Sequence: Synthetic oligonucleotide
  Target: SCN10A; (-) strand; PAM type: NRG; PAM sequence: GGG
aggcagaggtcatattgaag

SEQ ID NO: 20218 - DNA, 20 bp, Artificial Sequence
  Description of Artificial Sequence: Synthetic oligonucleotide
  Target: SCN10A; (-) strand; PAM type: NRG; PAM sequence: GGG
taggcagaggtcatattgaa

SEQ ID NO: 20219 - DNA, 20 bp, Artificial Sequence
  Description of Artificial Sequence: Synthetic oligonucleotide
  Target: SCN10A; (-) strand; PAM type: NRG; PAM sequence: AGG
gtaggcagaggtcatattga

SEQ ID NO: 20220 - DNA, 20 bp, Artificial Sequence
  Description of Artificial Sequence: Synthetic oligonucleotide
  Target: SCN10A; (-) strand; PAM type: NRG; PAM sequence: AAG
ggtaggcagaggtcatattg

SEQ ID NO: 20221 - DNA, 20 bp, Artificial Sequence
  Description of Artificial Sequence: Synthetic oligonucleotide
  Target: SCN10A; (-) strand; PAM type: NRG; PAM sequence: AGG
tggagtaaaagggtaggcag

SEQ ID NO: 20222 - DNA, 20 bp, Artificial Sequence
  Description of Artificial Sequence: Synthetic oligonucleotide
  Target: SCN10A; (-) strand; PAM type: NRG; PAM sequence: GAG
atggagtaaaagggtaggca

SEQ ID NO: 20223 - DNA, 20 bp, Artificial Sequence
  Description of Artificial Sequence: Synthetic oligonucleotide
  Target: SCN10A; (-) strand; PAM type: NRG; PAM sequence: CAG
taatggagtaaaagggtagg

SEQ ID NO: 20224 - DNA, 20 bp, Artificial Sequence
  Description of Artificial Sequence: Synthetic oligonucleotide
  Target: SCN10A; (-) strand; PAM type: NRG; PAM sequence: AGG
gattaatggagtaaaagggt

SEQ ID NO: 20225 - DNA, 20 bp, Artificial Sequence
  Description of Artificial Sequence: Synthetic oligonucleotide
  Target: SCN10A; (-) strand; PAM type: NRG; PAM sequence: TAG
ggattaatggagtaaaaggg

SEQ ID NO: 20226 - DNA, 20 bp, Artificial Sequence
  Description of Artificial Sequence: Synthetic oligonucleotide
  Target: SCN10A; (-) strand; PAM type: NRG; PAM sequence: GGG
agaggattaatggagtaaaa

SEQ ID NO: 20227 - DNA, 20 bp, Artificial Sequence
  Description of Artificial Sequence: Synthetic oligonucleotide
  Target: SCN10A; (-) strand; PAM type: NRG; PAM sequence: AGG
aagaggattaatggagtaaa

SEQ ID NO: 20228 - DNA, 20 bp, Artificial Sequence
  Description of Artificial Sequence: Synthetic oligonucleotide
  Target: SCN10A; (-) strand; PAM type: NRG; PAM sequence: AAG
aaagaggattaatggagtaa

SEQ ID NO: 20229 - DNA, 20 bp, Artificial Sequence
  Description of Artificial Sequence: Synthetic oligonucleotide
  Target: SCN10A; (-) strand; PAM type: NRG; PAM sequence: GAG
taagcaaaagaggattaatg

SEQ ID NO: 20230 - DNA, 20 bp, Artificial Sequence
  Description of Artificial Sequence: Synthetic oligonucleotide
  Target: SCN10A; (-) strand; PAM type: NRG; PAM sequence: TGG
tctaagcaaaagaggattaa

SEQ ID NO: 20231 - DNA, 20 bp, Artificial Sequence
  Description of Artificial Sequence: Synthetic oligonucleotide
  Target: SCN10A; (-) strand; PAM type: NRG; PAM sequence: AGG
tttggtgatctaagcaaaag

SEQ ID NO: 20232 - DNA, 20 bp, Artificial Sequence
  Description of Artificial Sequence: Synthetic oligonucleotide
  Target: SCN10A; (-) strand; PAM type: NRG; PAM sequence: GAG
ctttggtgatctaagcaaaa

SEQ ID NO: 20233 - DNA, 20 bp, Artificial Sequence
  Description of Artificial Sequence: Synthetic oligonucleotide
  Target: SCN10A; (-) strand; PAM type: NRG; PAM sequence: AAG
gtctttggtgatctaagcaa

SEQ ID NO: 20234 - DNA, 20 bp, Artificial Sequence
  Description of Artificial Sequence: Synthetic oligonucleotide
  Target: SCN10A; (-) strand; PAM type: NRG; PAM sequence: AAG
atggatgtctttggtgatct

SEQ ID NO: 20235 - DNA, 20 bp, Artificial Sequence
  Description of Artificial Sequence: Synthetic oligonucleotide
  Target: SCN10A; (-) strand; PAM type: NRG; PAM sequence: TGG
tttagtcacatggatgtctt

SEQ ID NO: 20236 - DNA, 20 bp, Artificial Sequence
  Description of Artificial Sequence: Synthetic oligonucleotide
  Target: SCN10A; (-) strand; PAM type: NRG; PAM sequence: TGG
gtccaggggctttagtcaca

SEQ ID NO: 20237 - DNA, 20 bp, Artificial Sequence
  Description of Artificial Sequence: Synthetic oligonucleotide
  Target: SCN10A; (-) strand; PAM type: NRG; PAM sequence: TAG
atgaaaaggtccaggggctt

SEQ ID NO: 20238 - DNA, 20 bp, Artificial Sequence
  Description of Artificial Sequence: Synthetic oligonucleotide
  Target: SCN10A; (-) strand; PAM type: NRG; PAM sequence: GGG
tgaaacatgaaaaggtccag

SEQ ID NO: 20239 - DNA, 20 bp, Artificial Sequence
  Description of Artificial Sequence: Synthetic oligonucleotide
  Target: SCN10A; (-) strand; PAM type: NRG; PAM sequence: GGG
atgaaacatgaaaaggtcca

SEQ ID NO: 20240 - DNA, 20 bp, Artificial Sequence
  Description of Artificial Sequence: Synthetic oligonucleotide
  Target: SCN10A; (-) strand; PAM type: NRG; PAM sequence: AGG
aatgaaacatgaaaaggtcc

SEQ ID NO: 20241 - DNA, 20 bp, Artificial Sequence
  Description of Artificial Sequence: Synthetic oligonucleotide
  Target: SCN10A; (-) strand; PAM type: NRG; PAM sequence: CAG
aaatgaaacatgaaaaggtc

SEQ ID NO: 20242 - DNA, 20 bp, Artificial Sequence
  Description of Artificial Sequence: Synthetic oligonucleotide
  Target: SCN10A; (-) strand; PAM type: NRG; PAM sequence: AGG
aggtaaaatgaaacatgaaa

SEQ ID NO: 20243 - DNA, 20 bp, Artificial Sequence
  Description of Artificial Sequence: Synthetic oligonucleotide
  Target: SCN10A; (-) strand; PAM type: NRG; PAM sequence: AAG
caggtaaaatgaaacatgaa

SEQ ID NO: 20244 - DNA, 20 bp, Artificial Sequence
  Description of Artificial Sequence: Synthetic oligonucleotide
  Target: SCN10A; (-) strand; PAM type: NRG; PAM sequence: AGG
ggcaatgctgtggaaaggtc

SEQ ID NO: 20245 - DNA, 20 bp, Artificial Sequence
  Description of Artificial Sequence: Synthetic oligonucleotide
  Target: SCN10A; (-) strand; PAM type: NRG; PAM sequence: CAG
aggcaatgctgtggaaaggt

SEQ ID NO: 20246 - DNA, 20 bp, Artificial Sequence
  Description of Artificial Sequence: Synthetic oligonucleotide
  Target: SCN10A; (-) strand; PAM type: NRG; PAM sequence: AGG
acagaggcaatgctgtggaa

SEQ ID NO: 20247 - DNA, 20 bp, Artificial Sequence
  Description of Artificial Sequence: Synthetic oligonucleotide
  Target: SCN10A; (-) strand; PAM type: NRG; PAM sequence: AAG
aacagaggcaatgctgtgga

SEQ ID NO: 20248 - DNA, 20 bp, Artificial Sequence
  Description of Artificial Sequence: Synthetic oligonucleotide
  Target: SCN10A; (-) strand; PAM type: NRG; PAM sequence: TGG
ggccaacagaggcaatgctg

SEQ ID NO: 20249 - DNA, 20 bp, Artificial Sequence
  Description of Artificial Sequence: Synthetic oligonucleotide
  Target: SCN10A; (-) strand; PAM type: NRG; PAM sequence: AGG
aagaatagaaaggccaacag

SEQ ID NO: 20250 - DNA, 20 bp, Artificial Sequence
  Description of Artificial Sequence: Synthetic oligonucleotide
  Target: SCN10A; (-) strand; PAM type: NRG; PAM sequence: GAG
aaagaatagaaaggccaaca

SEQ ID NO: 20251 - DNA, 20 bp, Artificial Sequence
  Description of Artificial Sequence: Synthetic oligonucleotide
  Target: SCN10A; (-) strand; PAM type: NRG; PAM sequence: CAG
agaaagaatagaaaggccaa

SEQ ID NO: 20252 - DNA, 20 bp, Artificial Sequence
  Description of Artificial Sequence: Synthetic oligonucleotide
  Target: SCN10A; (-) strand; PAM type: NRG; PAM sequence: AGG
tttcttcagaaagaatagaa

SEQ ID NO: 20253 - DNA, 20 bp, Artificial Sequence
  Description of Artificial Sequence: Synthetic oligonucleotide
  Target: SCN10A; (-) strand; PAM type: NRG; PAM sequence: AAG
atttcttcagaaagaataga

SEQ ID NO: 20254 - DNA, 20 bp, Artificial Sequence
  Description of Artificial Sequence: Synthetic oligonucleotide
  Target: SCN10A; (-) strand; PAM type: NRG; PAM sequence: TAG
aaaaatttcttcagaaagaa

SEQ ID NO: 20255 - DNA, 20 bp, Artificial Sequence
  Description of Artificial Sequence: Synthetic oligonucleotide
  Target: SCN10A; (-) strand; PAM type: NRG; PAM sequence: AAG
agagtaaaaatttcttcaga

SEQ ID NO: 20256 - DNA, 20 bp, Artificial Sequence
  Description of Artificial Sequence: Synthetic oligonucleotide
  Target: SCN10A; (-) strand; PAM type: NRG; PAM sequence: CAG
gccaagagtaaaaatttctt

SEQ ID NO: 20257 - DNA, 20 bp, Artificial Sequence
  Description of Artificial Sequence: Synthetic oligonucleotide
  Target: SCN10A; (-) strand; PAM type: NRG; PAM sequence: GAG
agaatacaatgcagagccaa

SEQ ID NO: 20258 - DNA, 20 bp, Artificial Sequence
  Description of Artificial Sequence: Synthetic oligonucleotide
  Target: SCN10A; (-) strand; PAM type: NRG; PAM sequence: AAG
gaagaatacaatgcagagcc

SEQ ID NO: 20259 - DNA, 20 bp, Artificial Sequence
  Description of Artificial Sequence: Synthetic oligonucleotide
  Target: SCN10A; (-) strand; PAM type: NRG; PAM sequence: GAG
atctagaagaatacaatgca

SEQ ID NO: 20260 - DNA, 20 bp, Artificial Sequence
  Description of Artificial Sequence: Synthetic oligonucleotide
  Target: SCN10A; (-) strand; PAM type: NRG; PAM sequence: CAG
agatctagaagaatacaatg

SEQ ID NO: 20261 - DNA, 20 bp, Artificial Sequence
  Description of Artificial Sequence: Synthetic oligonucleotide
  Target: SCN10A; (-) strand; PAM type: NRG; PAM sequence: AAG
agaaataggaaaagatctag

SEQ ID NO: 20262 - DNA, 20 bp, Artificial Sequence
  Description of Artificial Sequence: Synthetic oligonucleotide
  Target: SCN10A; (-) strand; PAM type: NRG; PAM sequence: TAG
tacagaaataggaaaagatc

SEQ ID NO: 20263 - DNA, 20 bp, Artificial Sequence
  Description of Artificial Sequence: Synthetic oligonucleotide
  Target: SCN10A; (-) strand; PAM type: NRG; PAM sequence: AAG
ggaaggtacagaaataggaa

SEQ ID NO: 20264 - DNA, 20 bp, Artificial Sequence
  Description of Artificial Sequence: Synthetic oligonucleotide
  Target: SCN10A; (-) strand; PAM type: NRG; PAM sequence: AGG
gaaaaggaaggtacagaaat

SEQ ID NO: 20265 - DNA, 20 bp, Artificial Sequence
  Description of Artificial Sequence: Synthetic oligonucleotide
  Target: SCN10A; (-) strand; PAM type: NRG; PAM sequence: TAG
tgaaaaggaaggtacagaaa

SEQ ID NO: 20266 - DNA, 20 bp, Artificial Sequence
  Description of Artificial Sequence: Synthetic oligonucleotide
  Target: SCN10A; (-) strand; PAM type: NRG; PAM sequence: CAG
ggagactgaaaaggaaggta

SEQ ID NO: 20267 - DNA, 20 bp, Artificial Sequence
  Description of Artificial Sequence: Synthetic oligonucleotide
  Target: SCN10A; (-) strand; PAM type: NRG; PAM sequence: AGG
gcagaggagactgaaaagga

SEQ ID NO: 20268 - DNA, 20 bp, Artificial Sequence
  Description of Artificial Sequence: Synthetic oligonucleotide
  Target: SCN10A; (-) strand; PAM type: NRG; PAM sequence: AAG
agcagaggagactgaaaagg

SEQ ID NO: 20269 - DNA, 20 bp, Artificial Sequence
  Description of Artificial Sequence: Synthetic oligonucleotide
  Target: SCN10A; (-) strand; PAM type: NRG; PAM sequence: AGG
cccagcagaggagactgaaa

SEQ ID NO: 20270 - DNA, 20 bp, Artificial Sequence
  Description of Artificial Sequence: Synthetic oligonucleotide
  Target: SCN10A; (-) strand; PAM type: NRG; PAM sequence: AAG
acccagcagaggagactgaa

SEQ ID NO: 20271 - DNA, 20 bp, Artificial Sequence
  Description of Artificial Sequence: Synthetic oligonucleotide
  Target: SCN10A; (-) strand; PAM type: NRG; PAM sequence: GAG
aagagatggacccagcagag

SEQ ID NO: 20272 - DNA, 20 bp, Artificial Sequence
  Description of Artificial Sequence: Synthetic oligonucleotide
  Target: SCN10A; (-) strand; PAM type: NRG; PAM sequence: AGG
agaagagatggacccagcag

SEQ ID NO: 20273 - DNA, 20 bp, Artificial Sequence
  Description of Artificial Sequence: Synthetic oligonucleotide
  Target: SCN10A; (-) strand; PAM type: NRG; PAM sequence: GAG
cagaagagatggacccagca

SEQ ID NO: 20274 - DNA, 20 bp, Artificial Sequence
  Description of Artificial Sequence: Synthetic oligonucleotide
  Target: SCN10A; (-) strand; PAM type: NRG; PAM sequence: CAG
agcagaagagatggacccag

SEQ ID NO: 20275 - DNA, 20 bp, Artificial Sequence
  Description of Artificial Sequence: Synthetic oligonucleotide
  Target: SCN10A; (-) strand; PAM type: NRG; PAM sequence: CAG
ttaagcagaagagatggacc

SEQ ID NO: 20276 - DNA, 20 bp, Artificial Sequence
  Description of Artificial Sequence: Synthetic oligonucleotide
  Target: SCN10A; (-) strand; PAM type: NRG; PAM sequence: TGG
taatagttaagcagaagaga

SEQ ID NO: 20277 - DNA, 20 bp, Artificial Sequence
  Description of Artificial Sequence: Synthetic oligonucleotide
  Target: SCN10A; (-) strand; PAM type: NRG; PAM sequence: GAG
tgtttaatagttaagcagaa

SEQ ID NO: 20278 - DNA, 20 bp, Artificial Sequence
  Description of Artificial Sequence: Synthetic oligonucleotide
  Target: SCN10A; (-) strand; PAM type: NRG; PAM sequence: AAG
aatgtttaatagttaagcag

SEQ ID NO: 20279 - DNA, 20 bp, Artificial Sequence
  Description of Artificial Sequence: Synthetic oligonucleotide
  Target: SCN10A; (-) strand; PAM type: NRG; PAM sequence: CAG
ctaaatgtttaatagttaag

SEQ ID NO: 20280 - DNA, 20 bp, Artificial Sequence
  Description of Artificial Sequence: Synthetic oligonucleotide
  Target: SCN10A; (-) strand; PAM type: NRG; PAM sequence: AAG
aaactaaatgtttaatagtt

SEQ ID NO: 20281 - DNA, 20 bp, Artificial Sequence
  Description of Artificial Sequence: Synthetic oligonucleotide
  Target: SCN10A; (-) strand; PAM type: NRG; PAM sequence: TAG
ctaacaaactaaatgtttaa

SEQ ID NO: 20282 - DNA, 20 bp, Artificial Sequence
  Description of Artificial Sequence: Synthetic oligonucleotide
  Target: SCN10A; (-) strand; PAM type: NRG; PAM sequence: CAG
agagaagaaggcctcagaca

SEQ ID NO: 20283 - DNA, 20 bp, Artificial Sequence
  Description of Artificial Sequence: Synthetic oligonucleotide
  Target: SCN10A; (-) strand; PAM type: NRG; PAM sequence: CAG
gtaagaagagaagaaggcct

SEQ ID NO: 20284 - DNA, 20 bp, Artificial Sequence
  Description of Artificial Sequence: Synthetic oligonucleotide
  Target: SCN10A; (-) strand; PAM type: NRG; PAM sequence: AGG
gttgaagtaagaagagaaga

SEQ ID NO: 20285 - DNA, 20 bp, Artificial Sequence
  Description of Artificial Sequence: Synthetic oligonucleotide
  Target: SCN10A; (-) strand; PAM type: NRG; PAM sequence: AAG
ggttgaagtaagaagagaag

SEQ ID NO: 20286 - DNA, 20 bp, Artificial Sequence
  Description of Artificial Sequence: Synthetic oligonucleotide
  Target: SCN10A; (-) strand; PAM type: NRG; PAM sequence: AAG
aagggttgaagtaagaagag

SEQ ID NO: 20287 - DNA, 20 bp, Artificial Sequence
  Description of Artificial Sequence: Synthetic oligonucleotide
  Target: SCN10A; (-) strand; PAM type: NRG; PAM sequence: GAG
cagaagggttgaagtaagaa

SEQ ID NO: 20288 - DNA, 20 bp, Artificial Sequence
  Description of Artificial Sequence: Synthetic oligonucleotide
  Target: SCN10A; (-) strand; PAM type: NRG; PAM sequence: AAG
cacagaagggttgaagtaag

SEQ ID NO: 20289 - DNA, 20 bp, Artificial Sequence
  Description of Artificial Sequence: Synthetic oligonucleotide
  Target: SCN10A; (-) strand; PAM type: NRG; PAM sequence: AAG
taacacagaagggttgaagt

SEQ ID NO: 20290 - DNA, 20 bp, Artificial Sequence
  Description of Artificial Sequence: Synthetic oligonucleotide
  Target: SCN10A; (-) strand; PAM type: NRG; PAM sequence: AAG
gagttaacacagaagggttg

SEQ ID NO: 20291 - DNA, 20 bp, Artificial Sequence
  Description of Artificial Sequence: Synthetic oligonucleotide
  Target: SCN10A; (-) strand; PAM type: NRG; PAM sequence: GGG
ctggatgagttaacacagaa

SEQ ID NO: 20292 - DNA, 20 bp, Artificial Sequence
  Description of Artificial Sequence: Synthetic oligonucleotide
  Target: SCN10A; (-) strand; PAM type: NRG; PAM sequence: AGG
actggatgagttaacacaga

SEQ ID NO: 20293 - DNA, 20 bp, Artificial Sequence
  Description of Artificial Sequence: Synthetic oligonucleotide
  Target: SCN10A; (-) strand; PAM type: NRG; PAM sequence: AAG
aactggatgagttaacacag

SEQ ID NO: 20294 - DNA, 20 bp, Artificial Sequence
  Description of Artificial Sequence: Synthetic oligonucleotide
  Target: SCN10A; (-) strand; PAM type: NRG; PAM sequence: CAG
tgcaactggatgagttaaca

SEQ ID NO: 20295 - DNA, 20 bp, Artificial Sequence
  Description of Artificial Sequence: Synthetic oligonucleotide
  Target: SCN10A; (-) strand; PAM type: NRG; PAM sequence: GAG
ttgaaaagatgcaactggat

SEQ ID NO: 20296 - DNA, 20 bp, Artificial Sequence
  Description of Artificial Sequence: Synthetic oligonucleotide
  Target: SCN10A; (-) strand; PAM type: NRG; PAM sequence: TGG
taattttgaaaagatgcaac

SEQ ID NO: 20297 - DNA, 20 bp, Artificial Sequence
  Description of Artificial Sequence: Synthetic oligonucleotide
  Target: SCN10A; (-) strand; PAM type: NRG; PAM sequence: AAG
atgtaagtggtaattttgaa

SEQ ID NO: 20298 - DNA, 20 bp, Artificial Sequence
  Description of Artificial Sequence: Synthetic oligonucleotide
  Target: SCN10A; (-) strand; PAM type: NRG; PAM sequence: TGG
gaaagcagtttgaatgtaag

SEQ ID NO: 20299 - DNA, 20 bp, Artificial Sequence
  Description of Artificial Sequence: Synthetic oligonucleotide
  Target: SCN10A; (-) strand; PAM type: NRG; PAM sequence: AAG
tttgaaagcagtttgaatgt

SEQ ID NO: 20300 - DNA, 20 bp, Artificial Sequence
  Description of Artificial Sequence: Synthetic oligonucleotide
  Target: SCN10A; (-) strand; PAM type: NRG; PAM sequence: CAG
tatatatatatatttgaaag

SEQ ID NO: 20301 - DNA, 20 bp, Artificial Sequence
  Description of Artificial Sequence: Synthetic oligonucleotide
  Target: SCN10A; (-) strand; PAM type: NRG; PAM sequence: AAG
atgtatatatatatatttga

SEQ ID NO: 20302 - DNA, 20 bp, Artificial Sequence
  Description of Artificial Sequence: Synthetic oligonucleotide
  Target: SCN10A; (-) strand; PAM type: NRG; PAM sequence: TGG
tagaacttagatgacaaaga

SEQ ID NO: 20303 - DNA, 20 bp, Artificial Sequence
  Description of Artificial Sequence: Synthetic oligonucleotide
  Target: SCN10A; (-) strand; PAM type: NRG; PAM sequence: AAG
ggtctagaacttagatgaca

SEQ ID NO: 20304 - DNA, 20 bp, Artificial Sequence
  Description of Artificial Sequence: Synthetic oligonucleotide
  Target: SCN10A; (-) strand; PAM type: NRG; PAM sequence: TAG
ggatataggggtctagaact

SEQ ID NO: 20305 - DNA, 20 bp, Artificial Sequence
  Description of Artificial Sequence: Synthetic oligonucleotide
  Target: SCN10A; (-) strand; PAM type: NRG; PAM sequence: TAG
gactttaggatataggggtc

SEQ ID NO: 20306 - DNA, 20 bp, Artificial Sequence
  Description of Artificial Sequence: Synthetic oligonucleotide
  Target: SCN10A; (-) strand; PAM type: NRG; PAM sequence: GGG
aagttgactttaggatatag

SEQ ID NO: 20307 - DNA, 20 bp, Artificial Sequence
  Description of Artificial Sequence: Synthetic oligonucleotide
  Target: SCN10A; (-) strand; PAM type: NRG; PAM sequence: GGG
gaagttgactttaggatata

SEQ ID NO: 20308 - DNA, 20 bp, Artificial Sequence
  Description of Artificial Sequence: Synthetic oligonucleotide
  Target: SCN10A; (-) strand; PAM type: NRG; PAM sequence: AGG
ggaagttgactttaggatat

SEQ ID NO: 20309 - DNA, 20 bp, Artificial Sequence
  Description of Artificial Sequence: Synthetic oligonucleotide
  Target: SCN10A; (-) strand; PAM type: NRG; PAM sequence: TAG
aggaagttgactttaggata

SEQ ID NO: 20310 - DNA, 20 bp, Artificial Sequence
  Description of Artificial Sequence: Synthetic oligonucleotide
  Target: SCN10A; (-) strand; PAM type: NRG; PAM sequence: AGG
tccagtaggaagttgacttt

SEQ ID NO: 20311 - DNA, 20 bp, Artificial Sequence
  Description of Artificial Sequence: Synthetic oligonucleotide
  Target: SCN10A; (-) strand; PAM type: NRG; PAM sequence: TAG
gtccagtaggaagttgactt

SEQ ID NO: 20312 - DNA, 20 bp, Artificial Sequence
  Description of Artificial Sequence: Synthetic oligonucleotide
  Target: SCN10A; (-) strand; PAM type: NRG; PAM sequence: AAG
aggtaggggtgtccagtagg

SEQ ID NO: 20313 - DNA, 20 bp, Artificial Sequence
  Description of Artificial Sequence: Synthetic oligonucleotide
  Target: SCN10A; (-) strand; PAM type: NRG; PAM sequence: AGG
tctaggtaggggtgtccagt

SEQ ID NO: 20314 - DNA, 20 bp, Artificial Sequence
  Description of Artificial Sequence: Synthetic oligonucleotide
  Target: SCN10A; (-) strand; PAM type: NRG; PAM sequence: TAG
atctaggtaggggtgtccag

SEQ ID NO: 20315 - DNA, 20 bp, Artificial Sequence
  Description of Artificial Sequence: Synthetic oligonucleotide
  Target: SCN10A; (-) strand; PAM type: NRG; PAM sequence: CAG
agcatctaggtaggggtgtc

SEQ ID NO: 20316 - DNA, 20 bp, Artificial Sequence
  Description of Artificial Sequence: Synthetic oligonucleotide
  Target: SCN10A; (-) strand; PAM type: NRG; PAM sequence: GGG
cccttggagcatctaggtag

SEQ ID NO: 20317 - DNA, 20 bp, Artificial Sequence
  Description of Artificial Sequence: Synthetic oligonucleotide
  Target: SCN10A; (-) strand; PAM type: NRG; PAM sequence: GGG
gcccttggagcatctaggta

SEQ ID NO: 20318 - DNA, 20 bp, Artificial Sequence
  Description of Artificial Sequence: Synthetic oligonucleotide
  Target: SCN10A; (-) strand; PAM type: NRG; PAM sequence: AGG
tgcccttggagcatctaggt

SEQ ID NO: 20319 - DNA, 20 bp, Artificial Sequence
  Description of Artificial Sequence: Synthetic oligonucleotide
  Target: SCN10A; (-) strand; PAM type: NRG; PAM sequence: TAG
gtgcccttggagcatctagg

SEQ ID NO: 20320 - DNA, 20 bp, Artificial Sequence
  Description of Artificial Sequence: Synthetic oligonucleotide
  Target: SCN10A; (-) strand; PAM type: NRG; PAM sequence: AGG
caggtgcccttggagcatct

SEQ ID NO: 20321 - DNA, 20 bp, Artificial Sequence
  Description of Artificial Sequence: Synthetic oligonucleotide
  Target: SCN10A; (-) strand; PAM type: NRG; PAM sequence: TAG
tcaggtgcccttggagcatc

SEQ ID NO: 20322 - DNA, 20 bp, Artificial Sequence
  Description of Artificial Sequence: Synthetic oligonucleotide
  Target: SCN10A; (-) strand; PAM type: NRG; PAM sequence: GAG
ttgggtttcaggtgcccttg

SEQ ID NO: 20323 - DNA, 20 bp, Artificial Sequence
  Description of Artificial Sequence: Synthetic oligonucleotide
  Target: SCN10A; (-) strand; PAM type: NRG; PAM sequence: TGG
tattgggtttcaggtgccct

SEQ ID NO: 20324 - DNA, 20 bp, Artificial Sequence
  Description of Artificial Sequence: Synthetic oligonucleotide
  Target: SCN10A; (-) strand; PAM type: NRG; PAM sequence: AGG
tctgggatatattgggtttc

SEQ ID NO: 20325 - DNA, 20 bp, Artificial Sequence
  Description of Artificial Sequence: Synthetic oligonucleotide
  Target: SCN10A; (-) strand; PAM type: NRG; PAM sequence: CAG
gtctgggatatattgggttt

SEQ ID NO: 20326 - DNA, 20 bp, Artificial Sequence
  Description of Artificial Sequence: Synthetic oligonucleotide
  Target: SCN10A; (-) strand; PAM type: NRG; PAM sequence: GGG
agttgagtctgggatatatt

SEQ ID NO: 20327 - DNA, 20 bp, Artificial Sequence
  Description of Artificial Sequence: Synthetic oligonucleotide
  Target: SCN10A; (-) strand; PAM type: NRG; PAM sequence: TGG
gagttgagtctgggatatat

SEQ ID NO: 20328 - DNA, 20 bp, Artificial Sequence
  Description of Artificial Sequence: Synthetic oligonucleotide
  Target: SCN10A; (-) strand; PAM type: NRG; PAM sequence: GGG
gaagattatgagttgagtct

SEQ ID NO: 20329 - DNA, 20 bp, Artificial Sequence
  Description of Artificial Sequence: Synthetic oligonucleotide
  Target: SCN10A; (-) strand; PAM type: NRG; PAM sequence: TGG
agaagattatgagttgagtc

SEQ ID NO: 20330 - DNA, 20 bp, Artificial Sequence
  Description of Artificial Sequence: Synthetic oligonucleotide
  Target: SCN10A; (-) strand; PAM type: NRG; PAM sequence: GAG
atgaaagaagattatgagtt

SEQ ID NO: 20331 - DNA, 20 bp, Artificial Sequence
  Description of Artificial Sequence: Synthetic oligonucleotide
  Target: SCN10A; (-) strand; PAM type: NRG; PAM sequence: GAG
gaaagatgaaagaagattat

SEQ ID NO: 20332 - DNA, 20 bp, Artificial Sequence
  Description of Artificial Sequence: Synthetic oligonucleotide
  Target: SCN10A; (-) strand; PAM type: NRG; PAM sequence: AAG
ttaatggggaaagatgaaag

SEQ ID NO: 20333 - DNA, 20 bp, Artificial Sequence
  Description of Artificial Sequence: Synthetic oligonucleotide
  Target: SCN10A; (-) strand; PAM type: NRG; PAM sequence: AAG
gctttaatggggaaagatga

SEQ ID NO: 20334 - DNA, 20 bp, Artificial Sequence
  Description of Artificial Sequence: Synthetic oligonucleotide
  Target: SCN10A; (-) strand; PAM type: NRG; PAM sequence: AAG
gaagggggctttaatgggga

SEQ ID NO: 20335 - DNA, 20 bp, Artificial Sequence
  Description of Artificial Sequence: Synthetic oligonucleotide
  Target: SCN10A; (-) strand; PAM type: NRG; PAM sequence: GGG
ggaagaagggggctttaatg

SEQ ID NO: 20336 - DNA, 20 bp, Artificial Sequence
  Description of Artificial Sequence: Synthetic oligonucleotide
  Target: SCN10A; (-) strand; PAM type: NRG; PAM sequence: GGG
gggaagaagggggctttaat

SEQ ID NO: 20337 - DNA, 20 bp, Artificial Sequence
  Description of Artificial Sequence: Synthetic oligonucleotide
  Target: SCN10A; (-) strand; PAM type: NRG; PAM sequence: TGG
ggggaagaagggggctttaa

SEQ ID NO: 20338 - DNA, 20 bp, Artificial Sequence
  Description of Artificial Sequence: Synthetic oligonucleotide
  Target: SCN10A; (-) strand; PAM type: NRG; PAM sequence: GGG
agcattttaggggaagaagg

SEQ ID NO: 20339 - DNA, 20 bp, Artificial Sequence
  Description of Artificial Sequence: Synthetic oligonucleotide
  Target: SCN10A; (-) strand; PAM type: NRG; PAM sequence: GGG
gagcattttaggggaagaag

SEQ ID NO: 20340 - DNA, 20 bp, Artificial Sequence
  Description of Artificial Sequence: Synthetic oligonucleotide
  Target: SCN10A; (-) strand; PAM type: NRG; PAM sequence: GGG
ggagcattttaggggaagaa

SEQ ID NO: 20341 - DNA, 20 bp, Artificial Sequence
  Description of Artificial Sequence: Synthetic oligonucleotide
  Target: SCN10A; (-) strand; PAM type: NRG; PAM sequence: AGG
gggagcattttaggggaaga

SEQ ID NO: 20342 - DNA, 20 bp, Artificial Sequence
  Description of Artificial Sequence: Synthetic oligonucleotide
  Target: SCN10A; (-) strand; PAM type: NRG; PAM sequence: AAG
agggagcattttaggggaag

SEQ ID NO: 20343 - DNA, 20 bp, Artificial Sequence
  Description of Artificial Sequence: Synthetic oligonucleotide
  Target: SCN10A; (-) strand; PAM type: NRG; PAM sequence: AAG
taaagggagcattttagggg

SEQ ID NO: 20344 - DNA, 20 bp, Artificial Sequence
  Description of Artificial Sequence: Synthetic oligonucleotide
  Target: SCN10A; (-) strand; PAM type: NRG; PAM sequence: GGG
tcataaagggagcattttag

SEQ ID NO: 20345 - DNA, 20 bp, Artificial Sequence
  Description of Artificial Sequence: Synthetic oligonucleotide
  Target: SCN10A; (-) strand; PAM type: NRG; PAM sequence: GGG
ctcataaagggagcatttta

SEQ ID NO: 20346 - DNA, 20 bp, Artificial Sequence
  Description of Artificial Sequence: Synthetic oligonucleotide
  Target: SCN10A; (-) strand; PAM type: NRG; PAM sequence: AGG
actcataaagggagcatttt

SEQ ID NO: 20347 - DNA, 20 bp, Artificial Sequence
  Description of Artificial Sequence: Synthetic oligonucleotide
  Target: SCN10A; (-) strand; PAM type: NRG; PAM sequence: TAG
aactcataaagggagcattt

SEQ ID NO: 20348 - DNA, 20 bp, Artificial Sequence
  Description of Artificial Sequence: Synthetic oligonucleotide
  Target: SCN10A; (-) strand; PAM type: NRG; PAM sequence: GAG
gatacaataactcataaagg

SEQ ID NO: 20349 - DNA, 20 bp, Artificial Sequence
  Description of Artificial Sequence: Synthetic oligonucleotide
  Target: SCN10A; (-) strand; PAM type: NRG; PAM sequence: GGG
ctgatacaataactcataaa

SEQ ID NO: 20350 - DNA, 20 bp, Artificial Sequence
  Description of Artificial Sequence: Synthetic oligonucleotide
  Target: SCN10A; (-) strand; PAM type: NRG; PAM sequence: AGG
gctgatacaataactcataa

SEQ ID NO: 20351 - DNA, 20 bp, Artificial Sequence
  Description of Artificial Sequence: Synthetic oligonucleotide
  Target: SCN10A; (-) strand; PAM type: NRG; PAM sequence: AAG
tgctgatacaataactcata

SEQ ID NO: 20352 - DNA, 20 bp, Artificial Sequence
  Description of Artificial Sequence: Synthetic oligonucleotide
  Target: SCN10A; (-) strand; PAM type: NRG; PAM sequence: AAG
ggttctggtataagtgcctt

SEQ ID NO: 20353 - DNA, 20 bp, Artificial Sequence
  Description of Artificial Sequence: Synthetic oligonucleotide
  Target: SCN10A; (-) strand; PAM type: NRG; PAM sequence: AAG
gatgcatatggttctggtat

SEQ ID NO: 20354 - DNA, 20 bp, Artificial Sequence
  Description of Artificial Sequence: Synthetic oligonucleotide
  Target: SCN10A; (-) strand; PAM type: NRG; PAM sequence: TGG
cttgatgatgcatatggttc

SEQ ID NO: 20355 - DNA, 20 bp, Artificial Sequence
  Description of Artificial Sequence: Synthetic oligonucleotide
  Target: SCN10A; (-) strand; PAM type: NRG; PAM sequence: TGG
tcaggacttgatgatgcata

SEQ ID NO: 20356 - DNA, 20 bp, Artificial Sequence
  Description of Artificial Sequence: Synthetic oligonucleotide
  Target: SCN10A; (-) strand; PAM type: NRG; PAM sequence: AGG
atctaaggggcataagattc

SEQ ID NO: 20357 - DNA, 20 bp, Artificial Sequence
  Description of Artificial Sequence: Synthetic oligonucleotide
  Target: SCN10A; (-) strand; PAM type: NRG; PAM sequence: CAG
tatctaaggggcataagatt

SEQ ID NO: 20358 - DNA, 20 bp, Artificial Sequence
  Description of Artificial Sequence: Synthetic oligonucleotide
  Target: SCN10A; (-) strand; PAM type: NRG; PAM sequence: AAG
gagagctatctaaggggcat

SEQ ID NO: 20359 - DNA, 20 bp, Artificial Sequence
  Description of Artificial Sequence: Synthetic oligonucleotide
  Target: SCN10A; (-) strand; PAM type: NRG; PAM sequence: GGG
ggatatgagagctatctaag

SEQ ID NO: 20360 - DNA, 20 bp, Artificial Sequence
  Description of Artificial Sequence: Synthetic oligonucleotide
  Target: SCN10A; (-) strand; PAM type: NRG; PAM sequence: GGG
aggatatgagagctatctaa

SEQ ID NO: 20361 - DNA, 20 bp, Artificial Sequence
  Description of Artificial Sequence: Synthetic oligonucleotide
  Target: SCN10A; (-) strand; PAM type: NRG; PAM sequence: AGG
aaggatatgagagctatcta

SEQ ID NO: 20362 - DNA, 20 bp, Artificial Sequence
  Description of Artificial Sequence: Synthetic oligonucleotide
  Target: SCN10A; (-) strand; PAM type: NRG; PAM sequence: AAG
gaaggatatgagagctatct

SEQ ID NO: 20363 - DNA, 20 bp, Artificial Sequence
  Description of Artificial Sequence: Synthetic oligonucleotide
  Target: SCN10A; (-) strand; PAM type: NRG; PAM sequence: GAG
tgggaaatggaaggatatga

SEQ ID NO: 20364 - DNA, 20 bp, Artificial Sequence
  Description of Artificial Sequence: Synthetic oligonucleotide
  Target: SCN10A; (-) strand; PAM type: NRG; PAM sequence: GAG
gatgggaaatggaaggatat

SEQ ID NO: 20365 - DNA, 20 bp, Artificial Sequence
  Description of Artificial Sequence: Synthetic oligonucleotide
  Target: SCN10A; (-) strand; PAM type: NRG; PAM sequence: AGG
tggggctgatgggaaatgga

SEQ ID NO: 20366 - DNA, 20 bp, Artificial Sequence
  Description of Artificial Sequence: Synthetic oligonucleotide
  Target: SCN10A; (-) strand; PAM type: NRG; PAM sequence: AAG
gtggggctgatgggaaatgg

SEQ ID NO: 20367 - DNA, 20 bp, Artificial Sequence
  Description of Artificial Sequence: Synthetic oligonucleotide
  Target: SCN10A; (-) strand; PAM type: NRG; PAM sequence: TGG
acagtggggctgatgggaaa

SEQ ID NO: 20368 - DNA, 20 bp, Artificial Sequence
  Description of Artificial Sequence: Synthetic oligonucleotide
  Target: SCN10A; (-) strand; PAM type: NRG; PAM sequence: GGG
gtagtgacagtggggctgat

SEQ ID NO: 20369 - DNA, 20 bp, Artificial Sequence
  Description of Artificial Sequence: Synthetic oligonucleotide
  Target: SCN10A; (-) strand; PAM type: NRG; PAM sequence: TGG
ggtagtgacagtggggctga

SEQ ID NO: 20370 - DNA, 20 bp, Artificial Sequence
  Description of Artificial Sequence: Synthetic oligonucleotide
  Target: SCN10A; (-) strand; PAM type: NRG; PAM sequence: GGG
actctggggtagtgacagtg

SEQ ID NO: 20371 - DNA, 20 bp, Artificial Sequence
  Description of Artificial Sequence: Synthetic oligonucleotide
  Target: SCN10A; (-) strand; PAM type: NRG; PAM sequence: GGG
aactctggggtagtgacagt

SEQ ID NO: 20372 - DNA, 20 bp, Artificial Sequence
  Description of Artificial Sequence: Synthetic oligonucleotide
  Target: SCN10A; (-) strand; PAM type: NRG; PAM sequence: TGG
gaactctggggtagtgacag

SEQ ID NO: 20373 - DNA, 20 bp, Artificial Sequence
  Description of Artificial Sequence: Synthetic oligonucleotide
  Target: SCN10A; (-) strand; PAM type: NRG; PAM sequence: CAG
cttgaactctggggtagtga

SEQ ID NO: 20374 - DNA, 20 bp, Artificial Sequence
  Description of Artificial Sequence: Synthetic oligonucleotide
  Target: SCN10A; (-) strand; PAM type: NRG; PAM sequence: TAG
gcagtgcttgaactctgggg

SEQ ID NO: 20375 - DNA, 20 bp, Artificial Sequence
  Description of Artificial Sequence: Synthetic oligonucleotide
  Target: SCN10A; (-) strand; PAM type: NRG; PAM sequence: GGG
atggcagtgcttgaactctg

SEQ ID NO: 20376 - DNA, 20 bp, Artificial Sequence
  Description of Artificial Sequence: Synthetic oligonucleotide
  Target: SCN10A; (-) strand; PAM type: NRG; PAM sequence: GGG
gatggcagtgcttgaactct

SEQ ID NO: 20377 - DNA, 20 bp, Artificial Sequence
  Description of Artificial Sequence: Synthetic oligonucleotide
  Target: SCN10A; (-) strand; PAM type: NRG; PAM sequence: TGG
agatggcagtgcttgaactc

SEQ ID NO: 20378 - DNA, 20 bp, Artificial Sequence
  Description of Artificial Sequence: Synthetic oligonucleotide
  Target: SCN10A; (-) strand; PAM type: NRG; PAM sequence: CAG
ggaagccaagtacaagatgg

SEQ ID NO: 20379 - DNA, 20 bp, Artificial Sequence
  Description of Artificial Sequence: Synthetic oligonucleotide
  Target: SCN10A; (-) strand; PAM type: NRG; PAM sequence: TGG
ggaggaagccaagtacaaga

SEQ ID NO: 20380 - DNA, 20 bp, Artificial Sequence
  Description of Artificial Sequence: Synthetic oligonucleotide
  Target: SCN10A; (-) strand; PAM type: NRG; PAM sequence: AAG
gttaggaggaagccaagtac

SEQ ID NO: 20381 - DNA, 20 bp, Artificial Sequence
  Description of Artificial Sequence: Synthetic oligonucleotide
  Target: SCN10A; (-) strand; PAM type: NRG; PAM sequence: AAG
aaaccagttaggaggaagcc

SEQ ID NO: 20382 - DNA, 20 bp, Artificial Sequence
  Description of Artificial Sequence: Synthetic oligonucleotide
  Target: SCN10A; (-) strand; PAM type: NRG; PAM sequence: AAG
cagggaaaccagttaggagg

SEQ ID NO: 20383 - DNA, 20 bp, Artificial Sequence
  Description of Artificial Sequence: Synthetic oligonucleotide
  Target: SCN10A; (-) strand; PAM type: NRG; PAM sequence: AGG
tgtcagggaaaccagttagg

SEQ ID NO: 20384 - DNA, 20 bp, Artificial Sequence
  Description of Artificial Sequence: Synthetic oligonucleotide
  Target: SCN10A; (-) strand; PAM type: NRG; PAM sequence: GAG
ttgtcagggaaaccagttag

SEQ ID NO: 20385 - DNA, 20 bp, Artificial Sequence
  Description of Artificial Sequence: Synthetic oligonucleotide
  Target: SCN10A; (-) strand; PAM type: NRG; PAM sequence: AGG
tgttgtcagggaaaccagtt

SEQ ID NO: 20386 - DNA, 20 bp, Artificial Sequence
  Description of Artificial Sequence: Synthetic oligonucleotide
  Target: SCN10A; (-) strand; PAM type: NRG; PAM sequence: TAG
atgttgtcagggaaaccagt

SEQ ID NO: 20387 - DNA, 20 bp, Artificial Sequence
  Description of Artificial Sequence: Synthetic oligonucleotide
  Target: SCN10A; (-) strand; PAM type: NRG; PAM sequence: CAG
aagtatgttgtcagggaaac

SEQ ID NO: 20388 - DNA, 20 bp, Artificial Sequence
  Description of Artificial Sequence: Synthetic oligonucleotide
  Target: SCN10A; (-) strand; PAM type: NRG; PAM sequence: GGG
agaggggaagtatgttgtca

SEQ ID NO: 20389 - DNA, 20 bp, Artificial Sequence
  Description of Artificial Sequence: Synthetic oligonucleotide
  Target: SCN10A; (-) strand; PAM type: NRG; PAM sequence: AGG
aagaggggaagtatgttgtc

SEQ ID NO: 20390 - DNA, 20 bp, Artificial Sequence
  Description of Artificial Sequence: Synthetic oligonucleotide
  Target: SCN10A; (-) strand; PAM type: NRG; PAM sequence: CAG
taagaggggaagtatgttgt

SEQ ID NO: 20391 - DNA, 20 bp, Artificial Sequence
  Description of Artificial Sequence: Synthetic oligonucleotide
  Target: SCN10A; (-) strand; PAM type: NRG; PAM sequence: AAG
acttgtagatataagagggg

SEQ ID NO: 20392 - DNA, 20 bp, Artificial Sequence
  Description of Artificial Sequence: Synthetic oligonucleotide
  Target: SCN10A; (-) strand; PAM type: NRG; PAM sequence: GGG
gatacttgtagatataagag

SEQ ID NO: 20393 - DNA, 20 bp, Artificial Sequence
  Description of Artificial Sequence: Synthetic oligonucleotide
  Target: SCN10A; (-) strand; PAM type: NRG; PAM sequence: GGG
ggatacttgtagatataaga

SEQ ID NO: 20394 - DNA, 20 bp, Artificial Sequence
  Description of Artificial Sequence: Synthetic oligonucleotide
  Target: SCN10A; (-) strand; PAM type: NRG; PAM sequence: AGG
tggatacttgtagatataag

SEQ ID NO: 20395 - DNA, 20 bp, Artificial Sequence
  Description of Artificial Sequence: Synthetic oligonucleotide
  Target: SCN10A; (-) strand; PAM type: NRG; PAM sequence: GAG
ctggatacttgtagatataa

SEQ ID NO: 20396 - DNA, 20 bp, Artificial Sequence
  Description of Artificial Sequence: Synthetic oligonucleotide
  Target: SCN10A; (-) strand; PAM type: NRG; PAM sequence: AAG
ctctggatacttgtagatat

SEQ ID NO: 20397 - DNA, 20 bp, Artificial Sequence
  Description of Artificial Sequence: Synthetic oligonucleotide
  Target: SCN10A; (-) strand; PAM type: NRG; PAM sequence: TAG
aaagttactctggatacttg

SEQ ID NO: 20398 - DNA, 20 bp, Artificial Sequence
  Description of Artificial Sequence: Synthetic oligonucleotide
  Target: SCN10A; (-) strand; PAM type: NRG; PAM sequence: TGG
gcattttataaaagttactc

SEQ ID NO: 20399 - DNA, 20 bp, Artificial Sequence
  Description of Artificial Sequence: Synthetic oligonucleotide
  Target: SCN10A; (-) strand; PAM type: NRG; PAM sequence: AAG
gttacatttgcattttataa

SEQ ID NO: 20400 - DNA, 20 bp, Artificial Sequence
  Description of Artificial Sequence: Synthetic oligonucleotide
  Target: SCN10A; (-) strand; PAM type: NRG; PAM sequence: AAG
ttaaaggattggaggcaggg

SEQ ID NO: 20401 - DNA, 20 bp, Artificial Sequence
  Description of Artificial Sequence: Synthetic oligonucleotide
  Target: SCN10A; (-) strand; PAM type: NRG; PAM sequence: GGG
ccattaaaggattggaggca

SEQ ID NO: 20402 - DNA, 20 bp, Artificial Sequence
  Description of Artificial Sequence: Synthetic oligonucleotide
  Target: SCN10A; (-) strand; PAM type: NRG; PAM sequence: AGG
gccattaaaggattggaggc

SEQ ID NO: 20403 - DNA, 20 bp, Artificial Sequence
  Description of Artificial Sequence: Synthetic oligonucleotide
  Target: SCN10A; (-) strand; PAM type: NRG; PAM sequence: CAG
tgccattaaaggattggagg

SEQ ID NO: 20404 - DNA, 20 bp, Artificial Sequence
  Description of Artificial Sequence: Synthetic oligonucleotide
  Target: SCN10A; (-) strand; PAM type: NRG; PAM sequence: AGG
aggtgccattaaaggattgg

SEQ ID NO: 20405 - DNA, 20 bp, Artificial Sequence
  Description of Artificial Sequence: Synthetic oligonucleotide
  Target: SCN10A; (-) strand; PAM type: NRG; PAM sequence: GAG
gaggtgccattaaaggattg

SEQ ID NO: 20406 - DNA, 20 bp, Artificial Sequence
  Description of Artificial Sequence: Synthetic oligonucleotide
  Target: SCN10A; (-) strand; PAM type: NRG; PAM sequence: TGG
gtgaggtgccattaaaggat

SEQ ID NO: 20407 - DNA, 20 bp, Artificial Sequence
  Description of Artificial Sequence: Synthetic oligonucleotide
  Target: SCN10A; (-) strand; PAM type: NRG; PAM sequence: AGG
gaggagtgaggtgccattaa

SEQ ID NO: 20408 - DNA, 20 bp, Artificial Sequence
  Description of Artificial Sequence: Synthetic oligonucleotide
  Target: SCN10A; (-) strand; PAM type: NRG; PAM sequence: AAG
agaggagtgaggtgccatta

SEQ ID NO: 20409 - DNA, 20 bp, Artificial Sequence
  Description of Artificial Sequence: Synthetic oligonucleotide
  Target: SCN10A; (-) strand; PAM type: NRG; PAM sequence: AGG
acttcatgctaagaggagtg

SEQ ID NO: 20410 - DNA, 20 bp, Artificial Sequence
  Description of Artificial Sequence: Synthetic oligonucleotide
  Target: SCN10A; (-) strand; PAM type: NRG; PAM sequence: GAG
gacttcatgctaagaggagt

SEQ ID NO: 20411 - DNA, 20 bp, Artificial Sequence
  Description of Artificial Sequence: Synthetic oligonucleotide
  Target: SCN10A; (-) strand; PAM type: NRG; PAM sequence: GAG
atgggacttcatgctaagag

SEQ ID NO: 20412 - DNA, 20 bp, Artificial Sequence
  Description of Artificial Sequence: Synthetic oligonucleotide
  Target: SCN10A; (-) strand; PAM type: NRG; PAM sequence: AGG
atatgggacttcatgctaag

SEQ ID NO: 20413 - DNA, 20 bp, Artificial Sequence
  Description of Artificial Sequence: Synthetic oligonucleotide
  Target: SCN10A; (-) strand; PAM type: NRG; PAM sequence: GAG
gatatgggacttcatgctaa

SEQ ID NO: 20414 - DNA, 20 bp, Artificial Sequence
  Description of Artificial Sequence: Synthetic oligonucleotide
  Target: SCN10A; (-) strand; PAM type: NRG; PAM sequence: AAG
aggatatgggacttcatgct

SEQ ID NO: 20415 - DNA, 20 bp, Artificial Sequence
  Description of Artificial Sequence: Synthetic oligonucleotide
  Target: SCN10A; (-) strand; PAM type: NRG; PAM sequence: GGG
ctagactgcattaaggatat

SEQ ID NO: 20416 - DNA, 20 bp, Artificial Sequence
  Description of Artificial Sequence: Synthetic oligonucleotide
  Target: SCN10A; (-) strand; PAM type: NRG; PAM sequence: TGG
cctagactgcattaaggata

SEQ ID NO: 20417 - DNA, 20 bp, Artificial Sequence
  Description of Artificial Sequence: Synthetic oligonucleotide
  Target: SCN10A; (-) strand; PAM type: NRG; PAM sequence: AGG
gaaactcctagactgcatta

SEQ ID NO: 20418 - DNA, 20 bp, Artificial Sequence
  Description of Artificial Sequence: Synthetic oligonucleotide
  Target: SCN10A; (-) strand; PAM type: NRG; PAM sequence: AAG
agaaactcctagactgcatt

SEQ ID NO: 20419 - DNA, 20 bp, Artificial Sequence
  Description of Artificial Sequence: Synthetic oligonucleotide
  Target: SCN10A; (-) strand; PAM type: NRG; PAM sequence: TAG
gccagatcccaagaaactcc

SEQ ID NO: 20420 - DNA, 20 bp, Artificial Sequence
  Description of Artificial Sequence: Synthetic oligonucleotide
  Target: SCN10A; (-) strand; PAM type: NRG; PAM sequence: AAG
atgagttggggccagatccc

SEQ ID NO: 20421 - DNA, 20 bp, Artificial Sequence
  Description of Artificial Sequence: Synthetic oligonucleotide
  Target: SCN10A; (-) strand; PAM type: NRG; PAM sequence: CAG
ctagagggatgagttggggc

SEQ ID NO: 20422 - DNA, 20 bp, Artificial Sequence
  Description of Artificial Sequence: Synthetic oligonucleotide
  Target: SCN10A; (-) strand; PAM type: NRG; PAM sequence: GGG
aaggctagagggatgagttg

SEQ ID NO: 20423 - DNA, 20 bp, Artificial Sequence
  Description of Artificial Sequence: Synthetic oligonucleotide
  Target: SCN10A; (-) strand; PAM type: NRG; PAM sequence: GGG
taaggctagagggatgagtt

SEQ ID NO: 20424 - DNA, 20 bp, Artificial Sequence
  Description of Artificial Sequence: Synthetic oligonucleotide
  Target: SCN10A; (-) strand; PAM type: NRG; PAM sequence: TGG
ataaggctagagggatgagt

SEQ ID NO: 20425 - DNA, 20 bp, Artificial Sequence
  Description of Artificial Sequence: Synthetic oligonucleotide
  Target: SCN10A; (-) strand; PAM type: NRG; PAM sequence: GAG
gaaaataaggctagagggat

SEQ ID NO: 20426 - DNA, 20 bp, Artificial Sequence
  Description of Artificial Sequence: Synthetic oligonucleotide
  Target: SCN10A; (-) strand; PAM type: NRG; PAM sequence: GGG
gaactgaaaataaggctaga

SEQ ID NO: 20427 - DNA, 20 bp, Artificial Sequence
  Description of Artificial Sequence: Synthetic oligonucleotide
  Target: SCN10A; (-) strand; PAM type: NRG; PAM sequence: AGG
agaactgaaaataaggctag

SEQ ID NO: 20428 - DNA, 20 bp, Artificial Sequence
  Description of Artificial Sequence: Synthetic oligonucleotide
  Target: SCN10A; (-) strand; PAM type: NRG; PAM sequence: GAG
gagaactgaaaataaggcta

SEQ ID NO: 20429 - DNA, 20 bp, Artificial Sequence
  Description of Artificial Sequence: Synthetic oligonucleotide
  Target: SCN10A; (-) strand; PAM type: NRG; PAM sequence: TAG
aggagaactgaaaataaggc

SEQ ID NO: 20430 - DNA, 20 bp, Artificial Sequence
  Description of Artificial Sequence: Synthetic oligonucleotide
  Target: SCN10A; (-) strand; PAM type: NRG; PAM sequence: AGG
aaccaggagaactgaaaata

SEQ ID NO: 20431 - DNA, 20 bp, Artificial Sequence
  Description of Artificial Sequence: Synthetic oligonucleotide
  Target: SCN10A; (-) strand; PAM type: NRG; PAM sequence: AAG
gaaccaggagaactgaaaat

SEQ ID NO: 20432 - DNA, 20 bp, Artificial Sequence
  Description of Artificial Sequence: Synthetic oligonucleotide
  Target: SCN10A; (-) strand; PAM type: NRG; PAM sequence: GAG
gctgtaacctagagaaccag

SEQ ID NO: 20433 - DNA, 20 bp, Artificial Sequence
  Description of Artificial Sequence: Synthetic oligonucleotide
  Target: SCN10A; (-) strand; PAM type: NRG; PAM sequence: AGG
tagctgtaacctagagaacc

SEQ ID NO: 20434 - DNA, 20 bp, Artificial Sequence
  Description of Artificial Sequence: Synthetic oligonucleotide
  Target: SCN10A; (-) strand; PAM type: NRG; PAM sequence: CAG
gtagctgtaacctagagaac

SEQ ID NO: 20435 - DNA, 20 bp, Artificial Sequence
  Description of Artificial Sequence: Synthetic oligonucleotide
  Target: SCN10A; (-) strand; PAM type: NRG; PAM sequence: GAG
cctaatgtagctgtaaccta

SEQ ID NO: 20436 - DNA, 20 bp, Artificial Sequence
  Description of Artificial Sequence: Synthetic oligonucleotide
  Target: SCN10A; (-) strand; PAM type: NRG; PAM sequence: TAG
agcctaatgtagctgtaacc

SEQ ID NO: 20437 - DNA, 20 bp, Artificial Sequence
  Description of Artificial Sequence: Synthetic oligonucleotide
  Target: SCN10A; (-) strand; PAM type: NRG; PAM sequence: TAG
aggaatgaaaaagcctaatg

SEQ ID NO: 20438 - DNA, 20 bp, Artificial Sequence
  Description of Artificial Sequence: Synthetic oligonucleotide
  Target: SCN10A; (-) strand; PAM type: NRG; PAM sequence: AAG
taacatttgaaggaatgaaa

SEQ ID NO: 20439 - DNA, 20 bp, Artificial Sequence
  Description of Artificial Sequence: Synthetic oligonucleotide
  Target: SCN10A; (-) strand; PAM type: NRG; PAM sequence: AGG
gaagagagaataacatttga

SEQ ID NO: 20440 - DNA, 20 bp, Artificial Sequence
  Description of Artificial Sequence: Synthetic oligonucleotide
  Target: SCN10A; (-) strand; PAM type: NRG; PAM sequence: AAG
agaagagagaataacatttg

SEQ ID NO: 20441 - DNA, 20 bp, Artificial Sequence
  Description of Artificial Sequence: Synthetic oligonucleotide
  Target: SCN10A; (-) strand; PAM type: NRG; PAM sequence: GAG
aaggactgcaaagcagaaga

SEQ ID NO: 20442 - DNA, 20 bp, Artificial Sequence
  Description of Artificial Sequence: Synthetic oligonucleotide
  Target: SCN10A; (-) strand; PAM type: NRG; PAM sequence: GAG
gaaaggactgcaaagcagaa

SEQ ID NO: 20443 - DNA, 20 bp, Artificial Sequence
  Description of Artificial Sequence: Synthetic oligonucleotide
  Target: SCN10A; (-) strand; PAM type: NRG; PAM sequence: AAG
ctgaaaggactgcaaagcag

SEQ ID NO: 20444 - DNA, 20 bp, Artificial Sequence
  Description of Artificial Sequence: Synthetic oligonucleotide
  Target: SCN10A; (-) strand; PAM type: NRG; PAM sequence: CAG
aggctgaaaggactgcaaag

SEQ ID NO: 20445 - DNA, 20 bp, Artificial Sequence
  Description of Artificial Sequence: Synthetic oligonucleotide
  Target: SCN10A; (-) strand; PAM type: NRG; PAM sequence: AAG
cccaggctgaaaggactgca

SEQ ID NO: 20446 - DNA, 20 bp, Artificial Sequence
  Description of Artificial Sequence: Synthetic oligonucleotide
  Target: SCN10A; (-) strand; PAM type: NRG; PAM sequence: AGG
gggaattatcccaggctgaa

SEQ ID NO: 20447 - DNA, 20 bp, Artificial Sequence
  Description of Artificial Sequence: Synthetic oligonucleotide
  Target: SCN10A; (-) strand; PAM type: NRG; PAM sequence: AAG
agggaattatcccaggctga

SEQ ID NO: 20448 - DNA, 20 bp, Artificial Sequence
  Description of Artificial Sequence: Synthetic oligonucleotide
  Target: SCN10A; (-) strand; PAM type: NRG; PAM sequence: AGG
tggagccagggaattatccc

SEQ ID NO: 20449 - DNA, 20 bp, Artificial Sequence
  Description of Artificial Sequence: Synthetic oligonucleotide
  Target: SCN10A; (-) strand; PAM type: NRG; PAM sequence: CAG
ctggagccagggaattatcc

SEQ ID NO: 20450 - DNA, 20 bp, Artificial Sequence
  Description of Artificial Sequence: Synthetic oligonucleotide
  Target: SCN10A; (-) strand; PAM type: NRG; PAM sequence: GGG
gtaagatttgcctggagcca

SEQ ID NO: 20451 - DNA, 20 bp, Artificial Sequence
  Description of Artificial Sequence: Synthetic oligonucleotide
  Target: SCN10A; (-) strand; PAM type: NRG; PAM sequence: AGG
ggtaagatttgcctggagcc

SEQ ID NO: 20452 - DNA, 20 bp, Artificial Sequence
  Description of Artificial Sequence: Synthetic oligonucleotide
  Target: SCN10A; (-) strand; PAM type: NRG; PAM sequence: CAG
tggtaagatttgcctggagc

SEQ ID NO: 20453 - DNA, 20 bp, Artificial Sequence
  Description of Artificial Sequence: Synthetic oligonucleotide
  Target: SCN10A; (-) strand; PAM type: NRG; PAM sequence: GAG
aatatggtaagatttgcctg

SEQ ID NO: 20454 - DNA, 20 bp, Artificial Sequence
  Description of Artificial Sequence: Synthetic oligonucleotide
  Target: SCN10A; (-) strand; PAM type: NRG; PAM sequence: TGG
gaaatatggtaagatttgcc

SEQ ID NO: 20455 - DNA, 20 bp, Artificial Sequence
  Description of Artificial Sequence: Synthetic oligonucleotide
  Target: SCN10A; (-) strand; PAM type: NRG; PAM sequence: AAG
gatactaagtgaaatatggt

SEQ ID NO: 20456 - DNA, 20 bp, Artificial Sequence
  Description of Artificial Sequence: Synthetic oligonucleotide
  Target: SCN10A; (-) strand; PAM type: NRG; PAM sequence: TGG
gcaggatactaagtgaaata

SEQ ID NO: 20457 - DNA, 20 bp, Artificial Sequence
  Description of Artificial Sequence: Synthetic oligonucleotide
  Target: SCN10A; (-) strand; PAM type: NRG; PAM sequence: AAG
aagaggaagtgcaggatact

SEQ ID NO: 20458 - DNA, 20 bp, Artificial Sequence
  Description of Artificial Sequence: Synthetic oligonucleotide
  Target: SCN10A; (-) strand; PAM type: NRG; PAM sequence: AGG
gtgccttaaagaggaagtgc

SEQ ID NO: 20459 - DNA, 20 bp, Artificial Sequence
  Description of Artificial Sequence: Synthetic oligonucleotide
  Target: SCN10A; (-) strand; PAM type: NRG; PAM sequence: CAG
agtgccttaaagaggaagtg

SEQ ID NO: 20460 - DNA, 20 bp, Artificial Sequence
  Description of Artificial Sequence: Synthetic oligonucleotide
  Target: SCN10A; (-) strand; PAM type: NRG; PAM sequence: AAG
tggtgagtgccttaaagagg

SEQ ID NO: 20461 - DNA, 20 bp, Artificial Sequence
  Description of Artificial Sequence: Synthetic oligonucleotide
  Target: SCN10A; (-) strand; PAM type: NRG; PAM sequence: AGG
gagtggtgagtgccttaaag

SEQ ID NO: 20462 - DNA, 20 bp, Artificial Sequence
  Description of Artificial Sequence: Synthetic oligonucleotide
  Target: SCN10A; (-) strand; PAM type: NRG; PAM sequence: GAG
ggagtggtgagtgccttaaa

SEQ ID NO: 20463 - DNA, 20 bp, Artificial Sequence
  Description of Artificial Sequence: Synthetic oligonucleotide
  Target: SCN10A; (-) strand; PAM type: NRG; PAM sequence: AAG
ctggagtggtgagtgcctta

SEQ ID NO: 20464 - DNA, 20 bp, Artificial Sequence
  Description of Artificial Sequence: Synthetic oligonucleotide
  Target: SCN10A; (-) strand; PAM type: NRG; PAM sequence: GAG
agtgagcttactggagtggt

SEQ ID NO: 20465 - DNA, 20 bp, Artificial Sequence
  Description of Artificial Sequence: Synthetic oligonucleotide
  Target: SCN10A; (-) strand; PAM type: NRG; PAM sequence: TGG
cagcagtgagcttactggag

SEQ ID NO: 20466 - DNA, 20 bp, Artificial Sequence
  Description of Artificial Sequence: Synthetic oligonucleotide
  Target: SCN10A; (-) strand; PAM type: NRG; PAM sequence: GAG
tcacagcagtgagcttactg

SEQ ID NO: 20467 - DNA, 20 bp, Artificial Sequence
  Description of Artificial Sequence: Synthetic oligonucleotide
  Target: SCN10A; (-) strand; PAM type: NRG; PAM sequence: TGG
ggtcacagcagtgagcttac

SEQ ID NO: 20468 - DNA, 20 bp, Artificial Sequence
  Description of Artificial Sequence: Synthetic oligonucleotide
  Target: SCN10A; (-) strand; PAM type: NRG; PAM sequence: GAG
agaagctgggtcacagcagt

SEQ ID NO: 20469 - DNA, 20 bp, Artificial Sequence
  Description of Artificial Sequence: Synthetic oligonucleotide
  Target: SCN10A; (-) strand; PAM type: NRG; PAM sequence: CAG
ttccagaagctgggtcacag

SEQ ID NO: 20470 - DNA, 20 bp, Artificial Sequence
  Description of Artificial Sequence: Synthetic oligonucleotide
  Target: SCN10A; (-) strand; PAM type: NRG; PAM sequence: CAG
gaattccagaagctgggtca

SEQ ID NO: 20471 - DNA, 20 bp, Artificial Sequence
  Description of Artificial Sequence: Synthetic oligonucleotide
  Target: SCN10A; (-) strand; PAM type: NRG; PAM sequence: GGG
aagccagaattccagaagct

SEQ ID NO: 20472 - DNA, 20 bp, Artificial Sequence
  Description of Artificial Sequence: Synthetic oligonucleotide
  Target: SCN10A; (-) strand; PAM type: NRG; PAM sequence: TGG
caagccagaattccagaagc

SEQ ID NO: 20473 - DNA, 20 bp, Artificial Sequence
  Description of Artificial Sequence: Synthetic oligonucleotide
  Target: SCN10A; (-) strand; PAM type: NRG; PAM sequence: AAG
tgtccaagccagaattccag

SEQ ID NO: 20474 - DNA, 20 bp, Artificial Sequence
  Description of Artificial Sequence: Synthetic oligonucleotide
  Target: SCN10A; (-) strand; PAM type: NRG; PAM sequence: CAG
tgttgtccaagccagaattc

SEQ ID NO: 20475 - DNA, 20 bp, Artificial Sequence
  Description of Artificial Sequence: Synthetic oligonucleotide
  Target: SCN10A; (-) strand; PAM type: NRG; PAM sequence: CAG
gatttcactgttgtccaagc

SEQ ID NO: 20476 - DNA, 20 bp, Artificial Sequence
  Description of Artificial Sequence: Synthetic oligonucleotide
  Target: SCN10A; (-) strand; PAM type: NRG; PAM sequence: AAG
ctgagatttcactgttgtcc

SEQ ID NO: 20477 - DNA, 20 bp, Artificial Sequence
  Description of Artificial Sequence: Synthetic oligonucleotide
  Target: SCN10A; (-) strand; PAM type: NRG; PAM sequence: GAG
ctatgcttggcatgcaagct

SEQ ID NO: 20478 - DNA, 20 bp, Artificial Sequence
  Description of Artificial Sequence: Synthetic oligonucleotide
  Target: SCN10A; (-) strand; PAM type: NRG; PAM sequence: AAG
accttctatgcttggcatgc

SEQ ID NO: 20479 - DNA, 20 bp, Artificial Sequence
  Description of Artificial Sequence: Synthetic oligonucleotide
  Target: SCN10A; (-) strand; PAM type: NRG; PAM sequence: TGG
gcatgtgaaccttctatgct

SEQ ID NO: 20480 - DNA, 20 bp, Artificial Sequence
  Description of Artificial Sequence: Synthetic oligonucleotide
  Target: SCN10A; (-) strand; PAM type: NRG; PAM sequence: AAG
ttgacaattcactgaactca

SEQ ID NO: 20481 - DNA, 20 bp, Artificial Sequence
  Description of Artificial Sequence: Synthetic oligonucleotide
  Target: SCN10A; (-) strand; PAM type: NRG; PAM sequence: GAG
agtttggcccaaaccaacag

SEQ ID NO: 20482 - DNA, 20 bp, Artificial Sequence
  Description of Artificial Sequence: Synthetic oligonucleotide
  Target: SCN10A; (-) strand; PAM type: NRG; PAM sequence: AGG
aaagtttggcccaaaccaac

SEQ ID NO: 20483 - DNA, 20 bp, Artificial Sequence
  Description of Artificial Sequence: Synthetic oligonucleotide
  Target: SCN10A; (-) strand; PAM type: NRG; PAM sequence: CAG
gaaagtttggcccaaaccaa

SEQ ID NO: 20484 - DNA, 20 bp, Artificial Sequence
  Description of Artificial Sequence: Synthetic oligonucleotide
  Target: SCN10A; (-) strand; PAM type: NRG; PAM sequence: TGG
ggattatgcttaagaaagtt

SEQ ID NO: 20485 - DNA, 20 bp, Artificial Sequence
  Description of Artificial Sequence: Synthetic oligonucleotide
  Target: SCN10A; (-) strand; PAM type: NRG; PAM sequence: AAG
aagagggattatgcttaaga

SEQ ID NO: 20486 - DNA, 20 bp, Artificial Sequence
  Description of Artificial Sequence: Synthetic oligonucleotide
  Target: SCN10A; (-) strand; PAM type: NRG; PAM sequence: AAG
ctttaagagggattatgctt

SEQ ID NO: 20487 - DNA, 20 bp, Artificial Sequence
  Description of Artificial Sequence: Synthetic oligonucleotide
  Target: SCN10A; (-) strand; PAM type: NRG; PAM sequence: GGG
taaaggccacctctttaaga

SEQ ID NO: 20488 - DNA, 20 bp, Artificial Sequence
  Description of Artificial Sequence: Synthetic oligonucleotide
  Target: SCN10A; (-) strand; PAM type: NRG; PAM sequence: AGG
ataaaggccacctctttaag

SEQ ID NO: 20489 - DNA, 20 bp, Artificial Sequence
  Description of Artificial Sequence: Synthetic oligonucleotide
  Target: SCN10A; (-) strand; PAM type: NRG; PAM sequence: GAG
tataaaggccacctctttaa

SEQ ID NO: 20490 - DNA, 20 bp, Artificial Sequence
  Description of Artificial Sequence: Synthetic oligonucleotide
  Target: SCN10A; (-) strand; PAM type: NRG; PAM sequence: AAG
tttataaaggccacctcttt

SEQ ID NO: 20491 - DNA, 20 bp, Artificial Sequence
  Description of Artificial Sequence: Synthetic oligonucleotide
  Target: SCN10A; (-) strand; PAM type: NRG; PAM sequence: AGG
agtcgtaataggatttataa

SEQ ID NO: 20492 - DNA, 20 bp, Artificial Sequence
  Description of Artificial Sequence: Synthetic oligonucleotide
  Target: SCN10A; (-) strand; PAM type: NRG; PAM sequence: AAG
gagtcgtaataggatttata

SEQ ID NO: 20493 - DNA, 20 bp, Artificial Sequence
  Description of Artificial Sequence: Synthetic oligonucleotide
  Target: SCN10A; (-) strand; PAM type: NRG; PAM sequence: AGG
catgctgccagagtcgtaat

SEQ ID NO: 20494 - DNA, 20 bp, Artificial Sequence
  Description of Artificial Sequence: Synthetic oligonucleotide
  Target: SCN10A; (-) strand; PAM type: NRG; PAM sequence: TAG
tcatgctgccagagtcgtaa

SEQ ID NO: 20495 - DNA, 20 bp, Artificial Sequence
  Description of Artificial Sequence: Synthetic oligonucleotide
  Target: SCN10A; (-) strand; PAM type: NRG; PAM sequence: GAG
aaggatgcttcatgctgcca

SEQ ID NO: 20496 - DNA, 20 bp, Artificial Sequence
  Description of Artificial Sequence: Synthetic oligonucleotide
  Target: SCN10A; (-) strand; PAM type: NRG; PAM sequence: CAG
tgaaggatgcttcatgctgc

SEQ ID NO: 20497 - DNA, 20 bp, Artificial Sequence
  Description of Artificial Sequence: Synthetic oligonucleotide
  Target: SCN10A; (-) strand; PAM type: NRG; PAM sequence: AGG
tacacacatgagacacctga

SEQ ID NO: 20498 - DNA, 20 bp, Artificial Sequence
  Description of Artificial Sequence: Synthetic oligonucleotide
  Target: SCN10A; (-) strand; PAM type: NRG; PAM sequence: AAG
ttacacacatgagacacctg

SEQ ID NO: 20499 - DNA, 20 bp, Artificial Sequence
  Description of Artificial Sequence: Synthetic oligonucleotide
  Target: SCN10A; (-) strand; PAM type: NRG; PAM sequence: GAG
gttatattcattacacacat

SEQ ID NO: 20500 - DNA, 20 bp, Artificial Sequence
  Description of Artificial Sequence: Synthetic oligonucleotide
  Target: SCN10A; (-) strand; PAM type: NRG; PAM sequence: TGG
ggcacatcatcttctctggt

SEQ ID NO: 20501 - DNA, 20 bp, Artificial Sequence
  Description of Artificial Sequence: Synthetic oligonucleotide
  Target: SCN10A; (-) strand; PAM type: NRG; PAM sequence: TGG
atagggcacatcatcttctc

SEQ ID NO: 20502 - DNA, 20 bp, Artificial Sequence
  Description of Artificial Sequence: Synthetic oligonucleotide
  Target: SCN10A; (-) strand; PAM type: NRG; PAM sequence: GGG
gtcaaagttttctgagcata

SEQ ID NO: 20503 - DNA, 20 bp, Artificial Sequence
  Description of Artificial Sequence: Synthetic oligonucleotide
  Target: SCN10A; (-) strand; PAM type: NRG; PAM sequence: AGG
ggtcaaagttttctgagcat

SEQ ID NO: 20504 - DNA, 20 bp, Artificial Sequence
  Description of Artificial Sequence: Synthetic oligonucleotide
  Target: SCN10A; (-) strand; PAM type: NRG; PAM sequence: TAG
aggtcaaagttttctgagca

SEQ ID NO: 20505 - DNA, 20 bp, Artificial Sequence
  Description of Artificial Sequence: Synthetic oligonucleotide
  Target: SCN10A; (-) strand; PAM type: NRG; PAM sequence: GAG
aaaagaggtcaaagttttct

SEQ ID NO: 20506 - DNA, 20 bp, Artificial Sequence
  Description of Artificial Sequence: Synthetic oligonucleotide
  Target: SCN10A; (-) strand; PAM type: NRG; PAM sequence: AAG
aggttaaataaaagaggtca

SEQ ID NO: 20507 - DNA, 20 bp, Artificial Sequence
  Description of Artificial Sequence: Synthetic oligonucleotide
  Target: SCN10A; (-) strand; PAM type: NRG; PAM sequence: AGG
aaccttaggttaaataaaag

SEQ ID NO: 20508 - DNA, 20 bp, Artificial Sequence
  Description of Artificial Sequence: Synthetic oligonucleotide
  Target: SCN10A; (-) strand; PAM type: NRG; PAM sequence: GAG
aaaccttaggttaaataaaa

SEQ ID NO: 20509 - DNA, 20 bp, Artificial Sequence
  Description of Artificial Sequence: Synthetic oligonucleotide
  Target: SCN10A; (-) strand; PAM type: NRG; PAM sequence: AAG
ggaaaccttaggttaaataa

SEQ ID NO: 20510 - DNA, 20 bp, Artificial Sequence
  Description of Artificial Sequence: Synthetic oligonucleotide
  Target: SCN10A; (-) strand; PAM type: NRG; PAM sequence: AGG
atctgaggagaggaaacctt

SEQ ID NO: 20511 - DNA, 20 bp, Artificial Sequence
  Description of Artificial Sequence: Synthetic oligonucleotide
  Target: SCN10A; (-) strand; PAM type: NRG; PAM sequence: TAG
aatctgaggagaggaaacct

SEQ ID NO: 20512 - DNA, 20 bp, Artificial Sequence
  Description of Artificial Sequence: Synthetic oligonucleotide
  Target: SCN10A; (-) strand; PAM type: NRG; PAM sequence: AGG
tttaaagaaaatctgaggag

SEQ ID NO: 20513 - DNA, 20 bp, Artificial Sequence
  Description of Artificial Sequence: Synthetic oligonucleotide
  Target: SCN10A; (-) strand; PAM type: NRG; PAM sequence: GAG
ttttaaagaaaatctgagga

SEQ ID NO: 20514 - DNA, 20 bp, Artificial Sequence
  Description of Artificial Sequence: Synthetic oligonucleotide
  Target: SCN10A; (-) strand; PAM type: NRG; PAM sequence: GAG
tgttttaaagaaaatctgag

SEQ ID NO: 20515 - DNA, 20 bp, Artificial Sequence
  Description of Artificial Sequence: Synthetic oligonucleotide
  Target: SCN10A; (-) strand; PAM type: NRG; PAM sequence: AGG
gatgttttaaagaaaatctg

SEQ ID NO: 20516 - DNA, 20 bp, Artificial Sequence
  Description of Artificial Sequence: Synthetic oligonucleotide
  Target: SCN10A; (-) strand; PAM type: NRG; PAM sequence: GAG
tgatgttttaaagaaaatct

SEQ ID NO: 20517 - DNA, 20 bp, Artificial Sequence
  Description of Artificial Sequence: Synthetic oligonucleotide
  Target: SCN10A; (-) strand; PAM type: NRG; PAM sequence: AAG
agagaaacaatgatgtttta

SEQ ID NO: 20518 - DNA, 20 bp, Artificial Sequence
  Description of Artificial Sequence: Synthetic oligonucleotide
  Target: SCN10A; (-) strand; PAM type: NRG; PAM sequence: GAG
cagtagagtaagaaaggcca

SEQ ID NO: 20519 - DNA, 20 bp, Artificial Sequence
  Description of Artificial Sequence: Synthetic oligonucleotide
  Target: SCN10A; (-) strand; PAM type: NRG; PAM sequence: CAG
gacagtagagtaagaaaggc

SEQ ID NO: 20520 - DNA, 20 bp, Artificial Sequence
  Description of Artificial Sequence: Synthetic oligonucleotide
  Target: SCN10A; (-) strand; PAM type: NRG; PAM sequence: AGG
ctgtgacagtagagtaagaa

SEQ ID NO: 20521 - DNA, 20 bp, Artificial Sequence
  Description of Artificial Sequence: Synthetic oligonucleotide
  Target: SCN10A; (-) strand; PAM type: NRG; PAM sequence: AAG
gctgtgacagtagagtaaga

SEQ ID NO: 20522 - DNA, 20 bp, Artificial Sequence
  Description of Artificial Sequence: Synthetic oligonucleotide
  Target: SCN10A; (-) strand; PAM type: NRG; PAM sequence: AAG
agatgctgtgacagtagagt

SEQ ID NO: 20523 - DNA, 20 bp, Artificial Sequence
  Description of Artificial Sequence: Synthetic oligonucleotide
  Target: SCN10A; (-) strand; PAM type: NRG; PAM sequence: GAG
aggaagatgctgtgacagta

SEQ ID NO: 20524 - DNA, 20 bp, Artificial Sequence
  Description of Artificial Sequence: Synthetic oligonucleotide
  Target: SCN10A; (-) strand; PAM type: NRG; PAM sequence: TAG
caaggaagatgctgtgacag

SEQ ID NO: 20525 - DNA, 20 bp, Artificial Sequence
  Description of Artificial Sequence: Synthetic oligonucleotide
  Target: SCN10A; (-) strand; PAM type: NRG; PAM sequence: CAG
cctcaaggaagatgctgtga

SEQ ID NO: 20526 - DNA, 20 bp, Artificial Sequence
  Description of Artificial Sequence: Synthetic oligonucleotide
  Target: SCN10A; (-) strand; PAM type: NRG; PAM sequence: AAG
gggtagacttcccctcaagg

SEQ ID NO: 20527 - DNA, 20 bp, Artificial Sequence
  Description of Artificial Sequence: Synthetic oligonucleotide
  Target: SCN10A; (-) strand; PAM type: NRG; PAM sequence: AGG
gtagggtagacttcccctca

SEQ ID NO: 20528 - DNA, 20 bp, Artificial Sequence
  Description of Artificial Sequence: Synthetic oligonucleotide
  Target: SCN10A; (-) strand; PAM type: NRG; PAM sequence: AAG
ggtagggtagacttcccctc

SEQ ID NO: 20529 - DNA, 20 bp, Artificial Sequence
  Description of Artificial Sequence: Synthetic oligonucleotide
  Target: SCN10A; (-) strand; PAM type: NRG; PAM sequence: TAG
gcaaatatgttggggtaggg

SEQ ID NO: 20530 - DNA, 20 bp, Artificial Sequence
  Description of Artificial Sequence: Synthetic oligonucleotide
  Target: SCN10A; (-) strand; PAM type: NRG; PAM sequence: GGG
taggcaaatatgttggggta

SEQ ID NO: 20531 - DNA, 20 bp, Artificial Sequence
  Description of Artificial Sequence: Synthetic oligonucleotide
  Target: SCN10A; (-) strand; PAM type: NRG; PAM sequence: AGG
ataggcaaatatgttggggt

SEQ ID NO: 20532 - DNA, 20 bp, Artificial Sequence
  Description of Artificial Sequence: Synthetic oligonucleotide
  Target: SCN10A; (-) strand; PAM type: NRG; PAM sequence: TAG
aataggcaaatatgttgggg

SEQ ID NO: 20533 - DNA, 20 bp, Artificial Sequence
  Description of Artificial Sequence: Synthetic oligonucleotide
  Target: SCN10A; (-) strand; PAM type: NRG; PAM sequence: GGG
agtaataggcaaatatgttg

SEQ ID NO: 20534 - DNA, 20 bp, Artificial Sequence
  Description of Artificial Sequence: Synthetic oligonucleotide
  Target: SCN10A; (-) strand; PAM type: NRG; PAM sequence: GGG
aagtaataggcaaatatgtt

SEQ ID NO: 20535 - DNA, 20 bp, Artificial Sequence
  Description of Artificial Sequence: Synthetic oligonucleotide
  Target: SCN10A; (-) strand; PAM type: NRG; PAM sequence: TGG
taagtaataggcaaatatgt

SEQ ID NO: 20536 - DNA, 20 bp, Artificial Sequence
  Description of Artificial Sequence: Synthetic oligonucleotide
  Target: SCN10A; (-) strand; PAM type: NRG; PAM sequence: AGG
aaaggaagaaaataagtaat

SEQ ID NO: 20537 - DNA, 20 bp, Artificial Sequence
  Description of Artificial Sequence: Synthetic oligonucleotide
  Target: SCN10A; (-) strand; PAM type: NRG; PAM sequence: TAG
aaaaggaagaaaataagtaa

SEQ ID NO: 20538 - DNA, 20 bp, Artificial Sequence
  Description of Artificial Sequence: Synthetic oligonucleotide
  Target: SCN10A; (-) strand; PAM type: NRG; PAM sequence: AAG
ctgataaaaaggaagaaaat

SEQ ID NO: 20539 - DNA, 20 bp, Artificial Sequence
  Description of Artificial Sequence: Synthetic oligonucleotide
  Target: SCN10A; (-) strand; PAM type: NRG; PAM sequence: AAG
agtgtgaactgataaaaagg

SEQ ID NO: 20540 - DNA, 20 bp, Artificial Sequence
  Description of Artificial Sequence: Synthetic oligonucleotide
  Target: SCN10A; (-) strand; PAM type: NRG; PAM sequence: AGG
aacagtgtgaactgataaaa

SEQ ID NO: 20541 - DNA, 20 bp, Artificial Sequence
  Description of Artificial Sequence: Synthetic oligonucleotide
  Target: SCN10A; (-) strand; PAM type: NRG; PAM sequence: AAG
taacagtgtgaactgataaa

SEQ ID NO: 20542 - DNA, 20 bp, Artificial Sequence
  Description of Artificial Sequence: Synthetic oligonucleotide
  Target: SCN10A; (-) strand; PAM type: NRG; PAM sequence: CAG
ggagtgatgctaatttataa

SEQ ID NO: 20543 - DNA, 20 bp, Artificial Sequence
  Description of Artificial Sequence: Synthetic oligonucleotide
  Target: SCN10A; (-) strand; PAM type: NRG; PAM sequence: GAG
atttgggtggttggcggcgg

SEQ ID NO: 20544 - DNA, 20 bp, Artificial Sequence
  Description of Artificial Sequence: Synthetic oligonucleotide
  Target: SCN10A; (-) strand; PAM type: NRG; PAM sequence: GGG
atatttgggtggttggcggc

SEQ ID NO: 20545 - DNA, 20 bp, Artificial Sequence
  Description of Artificial Sequence: Synthetic oligonucleotide
  Target: SCN10A; (-) strand; PAM type: NRG; PAM sequence: CGG
gatatttgggtggttggcgg

SEQ ID NO: 20546 - DNA, 20 bp, Artificial Sequence
  Description of Artificial Sequence: Synthetic oligonucleotide
  Target: SCN10A; (-) strand; PAM type: NRG; PAM sequence: CGG
ggtgatatttgggtggttgg

SEQ ID NO: 20547 - DNA, 20 bp, Artificial Sequence
  Description of Artificial Sequence: Synthetic oligonucleotide
  Target: SCN10A; (-) strand; PAM type: NRG; PAM sequence: TGG
aaaggtgatatttgggtggt

SEQ ID NO: 20548 - DNA, 20 bp, Artificial Sequence
  Description of Artificial Sequence: Synthetic oligonucleotide
  Target: SCN10A; (-) strand; PAM type: NRG; PAM sequence: TGG
gcacaaaggtgatatttggg

SEQ ID NO: 20549 - DNA, 20 bp, Artificial Sequence
  Description of Artificial Sequence: Synthetic oligonucleotide
  Target: SCN10A; (-) strand; PAM type: NRG; PAM sequence: GGG
catgcacaaaggtgatattt

SEQ ID NO: 20550 - DNA, 20 bp, Artificial Sequence
  Description of Artificial Sequence: Synthetic oligonucleotide
  Target: SCN10A; (-) strand; PAM type: NRG; PAM sequence: TGG
gcatgcacaaaggtgatatt

SEQ ID NO: 20551 - DNA, 20 bp, Artificial Sequence
  Description of Artificial Sequence: Synthetic oligonucleotide
  Target: SCN10A; (-) strand; PAM type: NRG; PAM sequence: AGG
gaagacaagtgcatgcacaa

SEQ ID NO: 20552 - DNA, 20 bp, Artificial Sequence
  Description of Artificial Sequence: Synthetic oligonucleotide
  Target: SCN10A; (-) strand; PAM type: NRG; PAM sequence: AAG
agaagacaagtgcatgcaca

SEQ ID NO: 20553 - DNA, 20 bp, Artificial Sequence
  Description of Artificial Sequence: Synthetic oligonucleotide
  Target: SCN10A; (-) strand; PAM type: NRG; PAM sequence: AAG
acctccattacccagaagac

SEQ ID NO: 20554 - DNA, 20 bp, Artificial Sequence
  Description of Artificial Sequence: Synthetic oligonucleotide
  Target: SCN10A; (-) strand; PAM type: NRG; PAM sequence: AAG
gcctgacctccattacccag

SEQ ID NO: 20555 - DNA, 20 bp, Artificial Sequence
  Description of Artificial Sequence: Synthetic oligonucleotide
  Target: SCN10A; (-) strand; PAM type: NRG; PAM sequence: CAG
acagcctgacctccattacc

SEQ ID NO: 20556 - DNA, 20 bp, Artificial Sequence
  Description of Artificial Sequence: Synthetic oligonucleotide
  Target: SCN10A; (-) strand; PAM type: NRG; PAM sequence: CAG
agatgtgtctgttttgctca

SEQ ID NO: 20557 - DNA, 20 bp, Artificial Sequence
  Description of Artificial Sequence: Synthetic oligonucleotide
  Target: SCN10A; (-) strand; PAM type: NRG; PAM sequence: GAG
ttgtaaaatctatgagggcg

SEQ ID NO: 20558 - DNA, 20 bp, Artificial Sequence
  Description of Artificial Sequence: Synthetic oligonucleotide
  Target: SCN10A; (-) strand; PAM type: NRG; PAM sequence: CGG
ggttgtaaaatctatgaggg

SEQ ID NO: 20559 - DNA, 20 bp, Artificial Sequence
  Description of Artificial Sequence: Synthetic oligonucleotide
  Target: SCN10A; (-) strand; PAM type: NRG; PAM sequence: GGG
ctaggttgtaaaatctatga

SEQ ID NO: 20560 - DNA, 20 bp, Artificial Sequence
  Description of Artificial Sequence: Synthetic oligonucleotide
  Target: SCN10A; (-) strand; PAM type: NRG; PAM sequence: AGG
actaggttgtaaaatctatg

SEQ ID NO: 20561 - DNA, 20 bp, Artificial Sequence
  Description of Artificial Sequence: Synthetic oligonucleotide
  Target: SCN10A; (-) strand; PAM type: NRG; PAM sequence: GAG
tactaggttgtaaaatctat

SEQ ID NO: 20562 - DNA, 20 bp, Artificial Sequence
  Description of Artificial Sequence: Synthetic oligonucleotide
  Target: SCN10A; (-) strand; PAM type: NRG; PAM sequence: AGG
tttggctattatgatttact

SEQ ID NO: 20563 - DNA, 20 bp, Artificial Sequence
  Description of Artificial Sequence: Synthetic oligonucleotide
  Target: SCN10A; (-) strand; PAM type: NRG; PAM sequence: TAG
atttggctattatgatttac

SEQ ID NO: 20564 - DNA, 20 bp, Artificial Sequence
  Description of Artificial Sequence: Synthetic oligonucleotide
  Target: SCN10A; (-) strand; PAM type: NRG; PAM sequence: TGG
tagtaaatactcatcacatt

SEQ ID NO: 20565 - DNA, 20 bp, Artificial Sequence
  Description of Artificial Sequence: Synthetic oligonucleotide
  Target: SCN10A; (-) strand; PAM type: NRG; PAM sequence: TAG
ttagaaccacgactggcatg

SEQ ID NO: 20566 - DNA, 20 bp, Artificial Sequence
  Description of Artificial Sequence: Synthetic oligonucleotide
  Target: SCN10A; (-) strand; PAM type: NRG; PAM sequence: TGG
aaaatgcttagaaccacgac

SEQ ID NO: 20567 - DNA, 20 bp, Artificial Sequence
  Description of Artificial Sequence: Synthetic oligonucleotide
  Target: SCN10A; (-) strand; PAM type: NRG; PAM sequence: TAG
gtcaggtcaagcaaaatgct

SEQ ID NO: 20568 - DNA, 20 bp, Artificial Sequence
  Description of Artificial Sequence: Synthetic oligonucleotide
  Target: SCN10A; (-) strand; PAM type: NRG; PAM sequence: AAG
aggattaaatgagtcaggtc

SEQ ID NO: 20569 - DNA, 20 bp, Artificial Sequence
  Description of Artificial Sequence: Synthetic oligonucleotide
  Target: SCN10A; (-) strand; PAM type: NRG; PAM sequence: AGG
ttgtgaggattaaatgagtc

SEQ ID NO: 20570 - DNA, 20 bp, Artificial Sequence
  Description of Artificial Sequence: Synthetic oligonucleotide
  Target: SCN10A; (-) strand; PAM type: NRG; PAM sequence: CAG
tttgtgaggattaaatgagt

SEQ ID NO: 20571 - DNA, 20 bp, Artificial Sequence
  Description of Artificial Sequence: Synthetic oligonucleotide
  Target: SCN10A; (-) strand; PAM type: NRG; PAM sequence: GAG
gagttttgtgaggattaaat

SEQ ID NO: 20572 - DNA, 20 bp, Artificial Sequence
  Description of Artificial Sequence: Synthetic oligonucleotide
  Target: SCN10A; (-) strand; PAM type: NRG; PAM sequence: AGG
ttatcttgtagagttttgtg

SEQ ID NO: 20573 - DNA, 20 bp, Artificial Sequence
  Description of Artificial Sequence: Synthetic oligonucleotide
  Target: SCN10A; (-) strand; PAM type: NRG; PAM sequence: GAG
cttatcttgtagagttttgt

SEQ ID NO: 20574 - DNA, 20 bp, Artificial Sequence
  Description of Artificial Sequence: Synthetic oligonucleotide
  Target: SCN10A; (-) strand; PAM type: NRG; PAM sequence: GAG
gagaatatacttatcttgta

SEQ ID NO: 20575 - DNA, 20 bp, Artificial Sequence
  Description of Artificial Sequence: Synthetic oligonucleotide
  Target: SCN10A; (-) strand; PAM type: NRG; PAM sequence: TAG
gtgagaatatacttatcttg

SEQ ID NO: 20576 - DNA, 20 bp, Artificial Sequence
  Description of Artificial Sequence: Synthetic oligonucleotide
  Target: SCN10A; (-) strand; PAM type: NRG; PAM sequence: GAG
tttttagcctgtaaagtagt

SEQ ID NO: 20577 - DNA, 20 bp, Artificial Sequence
  Description of Artificial Sequence: Synthetic oligonucleotide
  Target: SCN10A; (-) strand; PAM type: NRG; PAM sequence: TAG
cagatttttagcctgtaaag

SEQ ID NO: 20578 - DNA, 20 bp, Artificial Sequence
  Description of Artificial Sequence: Synthetic oligonucleotide
  Target: SCN10A; (-) strand; PAM type: NRG; PAM sequence: AAG
cctcagatttttagcctgta

SEQ ID NO: 20579 - DNA, 20 bp, Artificial Sequence
  Description of Artificial Sequence: Synthetic oligonucleotide
  Target: SCN10A; (-) strand; PAM type: NRG; PAM sequence: TAG
ttttctgtgcctcagatttt

SEQ ID NO: 20580 - DNA, 20 bp, Artificial Sequence
  Description of Artificial Sequence: Synthetic oligonucleotide
  Target: SCN10A; (-) strand; PAM type: NRG; PAM sequence: CAG
tcagtaacttttctgtgcct

SEQ ID NO: 20581 - DNA, 20 bp, Artificial Sequence
  Description of Artificial Sequence: Synthetic oligonucleotide
  Target: SCN10A; (-) strand; PAM type: NRG; PAM sequence: CAG
acagtgtgaccttggagctt

SEQ ID NO: 20582 - DNA, 20 bp, Artificial Sequence
  Description of Artificial Sequence: Synthetic oligonucleotide
  Target: SCN10A; (-) strand; PAM type: NRG; PAM sequence: GAG
tggtacacagtgtgaccttg

SEQ ID NO: 20583 - DNA, 20 bp, Artificial Sequence
  Description of Artificial Sequence: Synthetic oligonucleotide
  Target: SCN10A; (-) strand; PAM type: NRG; PAM sequence: TGG
tatggtacacagtgtgacct

SEQ ID NO: 20584 - DNA, 20 bp, Artificial Sequence
  Description of Artificial Sequence: Synthetic oligonucleotide
  Target: SCN10A; (-) strand; PAM type: NRG; PAM sequence: CAG
gctcttccacttatggtaca

SEQ ID NO: 20585 - DNA, 20 bp, Artificial Sequence
  Description of Artificial Sequence: Synthetic oligonucleotide
  Target: SCN10A; (-) strand; PAM type: NRG; PAM sequence: TGG
catcctagctcttccactta

SEQ ID NO: 20586 - DNA, 20 bp, Artificial Sequence
  Description of Artificial Sequence: Synthetic oligonucleotide
  Target: SCN10A; (-) strand; PAM type: NRG; PAM sequence: TAG
ggctgcctgggtttgcatcc

SEQ ID NO: 20587 - DNA, 20 bp, Artificial Sequence
  Description of Artificial Sequence: Synthetic oligonucleotide
  Target: SCN10A; (-) strand; PAM type: NRG; PAM sequence: GGG
gctctggaacccggctgcct

SEQ ID NO: 20588 - DNA, 20 bp, Artificial Sequence
  Description of Artificial Sequence: Synthetic oligonucleotide
  Target: SCN10A; (-) strand; PAM type: NRG; PAM sequence: TGG
tgctctggaacccggctgcc

SEQ ID NO: 20589 - DNA, 20 bp, Artificial Sequence
  Description of Artificial Sequence: Synthetic oligonucleotide
  Target: SCN10A; (-) strand; PAM type: NRG; PAM sequence: CGG
tagaacactgctctggaacc

SEQ ID NO: 20590 - DNA, 20 bp, Artificial Sequence
  Description of Artificial Sequence: Synthetic oligonucleotide
  Target: SCN10A; (-) strand; PAM type: NRG; PAM sequence: TGG
tagtagttagaacactgctc

SEQ ID NO: 20591 - DNA, 20 bp, Artificial Sequence
  Description of Artificial Sequence: Synthetic oligonucleotide
  Target: SCN10A; (-) strand; PAM type: NRG; PAM sequence: TAG
aggcaacagagggtagtagt

SEQ ID NO: 20592 - DNA, 20 bp, Artificial Sequence
  Description of Artificial Sequence: Synthetic oligonucleotide
  Target: SCN10A; (-) strand; PAM type: NRG; PAM sequence: TAG
tgagaggcaacagagggtag

SEQ ID NO: 20593 - DNA, 20 bp, Artificial Sequence
  Description of Artificial Sequence: Synthetic oligonucleotide
  Target: SCN10A; (-) strand; PAM type: NRG; PAM sequence: TAG
gaatgagaggcaacagaggg

SEQ ID NO: 20594 - DNA, 20 bp, Artificial Sequence
  Description of Artificial Sequence: Synthetic oligonucleotide
  Target: SCN10A; (-) strand; PAM type: NRG; PAM sequence: GGG
gatgaatgagaggcaacaga

SEQ ID NO: 20595 - DNA, 20 bp, Artificial Sequence
  Description of Artificial Sequence: Synthetic oligonucleotide
  Target: SCN10A; (-) strand; PAM type: NRG; PAM sequence: AGG
ggatgaatgagaggcaacag

SEQ ID NO: 20596 - DNA, 20 bp, Artificial Sequence
  Description of Artificial Sequence: Synthetic oligonucleotide
  Target: SCN10A; (-) strand; PAM type: NRG; PAM sequence: GAG
gggatgaatgagaggcaaca

SEQ ID NO: 20597 - DNA, 20 bp, Artificial Sequence
  Description of Artificial Sequence: Synthetic oligonucleotide
  Target: SCN10A; (-) strand; PAM type: NRG; PAM sequence: CAG
atgggatgaatgagaggcaa

SEQ ID NO: 20598 - DNA, 20 bp, Artificial Sequence
  Description of Artificial Sequence: Synthetic oligonucleotide
  Target: SCN10A; (-) strand; PAM type: NRG; PAM sequence: AGG
aaggtcatgggatgaatgag

SEQ ID NO: 20599 - DNA, 20 bp, Artificial Sequence
  Description of Artificial Sequence: Synthetic oligonucleotide
  Target: SCN10A; (-) strand; PAM type: NRG; PAM sequence: GAG
gaaggtcatgggatgaatga

SEQ ID NO: 20600 - DNA, 20 bp, Artificial Sequence
  Description of Artificial Sequence: Synthetic oligonucleotide
  Target: SCN10A; (-) strand; PAM type: NRG; PAM sequence: GAG
aagaaggtcatgggatgaat

SEQ ID NO: 20601 - DNA, 20 bp, Artificial Sequence
  Description of Artificial Sequence: Synthetic oligonucleotide
  Target: SCN10A; (-) strand; PAM type: NRG; PAM sequence: GGG
gtaagacaaaagaaggtcat

SEQ ID NO: 20602 - DNA, 20 bp, Artificial Sequence
  Description of Artificial Sequence: Synthetic oligonucleotide
  Target: SCN10A; (-) strand; PAM type: NRG; PAM sequence: TGG
ggtaagacaaaagaaggtca

SEQ ID NO: 20603 - DNA, 20 bp, Artificial Sequence
  Description of Artificial Sequence: Synthetic oligonucleotide
  Target: SCN10A; (-) strand; PAM type: NRG; PAM sequence: AGG
agtgtaggtaagacaaaaga

SEQ ID NO: 20604 - DNA, 20 bp, Artificial Sequence
  Description of Artificial Sequence: Synthetic oligonucleotide
  Target: SCN10A; (-) strand; PAM type: NRG; PAM sequence: AAG
cagtgtaggtaagacaaaag

SEQ ID NO: 20605 - DNA, 20 bp, Artificial Sequence
  Description of Artificial Sequence: Synthetic oligonucleotide
  Target: SCN10A; (-) strand; PAM type: NRG; PAM sequence: AAG
tcccagtgtaggtaagacaa

SEQ ID NO: 20606 - DNA, 20 bp, Artificial Sequence
  Description of Artificial Sequence: Synthetic oligonucleotide
  Target: SCN10A; (-) strand; PAM type: NRG; PAM sequence: AAG
aaacacatcccagtgtaggt

SEQ ID NO: 20607 - DNA, 20 bp, Artificial Sequence
  Description of Artificial Sequence: Synthetic oligonucleotide
  Target: SCN10A; (-) strand; PAM type: NRG; PAM sequence: AGG
tcccaaacacatcccagtgt

SEQ ID NO: 20608 - DNA, 20 bp, Artificial Sequence
  Description of Artificial Sequence: Synthetic oligonucleotide
  Target: SCN10A; (-) strand; PAM type: NRG; PAM sequence: TAG
gtcccaaacacatcccagtg

SEQ ID NO: 20609 - DNA, 20 bp, Artificial Sequence
  Description of Artificial Sequence: Synthetic oligonucleotide
  Target: SCN10A; (-) strand; PAM type: NRG; PAM sequence: CAG
tgcatgtcccaaacacatcc

SEQ ID NO: 20610 - DNA, 20 bp, Artificial Sequence
  Description of Artificial Sequence: Synthetic oligonucleotide
  Target: SCN10A; (-) strand; PAM type: NRG; PAM sequence: AAG
tgcaagaatgagatagcaac

SEQ ID NO: 20611 - DNA, 20 bp, Artificial Sequence
  Description of Artificial Sequence: Synthetic oligonucleotide
  Target: SCN10A; (-) strand; PAM type: NRG; PAM sequence: TAG
tgcattctgcaagaatgaga

SEQ ID NO: 20612 - DNA, 20 bp, Artificial Sequence
  Description of Artificial Sequence: Synthetic oligonucleotide
  Target: SCN10A; (-) strand; PAM type: NRG; PAM sequence: GAG
acaatgcattctgcaagaat

SEQ ID NO: 20613 - DNA, 20 bp, Artificial Sequence
  Description of Artificial Sequence: Synthetic oligonucleotide
  Target: SCN10A; (-) strand; PAM type: NRG; PAM sequence: AAG
gcaagtacaatgcattctgc

SEQ ID NO: 20614 - DNA, 20 bp, Artificial Sequence
  Description of Artificial Sequence: Synthetic oligonucleotide
  Target: SCN10A; (-) strand; PAM type: NRG; PAM sequence: AAG
agttcgcagacacaaatagc

SEQ ID NO: 20615 - DNA, 20 bp, Artificial Sequence
  Description of Artificial Sequence: Synthetic oligonucleotide
  Target: SCN10A; (-) strand; PAM type: NRG; PAM sequence: TAG
agaaagttcgcagacacaaa

SEQ ID NO: 20616 - DNA, 20 bp, Artificial Sequence
  Description of Artificial Sequence: Synthetic oligonucleotide
  Target: SCN10A; (-) strand; PAM type: NRG; PAM sequence: CAG
gaagctgaggagaaagttcg

SEQ ID NO: 20617 - DNA, 20 bp, Artificial Sequence
  Description of Artificial Sequence: Synthetic oligonucleotide
  Target: SCN10A; (-) strand; PAM type: NRG; PAM sequence: AAG
tatgtaagaagctgaggaga

SEQ ID NO: 20618 - DNA, 20 bp, Artificial Sequence
  Description of Artificial Sequence: Synthetic oligonucleotide
  Target: SCN10A; (-) strand; PAM type: NRG; PAM sequence: GAG
cagctatgtaagaagctgag

SEQ ID NO: 20619 - DNA, 20 bp, Artificial Sequence
  Description of Artificial Sequence: Synthetic oligonucleotide
  Target: SCN10A; (-) strand; PAM type: NRG; PAM sequence: AGG
atcagctatgtaagaagctg

SEQ ID NO: 20620 - DNA, 20 bp, Artificial Sequence
  Description of Artificial Sequence: Synthetic oligonucleotide
  Target: SCN10A; (-) strand; PAM type: NRG; PAM sequence: GAG
aatcagctatgtaagaagct

SEQ ID NO: 20621 - DNA, 20 bp, Artificial Sequence
  Description of Artificial Sequence: Synthetic oligonucleotide
  Target: SCN10A; (-) strand; PAM type: NRG; PAM sequence: AAG
aaaggaatcagctatgtaag

SEQ ID NO: 20622 - DNA, 20 bp, Artificial Sequence
  Description of Artificial Sequence: Synthetic oligonucleotide
  Target: SCN10A; (-) strand; PAM type: NRG; PAM sequence: AAG
aataaaggaatcagctatgt

SEQ ID NO: 20623 - DNA, 20 bp, Artificial Sequence
  Description of Artificial Sequence: Synthetic oligonucleotide
  Target: SCN10A; (-) strand; PAM type: NRG; PAM sequence: CAG
tttgaattaaataaaggaat

SEQ ID NO: 20624 - DNA, 20 bp, Artificial Sequence
  Description of Artificial Sequence: Synthetic oligonucleotide
  Target: SCN10A; (-) strand; PAM type: NRG; PAM sequence: AGG
cagaaatttgaattaaataa

SEQ ID NO: 20625 - DNA, 20 bp, Artificial Sequence
  Description of Artificial Sequence: Synthetic oligonucleotide
  Target: SCN10A; (-) strand; PAM type: NRG; PAM sequence: AAG
acagaaatttgaattaaata

SEQ ID NO: 20626 - DNA, 20 bp, Artificial Sequence
  Description of Artificial Sequence: Synthetic oligonucleotide
  Target: SCN10A; (-) strand; PAM type: NRG; PAM sequence: CAG
aaaattctctccaagaagaa

SEQ ID NO: 20627 - DNA, 20 bp, Artificial Sequence
  Description of Artificial Sequence: Synthetic oligonucleotide
  Target: SCN10A; (-) strand; PAM type: NRG; PAM sequence: AAG
gatggaaaattctctccaag

SEQ ID NO: 20628 - DNA, 20 bp, Artificial Sequence
  Description of Artificial Sequence: Synthetic oligonucleotide
  Target: SCN10A; (-) strand; PAM type: NRG; PAM sequence: AAG
ggagatggaaaattctctcc

SEQ ID NO: 20629 - DNA, 20 bp, Artificial Sequence
  Description of Artificial Sequence: Synthetic oligonucleotide
  Target: SCN10A; (-) strand; PAM type: NRG; PAM sequence: TGG
aaataaagtaggaaaggaga

SEQ ID NO: 20630 - DNA, 20 bp, Artificial Sequence
  Description of Artificial Sequence: Synthetic oligonucleotide
  Target: SCN10A; (-) strand; PAM type: NRG; PAM sequence: GAG
gaaaaaataaagtaggaaag

SEQ ID NO: 20631 - DNA, 20 bp, Artificial Sequence
  Description of Artificial Sequence: Synthetic oligonucleotide
  Target: SCN10A; (-) strand; PAM type: NRG; PAM sequence: AGG
gagaaaaaataaagtaggaa

SEQ ID NO: 20632 - DNA, 20 bp, Artificial Sequence
  Description of Artificial Sequence: Synthetic oligonucleotide
  Target: SCN10A; (-) strand; PAM type: NRG; PAM sequence: AAG
ggagaaaaaataaagtagga

SEQ ID NO: 20633 - DNA, 20 bp, Artificial Sequence
  Description of Artificial Sequence: Synthetic oligonucleotide
  Target: SCN10A; (-) strand; PAM type: NRG; PAM sequence: AGG
agtaggagaaaaaataaagt

SEQ ID NO: 20634 - DNA, 20 bp, Artificial Sequence
  Description of Artificial Sequence: Synthetic oligonucleotide
  Target: SCN10A; (-) strand; PAM type: NRG; PAM sequence: TAG
aagtaggagaaaaaataaag

SEQ ID NO: 20635 - DNA, 20 bp, Artificial Sequence
  Description of Artificial Sequence: Synthetic oligonucleotide
  Target: SCN10A; (-) strand; PAM type: NRG; PAM sequence: AAG
aagaagtaggagaaaaaata

SEQ ID NO: 20636 - DNA, 20 bp, Artificial Sequence
  Description of Artificial Sequence: Synthetic oligonucleotide
  Target: SCN10A; (-) strand; PAM type: NRG; PAM sequence: GAG
tattcagatataagaagtag

SEQ ID NO: 20637 - DNA, 20 bp, Artificial Sequence
  Description of Artificial Sequence: Synthetic oligonucleotide
  Target: SCN10A; (-) strand; PAM type: NRG; PAM sequence: AGG
gatattcagatataagaagt

SEQ ID NO: 20638 - DNA, 20 bp, Artificial Sequence
  Description of Artificial Sequence: Synthetic oligonucleotide
  Target: SCN10A; (-) strand; PAM type: NRG; PAM sequence: TAG
agatattcagatataagaag

SEQ ID NO: 20639 - DNA, 20 bp, Artificial Sequence
  Description of Artificial Sequence: Synthetic oligonucleotide
  Target: SCN10A; (-) strand; PAM type: NRG; PAM sequence: AAG
aatagatattcagatataag

SEQ ID NO: 20640 - DNA, 20 bp, Artificial Sequence
  Description of Artificial Sequence: Synthetic oligonucleotide
  Target: SCN10A; (-) strand; PAM type: NRG; PAM sequence: AAG
atgaatagatattcagatat

SEQ ID NO: 20641 - DNA, 20 bp, Artificial Sequence
  Description of Artificial Sequence: Synthetic oligonucleotide
  Target: SCN10A; (-) strand; PAM type: NRG; PAM sequence: CAG
atgaaagatgaatagatatt

SEQ ID NO: 20642 - DNA, 20 bp, Artificial Sequence
  Description of Artificial Sequence: Synthetic oligonucleotide
  Target: SCN10A; (-) strand; PAM type: NRG; PAM sequence: TAG
aaggggacatgaaagatgaa

SEQ ID NO: 20643 - DNA, 20 bp, Artificial Sequence
  Description of Artificial Sequence: Synthetic oligonucleotide
  Target: SCN10A; (-) strand; PAM type: NRG; PAM sequence: AAG
tagcagggaaggggacatga

SEQ ID NO: 20644 - DNA, 20 bp, Artificial Sequence
  Description of Artificial Sequence: Synthetic oligonucleotide
  Target: SCN10A; (-) strand; PAM type: NRG; PAM sequence: GGG
tctacatcctagcagggaag

SEQ ID NO: 20645 - DNA, 20 bp, Artificial Sequence
  Description of Artificial Sequence: Synthetic oligonucleotide
  Target: SCN10A; (-) strand; PAM type: NRG; PAM sequence: GGG
atctacatcctagcagggaa

SEQ ID NO: 20646 - DNA, 20 bp, Artificial Sequence
  Description of Artificial Sequence: Synthetic oligonucleotide
  Target: SCN10A; (-) strand; PAM type: NRG; PAM sequence: AGG
aatctacatcctagcaggga

SEQ ID NO: 20647 - DNA, 20 bp, Artificial Sequence
  Description of Artificial Sequence: Synthetic oligonucleotide
  Target: SCN10A; (-) strand; PAM type: NRG; PAM sequence: AAG
gaatctacatcctagcaggg

SEQ ID NO: 20648 - DNA, 20 bp, Artificial Sequence
  Description of Artificial Sequence: Synthetic oligonucleotide
  Target: SCN10A; (-) strand; PAM type: NRG; PAM sequence: GGG
atggaatctacatcctagca

SEQ ID NO: 20649 - DNA, 20 bp, Artificial Sequence
  Description of Artificial Sequence: Synthetic oligonucleotide
  Target: SCN10A; (-) strand; PAM type: NRG; PAM sequence: AGG
catggaatctacatcctagc

SEQ ID NO: 20650 - DNA, 20 bp, Artificial Sequence
  Description of Artificial Sequence: Synthetic oligonucleotide
  Target: SCN10A; (-) strand; PAM type: NRG; PAM sequence: CAG
tcatggaatctacatcctag

SEQ ID NO: 20651 - DNA, 20 bp, Artificial Sequence
  Description of Artificial Sequence: Synthetic oligonucleotide
  Target: SCN10A; (-) strand; PAM type: NRG; PAM sequence: TAG
cgctcatggaatctacatcc

SEQ ID NO: 20652 - DNA, 20 bp, Artificial Sequence
  Description of Artificial Sequence: Synthetic oligonucleotide
  Target: SCN10A; (-) strand; PAM type: NRG; PAM sequence: TGG
ctgatataagcttgcgctca

SEQ ID NO: 20653 - DNA, 20 bp, Artificial Sequence
  Description of Artificial Sequence: Synthetic oligonucleotide
  Target: SCN10A; (-) strand; PAM type: NRG; PAM sequence: AAG
attcagtggtgaactgatat

SEQ ID NO: 20654 - DNA, 20 bp, Artificial Sequence
  Description of Artificial Sequence: Synthetic oligonucleotide
  Target: SCN10A; (-) strand; PAM type: NRG; PAM sequence: TGG
cttcaggtgctgggattcag

SEQ ID NO: 20655 - DNA, 20 bp, Artificial Sequence
  Description of Artificial Sequence: Synthetic oligonucleotide
  Target: SCN10A; (-) strand; PAM type: NRG; PAM sequence: CAG
ttgcttcaggtgctgggatt

SEQ ID NO: 20656 - DNA, 20 bp, Artificial Sequence
  Description of Artificial Sequence: Synthetic oligonucleotide
  Target: SCN10A; (-) strand; PAM type: NRG; PAM sequence: GGG
gtggcattgcttcaggtgct

SEQ ID NO: 20657 - DNA, 20 bp, Artificial Sequence
  Description of Artificial Sequence: Synthetic oligonucleotide
  Target: SCN10A; (-) strand; PAM type: NRG; PAM sequence: TGG
tgtggcattgcttcaggtgc

SEQ ID NO: 20658 - DNA, 20 bp, Artificial Sequence
  Description of Artificial Sequence: Synthetic oligonucleotide
  Target: SCN10A; (-) strand; PAM type: NRG; PAM sequence: AGG
tgtgtgtgtggcattgcttc

SEQ ID NO: 20659 - DNA, 20 bp, Artificial Sequence
  Description of Artificial Sequence: Synthetic oligonucleotide
  Target: SCN10A; (-) strand; PAM type: NRG; PAM sequence: CAG
ttgtgtgtgtggcattgctt

SEQ ID NO: 20660 - DNA, 20 bp, Artificial Sequence
  Description of Artificial Sequence: Synthetic oligonucleotide
  Target: SCN10A; (-) strand; PAM type: NRG; PAM sequence: TGG
ttgagcccctgttgtgtgtg

SEQ ID NO: 20661 - DNA, 20 bp, Artificial Sequence
  Description of Artificial Sequence: Synthetic oligonucleotide
  Target: SCN10A; (-) strand; PAM type: NRG; PAM sequence: GAG
cttatcaacaagcatttgtt

SEQ ID NO: 20662 - DNA, 20 bp, Artificial Sequence
  Description of Artificial Sequence: Synthetic oligonucleotide
  Target: SCN10A; (-) strand; PAM type: NRG; PAM sequence: AAG
tcatttattctcttatcaac

SEQ ID NO: 20663 - DNA, 20 bp, Artificial Sequence
  Description of Artificial Sequence: Synthetic oligonucleotide
  Target: SCN10A; (-) strand; PAM type: NRG; PAM sequence: AAG
atttattctcgaaaactgtt

SEQ ID NO: 20664 - DNA, 20 bp, Artificial Sequence
  Description of Artificial Sequence: Synthetic oligonucleotide
  Target: SCN10A; (-) strand; PAM type: NRG; PAM sequence: CAG
cagcaaacattgaatacaaa

SEQ ID NO: 20665 - DNA, 20 bp, Artificial Sequence
  Description of Artificial Sequence: Synthetic oligonucleotide
  Target: SCN10A; (-) strand; PAM type: NRG; PAM sequence: CAG
ttttgctattagtcatcaaa

SEQ ID NO: 20666 - DNA, 20 bp, Artificial Sequence
  Description of Artificial Sequence: Synthetic oligonucleotide
  Target: SCN10A; (-) strand; PAM type: NRG; PAM sequence: TAG
tttggtttttgttttgctat

SEQ ID NO: 20667 - DNA, 20 bp, Artificial Sequence
  Description of Artificial Sequence: Synthetic oligonucleotide
  Target: SCN10A; (-) strand; PAM type: NRG; PAM sequence: TGG
tggtttttgtttgtttgttt

SEQ ID NO: 20668 - DNA, 20 bp, Artificial Sequence
  Description of Artificial Sequence: Synthetic oligonucleotide
  Target: SCN10A; (-) strand; PAM type: NRG; PAM sequence: TGG
tcttggccagataggtttct

SEQ ID NO: 20669 - DNA, 20 bp, Artificial Sequence
  Description of Artificial Sequence: Synthetic oligonucleotide
  Target: SCN10A; (-) strand; PAM type: NRG; PAM sequence: AGG
aatttctttcttggccagat

SEQ ID NO: 20670 - DNA, 20 bp, Artificial Sequence
  Description of Artificial Sequence: Synthetic oligonucleotide
  Target: SCN10A; (-) strand; PAM type: NRG; PAM sequence: TAG
caatttctttcttggccaga

SEQ ID NO: 20671 - DNA, 20 bp, Artificial Sequence
  Description of Artificial Sequence: Synthetic oligonucleotide
  Target: SCN10A; (-) strand; PAM type: NRG; PAM sequence: CAG
cccacaatttctttcttggc

SEQ ID NO: 20672 - DNA, 20 bp, Artificial Sequence
  Description of Artificial Sequence: Synthetic oligonucleotide
  Target: SCN10A; (-) strand; PAM type: NRG; PAM sequence: TGG
tattcccacaatttctttct

SEQ ID NO: 20673 - DNA, 20 bp, Artificial Sequence
  Description of Artificial Sequence: Synthetic oligonucleotide
  Target: SCN10A; (-) strand; PAM type: NRG; PAM sequence: AAG
tcatggcatagaatttgacc

SEQ ID NO: 20674 - DNA, 20 bp, Artificial Sequence
  Description of Artificial Sequence: Synthetic oligonucleotide
  Target: SCN10A; (-) strand; PAM type: NRG; PAM sequence: TAG
ttctaacatttttcatggca

SEQ ID NO: 20675 - DNA, 20 bp, Artificial Sequence
  Description of Artificial Sequence: Synthetic oligonucleotide
  Target: SCN10A; (-) strand; PAM type: NRG; PAM sequence: TGG
tgtacttctaacatttttca

SEQ ID NO: 20676 - DNA, 20 bp, Artificial Sequence
  Description of Artificial Sequence: Synthetic oligonucleotide
  Target: SCN10A; (-) strand; PAM type: NRG; PAM sequence: GAG
tatcactgttcattgtaata

SEQ ID NO: 20677 - DNA, 20 bp, Artificial Sequence
  Description of Artificial Sequence: Synthetic oligonucleotide
  Target: SCN10A; (-) strand; PAM type: NRG; PAM sequence: TAG
aatatcactgttcattgtaa

SEQ ID NO: 20678 - DNA, 20 bp, Artificial Sequence
  Description of Artificial Sequence: Synthetic oligonucleotide
  Target: SCN10A; (-) strand; PAM type: NRG; PAM sequence: CAG
tttctcaacaacaacgtgta

SEQ ID NO: 20679 - DNA, 20 bp, Artificial Sequence
  Description of Artificial Sequence: Synthetic oligonucleotide
  Target: SCN10A; (-) strand; PAM type: NRG; PAM sequence: GAG
catacctgagtttgtgcttt

SEQ ID NO: 20680 - DNA, 20 bp, Artificial Sequence
  Description of Artificial Sequence: Synthetic oligonucleotide
  Target: SCN10A; (-) strand; PAM type: NRG; PAM sequence: GAG
gttacatttcttgcatacct

SEQ ID NO: 20681 - DNA, 20 bp, Artificial Sequence
  Description of Artificial Sequence: Synthetic oligonucleotide
  Target: SCN10A; (-) strand; PAM type: NRG; PAM sequence: AAG
agcataaattgaattcaact

SEQ ID NO: 20682 - DNA, 20 bp, Artificial Sequence
  Description of Artificial Sequence: Synthetic oligonucleotide
  Target: SCN10A; (-) strand; PAM type: NRG; PAM sequence: AAG
gttcccatggtgaggacttg

SEQ ID NO: 20683 - DNA, 20 bp, Artificial Sequence
  Description of Artificial Sequence: Synthetic oligonucleotide
  Target: SCN10A; (-) strand; PAM type: NRG; PAM sequence: AGG
aagagacagttcccatggtg

SEQ ID NO: 20684 - DNA, 20 bp, Artificial Sequence
  Description of Artificial Sequence: Synthetic oligonucleotide
  Target: SCN10A; (-) strand; PAM type: NRG; PAM sequence: GAG
caagagacagttcccatggt

SEQ ID NO: 20685 - DNA, 20 bp, Artificial Sequence
  Description of Artificial Sequence: Synthetic oligonucleotide
  Target: SCN10A; (-) strand; PAM type: NRG; PAM sequence: TGG
ttaacaagagacagttccca

SEQ ID NO: 20686 - DNA, 20 bp, Artificial Sequence
  Description of Artificial Sequence: Synthetic oligonucleotide
  Target: SCN10A; (-) strand; PAM type: NRG; PAM sequence: CAG
aacattgacttaacaagaga

SEQ ID NO: 20687 - DNA, 20 bp, Artificial Sequence
  Description of Artificial Sequence: Synthetic oligonucleotide
  Target: SCN10A; (-) strand; PAM type: NRG; PAM sequence: GAG
acccaacattgacttaacaa

SEQ ID NO: 20688 - DNA, 20 bp, Artificial Sequence
  Description of Artificial Sequence: Synthetic oligonucleotide
  Target: SCN10A; (-) strand; PAM type: NRG; PAM sequence: AAG
gtacccaacattgacttaac

SEQ ID NO: 20689 - DNA, 20 bp, Artificial Sequence
  Description of Artificial Sequence: Synthetic oligonucleotide
  Target: SCN10A; (-) strand; PAM type: NRG; PAM sequence: TAG
cacagactcagatattgaaa

SEQ ID NO: 20690 - DNA, 20 bp, Artificial Sequence
  Description of Artificial Sequence: Synthetic oligonucleotide
  Target: SCN10A; (-) strand; PAM type: NRG; PAM sequence: CAG
acaaaactcagacacagact

SEQ ID NO: 20691 - DNA, 20 bp, Artificial Sequence
  Description of Artificial Sequence: Synthetic oligonucleotide
  Target: SCN10A; (-) strand; PAM type: NRG; PAM sequence: CAG
agccctacaaaactcagaca

SEQ ID NO: 20692 - DNA, 20 bp, Artificial Sequence
  Description of Artificial Sequence: Synthetic oligonucleotide
  Target: SCN10A; (-) strand; PAM type: NRG; PAM sequence: CAG
ggtttgagccctacaaaact

SEQ ID NO: 20693 - DNA, 20 bp, Artificial Sequence
  Description of Artificial Sequence: Synthetic oligonucleotide
  Target: SCN10A; (-) strand; PAM type: NRG; PAM sequence: GAG
ctcaactctcctccaggttt

SEQ ID NO: 20694 - DNA, 20 bp, Artificial Sequence
  Description of Artificial Sequence: Synthetic oligonucleotide
  Target: SCN10A; (-) strand; PAM type: NRG; PAM sequence: AGG
gaccagctcaactctcctcc

SEQ ID NO: 20695 - DNA, 20 bp, Artificial Sequence
  Description of Artificial Sequence: Synthetic oligonucleotide
  Target: SCN10A; (-) strand; PAM type: NRG; PAM sequence: CAG
ggaccagctcaactctcctc

SEQ ID NO: 20696 - DNA, 20 bp, Artificial Sequence
  Description of Artificial Sequence: Synthetic oligonucleotide
  Target: SCN10A; (-) strand; PAM type: NRG; PAM sequence: CAG
gcttagcaatgacaaaggac

SEQ ID NO: 20697 - DNA, 20 bp, Artificial Sequence
  Description of Artificial Sequence: Synthetic oligonucleotide
  Target: SCN10A; (-) strand; PAM type: NRG; PAM sequence: AGG
aatacgcttagcaatgacaa

SEQ ID NO: 20698 - DNA, 20 bp, Artificial Sequence
  Description of Artificial Sequence: Synthetic oligonucleotide
  Target: SCN10A; (-) strand; PAM type: NRG; PAM sequence: AAG
aaatacgcttagcaatgaca

SEQ ID NO: 20699 - DNA, 20 bp, Artificial Sequence
  Description of Artificial Sequence: Synthetic oligonucleotide
  Target: SCN10A; (-) strand; PAM type: NRG; PAM sequence: TAG
caactcaggcaaaatacgct

SEQ ID NO: 20700 - DNA, 20 bp, Artificial Sequence
  Description of Artificial Sequence: Synthetic oligonucleotide
  Target: SCN10A; (-) strand; PAM type: NRG; PAM sequence: AGG
ccagatgggagctacaactc

SEQ ID NO: 20701 - DNA, 20 bp, Artificial Sequence
  Description of Artificial Sequence: Synthetic oligonucleotide
  Target: SCN10A; (-) strand; PAM type: NRG; PAM sequence: CAG
accagatgggagctacaact

SEQ ID NO: 20702 - DNA, 20 bp, Artificial Sequence
  Description of Artificial Sequence: Synthetic oligonucleotide
  Target: SCN10A; (-) strand; PAM type: NRG; PAM sequence: GAG
tcccaccagggaccagatgg

SEQ ID NO: 20703 - DNA, 20 bp, Artificial Sequence
  Description of Artificial Sequence: Synthetic oligonucleotide
  Target: SCN10A; (-) strand; PAM type: NRG; PAM sequence: GGG
tctcccaccagggaccagat

SEQ ID NO: 20704 - DNA, 20 bp, Artificial Sequence
  Description of Artificial Sequence: Synthetic oligonucleotide
  Target: SCN10A; (-) strand; PAM type: NRG; PAM sequence: TGG
ctctcccaccagggaccaga

SEQ ID NO: 20705 - DNA, 20 bp, Artificial Sequence
  Description of Artificial Sequence: Synthetic oligonucleotide
  Target: SCN10A; (-) strand; PAM type: NRG; PAM sequence: CAG
tggactctcccaccagggac

SEQ ID NO: 20706 - DNA, 20 bp, Artificial Sequence
  Description of Artificial Sequence: Synthetic oligonucleotide
  Target: SCN10A; (-) strand; PAM type: NRG; PAM sequence: GGG
cttcatggactctcccacca

SEQ ID NO: 20707 - DNA, 20 bp, Artificial Sequence
  Description of Artificial Sequence: Synthetic oligonucleotide
  Target: SCN10A; (-) strand; PAM type: NRG; PAM sequence: AGG
tcttcatggactctcccacc

SEQ ID NO: 20708 - DNA, 20 bp, Artificial Sequence
  Description of Artificial Sequence: Synthetic oligonucleotide
  Target: SCN10A; (-) strand; PAM type: NRG; PAM sequence: CAG
atcttcatggactctcccac

SEQ ID NO: 20709 - DNA, 20 bp, Artificial Sequence
  Description of Artificial Sequence: Synthetic oligonucleotide
  Target: SCN10A; (-) strand; PAM type: NRG; PAM sequence: TGG
agagagaagagccatcttca

SEQ ID NO: 20710 - DNA, 20 bp, Artificial Sequence
  Description of Artificial Sequence: Synthetic oligonucleotide
  Target: SCN10A; (-) strand; PAM type: NRG; PAM sequence: GAG
gagggaaactagagagagaa

SEQ ID NO: 20711 - DNA, 20 bp, Artificial Sequence
  Description of Artificial Sequence: Synthetic oligonucleotide
  Target: SCN10A; (-) strand; PAM type: NRG; PAM sequence: AAG
tagagggaaactagagagag

SEQ ID NO: 20712 - DNA, 20 bp, Artificial Sequence
  Description of Artificial Sequence: Synthetic oligonucleotide
  Target: SCN10A; (-) strand; PAM type: NRG; PAM sequence: GAG
ccatagagggaaactagaga

SEQ ID NO: 20713 - DNA, 20 bp, Artificial Sequence
  Description of Artificial Sequence: Synthetic oligonucleotide
  Target: SCN10A; (-) strand; PAM type: NRG; PAM sequence: GAG
acccatagagggaaactaga

SEQ ID NO: 20714 - DNA, 20 bp, Artificial Sequence
  Description of Artificial Sequence: Synthetic oligonucleotide
  Target: SCN10A; (-) strand; PAM type: NRG; PAM sequence: GAG
agacccatagagggaaacta

SEQ ID NO: 20715 - DNA, 20 bp, Artificial Sequence
  Description of Artificial Sequence: Synthetic oligonucleotide
  Target: SCN10A; (-) strand; PAM type: NRG; PAM sequence: TAG
tgagacccatagagggaaac

SEQ ID NO: 20716 - DNA, 20 bp, Artificial Sequence
  Description of Artificial Sequence: Synthetic oligonucleotide
  Target: SCN10A; (-) strand; PAM type: NRG; PAM sequence: GGG
agatgagtgagacccataga

SEQ ID NO: 20717 - DNA, 20 bp, Artificial Sequence
  Description of Artificial Sequence: Synthetic oligonucleotide
  Target: SCN10A; (-) strand; PAM type: NRG; PAM sequence: AGG
aagatgagtgagacccatag

SEQ ID NO: 20718 - DNA, 20 bp, Artificial Sequence
  Description of Artificial Sequence: Synthetic oligonucleotide
  Target: SCN10A; (-) strand; PAM type: NRG; PAM sequence: GAG
aaagatgagtgagacccata

SEQ ID NO: 20719 - DNA, 20 bp, Artificial Sequence
  Description of Artificial Sequence: Synthetic oligonucleotide
  Target: SCN10A; (-) strand; PAM type: NRG; PAM sequence: TAG
aaaaagatgagtgagaccca

SEQ ID NO: 20720 - DNA, 20 bp, Artificial Sequence
  Description of Artificial Sequence: Synthetic oligonucleotide
  Target: SCN10A; (-) strand; PAM type: NRG; PAM sequence: GAG
ggctatggaaaaagatgagt

SEQ ID NO: 20721 - DNA, 20 bp, Artificial Sequence
  Description of Artificial Sequence: Synthetic oligonucleotide
  Target: SCN10A; (-) strand; PAM type: NRG; PAM sequence: GAG
tgaaggctatggaaaaagat

SEQ ID NO: 20722 - DNA, 20 bp, Artificial Sequence
  Description of Artificial Sequence: Synthetic oligonucleotide
  Target: SCN10A; (-) strand; PAM type: NRG; PAM sequence: AAG
cccagtgaaggctatggaaa

SEQ ID NO: 20723 - DNA, 20 bp, Artificial Sequence
  Description of Artificial Sequence: Synthetic oligonucleotide
  Target: SCN10A; (-) strand; PAM type: NRG; PAM sequence: TGG
ttagcccccagtgaaggcta

SEQ ID NO: 20724 - DNA, 20 bp, Artificial Sequence
  Description of Artificial Sequence: Synthetic oligonucleotide
  Target: SCN10A; (-) strand; PAM type: NRG; PAM sequence: AGG
gatgacttagcccccagtga

SEQ ID NO: 20725 - DNA, 20 bp, Artificial Sequence
  Description of Artificial Sequence: Synthetic oligonucleotide
  Target: SCN10A; (-) strand; PAM type: NRG; PAM sequence: AAG
tgatgacttagcccccagtg

SEQ ID NO: 20726 - DNA, 20 bp, Artificial Sequence
  Description of Artificial Sequence: Synthetic oligonucleotide
  Target: SCN10A; (-) strand; PAM type: NRG; PAM sequence: CAG
ctgggtgatgacttagcccc

SEQ ID NO: 20727 - DNA, 20 bp, Artificial Sequence
  Description of Artificial Sequence: Synthetic oligonucleotide
  Target: SCN10A; (-) strand; PAM type: NRG; PAM sequence: TAG
agaggagctgggtgatgact

SEQ ID NO: 20728 - DNA, 20 bp, Artificial Sequence
  Description of Artificial Sequence: Synthetic oligonucleotide
  Target: SCN10A; (-) strand; PAM type: NRG; PAM sequence: GGG
cagaatggcagagaggagct

SEQ ID NO: 20729 - DNA, 20 bp, Artificial Sequence
  Description of Artificial Sequence: Synthetic oligonucleotide
  Target: SCN10A; (-) strand; PAM type: NRG; PAM sequence: TGG
ccagaatggcagagaggagc

SEQ ID NO: 20730 - DNA, 20 bp, Artificial Sequence
  Description of Artificial Sequence: Synthetic oligonucleotide
  Target: SCN10A; (-) strand; PAM type: NRG; PAM sequence: GAG
ggctccagaatggcagagag

SEQ ID NO: 20731 - DNA, 20 bp, Artificial Sequence
  Description of Artificial Sequence: Synthetic oligonucleotide
  Target: SCN10A; (-) strand; PAM type: NRG; PAM sequence: AGG
gtggctccagaatggcagag

SEQ ID NO: 20732 - DNA, 20 bp, Artificial Sequence
  Description of Artificial Sequence: Synthetic oligonucleotide
  Target: SCN10A; (-) strand; PAM type: NRG; PAM sequence: GAG
tgtggctccagaatggcaga

SEQ ID NO: 20733 - DNA, 20 bp, Artificial Sequence
  Description of Artificial Sequence: Synthetic oligonucleotide
  Target: SCN10A; (-) strand; PAM type: NRG; PAM sequence: GAG
cctgtggctccagaatggca

SEQ ID NO: 20734 - DNA, 20 bp, Artificial Sequence
  Description of Artificial Sequence: Synthetic oligonucleotide
  Target: SCN10A; (-) strand; PAM type: NRG; PAM sequence: CAG
gccctgtggctccagaatgg

SEQ ID NO: 20735 - DNA, 20 bp, Artificial Sequence
  Description of Artificial Sequence: Synthetic oligonucleotide
  Target: SCN10A; (-) strand; PAM type: NRG; PAM sequence: TGG
agagccctgtggctccagaa

SEQ ID NO: 20736 - DNA, 20 bp, Artificial Sequence
  Description of Artificial Sequence: Synthetic oligonucleotide
  Target: SCN10A; (-) strand; PAM type: NRG; PAM sequence: CAG
cagagagagccctgtggctc

SEQ ID NO: 20737 - DNA, 20 bp, Artificial Sequence
  Description of Artificial Sequence: Synthetic oligonucleotide
  Target: SCN10A; (-) strand; PAM type: NRG; PAM sequence: TGG
cagcctcagagagagccctg

SEQ ID NO: 20738 - DNA, 20 bp, Artificial Sequence
  Description of Artificial Sequence: Synthetic oligonucleotide
  Target: SCN10A; (-) strand; PAM type: NRG; PAM sequence: GAG
gcctgaagcagcctcagaga

SEQ ID NO: 20739 - DNA, 20 bp, Artificial Sequence
  Description of Artificial Sequence: Synthetic oligonucleotide
  Target: SCN10A; (-) strand; PAM type: NRG; PAM sequence: GAG
aggcctgaagcagcctcaga

SEQ ID NO: 20740 - DNA, 20 bp, Artificial Sequence
  Description of Artificial Sequence: Synthetic oligonucleotide
  Target: SCN10A; (-) strand; PAM type: NRG; PAM sequence: GAG
gaaggcctgaagcagcctca

SEQ ID NO: 20741 - DNA, 20 bp, Artificial Sequence
  Description of Artificial Sequence: Synthetic oligonucleotide
  Target: SCN10A; (-) strand; PAM type: NRG; PAM sequence: CAG
gagaaggcctgaagcagcct

SEQ ID NO: 20742 - DNA, 20 bp, Artificial Sequence
  Description of Artificial Sequence: Synthetic oligonucleotide
  Target: SCN10A; (-) strand; PAM type: NRG; PAM sequence: CAG
aggttagagaaggcctgaag

SEQ ID NO: 20743 - DNA, 20 bp, Artificial Sequence
  Description of Artificial Sequence: Synthetic oligonucleotide
  Target: SCN10A; (-) strand; PAM type: NRG; PAM sequence: AAG
cttaggttagagaaggcctg

SEQ ID NO: 20744 - DNA, 20 bp, Artificial Sequence
  Description of Artificial Sequence: Synthetic oligonucleotide
  Target: SCN10A; (-) strand; PAM type: NRG; PAM sequence: AGG
ggtcaaccttaggttagaga

SEQ ID NO: 20745 - DNA, 20 bp, Artificial Sequence
  Description of Artificial Sequence: Synthetic oligonucleotide
  Target: SCN10A; (-) strand; PAM type: NRG; PAM sequence: AAG
aggtcaaccttaggttagag

SEQ ID NO: 20746 - DNA, 20 bp, Artificial Sequence
  Description of Artificial Sequence: Synthetic oligonucleotide
  Target: SCN10A; (-) strand; PAM type: NRG; PAM sequence: GAG
cttaggtcaaccttaggtta

SEQ ID NO: 20747 - DNA, 20 bp, Artificial Sequence
  Description of Artificial Sequence: Synthetic oligonucleotide
  Target: SCN10A; (-) strand; PAM type: NRG; PAM sequence: TAG
agcttaggtcaaccttaggt

SEQ ID NO: 20748 - DNA, 20 bp, Artificial Sequence
  Description of Artificial Sequence: Synthetic oligonucleotide
  Target: SCN10A; (-) strand; PAM type: NRG; PAM sequence: AGG
ccttagcttaggtcaacctt

SEQ ID NO: 20749 - DNA, 20 bp, Artificial Sequence
  Description of Artificial Sequence: Synthetic oligonucleotide
  Target: SCN10A; (-) strand; PAM type: NRG; PAM sequence: TAG
accttagcttaggtcaacct

SEQ ID NO: 20750 - DNA, 20 bp, Artificial Sequence
  Description of Artificial Sequence: Synthetic oligonucleotide
  Target: SCN10A; (-) strand; PAM type: NRG; PAM sequence: AGG
gggaaaggcaaccttagctt

SEQ ID NO: 20751 - DNA, 20 bp, Artificial Sequence
  Description of Artificial Sequence: Synthetic oligonucleotide
  Target: SCN10A; (-) strand; PAM type: NRG; PAM sequence: TAG
ggggaaaggcaaccttagct

SEQ ID NO: 20752 - DNA, 20 bp, Artificial Sequence
  Description of Artificial Sequence: Synthetic oligonucleotide
  Target: SCN10A; (-) strand; PAM type: NRG; PAM sequence: TAG
aatctggggaaaggcaacct

SEQ ID NO: 20753 - DNA, 20 bp, Artificial Sequence
  Description of Artificial Sequence: Synthetic oligonucleotide
  Target: SCN10A; (-) strand; PAM type: NRG; PAM sequence: AGG
ttttaagaaaatctggggaa

SEQ ID NO: 20754 - DNA, 20 bp, Artificial Sequence
  Description of Artificial Sequence: Synthetic oligonucleotide
  Target: SCN10A; (-) strand; PAM type: NRG; PAM sequence: AAG
tttttaagaaaatctgggga

SEQ ID NO: 20755 - DNA, 20 bp, Artificial Sequence
  Description of Artificial Sequence: Synthetic oligonucleotide
  Target: SCN10A; (-) strand; PAM type: NRG; PAM sequence: GGG
gacgtttttaagaaaatctg

SEQ ID NO: 20756 - DNA, 20 bp, Artificial Sequence
  Description of Artificial Sequence: Synthetic oligonucleotide
  Target: SCN10A; (-) strand; PAM type: NRG; PAM sequence: GGG
agacgtttttaagaaaatct

SEQ ID NO: 20757 - DNA, 20 bp, Artificial Sequence
  Description of Artificial Sequence: Synthetic oligonucleotide
  Target: SCN10A; (-) strand; PAM type: NRG; PAM sequence: TGG
aagacgtttttaagaaaatc

SEQ ID NO: 20758 - DNA, 20 bp, Artificial Sequence
  Description of Artificial Sequence: Synthetic oligonucleotide
  Target: SCN10A; (-) strand; PAM type: NRG; PAM sequence: AAG
ggagaaacaaagacgttttt

SEQ ID NO: 20759 - DNA, 20 bp, Artificial Sequence
  Description of Artificial Sequence: Synthetic oligonucleotide
  Target: SCN10A; (-) strand; PAM type: NRG; PAM sequence: AAG
taagaaaggcaggagaaaca

SEQ ID NO: 20760 - DNA, 20 bp, Artificial Sequence
  Description of Artificial Sequence: Synthetic oligonucleotide
  Target: SCN10A; (-) strand; PAM type: NRG; PAM sequence: GAG
gagtagagtaagaaaggcag

SEQ ID NO: 20761 - DNA, 20 bp, Artificial Sequence
  Description of Artificial Sequence: Synthetic oligonucleotide
  Target: SCN10A; (-) strand; PAM type: NRG; PAM sequence: AGG
gagagtagagtaagaaaggc

SEQ ID NO: 20762 - DNA, 20 bp, Artificial Sequence
  Description of Artificial Sequence: Synthetic oligonucleotide
  Target: SCN10A; (-) strand; PAM type: NRG; PAM sequence: CAG
tgagagtagagtaagaaagg

SEQ ID NO: 20763 - DNA, 20 bp, Artificial Sequence
  Description of Artificial Sequence: Synthetic oligonucleotide
  Target: SCN10A; (-) strand; PAM type: NRG; PAM sequence: AGG
ctgtgagagtagagtaagaa

SEQ ID NO: 20764 - DNA, 20 bp, Artificial Sequence
  Description of Artificial Sequence: Synthetic oligonucleotide
  Target: SCN10A; (-) strand; PAM type: NRG; PAM sequence: AAG
actgtgagagtagagtaaga

SEQ ID NO: 20765 - DNA, 20 bp, Artificial Sequence
  Description of Artificial Sequence: Synthetic oligonucleotide
  Target: SCN10A; (-) strand; PAM type: NRG; PAM sequence: AAG
agatactgtgagagtagagt

SEQ ID NO: 20766 - DNA, 20 bp, Artificial Sequence
  Description of Artificial Sequence: Synthetic oligonucleotide
  Target: SCN10A; (-) strand; PAM type: NRG; PAM sequence: GAG
aggaagatactgtgagagta

SEQ ID NO: 20767 - DNA, 20 bp, Artificial Sequence
  Description of Artificial Sequence: Synthetic oligonucleotide
  Target: SCN10A; (-) strand; PAM type: NRG; PAM sequence: TAG
caaggaagatactgtgagag

SEQ ID NO: 20768 - DNA, 20 bp, Artificial Sequence
  Description of Artificial Sequence: Synthetic oligonucleotide
  Target: SCN10A; (-) strand; PAM type: NRG; PAM sequence: GAG
gctcaaggaagatactgtga

SEQ ID NO: 20769 - DNA, 20 bp, Artificial Sequence
  Description of Artificial Sequence: Synthetic oligonucleotide
  Target: SCN10A; (-) strand; PAM type: NRG; PAM sequence: GAG
ccgctcaaggaagatactgt

SEQ ID NO: 20770 - DNA, 20 bp, Artificial Sequence
  Description of Artificial Sequence: Synthetic oligonucleotide
  Target: SCN10A; (-) strand; PAM type: NRG; PAM sequence: AAG
ggatagacttccgctcaagg

SEQ ID NO: 20771 - DNA, 20 bp, Artificial Sequence
  Description of Artificial Sequence: Synthetic oligonucleotide
  Target: SCN10A; (-) strand; PAM type: NRG; PAM sequence: AGG
gtaggatagacttccgctca

SEQ ID NO: 20772 - DNA, 20 bp, Artificial Sequence
  Description of Artificial Sequence: Synthetic oligonucleotide
  Target: SCN10A; (-) strand; PAM type: NRG; PAM sequence: AAG
ggtaggatagacttccgctc

SEQ ID NO: 20773 - DNA, 20 bp, Artificial Sequence
  Description of Artificial Sequence: Synthetic oligonucleotide
  Target: SCN10A; (-) strand; PAM type: NRG; PAM sequence: TAG
tcaggtatcttggggtagga

SEQ ID NO: 20774 - DNA, 20 bp, Artificial Sequence
  Description of Artificial Sequence: Synthetic oligonucleotide
  Target: SCN10A; (-) strand; PAM type: NRG; PAM sequence: AGG
atagtcaggtatcttggggt

SEQ ID NO: 20775 - DNA, 20 bp, Artificial Sequence
  Description of Artificial Sequence: Synthetic oligonucleotide
  Target: SCN10A; (-) strand; PAM type: NRG; PAM sequence: TAG
aatagtcaggtatcttgggg

SEQ ID NO: 20776 - DNA, 20 bp, Artificial Sequence
  Description of Artificial Sequence: Synthetic oligonucleotide
  Target: SCN10A; (-) strand; PAM type: NRG; PAM sequence: GGG
aggaatagtcaggtatcttg

SEQ ID NO: 20777 - DNA, 20 bp, Artificial Sequence
  Description of Artificial Sequence: Synthetic oligonucleotide
  Target: SCN10A; (-) strand; PAM type: NRG; PAM sequence: GGG
aaggaatagtcaggtatctt

SEQ ID NO: 20778 - DNA, 20 bp, Artificial Sequence
  Description of Artificial Sequence: Synthetic oligonucleotide
  Target: SCN10A; (-) strand; PAM type: NRG; PAM sequence: TGG
taaggaatagtcaggtatct

SEQ ID NO: 20779 - DNA, 20 bp, Artificial Sequence
  Description of Artificial Sequence: Synthetic oligonucleotide
  Target: SCN10A; (-) strand; PAM type: NRG; PAM sequence: AGG
gaagaaaataaggaatagtc

SEQ ID NO: 20780 - DNA, 20 bp, Artificial Sequence
  Description of Artificial Sequence: Synthetic oligonucleotide
  Target: SCN10A; (-) strand; PAM type: NRG; PAM sequence: CAG
ggaagaaaataaggaatagt

SEQ ID NO: 20781 - DNA, 20 bp, Artificial Sequence
  Description of Artificial Sequence: Synthetic oligonucleotide
  Target: SCN10A; (-) strand; PAM type: NRG; PAM sequence: TAG
aaaaggaagaaaataaggaa

SEQ ID NO: 20782 - DNA, 20 bp, Artificial Sequence
  Description of Artificial Sequence: Synthetic oligonucleotide
  Target: SCN10A; (-) strand; PAM type: NRG; PAM sequence: AGG
tgataaaaaggaagaaaata

SEQ ID NO: 20783 - DNA, 20 bp, Artificial Sequence
  Description of Artificial Sequence: Synthetic oligonucleotide
  Target: SCN10A; (-) strand; PAM type: NRG; PAM sequence: AAG
ctgataaaaaggaagaaaat

SEQ ID NO: 20784 - DNA, 20 bp, Artificial Sequence
  Description of Artificial Sequence: Synthetic oligonucleotide
  Target: SCN10A; (-) strand; PAM type: NRG; PAM sequence: AAG
ggtgtaaactgataaaaagg

SEQ ID NO: 20785 - DNA, 20 bp, Artificial Sequence
  Description of Artificial Sequence: Synthetic oligonucleotide
  Target: SCN10A; (-) strand; PAM type: NRG; PAM sequence: AGG
agtggtgtaaactgataaaa

SEQ ID NO: 20786 - DNA, 20 bp, Artificial Sequence
  Description of Artificial Sequence: Synthetic oligonucleotide
  Target: SCN10A; (-) strand; PAM type: NRG; PAM sequence: AAG
tagtggtgtaaactgataaa

SEQ ID NO: 20787 - DNA, 20 bp, Artificial Sequence
  Description of Artificial Sequence: Synthetic oligonucleotide
  Target: SCN10A; (-) strand; PAM type: NRG; PAM sequence: TGG
ggggtgatgctactttatag

SEQ ID NO: 20788 - DNA, 20 bp, Artificial Sequence
  Description of Artificial Sequence: Synthetic oligonucleotide
  Target: SCN10A; (-) strand; PAM type: NRG; PAM sequence: TAG
tggggggtgatgctacttta

SEQ ID NO: 20789 - DNA, 20 bp, Artificial Sequence
  Description of Artificial Sequence: Synthetic oligonucleotide
  Target: SCN10A; (-) strand; PAM type: NRG; PAM sequence: GGG
taacaaaggtgatatctggg

SEQ ID NO: 20790 - DNA, 20 bp, Artificial Sequence
  Description of Artificial Sequence: Synthetic oligonucleotide
  Target: SCN10A; (-) strand; PAM type: NRG; PAM sequence: GGG
ttaacaaaggtgatatctgg

SEQ ID NO: 20791 - DNA, 20 bp, Artificial Sequence
  Description of Artificial Sequence: Synthetic oligonucleotide
  Target: SCN10A; (-) strand; PAM type: NRG; PAM sequence: GGG
attaacaaaggtgatatctg

SEQ ID NO: 20792 - DNA, 20 bp, Artificial Sequence
  Description of Artificial Sequence: Synthetic oligonucleotide
  Target: SCN10A; (-) strand; PAM type: NRG; PAM sequence: GGG
cattaacaaaggtgatatct

SEQ ID NO: 20793 - DNA, 20 bp, Artificial Sequence
  Description of Artificial Sequence: Synthetic oligonucleotide
  Target: SCN10A; (-) strand; PAM type: NRG; PAM sequence: TGG
gcattaacaaaggtgatatc

SEQ ID NO: 20794 - DNA, 20 bp, Artificial Sequence
  Description of Artificial Sequence: Synthetic oligonucleotide
  Target: SCN10A; (-) strand; PAM type: NRG; PAM sequence: AGG
gaagagcagtgcattaacaa

SEQ ID NO: 20795 - DNA, 20 bp, Artificial Sequence
  Description of Artificial Sequence: Synthetic oligonucleotide
  Target: SCN10A; (-) strand; PAM type: NRG; PAM sequence: AAG
agaagagcagtgcattaaca

SEQ ID NO: 20796 - DNA, 20 bp, Artificial Sequence
  Description of Artificial Sequence: Synthetic oligonucleotide
  Target: SCN10A; (-) strand; PAM type: NRG; PAM sequence: CAG
atctccattacctagaagag

SEQ ID NO: 20797 - DNA, 20 bp, Artificial Sequence
  Description of Artificial Sequence: Synthetic oligonucleotide
  Target: SCN10A; (-) strand; PAM type: NRG; PAM sequence: GAG
tggatctccattacctagaa

SEQ ID NO: 20798 - DNA, 20 bp, Artificial Sequence
  Description of Artificial Sequence: Synthetic oligonucleotide
  Target: SCN10A; (-) strand; PAM type: NRG; PAM sequence: AAG
gctggatctccattacctag

SEQ ID NO: 20799 - DNA, 20 bp, Artificial Sequence
  Description of Artificial Sequence: Synthetic oligonucleotide
  Target: SCN10A; (-) strand; PAM type: NRG; PAM sequence: TAG
acagctggatctccattacc

SEQ ID NO: 20800 - DNA, 20 bp, Artificial Sequence
  Description of Artificial Sequence: Synthetic oligonucleotide
  Target: SCN10A; (-) strand; PAM type: NRG; PAM sequence: TGG
gtatctgttttgctcacagc

SEQ ID NO: 20801 - DNA, 20 bp, Artificial Sequence
  Description of Artificial Sequence: Synthetic oligonucleotide
  Target: SCN10A; (-) strand; PAM type: NRG; PAM sequence: CAG
agatgtatctgttttgctca

SEQ ID NO: 20802 - DNA, 20 bp, Artificial Sequence
  Description of Artificial Sequence: Synthetic oligonucleotide
  Target: SCN10A; (-) strand; PAM type: NRG; PAM sequence: GAG
agtaatttaccagatatgca

SEQ ID NO: 20803 - DNA, 20 bp, Artificial Sequence
  Description of Artificial Sequence: Synthetic oligonucleotide
  Target: SCN10A; (-) strand; PAM type: NRG; PAM sequence: CAG
ccagtaatttaccagatatg

SEQ ID NO: 20804 - DNA, 20 bp, Artificial Sequence
  Description of Artificial Sequence: Synthetic oligonucleotide
  Target: SCN10A; (-) strand; PAM type: NRG; PAM sequence: CAG
agaactagccagtaatttac

SEQ ID NO: 20805 - DNA, 20 bp, Artificial Sequence
  Description of Artificial Sequence: Synthetic oligonucleotide
  Target: SCN10A; (-) strand; PAM type: NRG; PAM sequence: CAG
aactgtagagtagaactagc

SEQ ID NO: 20806 - DNA, 20 bp, Artificial Sequence
  Description of Artificial Sequence: Synthetic oligonucleotide
  Target: SCN10A; (-) strand; PAM type: NRG; PAM sequence: TAG
cagaaactgtagagtagaac

SEQ ID NO: 20807 - DNA, 20 bp, Artificial Sequence
  Description of Artificial Sequence: Synthetic oligonucleotide
  Target: SCN10A; (-) strand; PAM type: NRG; PAM sequence: TAG
catgcacagaaactgtagag

SEQ ID NO: 20808 - DNA, 20 bp, Artificial Sequence
  Description of Artificial Sequence: Synthetic oligonucleotide
  Target: SCN10A; (-) strand; PAM type: NRG; PAM sequence: GAG
tcacatgcacagaaactgta

SEQ ID NO: 20809 - DNA, 20 bp, Artificial Sequence
  Description of Artificial Sequence: Synthetic oligonucleotide
  Target: SCN10A; (-) strand; PAM type: NRG; PAM sequence: TAG
attcacatgcacagaaactg

SEQ ID NO: 20810 - DNA, 20 bp, Artificial Sequence
  Description of Artificial Sequence: Synthetic oligonucleotide
  Target: SCN10A; (-) strand; PAM type: NRG; PAM sequence: CAG
tagagagagattcacatgca

SEQ ID NO: 20811 - DNA, 20 bp, Artificial Sequence
  Description of Artificial Sequence: Synthetic oligonucleotide
  Target: SCN10A; (-) strand; PAM type: NRG; PAM sequence: GAG
gaggtggcaagccttagaga

SEQ ID NO: 20812 - DNA, 20 bp, Artificial Sequence
  Description of Artificial Sequence: Synthetic oligonucleotide
  Target: SCN10A; (-) strand; PAM type: NRG; PAM sequence: GAG
cagaggtggcaagccttaga

SEQ ID NO: 20813 - DNA, 20 bp, Artificial Sequence
  Description of Artificial Sequence: Synthetic oligonucleotide
  Target: SCN10A; (-) strand; PAM type: NRG; PAM sequence: GAG
gccagaggtggcaagcctta

SEQ ID NO: 20814 - DNA, 20 bp, Artificial Sequence
  Description of Artificial Sequence: Synthetic oligonucleotide
  Target: SCN10A; (-) strand; PAM type: NRG; PAM sequence: TAG
aagccagaggtggcaagcct

SEQ ID NO: 20815 - DNA, 20 bp, Artificial Sequence
  Description of Artificial Sequence: Synthetic oligonucleotide
  Target: SCN10A; (-) strand; PAM type: NRG; PAM sequence: AAG
taggtaaagccagaggtggc

SEQ ID NO: 20816 - DNA, 20 bp, Artificial Sequence
  Description of Artificial Sequence: Synthetic oligonucleotide
  Target: SCN10A; (-) strand; PAM type: NRG; PAM sequence: TGG
tttctaggtaaagccagagg

SEQ ID NO: 20817 - DNA, 20 bp, Artificial Sequence
  Description of Artificial Sequence: Synthetic oligonucleotide
  Target: SCN10A; (-) strand; PAM type: NRG; PAM sequence: AGG
tactttctaggtaaagccag

SEQ ID NO: 20818 - DNA, 20 bp, Artificial Sequence
  Description of Artificial Sequence: Synthetic oligonucleotide
  Target: SCN10A; (-) strand; PAM type: NRG; PAM sequence: GAG
ctactttctaggtaaagcca

SEQ ID NO: 20819 - DNA, 20 bp, Artificial Sequence
  Description of Artificial Sequence: Synthetic oligonucleotide
  Target: SCN10A; (-) strand; PAM type: NRG; PAM sequence: CAG
ccctactttctaggtaaagc

SEQ ID NO: 20820 - DNA, 20 bp, Artificial Sequence
  Description of Artificial Sequence: Synthetic oligonucleotide
  Target: SCN10A; (-) strand; PAM type: NRG; PAM sequence: AAG
tgtgccctactttctaggta

SEQ ID NO: 20821 - DNA, 20 bp, Artificial Sequence
  Description of Artificial Sequence: Synthetic oligonucleotide
  Target: SCN10A; (-) strand; PAM type: NRG; PAM sequence: AGG
caatgtgtgccctactttct

SEQ ID NO: 20822 - DNA, 20 bp, Artificial Sequence
  Description of Artificial Sequence: Synthetic oligonucleotide
  Target: SCN10A; (-) strand; PAM type: NRG; PAM sequence: TAG
ccaatgtgtgccctactttc

SEQ ID NO: 20823 - DNA, 20 bp, Artificial Sequence
  Description of Artificial Sequence: Synthetic oligonucleotide
  Target: SCN10A; (-) strand; PAM type: NRG; PAM sequence: GAG
gtttgagggatttcaaaaca

SEQ ID NO: 20824 - DNA, 20 bp, Artificial Sequence
  Description of Artificial Sequence: Synthetic oligonucleotide
  Target: SCN10A; (-) strand; PAM type: NRG; PAM sequence: CAG
atgtttgagggatttcaaaa

SEQ ID NO: 20825 - DNA, 20 bp, Artificial Sequence
  Description of Artificial Sequence: Synthetic oligonucleotide
  Target: SCN10A; (-) strand; PAM type: NRG; PAM sequence: GGG
gaaaccaaaaaaatgtttga

SEQ ID NO: 20826 - DNA, 20 bp, Artificial Sequence
  Description of Artificial Sequence: Synthetic oligonucleotide
  Target: SCN10A; (-) strand; PAM type: NRG; PAM sequence: AGG
agaaaccaaaaaaatgtttg

SEQ ID NO: 20827 - DNA, 20 bp, Artificial Sequence
  Description of Artificial Sequence: Synthetic oligonucleotide
  Target: SCN10A; (-) strand; PAM type: NRG; PAM sequence: GAG
tagaaaccaaaaaaatgttt

SEQ ID NO: 20828 - DNA, 20 bp, Artificial Sequence
  Description of Artificial Sequence: Synthetic oligonucleotide
  Target: SCN10A; (-) strand; PAM type: NRG; PAM sequence: TAG
ggggaagaagtggtgagcaa

SEQ ID NO: 20829 - DNA, 20 bp, Artificial Sequence
  Description of Artificial Sequence: Synthetic oligonucleotide
  Target: SCN10A; (-) strand; PAM type: NRG; PAM sequence: GAG
atttgaggggaagaagtggt

SEQ ID NO: 20830 - DNA, 20 bp, Artificial Sequence
  Description of Artificial Sequence: Synthetic oligonucleotide
  Target: SCN10A; (-) strand; PAM type: NRG; PAM sequence: TGG
cctaatttgaggggaagaag

SEQ ID NO: 20831 - DNA, 20 bp, Artificial Sequence
  Description of Artificial Sequence: Synthetic oligonucleotide
  Target: SCN10A; (-) strand; PAM type: NRG; PAM sequence: AAG
aatcctaatttgaggggaag

SEQ ID NO: 20832 - DNA, 20 bp, Artificial Sequence
  Description of Artificial Sequence: Synthetic oligonucleotide
  Target: SCN10A; (-) strand; PAM type: NRG; PAM sequence: AAG
ctgaatcctaatttgagggg

SEQ ID NO: 20833 - DNA, 20 bp, Artificial Sequence
  Description of Artificial Sequence: Synthetic oligonucleotide
  Target: SCN10A; (-) strand; PAM type: NRG; PAM sequence: GGG
aggctgaatcctaatttgag

SEQ ID NO: 20834 - DNA, 20 bp, Artificial Sequence
  Description of Artificial Sequence: Synthetic oligonucleotide
  Target: SCN10A; (-) strand; PAM type: NRG; PAM sequence: GGG
taggctgaatcctaatttga

SEQ ID NO: 20835 - DNA, 20 bp, Artificial Sequence
  Description of Artificial Sequence: Synthetic oligonucleotide
  Target: SCN10A; (-) strand; PAM type: NRG; PAM sequence: AGG
ctaggctgaatcctaatttg

SEQ ID NO: 20836 - DNA, 20 bp, Artificial Sequence
  Description of Artificial Sequence: Synthetic oligonucleotide
  Target: SCN10A; (-) strand; PAM type: NRG; PAM sequence: GAG
cctaggctgaatcctaattt

SEQ ID NO: 20837 - DNA, 20 bp, Artificial Sequence
  Description of Artificial Sequence: Synthetic oligonucleotide
  Target: SCN10A; (-) strand; PAM type: NRG; PAM sequence: AGG
tgtgttttcctcccagccct

SEQ ID NO: 20838 - DNA, 20 bp, Artificial Sequence
  Description of Artificial Sequence: Synthetic oligonucleotide
  Target: SCN10A; (-) strand; PAM type: NRG; PAM sequence: TAG
gtgtgttttcctcccagccc

SEQ ID NO: 20839 - DNA, 20 bp, Artificial Sequence
  Description of Artificial Sequence: Synthetic oligonucleotide
  Target: SCN10A; (-) strand; PAM type: NRG; PAM sequence: CAG
agtcctgtgtgttttcctcc

SEQ ID NO: 20840 - DNA, 20 bp, Artificial Sequence
  Description of Artificial Sequence: Synthetic oligonucleotide
  Target: SCN10A; (-) strand; PAM type: NRG; PAM sequence: GAG
gctggtgtgcccctgagaag

SEQ ID NO: 20841 - DNA, 20 bp, Artificial Sequence
  Description of Artificial Sequence: Synthetic oligonucleotide
  Target: SCN10A; (-) strand; PAM type: NRG; PAM sequence: AGG
gtgctggtgtgcccctgaga

SEQ ID NO: 20842 - DNA, 20 bp, Artificial Sequence
  Description of Artificial Sequence: Synthetic oligonucleotide
  Target: SCN10A; (-) strand; PAM type: NRG; PAM sequence: AAG
agtgctggtgtgcccctgag

SEQ ID NO: 20843 - DNA, 20 bp, Artificial Sequence
  Description of Artificial Sequence: Synthetic oligonucleotide
  Target: SCN10A; (-) strand; PAM type: NRG; PAM sequence: GAG
ttgagtgctggtgtgcccct

SEQ ID NO: 20844 - DNA, 20 bp, Artificial Sequence
  Description of Artificial Sequence: Synthetic oligonucleotide
  Target: SCN10A; (-) strand; PAM type: NRG; PAM sequence: TGG
ttgtaagggagcttgagtgc

SEQ ID NO: 20845 - DNA, 20 bp, Artificial Sequence
  Description of Artificial Sequence: Synthetic oligonucleotide
  Target: SCN10A; (-) strand; PAM type: NRG; PAM sequence: GAG
gaggagttgtaagggagctt

SEQ ID NO: 20846 - DNA, 20 bp, Artificial Sequence
  Description of Artificial Sequence: Synthetic oligonucleotide
  Target: SCN10A; (-) strand; PAM type: NRG; PAM sequence: GAG
aggctggaggagttgtaagg

SEQ ID NO: 20847 - DNA, 20 bp, Artificial Sequence
  Description of Artificial Sequence: Synthetic oligonucleotide
  Target: SCN10A; (-) strand; PAM type: NRG; PAM sequence: GGG
ctaggctggaggagttgtaa

SEQ ID NO: 20848 - DNA, 20 bp, Artificial Sequence
  Description of Artificial Sequence: Synthetic oligonucleotide
  Target: SCN10A; (-) strand; PAM type: NRG; PAM sequence: AGG
cctaggctggaggagttgta

SEQ ID NO: 20849 - DNA, 20 bp, Artificial Sequence
  Description of Artificial Sequence: Synthetic oligonucleotide
  Target: SCN10A; (-) strand; PAM type: NRG; PAM sequence: AAG
acctaggctggaggagttgt

SEQ ID NO: 20850 - DNA, 20 bp, Artificial Sequence
  Description of Artificial Sequence: Synthetic oligonucleotide
  Target: SCN10A; (-) strand; PAM type: NRG; PAM sequence: GAG
taaactgacctaggctggag

SEQ ID NO: 20851 - DNA, 20 bp, Artificial Sequence
  Description of Artificial Sequence: Synthetic oligonucleotide
  Target: SCN10A; (-) strand; PAM type: NRG; PAM sequence: AGG
attaaactgacctaggctgg

SEQ ID NO: 20852 - DNA, 20 bp, Artificial Sequence
  Description of Artificial Sequence: Synthetic oligonucleotide
  Target: SCN10A; (-) strand; PAM type: NRG; PAM sequence: GAG
aattaaactgacctaggctg

SEQ ID NO: 20853 - DNA, 20 bp, Artificial Sequence
  Description of Artificial Sequence: Synthetic oligonucleotide
  Target: SCN10A; (-) strand; PAM type: NRG; PAM sequence: TGG
caaattaaactgacctaggc

SEQ ID NO: 20854 - DNA, 20 bp, Artificial Sequence
  Description of Artificial Sequence: Synthetic oligonucleotide
  Target: SCN10A; (-) strand; PAM type: NRG; PAM sequence: AGG
tagacaaattaaactgacct

SEQ ID NO: 20855 - DNA, 20 bp, Artificial Sequence
  Description of Artificial Sequence: Synthetic oligonucleotide
  Target: SCN10A; (-) strand; PAM type: NRG; PAM sequence: TAG
ctagacaaattaaactgacc

SEQ ID NO: 20856 - DNA, 20 bp, Artificial Sequence
  Description of Artificial Sequence: Synthetic oligonucleotide
  Target: SCN10A; (-) strand; PAM type: NRG; PAM sequence: TAG
ttccagttatcttactcccc

SEQ ID NO: 20857 - DNA, 20 bp, Artificial Sequence
  Description of Artificial Sequence: Synthetic oligonucleotide
  Target: SCN10A; (-) strand; PAM type: NRG; PAM sequence: CAG
aatgcaaccttcatcatttc

SEQ ID NO: 20858 - DNA, 20 bp, Artificial Sequence
  Description of Artificial Sequence: Synthetic oligonucleotide
  Target: SCN10A; (-) strand; PAM type: NRG; PAM sequence: GAG
tttttttgccttagggtatg

SEQ ID NO: 20859 - DNA, 20 bp, Artificial Sequence
  Description of Artificial Sequence: Synthetic oligonucleotide
  Target: SCN10A; (-) strand; PAM type: NRG; PAM sequence: TGG
cctttttttgccttagggta

SEQ ID NO: 20860 - DNA, 20 bp, Artificial Sequence
  Description of Artificial Sequence: Synthetic oligonucleotide
  Target: SCN10A; (-) strand; PAM type: NRG; PAM sequence: GGG
tccagcctttttttgcctta

SEQ ID NO: 20861 - DNA, 20 bp, Artificial Sequence
  Description of Artificial Sequence: Synthetic oligonucleotide
  Target: SCN10A; (-) strand; PAM type: NRG; PAM sequence: AGG
atccagcctttttttgcctt

SEQ ID NO: 20862 - DNA, 20 bp, Artificial Sequence
  Description of Artificial Sequence: Synthetic oligonucleotide
  Target: SCN10A; (-) strand; PAM type: NRG; PAM sequence: TAG
aatccagcctttttttgcct

SEQ ID NO: 20863 - DNA, 20 bp, Artificial Sequence
  Description of Artificial Sequence: Synthetic oligonucleotide
  Target: SCN10A; (-) strand; PAM type: NRG; PAM sequence: CAG
gcaggaggtctgttctaatc

SEQ ID NO: 20864 - DNA, 20 bp, Artificial Sequence
  Description of Artificial Sequence: Synthetic oligonucleotide
  Target: SCN10A; (-) strand; PAM type: NRG; PAM sequence: AGG
tccctctaaccttgagcagg

SEQ ID NO: 20865 - DNA, 20 bp, Artificial Sequence
  Description of Artificial Sequence: Synthetic oligonucleotide
  Target: SCN10A; (-) strand; PAM type: NRG; PAM sequence: GAG
atccctctaaccttgagcag

SEQ ID NO: 20866 - DNA, 20 bp, Artificial Sequence
  Description of Artificial Sequence: Synthetic oligonucleotide
  Target: SCN10A; (-) strand; PAM type: NRG; PAM sequence: AGG
gcatccctctaaccttgagc

SEQ ID NO: 20867 - DNA, 20 bp, Artificial Sequence
  Description of Artificial Sequence: Synthetic oligonucleotide
  Target: SCN10A; (-) strand; PAM type: NRG; PAM sequence: CAG
tgcatccctctaaccttgag

SEQ ID NO: 20868 - DNA, 20 bp, Artificial Sequence
  Description of Artificial Sequence: Synthetic oligonucleotide
  Target: SCN10A; (-) strand; PAM type: NRG; PAM sequence: GAG
gattgcatccctctaacctt

SEQ ID NO: 20869 - DNA, 20 bp, Artificial Sequence
  Description of Artificial Sequence: Synthetic oligonucleotide
  Target: SCN10A; (-) strand; PAM type: NRG; PAM sequence: GAG
tatccacacactttgccata

SEQ ID NO: 20870 - DNA, 20 bp, Artificial Sequence
  Description of Artificial Sequence: Synthetic oligonucleotide
  Target: SCN10A; (-) strand; PAM type: NRG; PAM sequence: TAG
cctatccacacactttgcca

SEQ ID NO: 20871 - DNA, 20 bp, Artificial Sequence
  Description of Artificial Sequence: Synthetic oligonucleotide
  Target: SCN10A; (-) strand; PAM type: NRG; PAM sequence: TGG
gaagagagtggcaatggtca

SEQ ID NO: 20872 - DNA, 20 bp, Artificial Sequence
  Description of Artificial Sequence: Synthetic oligonucleotide
  Target: SCN10A; (-) strand; PAM type: NRG; PAM sequence: TGG
gtagaggaagagagtggcaa

SEQ ID NO: 20873 - DNA, 20 bp, Artificial Sequence
  Description of Artificial Sequence: Synthetic oligonucleotide
  Target: SCN10A; (-) strand; PAM type: NRG; PAM sequence: TGG
caaagggtagaggaagagag

SEQ ID NO: 20874 - DNA, 20 bp, Artificial Sequence
  Description of Artificial Sequence: Synthetic oligonucleotide
  Target: SCN10A; (-) strand; PAM type: NRG; PAM sequence: GAG
agccaaagggtagaggaaga

SEQ ID NO: 20875 - DNA, 20 bp, Artificial Sequence
  Description of Artificial Sequence: Synthetic oligonucleotide
  Target: SCN10A; (-) strand; PAM type: NRG; PAM sequence: GAG
caagccaaagggtagaggaa

SEQ ID NO: 20876 - DNA, 20 bp, Artificial Sequence
  Description of Artificial Sequence: Synthetic oligonucleotide
  Target: SCN10A; (-) strand; PAM type: NRG; PAM sequence: AAG
tccaagccaaagggtagagg

SEQ ID NO: 20877 - DNA, 20 bp, Artificial Sequence
  Description of Artificial Sequence: Synthetic oligonucleotide
  Target: SCN10A; (-) strand; PAM type: NRG; PAM sequence: AGG
agttccaagccaaagggtag

SEQ ID NO: 20878 - DNA, 20 bp, Artificial Sequence
  Description of Artificial Sequence: Synthetic oligonucleotide
  Target: SCN10A; (-) strand; PAM type: NRG; PAM sequence: GAG
aagttccaagccaaagggta

SEQ ID NO: 20879 - DNA, 20 bp, Artificial Sequence
  Description of Artificial Sequence: Synthetic oligonucleotide
  Target: SCN10A; (-) strand; PAM type: NRG; PAM sequence: TAG
ctaagttccaagccaaaggg

SEQ ID NO: 20880 - DNA, 20 bp, Artificial Sequence
  Description of Artificial Sequence: Synthetic oligonucleotide
  Target: SCN10A; (-) strand; PAM type: NRG; PAM sequence: GGG
tatctaagttccaagccaaa

SEQ ID NO: 20881 - DNA, 20 bp, Artificial Sequence
  Description of Artificial Sequence: Synthetic oligonucleotide
  Target: SCN10A; (-) strand; PAM type: NRG; PAM sequence: AGG
gtatctaagttccaagccaa

SEQ ID NO: 20882 - DNA, 20 bp, Artificial Sequence
  Description of Artificial Sequence: Synthetic oligonucleotide
  Target: SCN10A; (-) strand; PAM type: NRG; PAM sequence: AAG
tgtatctaagttccaagcca

SEQ ID NO: 20883 - DNA, 20 bp, Artificial Sequence
  Description of Artificial Sequence: Synthetic oligonucleotide
  Target: SCN10A; (-) strand; PAM type: NRG; PAM sequence: AAG
cagcaatgtatctaagttcc

SEQ ID NO: 20884 - DNA, 20 bp, Artificial Sequence
  Description of Artificial Sequence: Synthetic oligonucleotide
  Target: SCN10A; (-) strand; PAM type: NRG; PAM sequence: AAG
gtctccccagcaatgtatct

SEQ ID NO: 20885 - DNA, 20 bp, Artificial Sequence
  Description of Artificial Sequence: Synthetic oligonucleotide
  Target: SCN10A; (-) strand; PAM type: NRG; PAM sequence: CAG
gggaatccactcagtctccc

SEQ ID NO: 20886 - DNA, 20 bp, Artificial Sequence
  Description of Artificial Sequence: Synthetic oligonucleotide
  Target: SCN10A; (-) strand; PAM type: NRG; PAM sequence: CAG
caatcaagtgggaatccact

SEQ ID NO: 20887 - DNA, 20 bp, Artificial Sequence
  Description of Artificial Sequence: Synthetic oligonucleotide
  Target: SCN10A; (-) strand; PAM type: NRG; PAM sequence: GGG
tagaattctaccaatcaagt

SEQ ID NO: 20888 - DNA, 20 bp, Artificial Sequence
  Description of Artificial Sequence: Synthetic oligonucleotide
  Target: SCN10A; (-) strand; PAM type: NRG; PAM sequence: TGG
ttagaattctaccaatcaag

SEQ ID NO: 20889 - DNA, 20 bp, Artificial Sequence
  Description of Artificial Sequence: Synthetic oligonucleotide
  Target: SCN10A; (-) strand; PAM type: NRG; PAM sequence: AAG
aatttagaattctaccaatc

SEQ ID NO: 20890 - DNA, 20 bp, Artificial Sequence
  Description of Artificial Sequence: Synthetic oligonucleotide
  Target: SCN10A; (-) strand; PAM type: NRG; PAM sequence: TAG
taactaagtccttgttaatt

SEQ ID NO: 20891 - DNA, 20 bp, Artificial Sequence
  Description of Artificial Sequence: Synthetic oligonucleotide
  Target: SCN10A; (-) strand; PAM type: NRG; PAM sequence: AAG
attaatcagtcaatttaact

SEQ ID NO: 20892 - DNA, 20 bp, Artificial Sequence
  Description of Artificial Sequence: Synthetic oligonucleotide
  Target: SCN10A; (-) strand; PAM type: NRG; PAM sequence: CAG
gacaatttaagtccattaat

SEQ ID NO: 20893 - DNA, 20 bp, Artificial Sequence
  Description of Artificial Sequence: Synthetic oligonucleotide
  Target: SCN10A; (-) strand; PAM type: NRG; PAM sequence: AAG
tgaatattggtagacaattt

SEQ ID NO: 20894 - DNA, 20 bp, Artificial Sequence
  Description of Artificial Sequence: Synthetic oligonucleotide
  Target: SCN10A; (-) strand; PAM type: NRG; PAM sequence: TAG
cacattatgctgaatattgg

SEQ ID NO: 20895 - DNA, 20 bp, Artificial Sequence
  Description of Artificial Sequence: Synthetic oligonucleotide
  Target: SCN10A; (-) strand; PAM type: NRG; PAM sequence: TGG
gcccacattatgctgaatat

SEQ ID NO: 20896 - DNA, 20 bp, Artificial Sequence
  Description of Artificial Sequence: Synthetic oligonucleotide
  Target: SCN10A; (-) strand; PAM type: NRG; PAM sequence: AAG
tgtaatttaatttcttgttc

SEQ ID NO: 20897 - DNA, 20 bp, Artificial Sequence
  Description of Artificial Sequence: Synthetic oligonucleotide
  Target: SCN10A; (-) strand; PAM type: NRG; PAM sequence: CAG
tttcatggttgtaacttaca

SEQ ID NO: 20898 - DNA, 20 bp, Artificial Sequence
  Description of Artificial Sequence: Synthetic oligonucleotide
  Target: SCN10A; (-) strand; PAM type: NRG; PAM sequence: TGG
tttcataattatatttttca

SEQ ID NO: 20899 - DNA, 20 bp, Artificial Sequence
  Description of Artificial Sequence: Synthetic oligonucleotide
  Target: SCN10A; (-) strand; PAM type: NRG; PAM sequence: TGG
tggcaaaattatccttttca

SEQ ID NO: 20900 - DNA, 20 bp, Artificial Sequence
  Description of Artificial Sequence: Synthetic oligonucleotide
  Target: SCN10A; (-) strand; PAM type: NRG; PAM sequence: TGG
ccatccttaattttccaaca

SEQ ID NO: 20901 - DNA, 20 bp, Artificial Sequence
  Description of Artificial Sequence: Synthetic oligonucleotide
  Target: SCN10A; (-) strand; PAM type: NRG; PAM sequence: AAG
aggccagctctccggtgtac

SEQ ID NO: 20902 - DNA, 20 bp, Artificial Sequence
  Description of Artificial Sequence: Synthetic oligonucleotide
  Target: SCN10A; (-) strand; PAM type: NRG; PAM sequence: CGG
agaatttcaggccagctctc

SEQ ID NO: 20903 - DNA, 20 bp, Artificial Sequence
  Description of Artificial Sequence: Synthetic oligonucleotide
  Target: SCN10A; (-) strand; PAM type: NRG; PAM sequence: CAG
ggcatcagagaatttcaggc

SEQ ID NO: 20904 - DNA, 20 bp, Artificial Sequence
  Description of Artificial Sequence: Synthetic oligonucleotide
  Target: SCN10A; (-) strand; PAM type: NRG; PAM sequence: AGG
ggcaggcatcagagaatttc

SEQ ID NO: 20905 - DNA, 20 bp, Artificial Sequence
  Description of Artificial Sequence: Synthetic oligonucleotide
  Target: SCN10A; (-) strand; PAM type: NRG; PAM sequence: CAG
tggcaggcatcagagaattt

SEQ ID NO: 20906 - DNA, 20 bp, Artificial Sequence
  Description of Artificial Sequence: Synthetic oligonucleotide
  Target: SCN10A; (-) strand; PAM type: NRG; PAM sequence: GAG
aagtgatctggcaggcatca

SEQ ID NO: 20907 - DNA, 20 bp, Artificial Sequence
  Description of Artificial Sequence: Synthetic oligonucleotide
  Target: SCN10A; (-) strand; PAM type: NRG; PAM sequence: CAG
aaaagtgatctggcaggcat

SEQ ID NO: 20908 - DNA, 20 bp, Artificial Sequence
  Description of Artificial Sequence: Synthetic oligonucleotide
  Target: SCN10A; (-) strand; PAM type: NRG; PAM sequence: AGG
atttttaaaagtgatctggc

SEQ ID NO: 20909 - DNA, 20 bp, Artificial Sequence
  Description of Artificial Sequence: Synthetic oligonucleotide
  Target: SCN10A; (-) strand; PAM type: NRG; PAM sequence: CAG
gatttttaaaagtgatctgg

SEQ ID NO: 20910 - DNA, 20 bp, Artificial Sequence
  Description of Artificial Sequence: Synthetic oligonucleotide
  Target: SCN10A; (-) strand; PAM type: NRG; PAM sequence: TGG
ctagatttttaaaagtgatc

SEQ ID NO: 20911 - DNA, 20 bp, Artificial Sequence
  Description of Artificial Sequence: Synthetic oligonucleotide
  Target: SCN10A; (-) strand; PAM type: NRG; PAM sequence: AAG
tcacaaaactagatttttaa

SEQ ID NO: 20912 - DNA, 20 bp, Artificial Sequence
  Description of Artificial Sequence: Synthetic oligonucleotide
  Target: SCN10A; (-) strand; PAM type: NRG; PAM sequence: TAG
ctttgcatgcatcacaaaac

SEQ ID NO: 20913 - DNA, 20 bp, Artificial Sequence
  Description of Artificial Sequence: Synthetic oligonucleotide
  Target: SCN10A; (-) strand; PAM type: NRG; PAM sequence: TAG
agctcatctcttgttcaaat

SEQ ID NO: 20914 - DNA, 20 bp, Artificial Sequence
  Description of Artificial Sequence: Synthetic oligonucleotide
  Target: SCN10A; (-) strand; PAM type: NRG; PAM sequence: TAG
atttgatgaataaaatatcc

SEQ ID NO: 20915 - DNA, 20 bp, Artificial Sequence
  Description of Artificial Sequence: Synthetic oligonucleotide
  Target: SCN10A; (-) strand; PAM type: NRG; PAM sequence: TAG
cttttatcaatgtggttttt

SEQ ID NO: 20916 - DNA, 20 bp, Artificial Sequence
  Description of Artificial Sequence: Synthetic oligonucleotide
  Target: SCN10A; (-) strand; PAM type: NRG; PAM sequence: TGG
cccaccatcttttatcaatg

SEQ ID NO: 20917 - DNA, 20 bp, Artificial Sequence
  Description of Artificial Sequence: Synthetic oligonucleotide
  Target: SCN10A; (-) strand; PAM type: NRG; PAM sequence: AGG
actcctcattcttatgtctt

SEQ ID NO: 20918 - DNA, 20 bp, Artificial Sequence
  Description of Artificial Sequence: Synthetic oligonucleotide
  Target: SCN10A; (-) strand; PAM type: NRG; PAM sequence: TAG
tactcctcattcttatgtct

SEQ ID NO: 20919 - DNA, 20 bp, Artificial Sequence
  Description of Artificial Sequence: Synthetic oligonucleotide
  Target: SCN10A; (-) strand; PAM type: NRG; PAM sequence: TGG
aagcgtccatctctgtgtac

SEQ ID NO: 20920 - DNA, 20 bp, Artificial Sequence
  Description of Artificial Sequence: Synthetic oligonucleotide
  Target: SCN10A; (-) strand; PAM type: NRG; PAM sequence: AAG
aatgtctctaactcgtgtca

SEQ ID NO: 20921 - DNA, 20 bp, Artificial Sequence
  Description of Artificial Sequence: Synthetic oligonucleotide
  Target: SCN10A; (-) strand; PAM type: NRG; PAM sequence: AAG
aattcccatgtgagcagcag

SEQ ID NO: 20922 - DNA, 20 bp, Artificial Sequence
  Description of Artificial Sequence: Synthetic oligonucleotide
  Target: SCN10A; (-) strand; PAM type: NRG; PAM sequence: CAG
atgaattcccatgtgagcag

SEQ ID NO: 20923 - DNA, 20 bp, Artificial Sequence
  Description of Artificial Sequence: Synthetic oligonucleotide
  Target: SCN10A; (-) strand; PAM type: NRG; PAM sequence: CAG
atgatgaattcccatgtgag

SEQ ID NO: 20924 - DNA, 20 bp, Artificial Sequence
  Description of Artificial Sequence: Synthetic oligonucleotide
  Target: SCN10A; (-) strand; PAM type: NRG; PAM sequence: GAG
gtcatgatgaattcccatgt

SEQ ID NO: 20925 - DNA, 20 bp, Artificial Sequence
  Description of Artificial Sequence: Synthetic oligonucleotide
  Target: SCN10A; (-) strand; PAM type: NRG; PAM sequence: AAG
taacctccgtccttgagggt

SEQ ID NO: 20926 - DNA, 20 bp, Artificial Sequence
  Description of Artificial Sequence: Synthetic oligonucleotide
  Target: SCN10A; (-) strand; PAM type: NRG; PAM sequence: GGG
atcataacctccgtccttga

SEQ ID NO: 20927 - DNA, 20 bp, Artificial Sequence
  Description of Artificial Sequence: Synthetic oligonucleotide
  Target: SCN10A; (-) strand; PAM type: NRG; PAM sequence: AGG
tatcataacctccgtccttg

SEQ ID NO: 20928 - DNA, 20 bp, Artificial Sequence
  Description of Artificial Sequence: Synthetic oligonucleotide
  Target: SCN10A; (-) strand; PAM type: NRG; PAM sequence: GAG
gtatcataacctccgtcctt

SEQ ID NO: 20929 - DNA, 20 bp, Artificial Sequence
  Description of Artificial Sequence: Synthetic oligonucleotide
  Target: SCN10A; (-) strand; PAM type: NRG; PAM sequence: CAG
caaagggcaatgagtgttgt

SEQ ID NO: 20930 - DNA, 20 bp, Artificial Sequence
  Description of Artificial Sequence: Synthetic oligonucleotide
  Target: SCN10A; (-) strand; PAM type: NRG; PAM sequence: GAG
ttccgggcccaaagggcaat

SEQ ID NO: 20931 - DNA, 20 bp, Artificial Sequence
  Description of Artificial Sequence: Synthetic oligonucleotide
  Target: SCN10A; (-) strand; PAM type: NRG; PAM sequence: GGG
tgaacctttccgggcccaaa

SEQ ID NO: 20932 - DNA, 20 bp, Artificial Sequence
  Description of Artificial Sequence: Synthetic oligonucleotide
  Target: SCN10A; (-) strand; PAM type: NRG; PAM sequence: AGG
atgaacctttccgggcccaa

SEQ ID NO: 20933 - DNA, 20 bp, Artificial Sequence
  Description of Artificial Sequence: Synthetic oligonucleotide
  Target: SCN10A; (-) strand; PAM type: NRG; PAM sequence: AAG
gatgaacctttccgggccca

SEQ ID NO: 20934 - DNA, 20 bp, Artificial Sequence
  Description of Artificial Sequence: Synthetic oligonucleotide
  Target: SCN10A; (-) strand; PAM type: NRG; PAM sequence: GGG
atacttagatgaacctttcc

SEQ ID NO: 20935 - DNA, 20 bp, Artificial Sequence
  Description of Artificial Sequence: Synthetic oligonucleotide
  Target: SCN10A; (-) strand; PAM type: NRG; PAM sequence: CGG
aatacttagatgaacctttc

SEQ ID NO: 20936 - DNA, 20 bp, Artificial Sequence
  Description of Artificial Sequence: Synthetic oligonucleotide
  Target: SCN10A; (-) strand; PAM type: NRG; PAM sequence: TAG
tttcttgtcagcagaatact

SEQ ID NO: 20937 - DNA, 20 bp, Artificial Sequence
  Description of Artificial Sequence: Synthetic oligonucleotide
  Target: SCN10A; (-) strand; PAM type: NRG; PAM sequence: CAG
aaagaagactttcttgtcag

SEQ ID NO: 20938 - DNA, 20 bp, Artificial Sequence
  Description of Artificial Sequence: Synthetic oligonucleotide
  Target: SCN10A; (-) strand; PAM type: NRG; PAM sequence: CAG
acaaaagaagactttcttgt

SEQ ID NO: 20939 - DNA, 20 bp, Artificial Sequence
  Description of Artificial Sequence: Synthetic oligonucleotide
  Target: SCN10A; (-) strand; PAM type: NRG; PAM sequence: AAG
cattcgatgcaggacaaaag

SEQ ID NO: 20940 - DNA, 20 bp, Artificial Sequence
  Description of Artificial Sequence: Synthetic oligonucleotide
  Target: SCN10A; (-) strand; PAM type: NRG; PAM sequence: AAG
aggcattcgatgcaggacaa

SEQ ID NO: 20941 - DNA, 20 bp, Artificial Sequence
  Description of Artificial Sequence: Synthetic oligonucleotide
  Target: SCN10A; (-) strand; PAM type: NRG; PAM sequence: AGG
tctcaacaggcattcgatgc

SEQ ID NO: 20942 - DNA, 20 bp, Artificial Sequence
  Description of Artificial Sequence: Synthetic oligonucleotide
  Target: SCN10A; (-) strand; PAM type: NRG; PAM sequence: CAG
gtctcaacaggcattcgatg

SEQ ID NO: 20943 - DNA, 20 bp, Artificial Sequence
  Description of Artificial Sequence: Synthetic oligonucleotide
  Target: SCN10A; (-) strand; PAM type: NRG; PAM sequence: AGG
gactctgtttgtgtctcaac

SEQ ID NO: 20944 - DNA, 20 bp, Artificial Sequence
  Description of Artificial Sequence: Synthetic oligonucleotide
  Target: SCN10A; (-) strand; PAM type: NRG; PAM sequence: CAG
tgactctgtttgtgtctcaa

SEQ ID NO: 20945 - DNA, 20 bp, Artificial Sequence
  Description of Artificial Sequence: Synthetic oligonucleotide
  Target: SCN10A; (-) strand; PAM type: NRG; PAM sequence: GAG
atgaagatgtcaggttaaag

SEQ ID NO: 20946 - DNA, 20 bp, Artificial Sequence
  Description of Artificial Sequence: Synthetic oligonucleotide
  Target: SCN10A; (-) strand; PAM type: NRG; PAM sequence: AGG
ccatgaagatgtcaggttaa

SEQ ID NO: 20947 - DNA, 20 bp, Artificial Sequence
  Description of Artificial Sequence: Synthetic oligonucleotide
  Target: SCN10A; (-) strand; PAM type: NRG; PAM sequence: AAG
gccatgaagatgtcaggtta

SEQ ID NO: 20948 - DNA, 20 bp, Artificial Sequence
  Description of Artificial Sequence: Synthetic oligonucleotide
  Target: SCN10A; (-) strand; PAM type: NRG; PAM sequence: AGG
aactttgccatgaagatgtc

SEQ ID NO: 20949 - DNA, 20 bp, Artificial Sequence
  Description of Artificial Sequence: Synthetic oligonucleotide
  Target: SCN10A; (-) strand; PAM type: NRG; PAM sequence: CAG
caactttgccatgaagatgt

SEQ ID NO: 20950 - DNA, 20 bp, Artificial Sequence
  Description of Artificial Sequence: Synthetic oligonucleotide
  Target: SCN10A; (-) strand; PAM type: NRG; PAM sequence: AAG
aatgatccaactttgccatg

SEQ ID NO: 20951 - DNA, 20 bp, Artificial Sequence
  Description of Artificial Sequence: Synthetic oligonucleotide
  Target: SCN10A; (-) strand; PAM type: NRG; PAM sequence: AGG
atatgagattggccaataag

SEQ ID NO: 20952 - DNA, 20 bp, Artificial Sequence
  Description of Artificial Sequence: Synthetic oligonucleotide
  Target: SCN10A; (-) strand; PAM type: NRG; PAM sequence: GAG
tatatgagattggccaataa

SEQ ID NO: 20953 - DNA, 20 bp, Artificial Sequence
  Description of Artificial Sequence: Synthetic oligonucleotide
  Target: SCN10A; (-) strand; PAM type: NRG; PAM sequence: AAG
tatatatgagattggccaat

SEQ ID NO: 20954 - DNA, 20 bp, Artificial Sequence
  Description of Artificial Sequence: Synthetic oligonucleotide
  Target: SCN10A; (-) strand; PAM type: NRG; PAM sequence: TGG
catatgactatatatgagat

SEQ ID NO: 20955 - DNA, 20 bp, Artificial Sequence
  Description of Artificial Sequence: Synthetic oligonucleotide
  Target: SCN10A; (-) strand; PAM type: NRG; PAM sequence: GAG
agtgacatatgactatatat

SEQ ID NO: 20956 - DNA, 20 bp, Artificial Sequence
  Description of Artificial Sequence: Synthetic oligonucleotide
  Target: SCN10A; (-) strand; PAM type: NRG; PAM sequence: AAG
cagaacatatctctatctgt

SEQ ID NO: 20957 - DNA, 20 bp, Artificial Sequence
  Description of Artificial Sequence: Synthetic oligonucleotide
  Target: SCN10A; (-) strand; PAM type: NRG; PAM sequence: CAG
tcacctaatgatgtatttgt

SEQ ID NO: 20958 - DNA, 20 bp, Artificial Sequence
  Description of Artificial Sequence: Synthetic oligonucleotide
  Target: SCN10A; (-) strand; PAM type: NRG; PAM sequence: CAG
aatacaatgtaggatattca

SEQ ID NO: 20959 - DNA, 20 bp, Artificial Sequence
  Description of Artificial Sequence: Synthetic oligonucleotide
  Target: SCN10A; (-) strand; PAM type: NRG; PAM sequence: AGG
tgtttgtgtaaatacaatgt

SEQ ID NO: 20960 - DNA, 20 bp, Artificial Sequence
  Description of Artificial Sequence: Synthetic oligonucleotide
  Target: SCN10A; (-) strand; PAM type: NRG; PAM sequence: TAG
ttgtttgtgtaaatacaatg

SEQ ID NO: 20961 - DNA, 20 bp, Artificial Sequence
  Description of Artificial Sequence: Synthetic oligonucleotide
  Target: SCN10A; (-) strand; PAM type: NRG; PAM sequence: TAG
cctagatgtatagaaggcta

SEQ ID NO: 20962 - DNA, 20 bp, Artificial Sequence
  Description of Artificial Sequence: Synthetic oligonucleotide
  Target: SCN10A; (-) strand; PAM type: NRG; PAM sequence: AGG
atttagcctagatgtataga

SEQ ID NO: 20963 - DNA, 20 bp, Artificial Sequence
  Description of Artificial Sequence: Synthetic oligonucleotide
  Target: SCN10A; (-) strand; PAM type: NRG; PAM sequence: AAG
tatttagcctagatgtatag

SEQ ID NO: 20964 - DNA, 20 bp, Artificial Sequence
  Description of Artificial Sequence: Synthetic oligonucleotide
  Target: SCN10A; (-) strand; PAM type: NRG; PAM sequence: TAG
cactatttagcctagatgta

SEQ ID NO: 20965 - DNA, 20 bp, Artificial Sequence
  Description of Artificial Sequence: Synthetic oligonucleotide
  Target: SCN10A; (-) strand; PAM type: NRG; PAM sequence: TAG
ataggccacactatttagcc

SEQ ID NO: 20966 - DNA, 20 bp, Artificial Sequence
  Description of Artificial Sequence: Synthetic oligonucleotide
  Target: SCN10A; (-) strand; PAM type: NRG; PAM sequence: TAG
gagcaataggccacactatt

SEQ ID NO: 20967 - DNA, 20 bp, Artificial Sequence
  Description of Artificial Sequence: Synthetic oligonucleotide
  Target: SCN10A; (-) strand; PAM type: NRG; PAM sequence: AGG
atttgtagcctaggagcaat

SEQ ID NO: 20968 - DNA, 20 bp, Artificial Sequence
  Description of Artificial Sequence: Synthetic oligonucleotide
  Target: SCN10A; (-) strand; PAM type: NRG; PAM sequence: TAG
gatttgtagcctaggagcaa

SEQ ID NO: 20969 - DNA, 20 bp, Artificial Sequence
  Description of Artificial Sequence: Synthetic oligonucleotide
  Target: SCN10A; (-) strand; PAM type: NRG; PAM sequence: GAG
tgtacagatttgtagcctag

SEQ ID NO: 20970 - DNA, 20 bp, Artificial Sequence
  Description of Artificial Sequence: Synthetic oligonucleotide
  Target: SCN10A; (-) strand; PAM type: NRG; PAM sequence: AGG
gctgtacagatttgtagcct

SEQ ID NO: 20971 - DNA, 20 bp, Artificial Sequence
  Description of Artificial Sequence: Synthetic oligonucleotide
  Target: SCN10A; (-) strand; PAM type: NRG; PAM sequence: TAG
tgctgtacagatttgtagcc

SEQ ID NO: 20972 - DNA, 20 bp, Artificial Sequence
  Description of Artificial Sequence: Synthetic oligonucleotide
  Target: SCN10A; (-) strand; PAM type: NRG; PAM sequence: TAG
taacatgctgtacagatttg

SEQ ID NO: 20973 - DNA, 20 bp, Artificial Sequence
  Description of Artificial Sequence: Synthetic oligonucleotide
  Target: SCN10A; (-) strand; PAM type: NRG; PAM sequence: CAG
ttcagcaataacatgctgta

SEQ ID NO: 20974 - DNA, 20 bp, Artificial Sequence
  Description of Artificial Sequence: Synthetic oligonucleotide
  Target: SCN10A; (-) strand; PAM type: NRG; PAM sequence: CAG
ctgtttatacttacagtatt

SEQ ID NO: 20975 - DNA, 20 bp, Artificial Sequence
  Description of Artificial Sequence: Synthetic oligonucleotide
  Target: SCN10A; (-) strand; PAM type: NRG; PAM sequence: CAG
ttattaactgtttatactta

SEQ ID NO: 20976 - DNA, 20 bp, Artificial Sequence
  Description of Artificial Sequence: Synthetic oligonucleotide
  Target: SCN10A; (-) strand; PAM type: NRG; PAM sequence: AAG
tgcttagtcctcatggttgg

SEQ ID NO: 20977 - DNA, 20 bp, Artificial Sequence
  Description of Artificial Sequence: Synthetic oligonucleotide
  Target: SCN10A; (-) strand; PAM type: NRG; PAM sequence: TGG
atttgcttagtcctcatggt

SEQ ID NO: 20978 - DNA, 20 bp, Artificial Sequence
  Description of Artificial Sequence: Synthetic oligonucleotide
  Target: SCN10A; (-) strand; PAM type: NRG; PAM sequence: TGG
tatcatttgcttagtcctca

SEQ ID NO: 20979 - DNA, 20 bp, Artificial Sequence
  Description of Artificial Sequence: Synthetic oligonucleotide
  Target: SCN10A; (-) strand; PAM type: NRG; PAM sequence: TAG
gactactagtatcatttgct

SEQ ID NO: 20980 - DNA, 20 bp, Artificial Sequence
  Description of Artificial Sequence: Synthetic oligonucleotide
  Target: SCN10A; (-) strand; PAM type: NRG; PAM sequence: TAG
taacaataaatagtgactac

SEQ ID NO: 20981 - DNA, 20 bp, Artificial Sequence
  Description of Artificial Sequence: Synthetic oligonucleotide
  Target: SCN10A; (-) strand; PAM type: NRG; PAM sequence: TAG
gtctgacagataacaataaa

SEQ ID NO: 20982 - DNA, 20 bp, Artificial Sequence
  Description of Artificial Sequence: Synthetic oligonucleotide
  Target: SCN10A; (-) strand; PAM type: NRG; PAM sequence: CAG
acatttttatacatgtctga

SEQ ID NO: 20983 - DNA, 20 bp, Artificial Sequence
  Description of Artificial Sequence: Synthetic oligonucleotide
  Target: SCN10A; (-) strand; PAM type: NRG; PAM sequence: AAG
gagggttaaatgaaataaca

SEQ ID NO: 20984 - DNA, 20 bp, Artificial Sequence
  Description of Artificial Sequence: Synthetic oligonucleotide
  Target: SCN10A; (-) strand; PAM type: NRG; PAM sequence: GGG
aaggtttctaaatagctgga

SEQ ID NO: 20985 - DNA, 20 bp, Artificial Sequence
  Description of Artificial Sequence: Synthetic oligonucleotide
  Target: SCN10A; (-) strand; PAM type: NRG; PAM sequence: AGG
aaaggtttctaaatagctgg

SEQ ID NO: 20986 - DNA, 20 bp, Artificial Sequence
  Description of Artificial Sequence: Synthetic oligonucleotide
  Target: SCN10A; (-) strand; PAM type: NRG; PAM sequence: GAG
aaaaggtttctaaatagctg

SEQ ID NO: 20987 - DNA, 20 bp, Artificial Sequence
  Description of Artificial Sequence: Synthetic oligonucleotide
  Target: SCN10A; (-) strand; PAM type: NRG; PAM sequence: TGG
taaaaaggtttctaaatagc

SEQ ID NO: 20988 - DNA, 20 bp, Artificial Sequence
  Description of Artificial Sequence: Synthetic oligonucleotide
  Target: SCN10A; (-) strand; PAM type: NRG; PAM sequence: TAG
cttgtaaaaaggtttctaaa

SEQ ID NO: 20989 - DNA, 20 bp, Artificial Sequence
  Description of Artificial Sequence: Synthetic oligonucleotide
  Target: SCN10A; (-) strand; PAM type: NRG; PAM sequence: AGG
ccttatctccccttgtaaaa

SEQ ID NO: 20990 - DNA, 20 bp, Artificial Sequence
  Description of Artificial Sequence: Synthetic oligonucleotide
  Target: SCN10A; (-) strand; PAM type: NRG; PAM sequence: AAG
tccttatctccccttgtaaa

SEQ ID NO: 20991 - DNA, 20 bp, Artificial Sequence
  Description of Artificial Sequence: Synthetic oligonucleotide
  Target: SCN10A; (-) strand; PAM type: NRG; PAM sequence: AAG
gcaagtcctttaaattatcc

SEQ ID NO: 20992 - DNA, 20 bp, Artificial Sequence
  Description of Artificial Sequence: Synthetic oligonucleotide
  Target: SCN10A; (-) strand; PAM type: NRG; PAM sequence: AAG
ccacctgagtcacatttagc

SEQ ID NO: 20993 - DNA, 20 bp, Artificial Sequence
  Description of Artificial Sequence: Synthetic oligonucleotide
  Target: SCN10A; (-) strand; PAM type: NRG; PAM sequence: TAG
gttaccacctgagtcacatt

SEQ ID NO: 20994 - DNA, 20 bp, Artificial Sequence
  Description of Artificial Sequence: Synthetic oligonucleotide
  Target: SCN10A; (-) strand; PAM type: NRG; PAM sequence: GAG
aactgtgccagttaccacct

SEQ ID NO: 20995 - DNA, 20 bp, Artificial Sequence
  Description of Artificial Sequence: Synthetic oligonucleotide
  Target: SCN10A; (-) strand; PAM type: NRG; PAM sequence: CAG
tattttagtcccaactgtgc

SEQ ID NO: 20996 - DNA, 20 bp, Artificial Sequence
  Description of Artificial Sequence: Synthetic oligonucleotide
  Target: SCN10A; (-) strand; PAM type: NRG; PAM sequence: TAG
tttagtatggacctatattt

SEQ ID NO: 20997 - DNA, 20 bp, Artificial Sequence
  Description of Artificial Sequence: Synthetic oligonucleotide
  Target: SCN10A; (-) strand; PAM type: NRG; PAM sequence: TGG
ttaggcccttctgtttagta

SEQ ID NO: 20998 - DNA, 20 bp, Artificial Sequence
  Description of Artificial Sequence: Synthetic oligonucleotide
  Target: SCN10A; (-) strand; PAM type: NRG; PAM sequence: TAG
actctttaggcccttctgtt

SEQ ID NO: 20999 - DNA, 20 bp, Artificial Sequence
  Description of Artificial Sequence: Synthetic oligonucleotide
  Target: SCN10A; (-) strand; PAM type: NRG; PAM sequence: AGG
tagtgaaagattgactcttt

SEQ ID NO: 21000 - DNA, 20 bp, Artificial Sequence
  Description of Artificial Sequence: Synthetic oligonucleotide
  Target: SCN10A; (-) strand; PAM type: NRG; PAM sequence: TAG
ctagtgaaagattgactctt

SEQ ID NO: 21001 - DNA, 20 bp, Artificial Sequence
  Description of Artificial Sequence: Synthetic oligonucleotide
  Target: SCN10A; (-) strand; PAM type: NRG; PAM sequence: AAG
ttaaattaccaggctagtga

SEQ ID NO: 21002 - DNA, 20 bp, Artificial Sequence
  Description of Artificial Sequence: Synthetic oligonucleotide
  Target: SCN10A; (-) strand; PAM type: NRG; PAM sequence: TAG
ttctagttaaattaccaggc

SEQ ID NO: 21003 - DNA, 20 bp, Artificial Sequence
  Description of Artificial Sequence: Synthetic oligonucleotide
  Target: SCN10A; (-) strand; PAM type: NRG; PAM sequence: AGG
ttcattctagttaaattacc

SEQ ID NO: 21004 - DNA, 20 bp, Artificial Sequence
  Description of Artificial Sequence: Synthetic oligonucleotide
  Target: SCN10A; (-) strand; PAM type: NRG; PAM sequence: CAG
attcattctagttaaattac

SEQ ID NO: 21005 - DNA, 20 bp, Artificial Sequence
  Description of Artificial Sequence: Synthetic oligonucleotide
  Target: SCN10A; (-) strand; PAM type: NRG; PAM sequence: TAG
attctgaccttgattcattc

SEQ ID NO: 21006 - DNA, 20 bp, Artificial Sequence
  Description of Artificial Sequence: Synthetic oligonucleotide
  Target: SCN10A; (-) strand; PAM type: NRG; PAM sequence: TAG
tcctgagattatcatgtgtc

SEQ ID NO: 21007 - DNA, 20 bp, Artificial Sequence
  Description of Artificial Sequence: Synthetic oligonucleotide
  Target: SCN10A; (-) strand; PAM type: NRG; PAM sequence: GAG
accctcctttctctgttcct

SEQ ID NO: 21008 - DNA, 20 bp, Artificial Sequence
  Description of Artificial Sequence: Synthetic oligonucleotide
  Target: SCN10A; (-) strand; PAM type: NRG; PAM sequence: GGG
atttatgcctctcttgtgat

SEQ ID NO: 21009 - DNA, 20 bp, Artificial Sequence
  Description of Artificial Sequence: Synthetic oligonucleotide
  Target: SCN10A; (-) strand; PAM type: NRG; PAM sequence: TGG
catttatgcctctcttgtga

SEQ ID NO: 21010 - DNA, 20 bp, Artificial Sequence
  Description of Artificial Sequence: Synthetic oligonucleotide
  Target: SCN10A; (-) strand; PAM type: NRG; PAM sequence: AGG
tctagaaaatgcctcactga

SEQ ID NO: 21011 - DNA, 20 bp, Artificial Sequence
  Description of Artificial Sequence: Synthetic oligonucleotide
  Target: SCN10A; (-) strand; PAM type: NRG; PAM sequence: AAG
ctctagaaaatgcctcactg

SEQ ID NO: 21012 - DNA, 20 bp, Artificial Sequence
  Description of Artificial Sequence: Synthetic oligonucleotide
  Target: SCN10A; (-) strand; PAM type: NRG; PAM sequence: TAG
ctgggagtgcattagcactc

SEQ ID NO: 21013 - DNA, 20 bp, Artificial Sequence
  Description of Artificial Sequence: Synthetic oligonucleotide
  Target: SCN10A; (-) strand; PAM type: NRG; PAM sequence: TAG
agggctcgctgggagtgcat

SEQ ID NO: 21014 - DNA, 20 bp, Artificial Sequence
  Description of Artificial Sequence: Synthetic oligonucleotide
  Target: SCN10A; (-) strand; PAM type: NRG; PAM sequence: GAG
catcctgcagggctcgctgg

SEQ ID NO: 21015 - DNA, 20 bp, Artificial Sequence
  Description of Artificial Sequence: Synthetic oligonucleotide
  Target: SCN10A; (-) strand; PAM type: NRG; PAM sequence: GGG
ggcatcctgcagggctcgct

SEQ ID NO: 21016 - DNA, 20 bp, Artificial Sequence
  Description of Artificial Sequence: Synthetic oligonucleotide
  Target: SCN10A; (-) strand; PAM type: NRG; PAM sequence: TGG
aggcatcctgcagggctcgc

SEQ ID NO: 21017 - DNA, 20 bp, Artificial Sequence
  Description of Artificial Sequence: Synthetic oligonucleotide
  Target: SCN10A; (-) strand; PAM type: NRG; PAM sequence: GGG
aaagtcaaaggcatcctgca

SEQ ID NO: 21018 - DNA, 20 bp, Artificial Sequence
  Description of Artificial Sequence: Synthetic oligonucleotide
  Target: SCN10A; (-) strand; PAM type: NRG; PAM sequence: AGG
taaagtcaaaggcatcctgc

SEQ ID NO: 21019 - DNA, 20 bp, Artificial Sequence
  Description of Artificial Sequence: Synthetic oligonucleotide
  Target: SCN10A; (-) strand; PAM type: NRG; PAM sequence: CAG
ttaaagtcaaaggcatcctg

SEQ ID NO: 21020 - DNA, 20 bp, Artificial Sequence
  Description of Artificial Sequence: Synthetic oligonucleotide
  Target: SCN10A; (-) strand; PAM type: NRG; PAM sequence: AGG
aaacagagccttaaagtcaa

SEQ ID NO: 21021 - DNA, 20 bp, Artificial Sequence
  Description of Artificial Sequence: Synthetic oligonucleotide
  Target: SCN10A; (-) strand; PAM type: NRG; PAM sequence: AAG
aaaacagagccttaaagtca

SEQ ID NO: 21022 - DNA, 20 bp, Artificial Sequence
  Description of Artificial Sequence: Synthetic oligonucleotide
  Target: SCN10A; (-) strand; PAM type: NRG; PAM sequence: AAG
atcaccaaaacagagcctta

SEQ ID NO: 21023 - DNA, 20 bp, Artificial Sequence
  Description of Artificial Sequence: Synthetic oligonucleotide
  Target: SCN10A; (-) strand; PAM type: NRG; PAM sequence: GAG
caaatggaatcaccaaaaca

SEQ ID NO: 21024 - DNA, 20 bp, Artificial Sequence
  Description of Artificial Sequence: Synthetic oligonucleotide
  Target: SCN10A; (-) strand; PAM type: NRG; PAM sequence: CAG
ggcaaatggaatcaccaaaa

SEQ ID NO: 21025 - DNA, 20 bp, Artificial Sequence
  Description of Artificial Sequence: Synthetic oligonucleotide
  Target: SCN10A; (-) strand; PAM type: NRG; PAM sequence: TGG
gagtaggtctccagggcaaa

SEQ ID NO: 21026 - DNA, 20 bp, Artificial Sequence
  Description of Artificial Sequence: Synthetic oligonucleotide
  Target: SCN10A; (-) strand; PAM type: NRG; PAM sequence: GGG
aggtagagagtaggtctcca

SEQ ID NO: 21027 - DNA, 20 bp, Artificial Sequence
  Description of Artificial Sequence: Synthetic oligonucleotide
  Target: SCN10A; (-) strand; PAM type: NRG; PAM sequence: AGG
aaggtagagagtaggtctcc

SEQ ID NO: 21028 - DNA, 20 bp, Artificial Sequence
  Description of Artificial Sequence: Synthetic oligonucleotide
  Target: SCN10A; (-) strand; PAM type: NRG; PAM sequence: CAG
gaaggtagagagtaggtctc

SEQ ID NO: 21029 - DNA, 20 bp, Artificial Sequence
  Description of Artificial Sequence: Synthetic oligonucleotide
  Target: SCN10A; (-) strand; PAM type: NRG; PAM sequence: AGG
cagtggagaaggtagagagt

SEQ ID NO: 21030 - DNA, 20 bp, Artificial Sequence
  Description of Artificial Sequence: Synthetic oligonucleotide
  Target: SCN10A; (-) strand; PAM type: NRG; PAM sequence: TAG
acagtggagaaggtagagag

SEQ ID NO: 21031 - DNA, 20 bp, Artificial Sequence
  Description of Artificial Sequence: Synthetic oligonucleotide
  Target: SCN10A; (-) strand; PAM type: NRG; PAM sequence: GAG
gagacagtggagaaggtaga

SEQ ID NO: 21032 - DNA, 20 bp, Artificial Sequence
  Description of Artificial Sequence: Synthetic oligonucleotide
  Target: SCN10A; (-) strand; PAM type: NRG; PAM sequence: GAG
cagagacagtggagaaggta

SEQ ID NO: 21033 - DNA, 20 bp, Artificial Sequence
  Description of Artificial Sequence: Synthetic oligonucleotide
  Target: SCN10A; (-) strand; PAM type: NRG; PAM sequence: TAG
aacagagacagtggagaagg

SEQ ID NO: 21034 - DNA, 20 bp, Artificial Sequence
  Description of Artificial Sequence: Synthetic oligonucleotide
  Target: SCN10A; (-) strand; PAM type: NRG; PAM sequence: AGG
aggaacagagacagtggaga

SEQ ID NO: 21035 - DNA, 20 bp, Artificial Sequence
  Description of Artificial Sequence: Synthetic oligonucleotide
  Target: SCN10A; (-) strand; PAM type: NRG; PAM sequence: AAG
caggaacagagacagtggag

SEQ ID NO: 21036 - DNA, 20 bp, Artificial Sequence
  Description of Artificial Sequence: Synthetic oligonucleotide
  Target: SCN10A; (-) strand; PAM type: NRG; PAM sequence: GAG
ccccaggaacagagacagtg

SEQ ID NO: 21037 - DNA, 20 bp, Artificial Sequence
  Description of Artificial Sequence: Synthetic oligonucleotide
  Target: SCN10A; (-) strand; PAM type: NRG; PAM sequence: TGG
ctccccaggaacagagacag

SEQ ID NO: 21038 - DNA, 20 bp, Artificial Sequence
  Description of Artificial Sequence: Synthetic oligonucleotide
  Target: SCN10A; (-) strand; PAM type: NRG; PAM sequence: CAG
tccctccccaggaacagaga

SEQ ID NO: 21039 - DNA, 20 bp, Artificial Sequence
  Description of Artificial Sequence: Synthetic oligonucleotide
  Target: SCN10A; (-) strand; PAM type: NRG; PAM sequence: GAG
ggtctccctccccaggaaca

SEQ ID NO: 21040 - DNA, 20 bp, Artificial Sequence
  Description of Artificial Sequence: Synthetic oligonucleotide
  Target: SCN10A; (-) strand; PAM type: NRG; PAM sequence: CAG
caggtctccctccccaggaa

SEQ ID NO: 21041 - DNA, 20 bp, Artificial Sequence
  Description of Artificial Sequence: Synthetic oligonucleotide
  Target: SCN10A; (-) strand; PAM type: NRG; PAM sequence: AGG
ttgtacaggtctccctcccc

SEQ ID NO: 21042 - DNA, 20 bp, Artificial Sequence
  Description of Artificial Sequence: Synthetic oligonucleotide
  Target: SCN10A; (-) strand; PAM type: NRG; PAM sequence: CAG
tttgtacaggtctccctccc

SEQ ID NO: 21043 - DNA, 20 bp, Artificial Sequence
  Description of Artificial Sequence: Synthetic oligonucleotide
  Target: SCN10A; (-) strand; PAM type: NRG; PAM sequence: AGG
aaggataacacattttgtac

SEQ ID NO: 21044 - DNA, 20 bp, Artificial Sequence
  Description of Artificial Sequence: Synthetic oligonucleotide
  Target: SCN10A; (-) strand; PAM type: NRG; PAM sequence: CAG
taaggataacacattttgta

SEQ ID NO: 21045 - DNA, 20 bp, Artificial Sequence
  Description of Artificial Sequence: Synthetic oligonucleotide
  Target: SCN10A; (-) strand; PAM type: NRG; PAM sequence: AGG
ctggccagaaccagagggta

SEQ ID NO: 21046 - DNA, 20 bp, Artificial Sequence
  Description of Artificial Sequence: Synthetic oligonucleotide
  Target: SCN10A; (-) strand; PAM type: NRG; PAM sequence: AAG
cctggccagaaccagagggt

SEQ ID NO: 21047 - DNA, 20 bp, Artificial Sequence
  Description of Artificial Sequence: Synthetic oligonucleotide
  Target: SCN10A; (-) strand; PAM type: NRG; PAM sequence: GGG
caaacctggccagaaccaga

SEQ ID NO: 21048 - DNA, 20 bp, Artificial Sequence
  Description of Artificial Sequence: Synthetic oligonucleotide
  Target: SCN10A; (-) strand; PAM type: NRG; PAM sequence: AGG
ccaaacctggccagaaccag

SEQ ID NO: 21049 - DNA, 20 bp, Artificial Sequence
  Description of Artificial Sequence: Synthetic oligonucleotide
  Target: SCN10A; (-) strand; PAM type: NRG; PAM sequence: GAG
accaaacctggccagaacca

SEQ ID NO: 21050 - DNA, 20 bp, Artificial Sequence
  Description of Artificial Sequence: Synthetic oligonucleotide
  Target: SCN10A; (-) strand; PAM type: NRG; PAM sequence: CAG
taaccaaacctggccagaac

SEQ ID NO: 21051 - DNA, 20 bp, Artificial Sequence
  Description of Artificial Sequence: Synthetic oligonucleotide
  Target: SCN10A; (-) strand; PAM type: NRG; PAM sequence: CAG
tcccattaaccaaacctggc

SEQ ID NO: 21052 - DNA, 20 bp, Artificial Sequence
  Description of Artificial Sequence: Synthetic oligonucleotide
  Target: SCN10A; (-) strand; PAM type: NRG; PAM sequence: TGG
tgtctcccattaaccaaacc

SEQ ID NO: 21053 - DNA, 20 bp, Artificial Sequence
  Description of Artificial Sequence: Synthetic oligonucleotide
  Target: SCN10A; (-) strand; PAM type: NRG; PAM sequence: GGG
cacaggagagaagaagccag

SEQ ID NO: 21054 - DNA, 20 bp, Artificial Sequence
  Description of Artificial Sequence: Synthetic oligonucleotide
  Target: SCN10A; (-) strand; PAM type: NRG; PAM sequence: GGG
gcacaggagagaagaagcca

SEQ ID NO: 21055 - DNA, 20 bp, Artificial Sequence
  Description of Artificial Sequence: Synthetic oligonucleotide
  Target: SCN10A; (-) strand; PAM type: NRG; PAM sequence: AGG
agcacaggagagaagaagcc

SEQ ID NO: 21056 - DNA, 20 bp, Artificial Sequence
  Description of Artificial Sequence: Synthetic oligonucleotide
  Target: SCN10A; (-) strand; PAM type: NRG; PAM sequence: CAG
tagcacaggagagaagaagc

SEQ ID NO: 21057 - DNA, 20 bp, Artificial Sequence
  Description of Artificial Sequence: Synthetic oligonucleotide
  Target: SCN10A; (-) strand; PAM type: NRG; PAM sequence: AAG
gccatagcacaggagagaag

SEQ ID NO: 21058 - DNA, 20 bp, Artificial Sequence
  Description of Artificial Sequence: Synthetic oligonucleotide
  Target: SCN10A; (-) strand; PAM type: NRG; PAM sequence: AAG
tcagccatagcacaggagag

SEQ ID NO: 21059 - DNA, 20 bp, Artificial Sequence
  Description of Artificial Sequence: Synthetic oligonucleotide
  Target: SCN10A; (-) strand; PAM type: NRG; PAM sequence: GAG
tactcagccatagcacagga

SEQ ID NO: 21060 - DNA, 20 bp, Artificial Sequence
  Description of Artificial Sequence: Synthetic oligonucleotide
  Target: SCN10A; (-) strand; PAM type: NRG; PAM sequence: GAG
gctactcagccatagcacag

SEQ ID NO: 21061 - DNA, 20 bp, Artificial Sequence
  Description of Artificial Sequence: Synthetic oligonucleotide
  Target: SCN10A; (-) strand; PAM type: NRG; PAM sequence: AGG
ctgctactcagccatagcac

SEQ ID NO: 21062 - DNA, 20 bp, Artificial Sequence
  Description of Artificial Sequence: Synthetic oligonucleotide
  Target: SCN10A; (-) strand; PAM type: NRG; PAM sequence: CAG
tctgctactcagccatagca

SEQ ID NO: 21063 - DNA, 20 bp, Artificial Sequence
  Description of Artificial Sequence: Synthetic oligonucleotide
  Target: SCN10A; (-) strand; PAM type: NRG; PAM sequence: TAG
acagctctgctactcagcca

SEQ ID NO: 21064 - DNA, 20 bp, Artificial Sequence
  Description of Artificial Sequence: Synthetic oligonucleotide
  Target: SCN10A; (-) strand; PAM type: NRG; PAM sequence: CAG
aggatcacagctctgctact

SEQ ID NO: 21065 - DNA, 20 bp, Artificial Sequence
  Description of Artificial Sequence: Synthetic oligonucleotide
  Target: SCN10A; (-) strand; PAM type: NRG; PAM sequence: CAG
gtgatcttagtagaggatca

SEQ ID NO: 21066 - DNA, 20 bp, Artificial Sequence
  Description of Artificial Sequence: Synthetic oligonucleotide
  Target: SCN10A; (-) strand; PAM type: NRG; PAM sequence: AGG
agaacttgtgatcttagtag

SEQ ID NO: 21067 - DNA, 20 bp, Artificial Sequence
  Description of Artificial Sequence: Synthetic oligonucleotide
  Target: SCN10A; (-) strand; PAM type: NRG; PAM sequence: GAG
cagaacttgtgatcttagta

SEQ ID NO: 21068 - DNA, 20 bp, Artificial Sequence
  Description of Artificial Sequence: Synthetic oligonucleotide
  Target: SCN10A; (-) strand; PAM type: NRG; PAM sequence: TAG
ggcagaacttgtgatcttag

SEQ ID NO: 21069 - DNA, 20 bp, Artificial Sequence
  Description of Artificial Sequence: Synthetic oligonucleotide
  Target: SCN10A; (-) strand; PAM type: NRG; PAM sequence: TAG
cctggcagaacttgtgatct

SEQ ID NO: 21070 - DNA, 20 bp, Artificial Sequence
  Description of Artificial Sequence: Synthetic oligonucleotide
  Target: SCN10A; (-) strand; PAM type: NRG; PAM sequence: CAG
gtgtcagagaggctgcctgg

SEQ ID NO: 21071 - DNA, 20 bp, Artificial Sequence
  Description of Artificial Sequence: Synthetic oligonucleotide
  Target: SCN10A; (-) strand; PAM type: NRG; PAM sequence: TGG
catgtgtcagagaggctgcc

SEQ ID NO: 21072 - DNA, 20 bp, Artificial Sequence
  Description of Artificial Sequence: Synthetic oligonucleotide
  Target: SCN10A; (-) strand; PAM type: NRG; PAM sequence: AGG
gctgccctcatgtgtcagag

SEQ ID NO: 21073 - DNA, 20 bp, Artificial Sequence
  Description of Artificial Sequence: Synthetic oligonucleotide
  Target: SCN10A; (-) strand; PAM type: NRG; PAM sequence: GAG
agctgccctcatgtgtcaga

SEQ ID NO: 21074 - DNA, 20 bp, Artificial Sequence
  Description of Artificial Sequence: Synthetic oligonucleotide
  Target: SCN10A; (-) strand; PAM type: NRG; PAM sequence: GAG
gcagctgccctcatgtgtca

SEQ ID NO: 21075 - DNA, 20 bp, Artificial Sequence
  Description of Artificial Sequence: Synthetic oligonucleotide
  Target: SCN10A; (-) strand; PAM type: NRG; PAM sequence: CAG
cagcagctgccctcatgtgt

SEQ ID NO: 21076 - DNA, 20 bp, Artificial Sequence
  Description of Artificial Sequence: Synthetic oligonucleotide
  Target: SCN10A; (-) strand; PAM type: NRG; PAM sequence: CAG
ccagaattagactacagcag

SEQ ID NO: 21077 - DNA, 20 bp, Artificial Sequence
  Description of Artificial Sequence: Synthetic oligonucleotide
  Target: SCN10A; (-) strand; PAM type: NRG; PAM sequence: CAG
ggaccagaattagactacag

SEQ ID NO: 21078 - DNA, 20 bp, Artificial Sequence
  Description of Artificial Sequence: Synthetic oligonucleotide
  Target: SCN10A; (-) strand; PAM type: NRG; PAM sequence: CAG
aaaggaccagaattagacta

SEQ ID NO: 21079 - DNA, 20 bp, Artificial Sequence
  Description of Artificial Sequence: Synthetic oligonucleotide
  Target: SCN10A; (-) strand; PAM type: NRG; PAM sequence: TAG
atgaaggaaaggaccagaat

SEQ ID NO: 21080 - DNA, 20 bp, Artificial Sequence
  Description of Artificial Sequence: Synthetic oligonucleotide
  Target: SCN10A; (-) strand; PAM type: NRG; PAM sequence: CAG
gaagggatgaaggaaaggac

SEQ ID NO: 21081 - DNA, 20 bp, Artificial Sequence
  Description of Artificial Sequence: Synthetic oligonucleotide
  Target: SCN10A; (-) strand; PAM type: NRG; PAM sequence: AGG
aggctgaagggatgaaggaa

SEQ ID NO: 21082 - DNA, 20 bp, Artificial Sequence
  Description of Artificial Sequence: Synthetic oligonucleotide
  Target: SCN10A; (-) strand; PAM type: NRG; PAM sequence: AAG
taggctgaagggatgaagga

SEQ ID NO: 21083 - DNA, 20 bp, Artificial Sequence
  Description of Artificial Sequence: Synthetic oligonucleotide
  Target: SCN10A; (-) strand; PAM type: NRG; PAM sequence: AGG
tgcctaggctgaagggatga

SEQ ID NO: 21084 - DNA, 20 bp, Artificial Sequence
  Description of Artificial Sequence: Synthetic oligonucleotide
  Target: SCN10A; (-) strand; PAM type: NRG; PAM sequence: AAG
atgcctaggctgaagggatg

SEQ ID NO: 21085 - DNA, 20 bp, Artificial Sequence
  Description of Artificial Sequence: Synthetic oligonucleotide
  Target: SCN10A; (-) strand; PAM type: NRG; PAM sequence: GGG
tgttacatgcctaggctgaa

SEQ ID NO: 21086 - DNA, 20 bp, Artificial Sequence
  Description of Artificial Sequence: Synthetic oligonucleotide
  Target: SCN10A; (-) strand; PAM type: NRG; PAM sequence: AGG
ctgttacatgcctaggctga

SEQ ID NO: 21087 - DNA, 20 bp, Artificial Sequence
  Description of Artificial Sequence: Synthetic oligonucleotide
  Target: SCN10A; (-) strand; PAM type: NRG; PAM sequence: AAG
gctgttacatgcctaggctg

SEQ ID NO: 21088 - DNA, 20 bp, Artificial Sequence
  Description of Artificial Sequence: Synthetic oligonucleotide
  Target: SCN10A; (-) strand; PAM type: NRG; PAM sequence: AGG
ggggaagctgttacatgcct

SEQ ID NO: 21089 - DNA, 20 bp, Artificial Sequence
  Description of Artificial Sequence: Synthetic oligonucleotide
  Target: SCN10A; (-) strand; PAM type: NRG; PAM sequence: TAG
gggggaagctgttacatgcc

SEQ ID NO: 21090 - DNA, 20 bp, Artificial Sequence
  Description of Artificial Sequence: Synthetic oligonucleotide
  Target: SCN10A; (-) strand; PAM type: NRG; PAM sequence: AAG
tagaaactagtaacaggggg

SEQ ID NO: 21091 - DNA, 20 bp, Artificial Sequence
  Description of Artificial Sequence: Synthetic oligonucleotide
  Target: SCN10A; (-) strand; PAM type: NRG; PAM sequence: GGG
acctagaaactagtaacagg

SEQ ID NO: 21092 - DNA, 20 bp, Artificial Sequence
  Description of Artificial Sequence: Synthetic oligonucleotide
  Target: SCN10A; (-) strand; PAM type: NRG; PAM sequence: GGG
cacctagaaactagtaacag

SEQ ID NO: 21093 - DNA, 20 bp, Artificial Sequence
  Description of Artificial Sequence: Synthetic oligonucleotide
  Target: SCN10A; (-) strand; PAM type: NRG; PAM sequence: GGG
gcacctagaaactagtaaca

SEQ ID NO: 21094 - DNA, 20 bp, Artificial Sequence
  Description of Artificial Sequence: Synthetic oligonucleotide
  Target: SCN10A; (-) strand; PAM type: NRG; PAM sequence: AGG
ggcacctagaaactagtaac

SEQ ID NO: 21095 - DNA, 20 bp, Artificial Sequence
  Description of Artificial Sequence: Synthetic oligonucleotide
  Target: SCN10A; (-) strand; PAM type: NRG; PAM sequence: CAG
aggcacctagaaactagtaa

SEQ ID NO: 21096 - DNA, 20 bp, Artificial Sequence
  Description of Artificial Sequence: Synthetic oligonucleotide
  Target: SCN10A; (-) strand; PAM type: NRG; PAM sequence: TAG
acagtgaggcacctagaaac

SEQ ID NO: 21097 - DNA, 20 bp, Artificial Sequence
  Description of Artificial Sequence: Synthetic oligonucleotide
  Target: SCN10A; (-) strand; PAM type: NRG; PAM sequence: TAG
ataagggacagtgaggcacc

SEQ ID NO: 21098 - DNA, 20 bp, Artificial Sequence
  Description of Artificial Sequence: Synthetic oligonucleotide
  Target: SCN10A; (-) strand; PAM type: NRG; PAM sequence: AGG
ggaatgaataagggacagtg

SEQ ID NO: 21099 - DNA, 20 bp, Artificial Sequence
  Description of Artificial Sequence: Synthetic oligonucleotide
  Target: SCN10A; (-) strand; PAM type: NRG; PAM sequence: GAG
gggaatgaataagggacagt

SEQ ID NO: 21100 - DNA, 20 bp, Artificial Sequence
  Description of Artificial Sequence: Synthetic oligonucleotide
  Target: SCN10A; (-) strand; PAM type: NRG; PAM sequence: CAG
cttagggaatgaataaggga

SEQ ID NO: 21101 - DNA, 20 bp, Artificial Sequence
  Description of Artificial Sequence: Synthetic oligonucleotide
  Target: SCN10A; (-) strand; PAM type: NRG; PAM sequence: GGG
tgggcttagggaatgaataa

SEQ ID NO: 21102 - DNA, 20 bp, Artificial Sequence
  Description of Artificial Sequence: Synthetic oligonucleotide
  Target: SCN10A; (-) strand; PAM type: NRG; PAM sequence: AGG
ctgggcttagggaatgaata

SEQ ID NO: 21103 - DNA, 20 bp, Artificial Sequence
  Description of Artificial Sequence: Synthetic oligonucleotide
  Target: SCN10A; (-) strand; PAM type: NRG; PAM sequence: AAG
gctgggcttagggaatgaat

SEQ ID NO: 21104 - DNA, 20 bp, Artificial Sequence
  Description of Artificial Sequence: Synthetic oligonucleotide
  Target: SCN10A; (-) strand; PAM type: NRG; PAM sequence: GGG
agaggtgtgggctgggctta

SEQ ID NO: 21105 - DNA, 20 bp, Artificial Sequence
  Description of Artificial Sequence: Synthetic oligonucleotide
  Target: SCN10A; (-) strand; PAM type: NRG; PAM sequence: AGG
cagaggtgtgggctgggctt

SEQ ID NO: 21106 - DNA, 20 bp, Artificial Sequence
  Description of Artificial Sequence: Synthetic oligonucleotide
  Target: SCN10A; (-) strand; PAM type: NRG; PAM sequence: TAG
acagaggtgtgggctgggct

SEQ ID NO: 21107 - DNA, 20 bp, Artificial Sequence
  Description of Artificial Sequence: Synthetic oligonucleotide
  Target: SCN10A; (-) strand; PAM type: NRG; PAM sequence: GGG
tatttacagaggtgtgggct

SEQ ID NO: 21108 - DNA, 20 bp, Artificial Sequence
  Description of Artificial Sequence: Synthetic oligonucleotide
  Target: SCN10A; (-) strand; PAM type: NRG; PAM sequence: TGG
gtatttacagaggtgtgggc

SEQ ID NO: 21109 - DNA, 20 bp, Artificial Sequence
  Description of Artificial Sequence: Synthetic oligonucleotide
  Target: SCN10A; (-) strand; PAM type: NRG; PAM sequence: GGG
taaagtatttacagaggtgt

SEQ ID NO: 21110 - DNA, 20 bp, Artificial Sequence
  Description of Artificial Sequence: Synthetic oligonucleotide
  Target: SCN10A; (-) strand; PAM type: NRG; PAM sequence: TGG
gtaaagtatttacagaggtg

SEQ ID NO: 21111 - DNA, 20 bp, Artificial Sequence
  Description of Artificial Sequence: Synthetic oligonucleotide
  Target: SCN10A; (-) strand; PAM type: NRG; PAM sequence: AGG
gtttagtaaagtatttacag

SEQ ID NO: 21112 - DNA, 20 bp, Artificial Sequence
  Description of Artificial Sequence: Synthetic oligonucleotide
  Target: SCN10A; (-) strand; PAM type: NRG; PAM sequence: GAG
agtttagtaaagtatttaca

SEQ ID NO: 21113 - DNA, 20 bp, Artificial Sequence
  Description of Artificial Sequence: Synthetic oligonucleotide
  Target: SCN10A; (-) strand; PAM type: NRG; PAM sequence: CAG
agagtttagtaaagtattta

SEQ ID NO: 21114 - DNA, 20 bp, Artificial Sequence
  Description of Artificial Sequence: Synthetic oligonucleotide
  Target: SCN10A; (-) strand; PAM type: NRG; PAM sequence: AAG
ctaatagagagagtttagta

SEQ ID NO: 21115 - DNA, 20 bp, Artificial Sequence
  Description of Artificial Sequence: Synthetic oligonucleotide
  Target: SCN10A; (-) strand; PAM type: NRG; PAM sequence: TAG
atgggctaatagagagagtt

SEQ ID NO: 21116 - DNA, 20 bp, Artificial Sequence
  Description of Artificial Sequence: Synthetic oligonucleotide
  Target: SCN10A; (-) strand; PAM type: NRG; PAM sequence: GAG
ctccgatgggctaatagaga

SEQ ID NO: 21117 - DNA, 20 bp, Artificial Sequence
  Description of Artificial Sequence: Synthetic oligonucleotide
  Target: SCN10A; (-) strand; PAM type: NRG; PAM sequence: GAG
cactccgatgggctaataga

SEQ ID NO: 21118 - DNA, 20 bp, Artificial Sequence
  Description of Artificial Sequence: Synthetic oligonucleotide
  Target: SCN10A; (-) strand; PAM type: NRG; PAM sequence: GAG
accactccgatgggctaata

SEQ ID NO: 21119 - DNA, 20 bp, Artificial Sequence
  Description of Artificial Sequence: Synthetic oligonucleotide
  Target: SCN10A; (-) strand; PAM type: NRG; PAM sequence: TAG
ggaccactccgatgggctaa

SEQ ID NO: 21120 - DNA, 20 bp, Artificial Sequence
  Description of Artificial Sequence: Synthetic oligonucleotide
  Target: SCN10A; (-) strand; PAM type: NRG; PAM sequence: GGG
aacagatggaccactccgat

SEQ ID NO: 21121 - DNA, 20 bp, Artificial Sequence
  Description of Artificial Sequence: Synthetic oligonucleotide
  Target: SCN10A; (-) strand; PAM type: NRG; PAM sequence: TGG
aaacagatggaccactccga

SEQ ID NO: 21122 - DNA, 20 bp, Artificial Sequence
  Description of Artificial Sequence: Synthetic oligonucleotide
  Target: SCN10A; (-) strand; PAM type: NRG; PAM sequence: TGG
gggtcccagcaagaaacaga

SEQ ID NO: 21123 - DNA, 20 bp, Artificial Sequence
  Description of Artificial Sequence: Synthetic oligonucleotide
  Target: SCN10A; (-) strand; PAM type: NRG; PAM sequence: CAG
ttcagggtcccagcaagaaa

SEQ ID NO: 21124 - DNA, 20 bp, Artificial Sequence
  Description of Artificial Sequence: Synthetic oligonucleotide
  Target: SCN10A; (-) strand; PAM type: NRG; PAM sequence: AAG
atgtgattcagggtcccagc

SEQ ID NO: 21125 - DNA, 20 bp, Artificial Sequence
  Description of Artificial Sequence: Synthetic oligonucleotide
  Target: SCN10A; (-) strand; PAM type: NRG; PAM sequence: CAG
tgtcatgtgattcagggtcc

SEQ ID NO: 21126 - DNA, 20 bp, Artificial Sequence
  Description of Artificial Sequence: Synthetic oligonucleotide
  Target: SCN10A; (-) strand; PAM type: NRG; PAM sequence: GGG
actcaatgtcatgtgattca

SEQ ID NO: 21127 - DNA, 20 bp, Artificial Sequence
  Description of Artificial Sequence: Synthetic oligonucleotide
  Target: SCN10A; (-) strand; PAM type: NRG; PAM sequence: AGG
gactcaatgtcatgtgattc

SEQ ID NO: 21128 - DNA, 20 bp, Artificial Sequence
  Description of Artificial Sequence: Synthetic oligonucleotide
  Target: SCN10A; (-) strand; PAM type: NRG; PAM sequence: CAG
tgactcaatgtcatgtgatt

SEQ ID NO: 21129 - DNA, 20 bp, Artificial Sequence
  Description of Artificial Sequence: Synthetic oligonucleotide
  Target: SCN10A; (-) strand; PAM type: NRG; PAM sequence: CAG
gtcttagagttgccttagct

SEQ ID NO: 21130 - DNA, 20 bp, Artificial Sequence
  Description of Artificial Sequence: Synthetic oligonucleotide
  Target: SCN10A; (-) strand; PAM type: NRG; PAM sequence: TAG
gataagtcttagagttgcct

SEQ ID NO: 21131 - DNA, 20 bp, Artificial Sequence
  Description of Artificial Sequence: Synthetic oligonucleotide
  Target: SCN10A; (-) strand; PAM type: NRG; PAM sequence: GAG
actgatacagataagtctta

SEQ ID NO: 21132 - DNA, 20 bp, Artificial Sequence
  Description of Artificial Sequence: Synthetic oligonucleotide
  Target: SCN10A; (-) strand; PAM type: NRG; PAM sequence: TAG
ccactgatacagataagtct

SEQ ID NO: 21133 - DNA, 20 bp, Artificial Sequence
  Description of Artificial Sequence: Synthetic oligonucleotide
  Target: SCN10A; (-) strand; PAM type: NRG; PAM sequence: AAG
atggttccactgatacagat

SEQ ID NO: 21134 - DNA, 20 bp, Artificial Sequence
  Description of Artificial Sequence: Synthetic oligonucleotide
  Target: SCN10A; (-) strand; PAM type: NRG; PAM sequence: CAG
aataaatggttccactgata

SEQ ID NO: 21135 - DNA, 20 bp, Artificial Sequence
  Description of Artificial Sequence: Synthetic oligonucleotide
  Target: SCN10A; (-) strand; PAM type: NRG; PAM sequence: TGG
attgtaaagagaccaataaa

SEQ ID NO: 21136 - DNA, 20 bp, Artificial Sequence
  Description of Artificial Sequence: Synthetic oligonucleotide
  Target: SCN10A; (-) strand; PAM type: NRG; PAM sequence: GAG
attgcagacagaattgtaaa

SEQ ID NO: 21137 - DNA, 20 bp, Artificial Sequence
  Description of Artificial Sequence: Synthetic oligonucleotide
  Target: SCN10A; (-) strand; PAM type: NRG; PAM sequence: AAG
caattgcagacagaattgta

SEQ ID NO: 21138 - DNA, 20 bp, Artificial Sequence
  Description of Artificial Sequence: Synthetic oligonucleotide
  Target: SCN10A; (-) strand; PAM type: NRG; PAM sequence: CAG
ggatacagcgcaattgcaga

SEQ ID NO: 21139 - DNA, 20 bp, Artificial Sequence
  Description of Artificial Sequence: Synthetic oligonucleotide
  Target: SCN10A; (-) strand; PAM type: NRG; PAM sequence: CAG
ccagggatacagcgcaattg

SEQ ID NO: 21140 - DNA, 20 bp, Artificial Sequence
  Description of Artificial Sequence: Synthetic oligonucleotide
  Target: SCN10A; (-) strand; PAM type: NRG; PAM sequence: CAG
tctctggctagccagggata

SEQ ID NO: 21141 - DNA, 20 bp, Artificial Sequence
  Description of Artificial Sequence: Synthetic oligonucleotide
  Target: SCN10A; (-) strand; PAM type: NRG; PAM sequence: GGG
ttgccctctctggctagcca

SEQ ID NO: 21142 - DNA, 20 bp, Artificial Sequence
  Description of Artificial Sequence: Synthetic oligonucleotide
  Target: SCN10A; (-) strand; PAM type: NRG; PAM sequence: AGG
tttgccctctctggctagcc

SEQ ID NO: 21143 - DNA, 20 bp, Artificial Sequence
  Description of Artificial Sequence: Synthetic oligonucleotide
  Target: SCN10A; (-) strand; PAM type: NRG; PAM sequence: CAG
atttgccctctctggctagc

SEQ ID NO: 21144 - DNA, 20 bp, Artificial Sequence
  Description of Artificial Sequence: Synthetic oligonucleotide
  Target: SCN10A; (-) strand; PAM type: NRG; PAM sequence: TAG
tttcatttgccctctctggc

SEQ ID NO: 21145 - DNA, 20 bp, Artificial Sequence
  Description of Artificial Sequence: Synthetic oligonucleotide
  Target: SCN10A; (-) strand; PAM type: NRG; PAM sequence: TGG
tgtttttcatttgccctctc

SEQ ID NO: 21146 - DNA, 20 bp, Artificial Sequence
  Description of Artificial Sequence: Synthetic oligonucleotide
  Target: SCN10A; (-) strand; PAM type: NRG; PAM sequence: TAG
agtttcagcaatgatgtttc

SEQ ID NO: 21147 - DNA, 20 bp, Artificial Sequence
  Description of Artificial Sequence: Synthetic oligonucleotide
  Target: SCN10A; (-) strand; PAM type: NRG; PAM sequence: CAG
tgagctctcccctccagttt

SEQ ID NO: 21148 - DNA, 20 bp, Artificial Sequence
  Description of Artificial Sequence: Synthetic oligonucleotide
  Target: SCN10A; (-) strand; PAM type: NRG; PAM sequence: CAG
ttaatgtgagctctcccctc

SEQ ID NO: 21149 - DNA, 20 bp, Artificial Sequence
  Description of Artificial Sequence: Synthetic oligonucleotide
  Target: SCN10A; (-) strand; PAM type: NRG; PAM sequence: GAG
tgggagctgtgagttaatgt

SEQ ID NO: 21150 - DNA, 20 bp, Artificial Sequence
  Description of Artificial Sequence: Synthetic oligonucleotide
  Target: SCN10A; (-) strand; PAM type: NRG; PAM sequence: GAG
ctcattggattgggagctgt

SEQ ID NO: 21151 - DNA, 20 bp, Artificial Sequence
  Description of Artificial Sequence: Synthetic oligonucleotide
  Target: SCN10A; (-) strand; PAM type: NRG; PAM sequence: GAG
gggattcctcattggattgg

SEQ ID NO: 21152 - DNA, 20 bp, Artificial Sequence
  Description of Artificial Sequence: Synthetic oligonucleotide
  Target: SCN10A; (-) strand; PAM type: NRG; PAM sequence: GGG
cagggattcctcattggatt

SEQ ID NO: 21153 - DNA, 20 bp, Artificial Sequence
  Description of Artificial Sequence: Synthetic oligonucleotide
  Target: SCN10A; (-) strand; PAM type: NRG; PAM sequence: TGG
tcagggattcctcattggat

SEQ ID NO: 21154 - DNA, 20 bp, Artificial Sequence
  Description of Artificial Sequence: Synthetic oligonucleotide
  Target: SCN10A; (-) strand; PAM type: NRG; PAM sequence: TGG
gcaagtcagggattcctcat

SEQ ID NO: 21155 - DNA, 20 bp, Artificial Sequence
  Description of Artificial Sequence: Synthetic oligonucleotide
  Target: SCN10A; (-) strand; PAM type: NRG; PAM sequence: GGG
cagagtgtaatggcaagtca

SEQ ID NO: 21156 - DNA, 20 bp, Artificial Sequence
  Description of Artificial Sequence: Synthetic oligonucleotide
  Target: SCN10A; (-) strand; PAM type: NRG; PAM sequence: AGG
gcagagtgtaatggcaagtc

SEQ ID NO: 21157 - DNA, 20 bp, Artificial Sequence
  Description of Artificial Sequence: Synthetic oligonucleotide
  Target: SCN10A; (-) strand; PAM type: NRG; PAM sequence: CAG
cgcagagtgtaatggcaagt

SEQ ID NO: 21158 - DNA, 20 bp, Artificial Sequence
  Description of Artificial Sequence: Synthetic oligonucleotide
  Target: SCN10A; (-) strand; PAM type: NRG; PAM sequence: AAG
taatcgcagagtgtaatggc

SEQ ID NO: 21159 - DNA, 20 bp, Artificial Sequence
  Description of Artificial Sequence: Synthetic oligonucleotide
  Target: SCN10A; (-) strand; PAM type: NRG; PAM sequence: TGG
agaataatcgcagagtgtaa

SEQ ID NO: 21160 - DNA, 20 bp, Artificial Sequence
  Description of Artificial Sequence: Synthetic oligonucleotide
  Target: SCN10A; (-) strand; PAM type: NRG; PAM sequence: GAG
tctttaatagaataatcgca

SEQ ID NO: 21161 - DNA, 20 bp, Artificial Sequence
  Description of Artificial Sequence: Synthetic oligonucleotide
  Target: SCN10A; (-) strand; PAM type: NRG; PAM sequence: CAG
actctttaatagaataatcg

SEQ ID NO: 21162 - DNA, 20 bp, Artificial Sequence
  Description of Artificial Sequence: Synthetic oligonucleotide
  Target: SCN10A; (-) strand; PAM type: NRG; PAM sequence: TAG
aactggccagcactctttaa

SEQ ID NO: 21163 - DNA, 20 bp, Artificial Sequence
  Description of Artificial Sequence: Synthetic oligonucleotide
  Target: SCN10A; (-) strand; PAM type: NRG; PAM sequence: CAG
ggcaacagtgactaactggc

SEQ ID NO: 21164 - DNA, 20 bp, Artificial Sequence
  Description of Artificial Sequence: Synthetic oligonucleotide
  Target: SCN10A; (-) strand; PAM type: NRG; PAM sequence: TGG
attaggcaacagtgactaac

SEQ ID NO: 21165 - DNA, 20 bp, Artificial Sequence
  Description of Artificial Sequence: Synthetic oligonucleotide
  Target: SCN10A; (-) strand; PAM type: NRG; PAM sequence: CAG
aaaatgagcaaattaggcaa

SEQ ID NO: 21166 - DNA, 20 bp, Artificial Sequence
  Description of Artificial Sequence: Synthetic oligonucleotide
  Target: SCN10A; (-) strand; PAM type: NRG; PAM sequence: AGG
tttgccaaaatgagcaaatt

SEQ ID NO: 21167 - DNA, 20 bp, Artificial Sequence
  Description of Artificial Sequence: Synthetic oligonucleotide
  Target: SCN10A; (-) strand; PAM type: NRG; PAM sequence: TAG
atttgccaaaatgagcaaat

SEQ ID NO: 21168 - DNA, 20 bp, Artificial Sequence
  Description of Artificial Sequence: Synthetic oligonucleotide
  Target: SCN10A; (-) strand; PAM type: NRG; PAM sequence: GAG
aagaaataatttgccaaaat

SEQ ID NO: 21169 - DNA, 20 bp, Artificial Sequence
  Description of Artificial Sequence: Synthetic oligonucleotide
  Target: SCN10A; (-) strand; PAM type: NRG; PAM sequence: AAG
attccttgctttactcacag

SEQ ID NO: 21170 - DNA, 20 bp, Artificial Sequence
  Description of Artificial Sequence: Synthetic oligonucleotide
  Target: SCN10A; (-) strand; PAM type: NRG; PAM sequence: CAG
agtattccttgctttactca

SEQ ID NO: 21171 - DNA, 20 bp, Artificial Sequence
  Description of Artificial Sequence: Synthetic oligonucleotide
  Target: SCN10A; (-) strand; PAM type: NRG; PAM sequence: CAG
gacagatctgaatagaagca

SEQ ID NO: 21172 - DNA, 20 bp, Artificial Sequence
  Description of Artificial Sequence: Synthetic oligonucleotide
  Target: SCN10A; (-) strand; PAM type: NRG; PAM sequence: AAG
cttaggacagatctgaatag

SEQ ID NO: 21173 - DNA, 20 bp, Artificial Sequence
  Description of Artificial Sequence: Synthetic oligonucleotide
  Target: SCN10A; (-) strand; PAM type: NRG; PAM sequence: TAG
tttcttaggacagatctgaa

SEQ ID NO: 21174 - DNA, 20 bp, Artificial Sequence
  Description of Artificial Sequence: Synthetic oligonucleotide
  Target: SCN10A; (-) strand; PAM type: NRG; PAM sequence: CAG
attcaggaagtttcttagga

SEQ ID NO: 21175 - DNA, 20 bp, Artificial Sequence
  Description of Artificial Sequence: Synthetic oligonucleotide
  Target: SCN10A; (-) strand; PAM type: NRG; PAM sequence: AGG
agaaattcaggaagtttctt

SEQ ID NO: 21176 - DNA, 20 bp, Artificial Sequence
  Description of Artificial Sequence: Synthetic oligonucleotide
  Target: SCN10A; (-) strand; PAM type: NRG; PAM sequence: TAG
gagaaattcaggaagtttct

SEQ ID NO: 21177 - DNA, 20 bp, Artificial Sequence
  Description of Artificial Sequence: Synthetic oligonucleotide
  Target: SCN10A; (-) strand; PAM type: NRG; PAM sequence: AAG
ggcacccagagaaattcagg

SEQ ID NO: 21178 - DNA, 20 bp, Artificial Sequence
  Description of Artificial Sequence: Synthetic oligonucleotide
  Target: SCN10A; (-) strand; PAM type: NRG; PAM sequence: AGG
aatggcacccagagaaattc

SEQ ID NO: 21179 - DNA, 20 bp, Artificial Sequence
  Description of Artificial Sequence: Synthetic oligonucleotide
  Target: SCN10A; (-) strand; PAM type: NRG; PAM sequence: CAG
aaatggcacccagagaaatt

SEQ ID NO: 21180 - DNA, 20 bp, Artificial Sequence
  Description of Artificial Sequence: Synthetic oligonucleotide
  Target: SCN10A; (-) strand; PAM type: NRG; PAM sequence: GAG
ggctgggcaaatggcaccca

SEQ ID NO: 21181 - DNA, 20 bp, Artificial Sequence
  Description of Artificial Sequence: Synthetic oligonucleotide
  Target: SCN10A; (-) strand; PAM type: NRG; PAM sequence: CAG
taggctgggcaaatggcacc

SEQ ID NO: 21182 - DNA, 20 bp, Artificial Sequence
  Description of Artificial Sequence: Synthetic oligonucleotide
  Target: SCN10A; (-) strand; PAM type: NRG; PAM sequence: TGG
actcttctaggctgggcaaa

SEQ ID NO: 21183 - DNA, 20 bp, Artificial Sequence
  Description of Artificial Sequence: Synthetic oligonucleotide
  Target: SCN10A; (-) strand; PAM type: NRG; PAM sequence: GGG
tatgcaaactcttctaggct

SEQ ID NO: 21184 - DNA, 20 bp, Artificial Sequence
  Description of Artificial Sequence: Synthetic oligonucleotide
  Target: SCN10A; (-) strand; PAM type: NRG; PAM sequence: TGG
ctatgcaaactcttctaggc

SEQ ID NO: 21185 - DNA, 20 bp, Artificial Sequence
  Description of Artificial Sequence: Synthetic oligonucleotide
  Target: SCN10A; (-) strand; PAM type: NRG; PAM sequence: AGG
ggctctatgcaaactcttct

SEQ ID NO: 21186 - DNA, 20 bp, Artificial Sequence
  Description of Artificial Sequence: Synthetic oligonucleotide
  Target: SCN10A; (-) strand; PAM type: NRG; PAM sequence: TAG
tggctctatgcaaactcttc

SEQ ID NO: 21187 - DNA, 20 bp, Artificial Sequence
  Description of Artificial Sequence: Synthetic oligonucleotide
  Target: SCN10A; (-) strand; PAM type: NRG; PAM sequence: TGG
gacccttctcttcctgctta

SEQ ID NO: 21188 - DNA, 20 bp, Artificial Sequence
  Description of Artificial Sequence: Synthetic oligonucleotide
  Target: SCN10A; (-) strand; PAM type: NRG; PAM sequence: AGG
acaggtatgagaaaaactga

SEQ ID NO: 21189 - DNA, 20 bp, Artificial Sequence
  Description of Artificial Sequence: Synthetic oligonucleotide
  Target: SCN10A; (-) strand; PAM type: NRG; PAM sequence: AAG
gacaggtatgagaaaaactg

SEQ ID NO: 21190 - DNA, 20 bp, Artificial Sequence
  Description of Artificial Sequence: Synthetic oligonucleotide
  Target: SCN10A; (-) strand; PAM type: NRG; PAM sequence: GAG
ctttcttgttggacaggtat

SEQ ID NO: 21191 - DNA, 20 bp, Artificial Sequence
  Description of Artificial Sequence: Synthetic oligonucleotide
  Target: SCN10A; (-) strand; PAM type: NRG; PAM sequence: AGG
ggcctgctttcttgttggac

SEQ ID NO: 21192 - DNA, 20 bp, Artificial Sequence
  Description of Artificial Sequence: Synthetic oligonucleotide
  Target: SCN10A; (-) strand; PAM type: NRG; PAM sequence: CAG
aggcctgctttcttgttgga

SEQ ID NO: 21193 - DNA, 20 bp, Artificial Sequence
  Description of Artificial Sequence: Synthetic oligonucleotide
  Target: SCN10A; (-) strand; PAM type: NRG; PAM sequence: TGG
tgataggcctgctttcttgt

SEQ ID NO: 21194 - DNA, 20 bp, Artificial Sequence
  Description of Artificial Sequence: Synthetic oligonucleotide
  Target: SCN10A; (-) strand; PAM type: NRG; PAM sequence: AGG
aacatcactgcctcagtgat

SEQ ID NO: 21195 - DNA, 20 bp, Artificial Sequence
  Description of Artificial Sequence: Synthetic oligonucleotide
  Target: SCN10A; (-) strand; PAM type: NRG; PAM sequence: TAG
caacatcactgcctcagtga

SEQ ID NO: 21196 - DNA, 20 bp, Artificial Sequence
  Description of Artificial Sequence: Synthetic oligonucleotide
  Target: SCN10A; (-) strand; PAM type: NRG; PAM sequence: CAG
cccactcaacatcactgcct

SEQ ID NO: 21197 - DNA, 20 bp, Artificial Sequence
  Description of Artificial Sequence: Synthetic oligonucleotide
  Target: SCN10A; (-) strand; PAM type: NRG; PAM sequence: CAG
tttgaccccatatttcttat

SEQ ID NO: 21198 - DNA, 20 bp, Artificial Sequence
  Description of Artificial Sequence: Synthetic oligonucleotide
  Target: SCN10A; (-) strand; PAM type: NRG; PAM sequence: TAG
tttcctggtttattctgcag

SEQ ID NO: 21199 - DNA, 20 bp, Artificial Sequence
  Description of Artificial Sequence: Synthetic oligonucleotide
  Target: SCN10A; (-) strand; PAM type: NRG; PAM sequence: CAG
aggtttcctggtttattctg

SEQ ID NO: 21200 - DNA, 20 bp, Artificial Sequence
  Description of Artificial Sequence: Synthetic oligonucleotide
  Target: SCN10A; (-) strand; PAM type: NRG; PAM sequence: TGG
ctgaggtcaaacaggtttcc

SEQ ID NO: 21201 - DNA, 20 bp, Artificial Sequence
  Description of Artificial Sequence: Synthetic oligonucleotide
  Target: SCN10A; (-) strand; PAM type: NRG; PAM sequence: AGG
gagttggcctgaggtcaaac

SEQ ID NO: 21202 - DNA, 20 bp, Artificial Sequence
  Description of Artificial Sequence: Synthetic oligonucleotide
  Target: SCN10A; (-) strand; PAM type: NRG; PAM sequence: CAG
tgagttggcctgaggtcaaa

SEQ ID NO: 21203 - DNA, 20 bp, Artificial Sequence
  Description of Artificial Sequence: Synthetic oligonucleotide
  Target: SCN10A; (-) strand; PAM type: NRG; PAM sequence: AGG
agagagattgagttggcctg

SEQ ID NO: 21204 - DNA, 20 bp, Artificial Sequence
  Description of Artificial Sequence: Synthetic oligonucleotide
  Target: SCN10A; (-) strand; PAM type: NRG; PAM sequence: GAG
gagagagattgagttggcct

SEQ ID NO: 21205 - DNA, 20 bp, Artificial Sequence
  Description of Artificial Sequence: Synthetic oligonucleotide
  Target: SCN10A; (-) strand; PAM type: NRG; PAM sequence: TGG
gagagagagagagattgagt

SEQ ID NO: 21206 - DNA, 20 bp, Artificial Sequence
  Description of Artificial Sequence: Synthetic oligonucleotide
  Target: SCN10A; (-) strand; PAM type: NRG; PAM sequence: GAG
cccagagagagagagagatt

SEQ ID NO: 21207 - DNA, 20 bp, Artificial Sequence
  Description of Artificial Sequence: Synthetic oligonucleotide
  Target: SCN10A; (-) strand; PAM type: NRG; PAM sequence: GAG
atgagacccagagagagaga

SEQ ID NO: 21208 - DNA, 20 bp, Artificial Sequence
  Description of Artificial Sequence: Synthetic oligonucleotide
  Target: SCN10A; (-) strand; PAM type: NRG; PAM sequence: GAG
agatgagacccagagagaga

SEQ ID NO: 21209 - DNA, 20 bp, Artificial Sequence
  Description of Artificial Sequence: Synthetic oligonucleotide
  Target: SCN10A; (-) strand; PAM type: NRG; PAM sequence: GAG
gaagatgagacccagagaga

SEQ ID NO: 21210 - DNA, 20 bp, Artificial Sequence
  Description of Artificial Sequence: Synthetic oligonucleotide
  Target: SCN10A; (-) strand; PAM type: NRG; PAM sequence: GAG
tagaagatgagacccagaga

SEQ ID NO: 21211 - DNA, 20 bp, Artificial Sequence
  Description of Artificial Sequence: Synthetic oligonucleotide
  Target: SCN10A; (-) strand; PAM type: NRG; PAM sequence: GAG
catagaagatgagacccaga

SEQ ID NO: 21212 - DNA, 20 bp, Artificial Sequence
  Description of Artificial Sequence: Synthetic oligonucleotide
  Target: SCN10A; (-) strand; PAM type: NRG; PAM sequence: GAG
gacatagaagatgagaccca

SEQ ID NO: 21213 - DNA, 20 bp, Artificial Sequence
  Description of Artificial Sequence: Synthetic oligonucleotide
  Target: SCN10A; (-) strand; PAM type: NRG; PAM sequence: CAG
cagacatagaagatgagacc

SEQ ID NO: 21214 - DNA, 20 bp, Artificial Sequence
  Description of Artificial Sequence: Synthetic oligonucleotide
  Target: SCN10A; (-) strand; PAM type: NRG; PAM sequence: GAG
tttttacagacatagaagat

SEQ ID NO: 21215 - DNA, 20 bp, Artificial Sequence
  Description of Artificial Sequence: Synthetic oligonucleotide
  Target: SCN10A; (-) strand; PAM type: NRG; PAM sequence: AAG
ctccttttttacagacatag

SEQ ID NO: 21216 - DNA, 20 bp, Artificial Sequence
  Description of Artificial Sequence: Synthetic oligonucleotide
  Target: SCN10A; (-) strand; PAM type: NRG; PAM sequence: TAG
ctactccttttttacagaca

SEQ ID NO: 21217 - DNA, 20 bp, Artificial Sequence
  Description of Artificial Sequence: Synthetic oligonucleotide
  Target: SCN10A; (-) strand; PAM type: NRG; PAM sequence: CAG
cccattctactcctttttta

SEQ ID NO: 21218 - DNA, 20 bp, Artificial Sequence
  Description of Artificial Sequence: Synthetic oligonucleotide
  Target: SCN10A; (-) strand; PAM type: NRG; PAM sequence: TAG
tcaccaatggaagggatctt

SEQ ID NO: 21219 - DNA, 20 bp, Artificial Sequence
  Description of Artificial Sequence: Synthetic oligonucleotide
  Target: SCN10A; (-) strand; PAM type: NRG; PAM sequence: GGG
cctgagtatcaccaatggaa

SEQ ID NO: 21220 - DNA, 20 bp, Artificial Sequence
  Description of Artificial Sequence: Synthetic oligonucleotide
  Target: SCN10A; (-) strand; PAM type: NRG; PAM sequence: AGG
gcctgagtatcaccaatgga

SEQ ID NO: 21221 - DNA, 20 bp, Artificial Sequence
  Description of Artificial Sequence: Synthetic oligonucleotide
  Target: SCN10A; (-) strand; PAM type: NRG; PAM sequence: AAG
agcctgagtatcaccaatgg

SEQ ID NO: 21222 - DNA, 20 bp, Artificial Sequence
  Description of Artificial Sequence: Synthetic oligonucleotide
  Target: SCN10A; (-) strand; PAM type: NRG; PAM sequence: TGG
agaagcctgagtatcaccaa

SEQ ID NO: 21223 - DNA, 20 bp, Artificial Sequence
  Description of Artificial Sequence: Synthetic oligonucleotide
  Target: SCN10A; (-) strand; PAM type: NRG; PAM sequence: GAG
agccttgagccaagaagcct

SEQ ID NO: 21224 - DNA, 20 bp, Artificial Sequence
  Description of Artificial Sequence: Synthetic oligonucleotide
  Target: SCN10A; (-) strand; PAM type: NRG; PAM sequence: AAG
cctagaagccttgagccaag

SEQ ID NO: 21225 - DNA, 20 bp, Artificial Sequence
  Description of Artificial Sequence: Synthetic oligonucleotide
  Target: SCN10A; (-) strand; PAM type: NRG; PAM sequence: AAG
ccacctagaagccttgagcc

SEQ ID NO: 21226 - DNA, 20 bp, Artificial Sequence
  Description of Artificial Sequence: Synthetic oligonucleotide
  Target: SCN10A; (-) strand; PAM type: NRG; PAM sequence: GAG
gtcttccacctagaagcctt

SEQ ID NO: 21227 - DNA, 20 bp, Artificial Sequence
  Description of Artificial Sequence: Synthetic oligonucleotide
  Target: SCN10A; (-) strand; PAM type: NRG; PAM sequence: AAG
tcaggctgtcttccacctag

SEQ ID NO: 21228 - DNA, 20 bp, Artificial Sequence
  Description of Artificial Sequence: Synthetic oligonucleotide
  Target: SCN10A; (-) strand; PAM type: NRG; PAM sequence: TAG
ccctcaggctgtcttccacc

SEQ ID NO: 21229 - DNA, 20 bp, Artificial Sequence
  Description of Artificial Sequence: Synthetic oligonucleotide
  Target: SCN10A; (-) strand; PAM type: NRG; PAM sequence: AGG
tgaatgcttcagactccctc

SEQ ID NO: 21230 - DNA, 20 bp, Artificial Sequence
  Description of Artificial Sequence: Synthetic oligonucleotide
  Target: SCN10A; (-) strand; PAM type: NRG; PAM sequence: CAG
gtgaatgcttcagactccct

SEQ ID NO: 21231 - DNA, 20 bp, Artificial Sequence
  Description of Artificial Sequence: Synthetic oligonucleotide
  Target: SCN10A; (-) strand; PAM type: NRG; PAM sequence: CAG
cggtgagtttgtgaatgctt

SEQ ID NO: 21232 - DNA, 20 bp, Artificial Sequence
  Description of Artificial Sequence: Synthetic oligonucleotide
  Target: SCN10A; (-) strand; PAM type: NRG; PAM sequence: GAG
ggagctgtcgatgtctcggt

SEQ ID NO: 21233 - DNA, 20 bp, Artificial Sequence
  Description of Artificial Sequence: Synthetic oligonucleotide
  Target: SCN10A; (-) strand; PAM type: NRG; PAM sequence: CGG
ccctggagctgtcgatgtct

SEQ ID NO: 21234 - DNA, 20 bp, Artificial Sequence
  Description of Artificial Sequence: Synthetic oligonucleotide
  Target: SCN10A; (-) strand; PAM type: NRG; PAM sequence: GAG
cactagtgagcttgcccctg

SEQ ID NO: 21235 - DNA, 20 bp, Artificial Sequence
  Description of Artificial Sequence: Synthetic oligonucleotide
  Target: SCN10A; (-) strand; PAM type: NRG; PAM sequence: TGG
cccactagtgagcttgcccc

SEQ ID NO: 21236 - DNA, 20 bp, Artificial Sequence
  Description of Artificial Sequence: Synthetic oligonucleotide
  Target: SCN10A; (-) strand; PAM type: NRG; PAM sequence: GAG
accaaccgccgcccactagt

SEQ ID NO: 21237 - DNA, 20 bp, Artificial Sequence
  Description of Artificial Sequence: Synthetic oligonucleotide
  Target: SCN10A; (-) strand; PAM type: NRG; PAM sequence: TAG
gaacaccaaccgccgcccac

SEQ ID NO: 21238 - DNA, 20 bp, Artificial Sequence
  Description of Artificial Sequence: Synthetic oligonucleotide
  Target: SCN10A; (-) strand; PAM type: NRG; PAM sequence: AAG
ccctgactccaggcatggag

SEQ ID NO: 21239 - DNA, 20 bp, Artificial Sequence
  Description of Artificial Sequence: Synthetic oligonucleotide
  Target: SCN10A; (-) strand; PAM type: NRG; PAM sequence: GAG
caaccctgactccaggcatg

SEQ ID NO: 21240 - DNA, 20 bp, Artificial Sequence
  Description of Artificial Sequence: Synthetic oligonucleotide
  Target: SCN10A; (-) strand; PAM type: NRG; PAM sequence: TGG
agcaaccctgactccaggca

SEQ ID NO: 21241 - DNA, 20 bp, Artificial Sequence
  Description of Artificial Sequence: Synthetic oligonucleotide
  Target: SCN10A; (-) strand; PAM type: NRG; PAM sequence: AGG
aacccagcaaccctgactcc

SEQ ID NO: 21242 - DNA, 20 bp, Artificial Sequence
  Description of Artificial Sequence: Synthetic oligonucleotide
  Target: SCN10A; (-) strand; PAM type: NRG; PAM sequence: CAG
caacccagcaaccctgactc

SEQ ID NO: 21243 - DNA, 20 bp, Artificial Sequence
  Description of Artificial Sequence: Synthetic oligonucleotide
  Target: SCN10A; (-) strand; PAM type: NRG; PAM sequence: CAG
agaagccctcttcctcaacc

SEQ ID NO: 21244 - DNA, 20 bp, Artificial Sequence
  Description of Artificial Sequence: Synthetic oligonucleotide
  Target: SCN10A; (-) strand; PAM type: NRG; PAM sequence: AAG
cagcaaggccccctccctag

SEQ ID NO: 21245 - DNA, 20 bp, Artificial Sequence
  Description of Artificial Sequence: Synthetic oligonucleotide
  Target: SCN10A; (-) strand; PAM type: NRG; PAM sequence: TAG
ggccagcaaggccccctccc

SEQ ID NO: 21246 - DNA, 20 bp, Artificial Sequence
  Description of Artificial Sequence: Synthetic oligonucleotide
  Target: SCN10A; (-) strand; PAM type: NRG; PAM sequence: AGG
ggtgggggtgctggccagca

SEQ ID NO: 21247 - DNA, 20 bp, Artificial Sequence
  Description of Artificial Sequence: Synthetic oligonucleotide
  Target: SCN10A; (-) strand; PAM type: NRG; PAM sequence: AAG
gggtgggggtgctggccagc

SEQ ID NO: 21248 - DNA, 20 bp, Artificial Sequence
  Description of Artificial Sequence: Synthetic oligonucleotide
  Target: SCN10A; (-) strand; PAM type: NRG; PAM sequence: CAG
tgctgggtgggggtgctggc

SEQ ID NO: 21249 - DNA, 20 bp, Artificial Sequence
  Description of Artificial Sequence: Synthetic oligonucleotide
  Target: SCN10A; (-) strand; PAM type: NRG; PAM sequence: TGG
ctgctgctgggtgggggtgc

SEQ ID NO: 21250 - DNA, 20 bp, Artificial Sequence
  Description of Artificial Sequence: Synthetic oligonucleotide
  Target: SCN10A; (-) strand; PAM type: NRG; PAM sequence: GGG
ggctctctgctgctgggtgg

SEQ ID NO: 21251 - DNA, 20 bp, Artificial Sequence
  Description of Artificial Sequence: Synthetic oligonucleotide
  Target: SCN10A; (-) strand; PAM type: NRG; PAM sequence: GGG
gggctctctgctgctgggtg

SEQ ID NO: 21252 - DNA, 20 bp, Artificial Sequence
  Description of Artificial Sequence: Synthetic oligonucleotide
  Target: SCN10A; (-) strand; PAM type: NRG; PAM sequence: GGG
ggggctctctgctgctgggt

SEQ ID NO: 21253 - DNA, 20 bp, Artificial Sequence
  Description of Artificial Sequence: Synthetic oligonucleotide
  Target: SCN10A; (-) strand; PAM type: NRG; PAM sequence: TGG
cggggctctctgctgctggg

SEQ ID NO: 21254 - DNA, 20 bp, Artificial Sequence
  Description of Artificial Sequence: Synthetic oligonucleotide
  Target: SCN10A; (-) strand; PAM type: NRG; PAM sequence: GGG
catcggggctctctgctgct

SEQ ID NO: 21255 - DNA, 20 bp, Artificial Sequence
  Description of Artificial Sequence: Synthetic oligonucleotide
  Target: SCN10A; (-) strand; PAM type: NRG; PAM sequence: TGG
ccatcggggctctctgctgc

SEQ ID NO: 21256 - DNA, 20 bp, Artificial Sequence
  Description of Artificial Sequence: Synthetic oligonucleotide
  Target: SCN10A; (-) strand; PAM type: NRG; PAM sequence: GGG
ggagaccacgaaagccatcg

SEQ ID NO: 21257 - DNA, 20 bp, Artificial Sequence
  Description of Artificial Sequence: Synthetic oligonucleotide
  Target: SCN10A; (-) strand; PAM type: NRG; PAM sequence: GGG
tggagaccacgaaagccatc

SEQ ID NO: 21258 - DNA, 20 bp, Artificial Sequence
  Description of Artificial Sequence: Synthetic oligonucleotide
  Target: SCN10A; (-) strand; PAM type: NRG; PAM sequence: CGG
ctggagaccacgaaagccat

SEQ ID NO: 21259 - DNA, 20 bp, Artificial Sequence
  Description of Artificial Sequence: Synthetic oligonucleotide
  Target: SCN10A; (-) strand; PAM type: NRG; PAM sequence: AAG
gtctttcctggagaccacga

SEQ ID NO: 21260 - DNA, 20 bp, Artificial Sequence
  Description of Artificial Sequence: Synthetic oligonucleotide
  Target: SCN10A; (-) strand; PAM type: NRG; PAM sequence: GAG
agatgatggagtctttcctg

SEQ ID NO: 21261 - DNA, 20 bp, Artificial Sequence
  Description of Artificial Sequence: Synthetic oligonucleotide
  Target: SCN10A; (-) strand; PAM type: NRG; PAM sequence: TGG
acagatgatggagtctttcc

SEQ ID NO: 21262 - DNA, 20 bp, Artificial Sequence
  Description of Artificial Sequence: Synthetic oligonucleotide
  Target: SCN10A; (-) strand; PAM type: NRG; PAM sequence: GAG
tgagggagtcacagatgatg

SEQ ID NO: 21263 - DNA, 20 bp, Artificial Sequence
  Description of Artificial Sequence: Synthetic oligonucleotide
  Target: SCN10A; (-) strand; PAM type: NRG; PAM sequence: TGG
cctgagggagtcacagatga

SEQ ID NO: 21264 - DNA, 20 bp, Artificial Sequence
  Description of Artificial Sequence: Synthetic oligonucleotide
  Target: SCN10A; (-) strand; PAM type: NRG; PAM sequence: CAG
ctcactccctgagggagtca

SEQ ID NO: 21265 - DNA, 20 bp, Artificial Sequence
  Description of Artificial Sequence: Synthetic oligonucleotide
  Target: SCN10A; (-) strand; PAM type: NRG; PAM sequence: GAG
agatatctcactccctgagg

SEQ ID NO: 21266 - DNA, 20 bp, Artificial Sequence
  Description of Artificial Sequence: Synthetic oligonucleotide
  Target: SCN10A; (-) strand; PAM type: NRG; PAM sequence: GGG
cgagatatctcactccctga

SEQ ID NO: 21267 - DNA, 20 bp, Artificial Sequence
  Description of Artificial Sequence: Synthetic oligonucleotide
  Target: SCN10A; (-) strand; PAM type: NRG; PAM sequence: AGG
ccgagatatctcactccctg

SEQ ID NO: 21268 - DNA, 20 bp, Artificial Sequence
  Description of Artificial Sequence: Synthetic oligonucleotide
  Target: SCN10A; (-) strand; PAM type: NRG; PAM sequence: GAG
gccgagatatctcactccct

SEQ ID NO: 21269 - DNA, 20 bp, Artificial Sequence
  Description of Artificial Sequence: Synthetic oligonucleotide
  Target: SCN10A; (-) strand; PAM type: NRG; PAM sequence: GAG
ccatttccggtcccctggcc

SEQ ID NO: 21270 - DNA, 20 bp, Artificial Sequence
  Description of Artificial Sequence: Synthetic oligonucleotide
  Target: SCN10A; (-) strand; PAM type: NRG; PAM sequence: TGG
gtgttccatttccggtcccc

SEQ ID NO: 21271 - DNA, 20 bp, Artificial Sequence
  Description of Artificial Sequence: Synthetic oligonucleotide
  Target: SCN10A; (-) strand; PAM type: NRG; PAM sequence: CGG
atggcagtgtgttccatttc

SEQ ID NO: 21272 - DNA, 20 bp, Artificial Sequence
  Description of Artificial Sequence: Synthetic oligonucleotide
  Target: SCN10A; (-) strand; PAM type: NRG; PAM sequence: CAG
aaacgccgggctagtcatgg

SEQ ID NO: 21273 - DNA, 20 bp, Artificial Sequence
  Description of Artificial Sequence: Synthetic oligonucleotide
  Target: SCN10A; (-) strand; PAM type: NRG; PAM sequence: TGG
ggaaaacgccgggctagtca

SEQ ID NO: 21274 - DNA, 20 bp, Artificial Sequence
  Description of Artificial Sequence: Synthetic oligonucleotide
  Target: SCN10A; (-) strand; PAM type: NRG; PAM sequence: TAG
gcctctggaaaacgccgggc

SEQ ID NO: 21275 - DNA, 20 bp, Artificial Sequence
  Description of Artificial Sequence: Synthetic oligonucleotide
  Target: SCN10A; (-) strand; PAM type: NRG; PAM sequence: GGG
cctcgcctctggaaaacgcc

SEQ ID NO: 21276 - DNA, 20 bp, Artificial Sequence
  Description of Artificial Sequence: Synthetic oligonucleotide
  Target: SCN10A; (-) strand; PAM type: NRG; PAM sequence: CGG
gcctcgcctctggaaaacgc

SEQ ID NO: 21277 - DNA, 20 bp, Artificial Sequence
  Description of Artificial Sequence: Synthetic oligonucleotide
  Target: SCN10A; (-) strand; PAM type: NRG; PAM sequence: TGG
tcttttctaggcctcgcctc

SEQ ID NO: 21278 - DNA, 20 bp, Artificial Sequence
  Description of Artificial Sequence: Synthetic oligonucleotide
  Target: SCN10A; (-) strand; PAM type: NRG; PAM sequence: AGG
ggcaatgcccagtcttttct

SEQ ID NO: 21279 - DNA, 20 bp, Artificial Sequence
  Description of Artificial Sequence: Synthetic oligonucleotide
  Target: SCN10A; (-) strand; PAM type: NRG; PAM sequence: TAG
gggcaatgcccagtcttttc

SEQ ID NO: 21280 - DNA, 20 bp, Artificial Sequence
  Description of Artificial Sequence: Synthetic oligonucleotide
  Target: SCN10A; (-) strand; PAM type: NRG; PAM sequence: CAG
tgctcctttggggcaatgcc

SEQ ID NO: 21281 - DNA, 20 bp, Artificial Sequence
  Description of Artificial Sequence: Synthetic oligonucleotide
  Target: SCN10A; (-) strand; PAM type: NRG; PAM sequence: GGG
ccagccttcttgctcctttg

SEQ ID NO: 21282 - DNA, 20 bp, Artificial Sequence
  Description of Artificial Sequence: Synthetic oligonucleotide
  Target: SCN10A; (-) strand; PAM type: NRG; PAM sequence: GGG
tccagccttcttgctccttt

SEQ ID NO: 21283 - DNA, 20 bp, Artificial Sequence
  Description of Artificial Sequence: Synthetic oligonucleotide
  Target: SCN10A; (-) strand; PAM type: NRG; PAM sequence: TGG
ttccagccttcttgctcctt

SEQ ID NO: 21284 - DNA, 20 bp, Artificial Sequence
  Description of Artificial Sequence: Synthetic oligonucleotide
  Target: SCN10A; (-) strand; PAM type: NRG; PAM sequence: CAG
tttcccagaggaccagtttc

SEQ ID NO: 21285 - DNA, 20 bp, Artificial Sequence
  Description of Artificial Sequence: Synthetic oligonucleotide
  Target: SCN10A; (-) strand; PAM type: NRG; PAM sequence: CAG
ctctagatttcccagaggac

SEQ ID NO: 21286 - DNA, 20 bp, Artificial Sequence
  Description of Artificial Sequence: Synthetic oligonucleotide
  Target: SCN10A; (-) strand; PAM type: NRG; PAM sequence: AGG
ttgggctctagatttcccag

SEQ ID NO: 21287 - DNA, 20 bp, Artificial Sequence
  Description of Artificial Sequence: Synthetic oligonucleotide
  Target: SCN10A; (-) strand; PAM type: NRG; PAM sequence: GAG
gttgggctctagatttccca

SEQ ID NO: 21288 - DNA, 20 bp, Artificial Sequence
  Description of Artificial Sequence: Synthetic oligonucleotide
  Target: SCN10A; (-) strand; PAM type: NRG; PAM sequence: CAG
gtgttgggctctagatttcc

SEQ ID NO: 21289 - DNA, 20 bp, Artificial Sequence
  Description of Artificial Sequence: Synthetic oligonucleotide
  Target: SCN10A; (-) strand; PAM type: NRG; PAM sequence: TAG
tagagggaagtgttgggctc

SEQ ID NO: 21290 - DNA, 20 bp, Artificial Sequence
  Description of Artificial Sequence: Synthetic oligonucleotide
  Target: SCN10A; (-) strand; PAM type: NRG; PAM sequence: GGG
agtaggtagagggaagtgtt

SEQ ID NO: 21291 - DNA, 20 bp, Artificial Sequence
  Description of Artificial Sequence: Synthetic oligonucleotide
  Target: SCN10A; (-) strand; PAM type: NRG; PAM sequence: TGG
gagtaggtagagggaagtgt

SEQ ID NO: 21292 - DNA, 20 bp, Artificial Sequence
  Description of Artificial Sequence: Synthetic oligonucleotide
  Target: SCN10A; (-) strand; PAM type: NRG; PAM sequence: AAG
aaatgggagtaggtagaggg

SEQ ID NO: 21293 - DNA, 20 bp, Artificial Sequence
  Description of Artificial Sequence: Synthetic oligonucleotide
  Target: SCN10A; (-) strand; PAM type: NRG; PAM sequence: GGG
gggaaatgggagtaggtaga

SEQ ID NO: 21294 - DNA, 20 bp, Artificial Sequence
  Description of Artificial Sequence: Synthetic oligonucleotide
  Target: SCN10A; (-) strand; PAM type: NRG; PAM sequence: AGG
agggaaatgggagtaggtag

SEQ ID NO: 21295 - DNA, 20 bp, Artificial Sequence
  Description of Artificial Sequence: Synthetic oligonucleotide
  Target: SCN10A; (-) strand; PAM type: NRG; PAM sequence: GAG
cagggaaatgggagtaggta

SEQ ID NO: 21296 - DNA, 20 bp, Artificial Sequence
  Description of Artificial Sequence: Synthetic oligonucleotide
  Target: SCN10A; (-) strand; PAM type: NRG; PAM sequence: TAG
ggcagggaaatgggagtagg

SEQ ID NO: 21297 - DNA, 20 bp, Artificial Sequence
  Description of Artificial Sequence: Synthetic oligonucleotide
  Target: SCN10A; (-) strand; PAM type: NRG; PAM sequence: AGG
aggggcagggaaatgggagt

SEQ ID NO: 21298 - DNA, 20 bp, Artificial Sequence
  Description of Artificial Sequence: Synthetic oligonucleotide
  Target: SCN10A; (-) strand; PAM type: NRG; PAM sequence: TAG
caggggcagggaaatgggag

SEQ ID NO: 21299 - DNA, 20 bp, Artificial Sequence
  Description of Artificial Sequence: Synthetic oligonucleotide
  Target: SCN10A; (-) strand; PAM type: NRG; PAM sequence: GAG
agacaggggcagggaaatgg

SEQ ID NO: 21300 - DNA, 20 bp, Artificial Sequence
  Description of Artificial Sequence: Synthetic oligonucleotide
  Target: SCN10A; (-) strand; PAM type: NRG; PAM sequence: GGG
aaagacaggggcagggaaat

SEQ ID NO: 21301 - DNA, 20 bp, Artificial Sequence
  Description of Artificial Sequence: Synthetic oligonucleotide
  Target: SCN10A; (-) strand; PAM type: NRG; PAM sequence: TGG
taaagacaggggcagggaaa

SEQ ID NO: 21302 - DNA, 20 bp, Artificial Sequence
  Description of Artificial Sequence: Synthetic oligonucleotide
  Target: SCN10A; (-) strand; PAM type: NRG; PAM sequence: GGG
aggtcataaagacaggggca

SEQ ID NO: 21303 - DNA, 20 bp, Artificial Sequence
  Description of Artificial Sequence: Synthetic oligonucleotide
  Target: SCN10A; (-) strand; PAM type: NRG; PAM sequence: AGG
aaggtcataaagacaggggc

SEQ ID NO: 21304 - DNA, 20 bp, Artificial Sequence
  Description of Artificial Sequence: Synthetic oligonucleotide
  Target: SCN10A; (-) strand; PAM type: NRG; PAM sequence: CAG
aaaggtcataaagacagggg

SEQ ID NO: 21305 - DNA, 20 bp, Artificial Sequence
  Description of Artificial Sequence: Synthetic oligonucleotide
  Target: SCN10A; (-) strand; PAM type: NRG; PAM sequence: GGG
ctgaaaggtcataaagacag

SEQ ID NO: 21306 - DNA, 20 bp, Artificial Sequence
  Description of Artificial Sequence: Synthetic oligonucleotide
  Target: SCN10A; (-) strand; PAM type: NRG; PAM sequence: GGG
actgaaaggtcataaagaca

SEQ ID NO: 21307 - DNA, 20 bp, Artificial Sequence
  Description of Artificial Sequence: Synthetic oligonucleotide
  Target: SCN10A; (-) strand; PAM type: NRG; PAM sequence: AGG
gactgaaaggtcataaagac

SEQ ID NO: 21308 - DNA, 20 bp, Artificial Sequence
  Description of Artificial Sequence: Synthetic oligonucleotide
  Target: SCN10A; (-) strand; PAM type: NRG; PAM sequence: CAG
tgactgaaaggtcataaaga

SEQ ID NO: 21309 - DNA, 20 bp, Artificial Sequence
  Description of Artificial Sequence: Synthetic oligonucleotide
  Target: SCN10A; (-) strand; PAM type: NRG; PAM sequence: AAG
ttagtgactgaaaggtcata

SEQ ID NO: 21310 - DNA, 20 bp, Artificial Sequence
  Description of Artificial Sequence: Synthetic oligonucleotide
  Target: SCN10A; (-) strand; PAM type: NRG; PAM sequence: AGG
gcctttacttagtgactgaa

SEQ ID NO: 21311 - DNA, 20 bp, Artificial Sequence
  Description of Artificial Sequence: Synthetic oligonucleotide
  Target: SCN10A; (-) strand; PAM type: NRG; PAM sequence: AAG
tgcctttacttagtgactga

SEQ ID NO: 21312 - DNA, 20 bp, Artificial Sequence
  Description of Artificial Sequence: Synthetic oligonucleotide
  Target: SCN10A; (-) strand; PAM type: NRG; PAM sequence: TAG
cttagatttgtgcctttact

SEQ ID NO: 21313 - DNA, 20 bp, Artificial Sequence
  Description of Artificial Sequence: Synthetic oligonucleotide
  Target: SCN10A; (-) strand; PAM type: NRG; PAM sequence: TAG
tgcatacctagaatacccct

SEQ ID NO: 21314 - DNA, 20 bp, Artificial Sequence
  Description of Artificial Sequence: Synthetic oligonucleotide
  Target: SCN10A; (-) strand; PAM type: NRG; PAM sequence: TAG
ttttccccaccatgcatacc

SEQ ID NO: 21315 - DNA, 20 bp, Artificial Sequence
  Description of Artificial Sequence: Synthetic oligonucleotide
  Target: SCN10A; (-) strand; PAM type: NRG; PAM sequence: GAG
tctttcccggagtctatcta

SEQ ID NO: 21316 - DNA, 20 bp, Artificial Sequence
  Description of Artificial Sequence: Synthetic oligonucleotide
  Target: SCN10A; (-) strand; PAM type: NRG; PAM sequence: TAG
ggtctttcccggagtctatc

SEQ ID NO: 21317 - DNA, 20 bp, Artificial Sequence
  Description of Artificial Sequence: Synthetic oligonucleotide
  Target: SCN10A; (-) strand; PAM type: NRG; PAM sequence: GAG
ctctctcctggtctttcccg

SEQ ID NO: 21318 - DNA, 20 bp, Artificial Sequence
  Description of Artificial Sequence: Synthetic oligonucleotide
  Target: SCN10A; (-) strand; PAM type: NRG; PAM sequence: CGG
tcctctctcctggtctttcc

SEQ ID NO: 21319 - DNA, 20 bp, Artificial Sequence
  Description of Artificial Sequence: Synthetic oligonucleotide
  Target: SCN10A; (-) strand; PAM type: NRG; PAM sequence: TGG
ctgtaatctctcctctctcc

SEQ ID NO: 21320 - DNA, 20 bp, Artificial Sequence
  Description of Artificial Sequence: Synthetic oligonucleotide
  Target: SCN10A; (-) strand; PAM type: NRG; PAM sequence: CAG
ataacctatttgctgagcat

SEQ ID NO: 21321 - DNA, 20 bp, Artificial Sequence
  Description of Artificial Sequence: Synthetic oligonucleotide
  Target: SCN10A; (-) strand; PAM type: NRG; PAM sequence: GAG
accatgataacctatttgct

SEQ ID NO: 21322 - DNA, 20 bp, Artificial Sequence
  Description of Artificial Sequence: Synthetic oligonucleotide
  Target: SCN10A; (-) strand; PAM type: NRG; PAM sequence: AGG
actgaactatccaggtgaca

SEQ ID NO: 21323 - DNA, 20 bp, Artificial Sequence
  Description of Artificial Sequence: Synthetic oligonucleotide
  Target: SCN10A; (-) strand; PAM type: NRG; PAM sequence: AAG
aactgaactatccaggtgac

SEQ ID NO: 21324 - DNA, 20 bp, Artificial Sequence
  Description of Artificial Sequence: Synthetic oligonucleotide
  Target: SCN10A; (-) strand; PAM type: NRG; PAM sequence: AGG
ggcaatcaactgaactatcc

SEQ ID NO: 21325 - DNA, 20 bp, Artificial Sequence
  Description of Artificial Sequence: Synthetic oligonucleotide
  Target: SCN10A; (-) strand; PAM type: NRG; PAM sequence: CAG
tggcaatcaactgaactatc

SEQ ID NO: 21326 - DNA, 20 bp, Artificial Sequence
  Description of Artificial Sequence: Synthetic oligonucleotide
  Target: SCN10A; (-) strand; PAM type: NRG; PAM sequence: TGG
ctagccctgtggccaaaggt

SEQ ID NO: 21327 - DNA, 20 bp, Artificial Sequence
  Description of Artificial Sequence: Synthetic oligonucleotide
  Target: SCN10A; (-) strand; PAM type: NRG; PAM sequence: AGG
ttgtctagccctgtggccaa

SEQ ID NO: 21328 - DNA, 20 bp, Artificial Sequence
  Description of Artificial Sequence: Synthetic oligonucleotide
  Target: SCN10A; (-) strand; PAM type: NRG; PAM sequence: AAG
tttgtctagccctgtggcca

SEQ ID NO: 21329 - DNA, 20 bp, Artificial Sequence
  Description of Artificial Sequence: Synthetic oligonucleotide
  Target: SCN10A; (-) strand; PAM type: NRG; PAM sequence: TGG
gacagctttgtctagccctg

SEQ ID NO: 21330 - DNA, 20 bp, Artificial Sequence
  Description of Artificial Sequence: Synthetic oligonucleotide
  Target: SCN10A; (-) strand; PAM type: NRG; PAM sequence: TAG
gaacttaggacagctttgtc

SEQ ID NO: 21331 - DNA, 20 bp, Artificial Sequence
  Description of Artificial Sequence: Synthetic oligonucleotide
  Target: SCN10A; (-) strand; PAM type: NRG; PAM sequence: CAG
gtggaaaagtgaacttagga

SEQ ID NO: 21332 - DNA, 20 bp, Artificial Sequence
  Description of Artificial Sequence: Synthetic oligonucleotide
  Target: SCN10A; (-) strand; PAM type: NRG; PAM sequence: AGG
gcatgtggaaaagtgaactt

SEQ ID NO: 21333 - DNA, 20 bp, Artificial Sequence
  Description of Artificial Sequence: Synthetic oligonucleotide
  Target: SCN10A; (-) strand; PAM type: NRG; PAM sequence: TAG
tgcatgtggaaaagtgaact

SEQ ID NO: 21334 - DNA, 20 bp, Artificial Sequence
  Description of Artificial Sequence: Synthetic oligonucleotide
  Target: SCN10A; (-) strand; PAM type: NRG; PAM sequence: AAG
tcacaactttgcatgtggaa

SEQ ID NO: 21335 - DNA, 20 bp, Artificial Sequence
  Description of Artificial Sequence: Synthetic oligonucleotide
  Target: SCN10A; (-) strand; PAM type: NRG; PAM sequence: TGG
ttaggtcacaactttgcatg

SEQ ID NO: 21336 - DNA, 20 bp, Artificial Sequence
  Description of Artificial Sequence: Synthetic oligonucleotide
  Target: SCN10A; (-) strand; PAM type: NRG; PAM sequence: AGG
gtgtgcatagtagcctcctt

SEQ ID NO: 21337 - DNA, 20 bp, Artificial Sequence
  Description of Artificial Sequence: Synthetic oligonucleotide
  Target: SCN10A; (-) strand; PAM type: NRG; PAM sequence: TAG
ggtgtgcatagtagcctcct

SEQ ID NO: 21338 - DNA, 20 bp, Artificial Sequence
  Description of Artificial Sequence: Synthetic oligonucleotide
  Target: SCN10A; (-) strand; PAM type: NRG; PAM sequence: TAG
tccagtactggtgtgcatag

SEQ ID NO: 21339 - DNA, 20 bp, Artificial Sequence
  Description of Artificial Sequence: Synthetic oligonucleotide
  Target: SCN10A; (-) strand; PAM type: NRG; PAM sequence: TAG
tgttccagtactggtgtgca

SEQ ID NO: 21340 - DNA, 20 bp, Artificial Sequence
  Description of Artificial Sequence: Synthetic oligonucleotide
  Target: SCN10A; (-) strand; PAM type: NRG; PAM sequence: TGG
taccaagtatgttccagtac

SEQ ID NO: 21341 - DNA, 20 bp, Artificial Sequence
  Description of Artificial Sequence: Synthetic oligonucleotide
  Target: SCN10A; (-) strand; PAM type: NRG; PAM sequence: CAG
accacttaccaagtatgttc

SEQ ID NO: 21342 - DNA, 20 bp, Artificial Sequence
  Description of Artificial Sequence: Synthetic oligonucleotide
  Target: SCN10A; (-) strand; PAM type: NRG; PAM sequence: AAG
tcattcaacaaccacttacc

SEQ ID NO: 21343 - DNA, 20 bp, Artificial Sequence
  Description of Artificial Sequence: Synthetic oligonucleotide
  Target: SCN10A; (-) strand; PAM type: NRG; PAM sequence: AAG
tacctaattttcagacaatg

SEQ ID NO: 21344 - DNA, 20 bp, Artificial Sequence
  Description of Artificial Sequence: Synthetic oligonucleotide
  Target: SCN10A; (-) strand; PAM type: NRG; PAM sequence: CAG
gaattgtactacctaatttt

SEQ ID NO: 21345 - DNA, 20 bp, Artificial Sequence
  Description of Artificial Sequence: Synthetic oligonucleotide
  Target: SCN10A; (-) strand; PAM type: NRG; PAM sequence: GGG
actctcacattcatacagat

SEQ ID NO: 21346 - DNA, 20 bp, Artificial Sequence
  Description of Artificial Sequence: Synthetic oligonucleotide
  Target: SCN10A; (-) strand; PAM type: NRG; PAM sequence: TGG
aactctcacattcatacaga

SEQ ID NO: 21347 - DNA, 20 bp, Artificial Sequence
  Description of Artificial Sequence: Synthetic oligonucleotide
  Target: SCN10A; (-) strand; PAM type: NRG; PAM sequence: CAG
cacaaactctcacattcata

SEQ ID NO: 21348 - DNA, 20 bp, Artificial Sequence
  Description of Artificial Sequence: Synthetic oligonucleotide
  Target: SCN10A; (-) strand; PAM type: NRG; PAM sequence: CAG
tagaaactcattgcactgta

SEQ ID NO: 21349 - DNA, 20 bp, Artificial Sequence
  Description of Artificial Sequence: Synthetic oligonucleotide
  Target: SCN10A; (-) strand; PAM type: NRG; PAM sequence: TAG
gttcaagcctcgagggatcc

SEQ ID NO: 21350 - DNA, 20 bp, Artificial Sequence
  Description of Artificial Sequence: Synthetic oligonucleotide
  Target: SCN10A; (-) strand; PAM type: NRG; PAM sequence: GGG
gttgactgttcaagcctcga

SEQ ID NO: 21351 - DNA, 20 bp, Artificial Sequence
  Description of Artificial Sequence: Synthetic oligonucleotide
  Target: SCN10A; (-) strand; PAM type: NRG; PAM sequence: AGG
tgttgactgttcaagcctcg

SEQ ID NO: 21352 - DNA, 20 bp, Artificial Sequence
  Description of Artificial Sequence: Synthetic oligonucleotide
  Target: SCN10A; (-) strand; PAM type: NRG; PAM sequence: GAG
ttgttgactgttcaagcctc

SEQ ID NO: 21353 - DNA, 20 bp, Artificial Sequence
  Description of Artificial Sequence: Synthetic oligonucleotide
  Target: SCN10A; (-) strand; PAM type: NRG; PAM sequence: AAG
ctctccattgttgactgttc

SEQ ID NO: 21354 - DNA, 20 bp, Artificial Sequence
  Description of Artificial Sequence: Synthetic oligonucleotide
  Target: SCN10A; (-) strand; PAM type: NRG; PAM sequence: CAG
ttaggctgcaacccttcctt

SEQ ID NO: 21355 - DNA, 20 bp, Artificial Sequence
  Description of Artificial Sequence: Synthetic oligonucleotide
  Target: SCN10A; (-) strand; PAM type: NRG; PAM sequence: AGG
cattattcttccaggaaatt

SEQ ID NO: 21356 - DNA, 20 bp, Artificial Sequence
  Description of Artificial Sequence: Synthetic oligonucleotide
  Target: SCN10A; (-) strand; PAM type: NRG; PAM sequence: TAG
acattattcttccaggaaat

SEQ ID NO: 21357 - DNA, 20 bp, Artificial Sequence
  Description of Artificial Sequence: Synthetic oligonucleotide
  Target: SCN10A; (-) strand; PAM type: NRG; PAM sequence: AGG
aggaatgacattattcttcc

SEQ ID NO: 21358 - DNA, 20 bp, Artificial Sequence
  Description of Artificial Sequence: Synthetic oligonucleotide
  Target: SCN10A; (-) strand; PAM type: NRG; PAM sequence: CAG
gaggaatgacattattcttc

SEQ ID NO: 21359 - DNA, 20 bp, Artificial Sequence
  Description of Artificial Sequence: Synthetic oligonucleotide
  Target: SCN10A; (-) strand; PAM type: NRG; PAM sequence: AGG
ggaaatgtttattgatttgg

SEQ ID NO: 21360 - DNA, 20 bp, Artificial Sequence
  Description of Artificial Sequence: Synthetic oligonucleotide
  Target: SCN10A; (-) strand; PAM type: NRG; PAM sequence: GAG
gggaaatgtttattgatttg

SEQ ID NO: 21361 - DNA, 20 bp, Artificial Sequence
  Description of Artificial Sequence: Synthetic oligonucleotide
  Target: SCN10A; (-) strand; PAM type: NRG; PAM sequence: TGG
atgggaaatgtttattgatt

SEQ ID NO: 21362 - DNA, 20 bp, Artificial Sequence
  Description of Artificial Sequence: Synthetic oligonucleotide
  Target: SCN10A; (-) strand; PAM type: NRG; PAM sequence: GGG
cctcaatggaagattttgat

SEQ ID NO: 21363 - DNA, 20 bp, Artificial Sequence
  Description of Artificial Sequence: Synthetic oligonucleotide
  Target: SCN10A; (-) strand; PAM type: NRG; PAM sequence: TGG
ccctcaatggaagattttga

SEQ ID NO: 21364 - DNA, 20 bp, Artificial Sequence
  Description of Artificial Sequence: Synthetic oligonucleotide
  Target: SCN10A; (-) strand; PAM type: NRG; PAM sequence: AAG
ccacacagttccctcaatgg

SEQ ID NO: 21365 - DNA, 20 bp, Artificial Sequence
  Description of Artificial Sequence: Synthetic oligonucleotide
  Target: SCN10A; (-) strand; PAM type: NRG; PAM sequence: TGG
aagccacacagttccctcaa

SEQ ID NO: 21366 - DNA, 20 bp, Artificial Sequence
  Description of Artificial Sequence: Synthetic oligonucleotide
  Target: SCN10A; (-) strand; PAM type: NRG; PAM sequence: CAG
tctggcaactttaagccaca

SEQ ID NO: 21367 - DNA, 20 bp, Artificial Sequence
  Description of Artificial Sequence: Synthetic oligonucleotide
  Target: SCN10A; (-) strand; PAM type: NRG; PAM sequence: AAG
ctcttttctctggcaacttt

SEQ ID NO: 21368 - DNA, 20 bp, Artificial Sequence
  Description of Artificial Sequence: Synthetic oligonucleotide
  Target: SCN10A; (-) strand; PAM type: NRG; PAM sequence: TGG
tatgaattagctcttttctc

SEQ ID NO: 21369 - DNA, 20 bp, Artificial Sequence
  Description of Artificial Sequence: Synthetic oligonucleotide
  Target: SCN10A; (-) strand; PAM type: NRG; PAM sequence: TAG
agggctctgggtttatgaat

SEQ ID NO: 21370 - DNA, 20 bp, Artificial Sequence
  Description of Artificial Sequence: Synthetic oligonucleotide
  Target: SCN10A; (-) strand; PAM type: NRG; PAM sequence: GGG
actaattctctgagggctct

SEQ ID NO: 21371 - DNA, 20 bp, Artificial Sequence
  Description of Artificial Sequence: Synthetic oligonucleotide
  Target: SCN10A; (-) strand; PAM type: NRG; PAM sequence: TGG
cactaattctctgagggctc

SEQ ID NO: 21372 - DNA, 20 bp, Artificial Sequence
  Description of Artificial Sequence: Synthetic oligonucleotide
  Target: SCN10A; (-) strand; PAM type: NRG; PAM sequence: GGG
ccagcacactaattctctga

SEQ ID NO: 21373 - DNA, 20 bp, Artificial Sequence
  Description of Artificial Sequence: Synthetic oligonucleotide
  Target: SCN10A; (-) strand; PAM type: NRG; PAM sequence: AGG
cccagcacactaattctctg

SEQ ID NO: 21374 - DNA, 20 bp, Artificial Sequence
  Description of Artificial Sequence: Synthetic oligonucleotide
  Target: SCN10A; (-) strand; PAM type: NRG; PAM sequence: GAG
acccagcacactaattctct

SEQ ID NO: 21375 - DNA, 20 bp, Artificial Sequence
  Description of Artificial Sequence: Synthetic oligonucleotide
  Target: SCN10A; (-) strand; PAM type: NRG; PAM sequence: CAG
gtcatgggaactacctaacc

SEQ ID NO: 21376 - DNA, 20 bp, Artificial Sequence
  Description of Artificial Sequence: Synthetic oligonucleotide
  Target: SCN10A; (-) strand; PAM type: NRG; PAM sequence: GGG
tcaagtttcactatggtcat

SEQ ID NO: 21377 - DNA, 20 bp, Artificial Sequence
  Description of Artificial Sequence: Synthetic oligonucleotide
  Target: SCN10A; (-) strand; PAM type: NRG; PAM sequence: TGG
gtcaagtttcactatggtca

SEQ ID NO: 21378 - DNA, 20 bp, Artificial Sequence
  Description of Artificial Sequence: Synthetic oligonucleotide
  Target: SCN10A; (-) strand; PAM type: NRG; PAM sequence: TGG
attatggtcaagtttcacta

SEQ ID NO: 21379 - DNA, 20 bp, Artificial Sequence
  Description of Artificial Sequence: Synthetic oligonucleotide
  Target: SCN10A; (-) strand; PAM type: NRG; PAM sequence: AAG
aatgatggtttattatggtc

SEQ ID NO: 21380 - DNA, 20 bp, Artificial Sequence
  Description of Artificial Sequence: Synthetic oligonucleotide
  Target: SCN10A; (-) strand; PAM type: NRG; PAM sequence: TGG
acacaaatgatggtttatta

SEQ ID NO: 21381 - DNA, 20 bp, Artificial Sequence
  Description of Artificial Sequence: Synthetic oligonucleotide
  Target: SCN10A; (-) strand; PAM type: NRG; PAM sequence: TGG
ccacctgaggacacaaatga

SEQ ID NO: 21382 - DNA, 20 bp, Artificial Sequence
  Description of Artificial Sequence: Synthetic oligonucleotide
  Target: SCN10A; (-) strand; PAM type: NRG; PAM sequence: AGG
tacatactatagaccacctg

SEQ ID NO: 21383 - DNA, 20 bp, Artificial Sequence
  Description of Artificial Sequence: Synthetic oligonucleotide
  Target: SCN10A; (-) strand; PAM type: NRG; PAM sequence: GAG
gtacatactatagaccacct

SEQ ID NO: 21384 - DNA, 20 bp, Artificial Sequence
  Description of Artificial Sequence: Synthetic oligonucleotide
  Target: SCN10A; (-) strand; PAM type: NRG; PAM sequence: TAG
tttagattttgtacatacta

SEQ ID NO: 21385 - DNA, 20 bp, Artificial Sequence
  Description of Artificial Sequence: Synthetic oligonucleotide
  Target: SCN10A; (-) strand; PAM type: NRG; PAM sequence: TAG
tttggtatgaagtcaatgtt

SEQ ID NO: 21386 - DNA, 20 bp, Artificial Sequence
  Description of Artificial Sequence: Synthetic oligonucleotide
  Target: SCN10A; (-) strand; PAM type: NRG; PAM sequence: AAG
tatgatcagagtttggtatg

SEQ ID NO: 21387 - DNA, 20 bp, Artificial Sequence
  Description of Artificial Sequence: Synthetic oligonucleotide
  Target: SCN10A; (-) strand; PAM type: NRG; PAM sequence: TGG
aaatcggtatgatcagagtt

SEQ ID NO: 21388 - DNA, 20 bp, Artificial Sequence
  Description of Artificial Sequence: Synthetic oligonucleotide
  Target: SCN10A; (-) strand; PAM type: NRG; PAM sequence: GAG
ggaataaatcggtatgatca

SEQ ID NO: 21389 - DNA, 20 bp, Artificial Sequence
  Description of Artificial Sequence: Synthetic oligonucleotide
  Target: SCN10A; (-) strand; PAM type: NRG; PAM sequence: CAG
gtggaataaatcggtatgat

SEQ ID NO: 21390 - DNA, 20 bp, Artificial Sequence
  Description of Artificial Sequence: Synthetic oligonucleotide
  Target: SCN10A; (-) strand; PAM type: NRG; PAM sequence: CGG
ggaaggtgagtggaataaat

SEQ ID NO: 21391 - DNA, 20 bp, Artificial Sequence
  Description of Artificial Sequence: Synthetic oligonucleotide
  Target: SCN10A; (-) strand; PAM type: NRG; PAM sequence: TGG
aaggagttaaggaaggtgag

SEQ ID NO: 21392 - DNA, 20 bp, Artificial Sequence
  Description of Artificial Sequence: Synthetic oligonucleotide
  Target: SCN10A; (-) strand; PAM type: NRG; PAM sequence: GAG
aaaaaggagttaaggaaggt

SEQ ID NO: 21393 - DNA, 20 bp, Artificial Sequence
  Description of Artificial Sequence: Synthetic oligonucleotide
  Target: SCN10A; (-) strand; PAM type: NRG; PAM sequence: AGG
taataaaaaggagttaagga

SEQ ID NO: 21394 - DNA, 20 bp, Artificial Sequence
  Description of Artificial Sequence: Synthetic oligonucleotide
  Target: SCN10A; (-) strand; PAM type: NRG; PAM sequence: AAG
gtaataaaaaggagttaagg

SEQ ID NO: 21395 - DNA, 20 bp, Artificial Sequence
  Description of Artificial Sequence: Synthetic oligonucleotide
  Target: SCN10A; (-) strand; PAM type: NRG; PAM sequence: AGG
ttagtaataaaaaggagtta

SEQ ID NO: 21396 - DNA, 20 bp, Artificial Sequence
  Description of Artificial Sequence: Synthetic oligonucleotide
  Target: SCN10A; (-) strand; PAM type: NRG; PAM sequence: AAG
cttagtaataaaaaggagtt

SEQ ID NO: 21397 - DNA, 20 bp, Artificial Sequence
  Description of Artificial Sequence: Synthetic oligonucleotide
  Target: SCN10A; (-) strand; PAM type: NRG; PAM sequence: GAG
agtagcttagtaataaaaag

SEQ ID NO: 21398 - DNA, 20 bp, Artificial Sequence
  Description of Artificial Sequence: Synthetic oligonucleotide
  Target: SCN10A; (-) strand; PAM type: NRG; PAM sequence: AGG
ttagtagcttagtaataaaa

SEQ ID NO: 21399 - DNA, 20 bp, Artificial Sequence
  Description of Artificial Sequence: Synthetic oligonucleotide
  Target: SCN10A; (-) strand; PAM type: NRG; PAM sequence: AAG
tttagtagcttagtaataaa

SEQ ID NO: 21400 - DNA, 20 bp, Artificial Sequence
  Description of Artificial Sequence: Synthetic oligonucleotide
  Target: SCN10A; (-) strand; PAM type: NRG; PAM sequence: TAG
gattctccactttagtagct

SEQ ID NO: 21401 - DNA, 20 bp, Artificial Sequence
  Description of Artificial Sequence: Synthetic oligonucleotide
  Target: SCN10A; (-) strand; PAM type: NRG; PAM sequence: TAG
ggcaagattctccactttag

SEQ ID NO: 21402 - DNA, 20 bp, Artificial Sequence
  Description of Artificial Sequence: Synthetic oligonucleotide
  Target: SCN10A; (-) strand; PAM type: NRG; PAM sequence: TAG
attggcaagattctccactt

SEQ ID NO: 21403 - DNA, 20 bp, Artificial Sequence
  Description of Artificial Sequence: Synthetic oligonucleotide
  Target: SCN10A; (-) strand; PAM type: NRG; PAM sequence: AAG
taaggagaaccccaattggc

SEQ ID NO: 21404 - DNA, 20 bp, Artificial Sequence
  Description of Artificial Sequence: Synthetic oligonucleotide
  Target: SCN10A; (-) strand; PAM type: NRG; PAM sequence: TGG
ttagtaaggagaaccccaat

SEQ ID NO: 21405 - DNA, 20 bp, Artificial Sequence
  Description of Artificial Sequence: Synthetic oligonucleotide
  Target: SCN10A; (-) strand; PAM type: NRG; PAM sequence: GAG
gagataaggggattagtaag

SEQ ID NO: 21406 - DNA, 20 bp, Artificial Sequence
  Description of Artificial Sequence: Synthetic oligonucleotide
  Target: SCN10A; (-) strand; PAM type: NRG; PAM sequence: AGG
gtgagataaggggattagta

SEQ ID NO: 21407 - DNA, 20 bp, Artificial Sequence
  Description of Artificial Sequence: Synthetic oligonucleotide
  Target: SCN10A; (-) strand; PAM type: NRG; PAM sequence: AAG
tgtgagataaggggattagt

SEQ ID NO: 21408 - DNA, 20 bp, Artificial Sequence
  Description of Artificial Sequence: Synthetic oligonucleotide
  Target: SCN10A; (-) strand; PAM type: NRG; PAM sequence: TAG
gttctgtgagataaggggat

SEQ ID NO: 21409 - DNA, 20 bp, Artificial Sequence
  Description of Artificial Sequence: Synthetic oligonucleotide
  Target: SCN10A; (-) strand; PAM type: NRG; PAM sequence: GGG
cttcagttctgtgagataag

SEQ ID NO: 21410 - DNA, 20 bp, Artificial Sequence
  Description of Artificial Sequence: Synthetic oligonucleotide
  Target: SCN10A; (-) strand; PAM type: NRG; PAM sequence: GGG
acttcagttctgtgagataa

SEQ ID NO: 21411 - DNA, 20 bp, Artificial Sequence
  Description of Artificial Sequence: Synthetic oligonucleotide
  Target: SCN10A; (-) strand; PAM type: NRG; PAM sequence: AGG
aacttcagttctgtgagata

SEQ ID NO: 21412 - DNA, 20 bp, Artificial Sequence
  Description of Artificial Sequence: Synthetic oligonucleotide
  Target: SCN10A; (-) strand; PAM type: NRG; PAM sequence: AAG
aaacttcagttctgtgagat

SEQ ID NO: 21413 - DNA, 20 bp, Artificial Sequence
  Description of Artificial Sequence: Synthetic oligonucleotide
  Target: SCN10A; (-) strand; PAM type: NRG; PAM sequence: GAG
agaggaaacttcagttctgt

SEQ ID NO: 21414 - DNA, 20 bp, Artificial Sequence
  Description of Artificial Sequence: Synthetic oligonucleotide
  Target: SCN10A; (-) strand; PAM type: NRG; PAM sequence: CAG
attatcaagagaggaaactt

SEQ ID NO: 21415 - DNA, 20 bp, Artificial Sequence
  Description of Artificial Sequence: Synthetic oligonucleotide
  Target: SCN10A; (-) strand; PAM type: NRG; PAM sequence: AGG
aggcttcaaattatcaagag

SEQ ID NO: 21416 - DNA, 20 bp, Artificial Sequence
  Description of Artificial Sequence: Synthetic oligonucleotide
  Target: SCN10A; (-) strand; PAM type: NRG; PAM sequence: GAG
caggcttcaaattatcaaga

SEQ ID NO: 21417 - DNA, 20 bp, Artificial Sequence
  Description of Artificial Sequence: Synthetic oligonucleotide
  Target: SCN10A; (-) strand; PAM type: NRG; PAM sequence: GAG
atcaggcttcaaattatcaa

SEQ ID NO: 21418 - DNA, 20 bp, Artificial Sequence
  Description of Artificial Sequence: Synthetic oligonucleotide
  Target: SCN10A; (-) strand; PAM type: NRG; PAM sequence: AAG
ggatcaggcttcaaattatc

SEQ ID NO: 21419 - DNA, 20 bp, Artificial Sequence
  Description of Artificial Sequence: Synthetic oligonucleotide
  Target: SCN10A; (-) strand; PAM type: NRG; PAM sequence: AGG
aatggttgctaaacaggatc

SEQ ID NO: 21420 - DNA, 20 bp, Artificial Sequence
  Description of Artificial Sequence: Synthetic oligonucleotide
  Target: SCN10A; (-) strand; PAM type: NRG; PAM sequence: CAG
taatggttgctaaacaggat

SEQ ID NO: 21421 - DNA, 20 bp, Artificial Sequence
  Description of Artificial Sequence: Synthetic oligonucleotide
  Target: SCN10A; (-) strand; PAM type: NRG; PAM sequence: AGG
tttaataatggttgctaaac

SEQ ID NO: 21422 - DNA, 20 bp, Artificial Sequence
  Description of Artificial Sequence: Synthetic oligonucleotide
  Target: SCN10A; (-) strand; PAM type: NRG; PAM sequence: CAG
ttttaataatggttgctaaa

SEQ ID NO: 21423 - DNA, 20 bp, Artificial Sequence
  Description of Artificial Sequence: Synthetic oligonucleotide
  Target: SCN10A; (-) strand; PAM type: NRG; PAM sequence: TGG
taatactgagcttttaataa

SEQ ID NO: 21424 - DNA, 20 bp, Artificial Sequence
  Description of Artificial Sequence: Synthetic oligonucleotide
  Target: SCN10A; (-) strand; PAM type: NRG; PAM sequence: GAG
agtactctatttataatact

SEQ ID NO: 21425 - DNA, 20 bp, Artificial Sequence
  Description of Artificial Sequence: Synthetic oligonucleotide
  Target: SCN10A; (-) strand; PAM type: NRG; PAM sequence: GAG
gggcatgtattacaggcaga

SEQ ID NO: 21426 - DNA, 20 bp, Artificial Sequence
  Description of Artificial Sequence: Synthetic oligonucleotide
  Target: SCN10A; (-) strand; PAM type: NRG; PAM sequence: GAG
ttgggcatgtattacaggca

SEQ ID NO: 21427 - DNA, 20 bp, Artificial Sequence
  Description of Artificial Sequence: Synthetic oligonucleotide
  Target: SCN10A; (-) strand; PAM type: NRG; PAM sequence: CAG
ccttgggcatgtattacagg

SEQ ID NO: 21428 - DNA, 20 bp, Artificial Sequence
  Description of Artificial Sequence: Synthetic oligonucleotide
  Target: SCN10A; (-) strand; PAM type: NRG; PAM sequence: AGG
agtccttgggcatgtattac

SEQ ID NO: 21429 - DNA, 20 bp, Artificial Sequence
  Description of Artificial Sequence: Synthetic oligonucleotide
  Target: SCN10A; (-) strand; PAM type: NRG; PAM sequence: CAG
tagtccttgggcatgtatta

SEQ ID NO: 21430 - DNA, 20 bp, Artificial Sequence
  Description of Artificial Sequence: Synthetic oligonucleotide
  Target: SCN10A; (-) strand; PAM type: NRG; PAM sequence: GGG
ttatgagttctatagtcctt

SEQ ID NO: 21431 - DNA, 20 bp, Artificial Sequence
  Description of Artificial Sequence: Synthetic oligonucleotide
  Target: SCN10A; (-) strand; PAM type: NRG; PAM sequence: TGG
tttatgagttctatagtcct

SEQ ID NO: 21432 - DNA, 20 bp, Artificial Sequence
  Description of Artificial Sequence: Synthetic oligonucleotide
  Target: SCN10A; (-) strand; PAM type: NRG; PAM sequence: TAG
tttgcattttatgagttcta

SEQ ID NO: 21433 - DNA, 20 bp, Artificial Sequence
  Description of Artificial Sequence: Synthetic oligonucleotide
  Target: SCN10A; (-) strand; PAM type: NRG; PAM sequence: GAG
gaaggatttttgcattttat

SEQ ID NO: 21434 - DNA, 20 bp, Artificial Sequence
  Description of Artificial Sequence: Synthetic oligonucleotide
  Target: SCN10A; (-) strand; PAM type: NRG; PAM sequence: AGG
catttgcttcaaaaattgga

SEQ ID NO: 21435 - DNA, 20 bp, Artificial Sequence
  Description of Artificial Sequence: Synthetic oligonucleotide
  Target: SCN10A; (-) strand; PAM type: NRG; PAM sequence: AAG
tcatttgcttcaaaaattgg

SEQ ID NO: 21436 - DNA, 20 bp, Artificial Sequence
  Description of Artificial Sequence: Synthetic oligonucleotide
  Target: SCN10A; (-) strand; PAM type: NRG; PAM sequence: TGG
ttctcatttgcttcaaaaat

SEQ ID NO: 21437 - DNA, 20 bp, Artificial Sequence
  Description of Artificial Sequence: Synthetic oligonucleotide
  Target: SCN10A; (-) strand; PAM type: NRG; PAM sequence: TGG
tagtattcccttccttaata

SEQ ID NO: 21438 - DNA, 20 bp, Artificial Sequence
  Description of Artificial Sequence: Synthetic oligonucleotide
  Target: SCN10A; (-) strand; PAM type: NRG; PAM sequence: TAG
gtgctcaagtgcaaataatg

SEQ ID NO: 21439 - DNA, 20 bp, Artificial Sequence
  Description of Artificial Sequence: Synthetic oligonucleotide
  Target: SCN10A; (-) strand; PAM type: NRG; PAM sequence: AAG
cattggtttgcttggtgctc

SEQ ID NO: 21440 - DNA, 20 bp, Artificial Sequence
  Description of Artificial Sequence: Synthetic oligonucleotide
  Target: SCN10A; (-) strand; PAM type: NRG; PAM sequence: TGG
agtttcttcattggtttgct

SEQ ID NO: 21441 - DNA, 20 bp, Artificial Sequence
  Description of Artificial Sequence: Synthetic oligonucleotide
  Target: SCN10A; (-) strand; PAM type: NRG; PAM sequence: TGG
tttcttctcagtttcttcat

SEQ ID NO: 21442 - DNA, 20 bp, Artificial Sequence
  Description of Artificial Sequence: Synthetic oligonucleotide
  Target: SCN10A; (-) strand; PAM type: NRG; PAM sequence: CAG
tgcaaccaaaattttcttct

SEQ ID NO: 21443 - DNA, 20 bp, Artificial Sequence
  Description of Artificial Sequence: Synthetic oligonucleotide
  Target: SCN10A; (-) strand; PAM type: NRG; PAM sequence: GAG
taaaataactcgtggccaag

SEQ ID NO: 21444 - DNA, 20 bp, Artificial Sequence
  Description of Artificial Sequence: Synthetic oligonucleotide
  Target: SCN10A; (-) strand; PAM type: NRG; PAM sequence: AGG
tctaaaataactcgtggcca

SEQ ID NO: 21445 - DNA, 20 bp, Artificial Sequence
  Description of Artificial Sequence: Synthetic oligonucleotide
  Target: SCN10A; (-) strand; PAM type: NRG; PAM sequence: AAG
ttctaaaataactcgtggcc

SEQ ID NO: 21446 - DNA, 20 bp, Artificial Sequence
  Description of Artificial Sequence: Synthetic oligonucleotide
  Target: SCN10A; (-) strand; PAM type: NRG; PAM sequence: TGG
cttaattctaaaataactcg

SEQ ID NO: 21447 - DNA, 20 bp, Artificial Sequence
  Description of Artificial Sequence: Synthetic oligonucleotide
  Target: SCN10A; (-) strand; PAM type: NRG; PAM sequence: AAG
attctaatgcttatactcag

SEQ ID NO: 21448 - DNA, 20 bp, Artificial Sequence
  Description of Artificial Sequence: Synthetic oligonucleotide
  Target: SCN10A; (-) strand; PAM type: NRG; PAM sequence: CAG
gcaattctaatgcttatact

SEQ ID NO: 21449 - DNA, 20 bp, Artificial Sequence
  Description of Artificial Sequence: Synthetic oligonucleotide
  Target: SCN10A; (-) strand; PAM type: NRG; PAM sequence: AAG
tcgttagaggatgaatttta

SEQ ID NO: 21450 - DNA, 20 bp, Artificial Sequence
  Description of Artificial Sequence: Synthetic oligonucleotide
  Target: SCN10A; (-) strand; PAM type: NRG; PAM sequence: AGG
agaccagttggtctcgttag

SEQ ID NO: 21451 - DNA, 20 bp, Artificial Sequence
  Description of Artificial Sequence: Synthetic oligonucleotide
  Target: SCN10A; (-) strand; PAM type: NRG; PAM sequence: GAG
cagaccagttggtctcgtta

SEQ ID NO: 21452 - DNA, 20 bp, Artificial Sequence
  Description of Artificial Sequence: Synthetic oligonucleotide
  Target: SCN10A; (-) strand; PAM type: NRG; PAM sequence: TAG
cacagaccagttggtctcgt

SEQ ID NO: 21453 - DNA, 20 bp, Artificial Sequence
  Description of Artificial Sequence: Synthetic oligonucleotide
  Target: SCN10A; (-) strand; PAM type: NRG; PAM sequence: TGG
gtggaaaatcacagaccagt

SEQ ID NO: 21454 - DNA, 20 bp, Artificial Sequence
  Description of Artificial Sequence: Synthetic oligonucleotide
  Target: SCN10A; (-) strand; PAM type: NRG; PAM sequence: CAG
ttttgtggaaaatcacagac

SEQ ID NO: 21455 - DNA, 20 bp, Artificial Sequence
  Description of Artificial Sequence: Synthetic oligonucleotide
  Target: SCN10A; (-) strand; PAM type: NRG; PAM sequence: CAG
agggtttttgtggaaaatca

SEQ ID NO: 21456 - DNA, 20 bp, Artificial Sequence
  Description of Artificial Sequence: Synthetic oligonucleotide
  Target: SCN10A; (-) strand; PAM type: NRG; PAM sequence: TGG
gagacccaggagggtttttg

SEQ ID NO: 21457 - DNA, 20 bp, Artificial Sequence
  Description of Artificial Sequence: Synthetic oligonucleotide
  Target: SCN10A; (-) strand; PAM type: NRG; PAM sequence: GGG
tatatagaagagacccagga

SEQ ID NO: 21458 - DNA, 20 bp, Artificial Sequence
  Description of Artificial Sequence: Synthetic oligonucleotide
  Target: SCN10A; (-) strand; PAM type: NRG; PAM sequence: AGG
atatatagaagagacccagg

SEQ ID NO: 21459 - DNA, 20 bp, Artificial Sequence
  Description of Artificial Sequence: Synthetic oligonucleotide
  Target: SCN10A; (-) strand; PAM type: NRG; PAM sequence: GAG
aatatatagaagagacccag

SEQ ID NO: 21460 - DNA, 20 bp, Artificial Sequence
  Description of Artificial Sequence: Synthetic oligonucleotide
  Target: SCN10A; (-) strand; PAM type: NRG; PAM sequence: AGG
ggaatatatagaagagaccc

SEQ ID NO: 21461 - DNA, 20 bp, Artificial Sequence
  Description of Artificial Sequence: Synthetic oligonucleotide
  Target: SCN10A; (-) strand; PAM type: NRG; PAM sequence: CAG
aggaatatatagaagagacc

SEQ ID NO: 21462 - DNA, 20 bp, Artificial Sequence
  Description of Artificial Sequence: Synthetic oligonucleotide
  Target: SCN10A; (-) strand; PAM type: NRG; PAM sequence: GAG
aaatagaggaatatatagaa

SEQ ID NO: 21463 - DNA, 20 bp, Artificial Sequence
  Description of Artificial Sequence: Synthetic oligonucleotide
  Target: SCN10A; (-) strand; PAM type: NRG; PAM sequence: AAG
ttaaatagaggaatatatag

SEQ ID NO: 21464 - DNA, 20 bp, Artificial Sequence
  Description of Artificial Sequence: Synthetic oligonucleotide
  Target: SCN10A; (-) strand; PAM type: NRG; PAM sequence: TAG
aaattaaatagaggaatata

SEQ ID NO: 21465 - DNA, 20 bp, Artificial Sequence
  Description of Artificial Sequence: Synthetic oligonucleotide
  Target: SCN10A; (-) strand; PAM type: NRG; PAM sequence: AGG
aaccaatagaaattaaatag

SEQ ID NO: 21466 - DNA, 20 bp, Artificial Sequence
  Description of Artificial Sequence: Synthetic oligonucleotide
  Target: SCN10A; (-) strand; PAM type: NRG; PAM sequence: GAG
taaccaatagaaattaaata

SEQ ID NO: 21467 - DNA, 20 bp, Artificial Sequence
  Description of Artificial Sequence: Synthetic oligonucleotide
  Target: SCN10A; (-) strand; PAM type: NRG; PAM sequence: TAG
tataaccaatagaaattaaa

SEQ ID NO: 21468 - DNA, 20 bp, Artificial Sequence
  Description of Artificial Sequence: Synthetic oligonucleotide
  Target: SCN10A; (-) strand; PAM type: NRG; PAM sequence: TAG
taaagccattttataaccaa

SEQ ID NO: 21469 - DNA, 20 bp, Artificial Sequence
  Description of Artificial Sequence: Synthetic oligonucleotide
  Target: SCN10A; (-) strand; PAM type: NRG; PAM sequence: AAG
cctaatgcagtttttatcta

SEQ ID NO: 21470 - DNA, 20 bp, Artificial Sequence
  Description of Artificial Sequence: Synthetic oligonucleotide
  Target: SCN10A; (-) strand; PAM type: NRG; PAM sequence: CAG
tgtggtaaatagacctaatg

SEQ ID NO: 21471 - DNA, 20 bp, Artificial Sequence
  Description of Artificial Sequence: Synthetic oligonucleotide
  Target: SCN10A; (-) strand; PAM type: NRG; PAM sequence: TAG
aggtacattcatgtggtaaa

SEQ ID NO: 21472 - DNA, 20 bp, Artificial Sequence
  Description of Artificial Sequence: Synthetic oligonucleotide
  Target: SCN10A; (-) strand; PAM type: NRG; PAM sequence: TGG
ttttcccaggtacattcatg

SEQ ID NO: 21473 - DNA, 20 bp, Artificial Sequence
  Description of Artificial Sequence: Synthetic oligonucleotide
  Target: SCN10A; (-) strand; PAM type: NRG; PAM sequence: AGG
catcctctccctcttttccc

SEQ ID NO: 21474 - DNA, 20 bp, Artificial Sequence
  Description of Artificial Sequence: Synthetic oligonucleotide
  Target: SCN10A; (-) strand; PAM type: NRG; PAM sequence: CAG
gcatcctctccctcttttcc

SEQ ID NO: 21475 - DNA, 20 bp, Artificial Sequence
  Description of Artificial Sequence: Synthetic oligonucleotide
  Target: SCN10A; (-) strand; PAM type: NRG; PAM sequence: AGG
ttattggagcccactcagga

SEQ ID NO: 21476 - DNA, 20 bp, Artificial Sequence
  Description of Artificial Sequence: Synthetic oligonucleotide
  Target: SCN10A; (-) strand; PAM type: NRG; PAM sequence: AAG
tttattggagcccactcagg

SEQ ID NO: 21477 - DNA, 20 bp, Artificial Sequence
  Description of Artificial Sequence: Synthetic oligonucleotide
  Target: SCN10A; (-) strand; PAM type: NRG; PAM sequence: AGG
tgatttattggagcccactc

SEQ ID NO: 21478 - DNA, 20 bp, Artificial Sequence
  Description of Artificial Sequence: Synthetic oligonucleotide
  Target: SCN10A; (-) strand; PAM type: NRG; PAM sequence: CAG
ttgatttattggagcccact

SEQ ID NO: 21479 - DNA, 20 bp, Artificial Sequence
  Description of Artificial Sequence: Synthetic oligonucleotide
  Target: SCN10A; (-) strand; PAM type: NRG; PAM sequence: GAG
taatgctaattgatttattg

SEQ ID NO: 21480 - DNA, 20 bp, Artificial Sequence
  Description of Artificial Sequence: Synthetic oligonucleotide
  Target: SCN10A; (-) strand; PAM type: NRG; PAM sequence: TGG
tttaatgctaattgatttat

SEQ ID NO: 21481 - DNA, 20 bp, Artificial Sequence
  Description of Artificial Sequence: Synthetic oligonucleotide
  Target: SCN10A; (-) strand; PAM type: NRG; PAM sequence: AAG
aagacagggaggcaccattt

SEQ ID NO: 21482 - DNA, 20 bp, Artificial Sequence
  Description of Artificial Sequence: Synthetic oligonucleotide
  Target: SCN10A; (-) strand; PAM type: NRG; PAM sequence: AGG
atgtatgtgcaaagacaggg

SEQ ID NO: 21483 - DNA, 20 bp, Artificial Sequence
  Description of Artificial Sequence: Synthetic oligonucleotide
  Target: SCN10A; (-) strand; PAM type: NRG; PAM sequence: GAG
catgtatgtgcaaagacagg

SEQ ID NO: 21484 - DNA, 20 bp, Artificial Sequence
  Description of Artificial Sequence: Synthetic oligonucleotide
  Target: SCN10A; (-) strand; PAM type: NRG; PAM sequence: GGG
aacatgtatgtgcaaagaca

SEQ ID NO: 21485 - DNA, 20 bp, Artificial Sequence
  Description of Artificial Sequence: Synthetic oligonucleotide
  Target: SCN10A; (-) strand; PAM type: NRG; PAM sequence: AGG
caacatgtatgtgcaaagac

SEQ ID NO: 21486 - DNA, 20 bp, Artificial Sequence
  Description of Artificial Sequence: Synthetic oligonucleotide
  Target: SCN10A; (-) strand; PAM type: NRG; PAM sequence: CAG
acaacatgtatgtgcaaaga

SEQ ID NO: 21487 - DNA, 20 bp, Artificial Sequence
  Description of Artificial Sequence: Synthetic oligonucleotide
  Target: SCN10A; (-) strand; PAM type: NRG; PAM sequence: AAG
aagaacaacatgtatgtgca

SEQ ID NO: 21488 - DNA, 20 bp, Artificial Sequence
  Description of Artificial Sequence: Synthetic oligonucleotide
  Target: SCN10A; (-) strand; PAM type: NRG; PAM sequence: AAG
aggagtattttcctggcaga

SEQ ID NO: 21489 - DNA, 20 bp, Artificial Sequence
  Description of Artificial Sequence: Synthetic oligonucleotide
  Target: SCN10A; (-) strand; PAM type: NRG; PAM sequence: CAG
ggggaggagtattttcctgg

SEQ ID NO: 21490 - DNA, 20 bp, Artificial Sequence
  Description of Artificial Sequence: Synthetic oligonucleotide
  Target: SCN10A; (-) strand; PAM type: NRG; PAM sequence: TGG
tttggggaggagtattttcc

SEQ ID NO: 21491 - DNA, 20 bp, Artificial Sequence
  Description of Artificial Sequence: Synthetic oligonucleotide
  Target: SCN10A; (-) strand; PAM type: NRG; PAM sequence: GAG
acttgagagagtttggggag

SEQ ID NO: 21492 - DNA, 20 bp, Artificial Sequence
  Description of Artificial Sequence: Synthetic oligonucleotide
  Target: SCN10A; (-) strand; PAM type: NRG; PAM sequence: AGG
agacttgagagagtttgggg

SEQ ID NO: 21493 - DNA, 20 bp, Artificial Sequence
  Description of Artificial Sequence: Synthetic oligonucleotide
  Target: SCN10A; (-) strand; PAM type: NRG; PAM sequence: GAG
aagacttgagagagtttggg

SEQ ID NO: 21494 - DNA, 20 bp, Artificial Sequence
  Description of Artificial Sequence: Synthetic oligonucleotide
  Target: SCN10A; (-) strand; PAM type: NRG; PAM sequence: GGG
tgaagacttgagagagtttg

SEQ ID NO: 21495 - DNA, 20 bp, Artificial Sequence
  Description of Artificial Sequence: Synthetic oligonucleotide
  Target: SCN10A; (-) strand; PAM type: NRG; PAM sequence: GGG
ttgaagacttgagagagttt

SEQ ID NO: 21496 - DNA, 20 bp, Artificial Sequence
  Description of Artificial Sequence: Synthetic oligonucleotide
  Target: SCN10A; (-) strand; PAM type: NRG; PAM sequence: TGG
attgaagacttgagagagtt

SEQ ID NO: 21497 - DNA, 20 bp, Artificial Sequence
  Description of Artificial Sequence: Synthetic oligonucleotide
  Target: SCN10A; (-) strand; PAM type: NRG; PAM sequence: GAG
tagtaattgaagacttgaga

SEQ ID NO: 21498 - DNA, 20 bp, Artificial Sequence
  Description of Artificial Sequence: Synthetic oligonucleotide
  Target: SCN10A; (-) strand; PAM type: NRG; PAM sequence: GAG
tctagtaattgaagacttga

SEQ ID NO: 21499 - DNA, 20 bp, Artificial Sequence
  Description of Artificial Sequence: Synthetic oligonucleotide
  Target: SCN10A; (-) strand; PAM type: NRG; PAM sequence: GAG
cttctagtaattgaagactt

SEQ ID NO: 21500 - DNA, 20 bp, Artificial Sequence
  Description of Artificial Sequence: Synthetic oligonucleotide
  Target: SCN10A; (-) strand; PAM type: NRG; PAM sequence: AAG
aggggttcttctagtaattg

SEQ ID NO: 21501 - DNA, 20 bp, Artificial Sequence
  Description of Artificial Sequence: Synthetic oligonucleotide
  Target: SCN10A; (-) strand; PAM type: NRG; PAM sequence: TAG
atagcatgtaggggttcttc

SEQ ID NO: 21502 - DNA, 20 bp, Artificial Sequence
  Description of Artificial Sequence: Synthetic oligonucleotide
  Target: SCN10A; (-) strand; PAM type: NRG; PAM sequence: GGG
caacaataaatagcatgtag

SEQ ID NO: 21503 - DNA, 20 bp, Artificial Sequence
  Description of Artificial Sequence: Synthetic oligonucleotide
  Target: SCN10A; (-) strand; PAM type: NRG; PAM sequence: GGG
tcaacaataaatagcatgta

SEQ ID NO: 21504 - DNA, 20 bp, Artificial Sequence
  Description of Artificial Sequence: Synthetic oligonucleotide
  Target: SCN10A; (-) strand; PAM type: NRG; PAM sequence: AGG
atcaacaataaatagcatgt

SEQ ID NO: 21505 - DNA, 20 bp, Artificial Sequence
  Description of Artificial Sequence: Synthetic oligonucleotide
  Target: SCN10A; (-) strand; PAM type: NRG; PAM sequence: TAG
gatcaacaataaatagcatg

SEQ ID NO: 21506 - DNA, 20 bp, Artificial Sequence
  Description of Artificial Sequence: Synthetic oligonucleotide
  Target: SCN10A; (-) strand; PAM type: NRG; PAM sequence: TAG
taattgggatcaacaataaa

SEQ ID NO: 21507 - DNA, 20 bp, Artificial Sequence
  Description of Artificial Sequence: Synthetic oligonucleotide
  Target: SCN10A; (-) strand; PAM type: NRG; PAM sequence: GGG
tcctggaggaaggcataatt

SEQ ID NO: 21508 - DNA, 20 bp, Artificial Sequence
  Description of Artificial Sequence: Synthetic oligonucleotide
  Target: SCN10A; (-) strand; PAM type: NRG; PAM sequence: TGG
ttcctggaggaaggcataat

SEQ ID NO: 21509 - DNA, 20 bp, Artificial Sequence
  Description of Artificial Sequence: Synthetic oligonucleotide
  Target: SCN10A; (-) strand; PAM type: NRG; PAM sequence: AGG
agaaaaggcttcctggagga

SEQ ID NO: 21510 - DNA, 20 bp, Artificial Sequence
  Description of Artificial Sequence: Synthetic oligonucleotide
  Target: SCN10A; (-) strand; PAM type: NRG; PAM sequence: AAG
cagaaaaggcttcctggagg

SEQ ID NO: 21511 - DNA, 20 bp, Artificial Sequence
  Description of Artificial Sequence: Synthetic oligonucleotide
  Target: SCN10A; (-) strand; PAM type: NRG; PAM sequence: AGG
tatcagaaaaggcttcctgg

SEQ ID NO: 21512 - DNA, 20 bp, Artificial Sequence
  Description of Artificial Sequence: Synthetic oligonucleotide
  Target: SCN10A; (-) strand; PAM type: NRG; PAM sequence: GAG
gtatcagaaaaggcttcctg

SEQ ID NO: 21513 - DNA, 20 bp, Artificial Sequence
  Description of Artificial Sequence: Synthetic oligonucleotide
  Target: SCN10A; (-) strand; PAM type: NRG; PAM sequence: TGG
aggtatcagaaaaggcttcc

SEQ ID NO: 21514 - DNA, 20 bp, Artificial Sequence
  Description of Artificial Sequence: Synthetic oligonucleotide
  Target: SCN10A; (-) strand; PAM type: NRG; PAM sequence: AGG
ggctggataggtatcagaaa

SEQ ID NO: 21515 - DNA, 20 bp, Artificial Sequence
  Description of Artificial Sequence: Synthetic oligonucleotide
  Target: SCN10A; (-) strand; PAM type: NRG; PAM sequence: AAG
gggctggataggtatcagaa

SEQ ID NO: 21516 - DNA, 20 bp, Artificial Sequence
  Description of Artificial Sequence: Synthetic oligonucleotide
  Target: SCN10A; (-) strand; PAM type: NRG; PAM sequence: CAG
ttatggggctggataggtat

SEQ ID NO: 21517 - DNA, 20 bp, Artificial Sequence
  Description of Artificial Sequence: Synthetic oligonucleotide
  Target: SCN10A; (-) strand; PAM type: NRG; PAM sequence: AGG
ccactcttatggggctggat

SEQ ID NO: 21518 - DNA, 20 bp, Artificial Sequence
  Description of Artificial Sequence: Synthetic oligonucleotide
  Target: SCN10A; (-) strand; PAM type: NRG; PAM sequence: TAG
tccactcttatggggctgga

SEQ ID NO: 21519 - DNA, 20 bp, Artificial Sequence
  Description of Artificial Sequence: Synthetic oligonucleotide
  Target: SCN10A; (-) strand; PAM type: NRG; PAM sequence: TGG
aacatccactcttatggggc

SEQ ID NO: 21520 - DNA, 20 bp, Artificial Sequence
  Description of Artificial Sequence: Synthetic oligonucleotide
  Target: SCN10A; (-) strand; PAM type: NRG; PAM sequence: GGG
aagaaacatccactcttatg

SEQ ID NO: 21521 - DNA, 20 bp, Artificial Sequence
  Description of Artificial Sequence: Synthetic oligonucleotide
  Target: SCN10A; (-) strand; PAM type: NRG; PAM sequence: GGG
gaagaaacatccactcttat

SEQ ID NO: 21522 - DNA, 20 bp, Artificial Sequence
  Description of Artificial Sequence: Synthetic oligonucleotide
  Target: SCN10A; (-) strand; PAM type: NRG; PAM sequence: TGG
ggaagaaacatccactctta

SEQ ID NO: 21523 - DNA, 20 bp, Artificial Sequence
  Description of Artificial Sequence: Synthetic oligonucleotide
  Target: SCN10A; (-) strand; PAM type: NRG; PAM sequence: AAG
tggtgttttgagaatcaggg

SEQ ID NO: 21524 - DNA, 20 bp, Artificial Sequence
  Description of Artificial Sequence: Synthetic oligonucleotide
  Target: SCN10A; (-) strand; PAM type: NRG; PAM sequence: GGG
acatggtgttttgagaatca

SEQ ID NO: 21525 - DNA, 20 bp, Artificial Sequence
  Description of Artificial Sequence: Synthetic oligonucleotide
  Target: SCN10A; (-) strand; PAM type: NRG; PAM sequence: AGG
tacatggtgttttgagaatc

SEQ ID NO: 21526 - DNA, 20 bp, Artificial Sequence
  Description of Artificial Sequence: Synthetic oligonucleotide
  Target: SCN10A; (-) strand; PAM type: NRG; PAM sequence: CAG
atacatggtgttttgagaat

SEQ ID NO: 21527 - DNA, 20 bp, Artificial Sequence
  Description of Artificial Sequence: Synthetic oligonucleotide
  Target: SCN10A; (-) strand; PAM type: NRG; PAM sequence: GAG
agacacatacatggtgtttt

SEQ ID NO: 21528 - DNA, 20 bp, Artificial Sequence
  Description of Artificial Sequence: Synthetic oligonucleotide
  Target: SCN10A; (-) strand; PAM type: NRG; PAM sequence: TGG
gtgtattagagacacataca

SEQ ID NO: 21529 - DNA, 20 bp, Artificial Sequence
  Description of Artificial Sequence: Synthetic oligonucleotide
  Target: SCN10A; (-) strand; PAM type: NRG; PAM sequence: GAG
atgtgttaaatagtgtatta

SEQ ID NO: 21530 - DNA, 20 bp, Artificial Sequence
  Description of Artificial Sequence: Synthetic oligonucleotide
  Target: SCN10A; (-) strand; PAM type: NRG; PAM sequence: TAG
ctatgtgttaaatagtgtat

SEQ ID NO: 21531 - DNA, 20 bp, Artificial Sequence
  Description of Artificial Sequence: Synthetic oligonucleotide
  Target: SCN10A; (-) strand; PAM type: NRG; PAM sequence: TAG
aaacacagctatgtgttaaa

SEQ ID NO: 21532 - DNA, 20 bp, Artificial Sequence
  Description of Artificial Sequence: Synthetic oligonucleotide
  Target: SCN10A; (-) strand; PAM type: NRG; PAM sequence: CAG
ggaggaggcagatataaaca

SEQ ID NO: 21533 - DNA, 20 bp, Artificial Sequence
  Description of Artificial Sequence: Synthetic oligonucleotide
  Target: SCN10A; (-) strand; PAM type: NRG; PAM sequence: CAG
ttccatttgggtggaggagg

SEQ ID NO: 21534 - DNA, 20 bp, Artificial Sequence
  Description of Artificial Sequence: Synthetic oligonucleotide
  Target: SCN10A; (-) strand; PAM type: NRG; PAM sequence: AGG
gatttccatttgggtggagg

SEQ ID NO: 21535 - DNA, 20 bp, Artificial Sequence
  Description of Artificial Sequence: Synthetic oligonucleotide
  Target: SCN10A; (-) strand; PAM type: NRG; PAM sequence: GAG
ggatttccatttgggtggag

SEQ ID NO: 21536 - DNA, 20 bp, Artificial Sequence
  Description of Artificial Sequence: Synthetic oligonucleotide
  Target: SCN10A; (-) strand; PAM type: NRG; PAM sequence: AGG
aaggatttccatttgggtgg

SEQ ID NO: 21537 - DNA, 20 bp, Artificial Sequence
  Description of Artificial Sequence: Synthetic oligonucleotide
  Target: SCN10A; (-) strand; PAM type: NRG; PAM sequence: GAG
taaggatttccatttgggtg

SEQ ID NO: 21538 - DNA, 20 bp, Artificial Sequence
  Description of Artificial Sequence: Synthetic oligonucleotide
  Target: SCN10A; (-) strand; PAM type: NRG; PAM sequence: TGG
cctaaggatttccatttggg

SEQ ID NO: 21539 - DNA, 20 bp, Artificial Sequence
  Description of Artificial Sequence: Synthetic oligonucleotide
  Target: SCN10A; (-) strand; PAM type: NRG; PAM sequence: GGG
ttccctaaggatttccattt

SEQ ID NO: 21540 - DNA, 20 bp, Artificial Sequence
  Description of Artificial Sequence: Synthetic oligonucleotide
  Target: SCN10A; (-) strand; PAM type: NRG; PAM sequence: TGG
tttccctaaggatttccatt

SEQ ID NO: 21541 - DNA, 20 bp, Artificial Sequence
  Description of Artificial Sequence: Synthetic oligonucleotide
  Target: SCN10A; (-) strand; PAM type: NRG; PAM sequence: AGG
agaacatgttcttttcccta

SEQ ID NO: 21542 - DNA, 20 bp, Artificial Sequence
  Description of Artificial Sequence: Synthetic oligonucleotide
  Target: SCN10A; (-) strand; PAM type: NRG; PAM sequence: AAG
tagaacatgttcttttccct

SEQ ID NO: 21543 - DNA, 20 bp, Artificial Sequence
  Description of Artificial Sequence: Synthetic oligonucleotide
  Target: SCN10A; (-) strand; PAM type: NRG; PAM sequence: TAG
gcttggtataaagagatgac

SEQ ID NO: 21544 - DNA, 20 bp, Artificial Sequence
  Description of Artificial Sequence: Synthetic oligonucleotide
  Target: SCN10A; (-) strand; PAM type: NRG; PAM sequence: GAG
tactaggtgcttggtataaa

SEQ ID NO: 21545 - DNA, 20 bp, Artificial Sequence
  Description of Artificial Sequence: Synthetic oligonucleotide
  Target: SCN10A; (-) strand; PAM type: NRG; PAM sequence: AAG
aatactaggtgcttggtata

SEQ ID NO: 21546 - DNA, 20 bp, Artificial Sequence
  Description of Artificial Sequence: Synthetic oligonucleotide
  Target: SCN10A; (-) strand; PAM type: NRG; PAM sequence: TGG
attcaacaatactaggtgct

SEQ ID NO: 21547 - DNA, 20 bp, Artificial Sequence
  Description of Artificial Sequence: Synthetic oligonucleotide
  Target: SCN10A; (-) strand; PAM type: NRG; PAM sequence: AGG
cttgttcattcaacaatact

SEQ ID NO: 21548 - DNA, 20 bp, Artificial Sequence
  Description of Artificial Sequence: Synthetic oligonucleotide
  Target: SCN10A; (-) strand; PAM type: NRG; PAM sequence: TAG
acttgttcattcaacaatac

SEQ ID NO: 21549 - DNA, 20 bp, Artificial Sequence
  Description of Artificial Sequence: Synthetic oligonucleotide
  Target: SCN10A; (-) strand; PAM type: NRG; PAM sequence: GAG
ctttcaaagggaaaaaagag

SEQ ID NO: 21550 - DNA, 20 bp, Artificial Sequence
  Description of Artificial Sequence: Synthetic oligonucleotide
  Target: SCN10A; (-) strand; PAM type: NRG; PAM sequence: AGG
tactttcaaagggaaaaaag

SEQ ID NO: 21551 - DNA, 20 bp, Artificial Sequence
  Description of Artificial Sequence: Synthetic oligonucleotide
  Target: SCN10A; (-) strand; PAM type: NRG; PAM sequence: GAG
ttactttcaaagggaaaaaa

SEQ ID NO: 21552 - DNA, 20 bp, Artificial Sequence
  Description of Artificial Sequence: Synthetic oligonucleotide
  Target: SCN10A; (-) strand; PAM type: NRG; PAM sequence: AAG
gcttactttcaaagggaaaa

SEQ ID NO: 21553 - DNA, 20 bp, Artificial Sequence
  Description of Artificial Sequence: Synthetic oligonucleotide
  Target: SCN10A; (-) strand; PAM type: NRG; PAM sequence: GGG
cagtgatgcttactttcaaa

SEQ ID NO: 21554 - DNA, 20 bp, Artificial Sequence
  Description of Artificial Sequence: Synthetic oligonucleotide
  Target: SCN10A; (-) strand; PAM type: NRG; PAM sequence: AGG
ccagtgatgcttactttcaa

SEQ ID NO: 21555 - DNA, 20 bp, Artificial Sequence
  Description of Artificial Sequence: Synthetic oligonucleotide
  Target: SCN10A; (-) strand; PAM type: NRG; PAM sequence: AAG
tccagtgatgcttactttca

SEQ ID NO: 21556 - DNA, 20 bp, Artificial Sequence
  Description of Artificial Sequence: Synthetic oligonucleotide
  Target: SCN10A; (-) strand; PAM type: NRG; PAM sequence: CAG
ggtatgtgtgcttgtctctc

SEQ ID NO: 21557 - DNA, 20 bp, Artificial Sequence
  Description of Artificial Sequence: Synthetic oligonucleotide
  Target: SCN10A; (-) strand; PAM type: NRG; PAM sequence: TGG
gcacttggatgtccaataat

SEQ ID NO: 21558 - DNA, 20 bp, Artificial Sequence
  Description of Artificial Sequence: Synthetic oligonucleotide
  Target: SCN10A; (-) strand; PAM type: NRG; PAM sequence: TGG
gccccacacagattagcact

SEQ ID NO: 21559 - DNA, 20 bp, Artificial Sequence
  Description of Artificial Sequence: Synthetic oligonucleotide
  Target: SCN10A; (-) strand; PAM type: NRG; PAM sequence: TAG
tctgtcagccccacacagat

SEQ ID NO: 21560 - DNA, 20 bp, Artificial Sequence
  Description of Artificial Sequence: Synthetic oligonucleotide
  Target: SCN10A; (-) strand; PAM type: NRG; PAM sequence: CAG
cccattctgtcagccccaca

SEQ ID NO: 21561 - DNA, 20 bp, Artificial Sequence
  Description of Artificial Sequence: Synthetic oligonucleotide
  Target: SCN10A; (-) strand; PAM type: NRG; PAM sequence: CAG
tttaatttcccccattctgt

SEQ ID NO: 21562 - DNA, 20 bp, Artificial Sequence
  Description of Artificial Sequence: Synthetic oligonucleotide
  Target: SCN10A; (-) strand; PAM type: NRG; PAM sequence: GGG
aatgtcaatgacactgaatt

SEQ ID NO: 21563 - DNA, 20 bp, Artificial Sequence
  Description of Artificial Sequence: Synthetic oligonucleotide
  Target: SCN10A; (-) strand; PAM type: NRG; PAM sequence: TGG
aaatgtcaatgacactgaat

SEQ ID NO: 21564 - DNA, 20 bp, Artificial Sequence
  Description of Artificial Sequence: Synthetic oligonucleotide
  Target: SCN10A; (-) strand; PAM type: NRG; PAM sequence: TGG
aggatgaatcacagcttcca

SEQ ID NO: 21565 - DNA, 20 bp, Artificial Sequence
  Description of Artificial Sequence: Synthetic oligonucleotide
  Target: SCN10A; (-) strand; PAM type: NRG; PAM sequence: CAG
tcacagaacaggatgaatca

SEQ ID NO: 21566 - DNA, 20 bp, Artificial Sequence
  Description of Artificial Sequence: Synthetic oligonucleotide
  Target: SCN10A; (-) strand; PAM type: NRG; PAM sequence: AGG
agttcagacaatcacagaac

SEQ ID NO: 21567 - DNA, 20 bp, Artificial Sequence
  Description of Artificial Sequence: Synthetic oligonucleotide
  Target: SCN10A; (-) strand; PAM type: NRG; PAM sequence: CAG
cagttcagacaatcacagaa

SEQ ID NO: 21568 - DNA, 20 bp, Artificial Sequence
  Description of Artificial Sequence: Synthetic oligonucleotide
  Target: SCN10A; (-) strand; PAM type: NRG; PAM sequence: CAG
gggcacagttcagacaatca

SEQ ID NO: 21569 - DNA, 20 bp, Artificial Sequence
  Description of Artificial Sequence: Synthetic oligonucleotide
  Target: SCN10A; (-) strand; PAM type: NRG; PAM sequence: CAG
ggcatacatggggcacagtt

SEQ ID NO: 21570 - DNA, 20 bp, Artificial Sequence
  Description of Artificial Sequence: Synthetic oligonucleotide
  Target: SCN10A; (-) strand; PAM type: NRG; PAM sequence: CAG
cacctggcatacatggggca

SEQ ID NO: 21571 - DNA, 20 bp, Artificial Sequence
  Description of Artificial Sequence: Synthetic oligonucleotide
  Target: SCN10A; (-) strand; PAM type: NRG; PAM sequence: GGG
agcagcacctggcatacatg

SEQ ID NO: 21572 - DNA, 20 bp, Artificial Sequence
  Description of Artificial Sequence: Synthetic oligonucleotide
  Target: SCN10A; (-) strand; PAM type: NRG; PAM sequence: GGG
gagcagcacctggcatacat

SEQ ID NO: 21573 - DNA, 20 bp, Artificial Sequence
  Description of Artificial Sequence: Synthetic oligonucleotide
  Target: SCN10A; (-) strand; PAM type: NRG; PAM sequence: TGG
tgagcagcacctggcataca

SEQ ID NO: 21574 - DNA, 20 bp, Artificial Sequence
  Description of Artificial Sequence: Synthetic oligonucleotide
  Target: SCN10A; (-) strand; PAM type: NRG; PAM sequence: TGG
tgccccttttgagcagcacc

SEQ ID NO: 21575 - DNA, 20 bp, Artificial Sequence
  Description of Artificial Sequence: Synthetic oligonucleotide
  Target: SCN10A; (-) strand; PAM type: NRG; PAM sequence: CAG
cttgctttgccccttttgag

SEQ ID NO: 21576 - DNA, 20 bp, Artificial Sequence
  Description of Artificial Sequence: Synthetic oligonucleotide
  Target: SCN10A; (-) strand; PAM type: NRG; PAM sequence: GAG
tttcttgctttgcccctttt

SEQ ID NO: 21577 - DNA, 20 bp, Artificial Sequence
  Description of Artificial Sequence: Synthetic oligonucleotide
  Target: SCN10A; (-) strand; PAM type: NRG; PAM sequence: CAG
ctcatgacacatccacactt

SEQ ID NO: 21578 - DNA, 20 bp, Artificial Sequence
  Description of Artificial Sequence: Synthetic oligonucleotide
  Target: SCN10A; (-) strand; PAM type: NRG; PAM sequence: CAG
tatgtgtgcatatacaaaca

SEQ ID NO: 21579 - DNA, 20 bp, Artificial Sequence
  Description of Artificial Sequence: Synthetic oligonucleotide
  Target: SCN10A; (-) strand; PAM type: NRG; PAM sequence: CAG
aataccatctctccaaccct

SEQ ID NO: 21580 - DNA, 20 bp, Artificial Sequence
  Description of Artificial Sequence: Synthetic oligonucleotide
  Target: SCN10A; (-) strand; PAM type: NRG; PAM sequence: AGG
cttttcctgtgctaagccga

SEQ ID NO: 21581 - DNA, 20 bp, Artificial Sequence
  Description of Artificial Sequence: Synthetic oligonucleotide
  Target: SCN10A; (-) strand; PAM type: NRG; PAM sequence: AAG
tcttttcctgtgctaagccg

SEQ ID NO: 21582 - DNA, 20 bp, Artificial Sequence
  Description of Artificial Sequence: Synthetic oligonucleotide
  Target: SCN10A; (-) strand; PAM type: NRG; PAM sequence: AAG
tcaatctcttttcctgtgct

SEQ ID NO: 21583 - DNA, 20 bp, Artificial Sequence
  Description of Artificial Sequence: Synthetic oligonucleotide
  Target: SCN10A; (-) strand; PAM type: NRG; PAM sequence: TGG
tgtggaaaaggggatcaaca

SEQ ID NO: 21584 - DNA, 20 bp, Artificial Sequence
  Description of Artificial Sequence: Synthetic oligonucleotide
  Target: SCN10A; (-) strand; PAM type: NRG; PAM sequence: GGG
acactaacagtgtggaaaag

SEQ ID NO: 21585 - DNA, 20 bp, Artificial Sequence
  Description of Artificial Sequence: Synthetic oligonucleotide
  Target: SCN10A; (-) strand; PAM type: NRG; PAM sequence: GGG
cacactaacagtgtggaaaa

SEQ ID NO: 21586 - DNA, 20 bp, Artificial Sequence
  Description of Artificial Sequence: Synthetic oligonucleotide
  Target: SCN10A; (-) strand; PAM type: NRG; PAM sequence: AGG
ccacactaacagtgtggaaa

SEQ ID NO: 21587 - DNA, 20 bp, Artificial Sequence
  Description of Artificial Sequence: Synthetic oligonucleotide
  Target: SCN10A; (-) strand; PAM type: NRG; PAM sequence: AAG
tccacactaacagtgtggaa

SEQ ID NO: 21588 - DNA, 20 bp, Artificial Sequence
  Description of Artificial Sequence: Synthetic oligonucleotide
  Target: SCN10A; (-) strand; PAM type: NRG; PAM sequence: TGG
gtggctccacactaacagtg

SEQ ID NO: 21589 - DNA, 20 bp, Artificial Sequence
  Description of Artificial Sequence: Synthetic oligonucleotide
  Target: SCN10A; (-) strand; PAM type: NRG; PAM sequence: CAG
ggagggtggctccacactaa

SEQ ID NO: 21590 - DNA, 20 bp, Artificial Sequence
  Description of Artificial Sequence: Synthetic oligonucleotide
  Target: SCN10A; (-) strand; PAM type: NRG; PAM sequence: TGG
atatctgctgtgtgggaggg

SEQ ID NO: 21591 - DNA, 20 bp, Artificial Sequence
  Description of Artificial Sequence: Synthetic oligonucleotide
  Target: SCN10A; (-) strand; PAM type: NRG; PAM sequence: GGG
ataatatctgctgtgtggga

SEQ ID NO: 21592 - DNA, 20 bp, Artificial Sequence
  Description of Artificial Sequence: Synthetic oligonucleotide
  Target: SCN10A; (-) strand; PAM type: NRG; PAM sequence: AGG
gataatatctgctgtgtggg

SEQ ID NO: 21593 - DNA, 20 bp, Artificial Sequence
  Description of Artificial Sequence: Synthetic oligonucleotide
  Target: SCN10A; (-) strand; PAM type: NRG; PAM sequence: GAG
agataatatctgctgtgtgg

SEQ ID NO: 21594 - DNA, 20 bp, Artificial Sequence
  Description of Artificial Sequence: Synthetic oligonucleotide
  Target: SCN10A; (-) strand; PAM type: NRG; PAM sequence: GGG
acagataatatctgctgtgt

SEQ ID NO: 21595 - DNA, 20 bp, Artificial Sequence
  Description of Artificial Sequence: Synthetic oligonucleotide
  Target: SCN10A; (-) strand; PAM type: NRG; PAM sequence: TGG
gacagataatatctgctgtg

SEQ ID NO: 21596 - DNA, 20 bp, Artificial Sequence
  Description of Artificial Sequence: Synthetic oligonucleotide
  Target: SCN10A; (-) strand; PAM type: NRG; PAM sequence: CAG
tgccctttctataggtctga

SEQ ID NO: 21597 - DNA, 20 bp, Artificial Sequence
  Description of Artificial Sequence: Synthetic oligonucleotide
  Target: SCN10A; (-) strand; PAM type: NRG; PAM sequence: AGG
cccaaatatgccctttctat

SEQ ID NO: 21598 - DNA, 20 bp, Artificial Sequence
  Description of Artificial Sequence: Synthetic oligonucleotide
  Target: SCN10A; (-) strand; PAM type: NRG; PAM sequence: TAG
ccccaaatatgccctttcta

SEQ ID NO: 21599 - DNA, 20 bp, Artificial Sequence
  Description of Artificial Sequence: Synthetic oligonucleotide
  Target: SCN10A; (-) strand; PAM type: NRG; PAM sequence: AAG
accaccttcctgccccttga

SEQ ID NO: 21600 - DNA, 20 bp, Artificial Sequence
  Description of Artificial Sequence: Synthetic oligonucleotide
  Target: SCN10A; (-) strand; PAM type: NRG; PAM sequence: TAG
gcacctcacctcagaccctg

SEQ ID NO: 21601 - DNA, 20 bp, Artificial Sequence
  Description of Artificial Sequence: Synthetic oligonucleotide
  Target: SCN10A; (-) strand; PAM type: NRG; PAM sequence: CAG
atggcttcagcacctcacct

SEQ ID NO: 21602 - DNA, 20 bp, Artificial Sequence
  Description of Artificial Sequence: Synthetic oligonucleotide
  Target: SCN10A; (-) strand; PAM type: NRG; PAM sequence: CAG
atccagcctgggaatggctt

SEQ ID NO: 21603 - DNA, 20 bp, Artificial Sequence
  Description of Artificial Sequence: Synthetic oligonucleotide
  Target: SCN10A; (-) strand; PAM type: NRG; PAM sequence: TGG
gacacaatccagcctgggaa

SEQ ID NO: 21604 - DNA, 20 bp, Artificial Sequence
  Description of Artificial Sequence: Synthetic oligonucleotide
  Target: SCN10A; (-) strand; PAM type: NRG; PAM sequence: GGG
tctgtgacacaatccagcct

SEQ ID NO: 21605 - DNA, 20 bp, Artificial Sequence
  Description of Artificial Sequence: Synthetic oligonucleotide
  Target: SCN10A; (-) strand; PAM type: NRG; PAM sequence: TGG
ctctgtgacacaatccagcc

SEQ ID NO: 21606 - DNA, 20 bp, Artificial Sequence
  Description of Artificial Sequence: Synthetic oligonucleotide
  Target: SCN10A; (-) strand; PAM type: NRG; PAM sequence: CAG
cccatctctgtgacacaatc

SEQ ID NO: 21607 - DNA, 20 bp, Artificial Sequence
  Description of Artificial Sequence: Synthetic oligonucleotide
  Target: SCN10A; (-) strand; PAM type: NRG; PAM sequence: CAG
gttgttatcagaaaagtttc

SEQ ID NO: 21608 - DNA, 20 bp, Artificial Sequence
  Description of Artificial Sequence: Synthetic oligonucleotide
  Target: SCN10A; (-) strand; PAM type: NRG; PAM sequence: AAG
gtcacctgttgttatcagaa

SEQ ID NO: 21609 - DNA, 20 bp, Artificial Sequence
  Description of Artificial Sequence: Synthetic oligonucleotide
  Target: SCN10A; (-) strand; PAM type: NRG; PAM sequence: CAG
aagctgtcacctgttgttat

SEQ ID NO: 21610 - DNA, 20 bp, Artificial Sequence
  Description of Artificial Sequence: Synthetic oligonucleotide
  Target: SCN10A; (-) strand; PAM type: NRG; PAM sequence: AAG
ttcctaaggtcctgcaattc

SEQ ID NO: 21611 - DNA, 20 bp, Artificial Sequence
  Description of Artificial Sequence: Synthetic oligonucleotide
  Target: SCN10A; (-) strand; PAM type: NRG; PAM sequence: AGG
aatttctgacctccttccta

SEQ ID NO: 21612 - DNA, 20 bp, Artificial Sequence
  Description of Artificial Sequence: Synthetic oligonucleotide
  Target: SCN10A; (-) strand; PAM type: NRG; PAM sequence: AAG
taatttctgacctccttcct

SEQ ID NO: 21613 - DNA, 20 bp, Artificial Sequence
  Description of Artificial Sequence: Synthetic oligonucleotide
  Target: SCN10A; (-) strand; PAM type: NRG; PAM sequence: GGG
cacaattttatataattatt

SEQ ID NO: 21614 - DNA, 20 bp, Artificial Sequence
  Description of Artificial Sequence: Synthetic oligonucleotide
  Target: SCN10A; (-) strand; PAM type: NRG; PAM sequence: TGG
tcacaattttatataattat

SEQ ID NO: 21615 - DNA, 20 bp, Artificial Sequence
  Description of Artificial Sequence: Synthetic oligonucleotide
  Target: SCN10A; (-) strand; PAM type: NRG; PAM sequence: TAG
gtggtttttatttttttact

SEQ ID NO: 21616 - DNA, 20 bp, Artificial Sequence
  Description of Artificial Sequence: Synthetic oligonucleotide
  Target: SCN10A; (-) strand; PAM type: NRG; PAM sequence: TGG
ttttttctgatgcgtcgagg

SEQ ID NO: 21617 - DNA, 20 bp, Artificial Sequence
  Description of Artificial Sequence: Synthetic oligonucleotide
  Target: SCN10A; (-) strand; PAM type: NRG; PAM sequence: AGG
tttttttttctgatgcgtcg

SEQ ID NO: 21618 - DNA, 20 bp, Artificial Sequence
  Description of Artificial Sequence: Synthetic oligonucleotide
  Target: SCN10A; (-) strand; PAM type: NRG; PAM sequence: GAG
ttttttttttctgatgcgtc

SEQ ID NO: 21619 - DNA, 20 bp, Artificial Sequence
  Description of Artificial Sequence: Synthetic oligonucleotide
  Target: SCN10A; (-) strand; PAM type: NRG; PAM sequence: GAG
ggttccctgtccgtggtgct

SEQ ID NO: 21620 - DNA, 20 bp, Artificial Sequence
  Description of Artificial Sequence: Synthetic oligonucleotide
  Target: SCN10A; (-) strand; PAM type: NRG; PAM sequence: TGG
agtgcaaggttccctgtccg

SEQ ID NO: 21621 - DNA, 20 bp, Artificial Sequence
  Description of Artificial Sequence: Synthetic oligonucleotide
  Target: SCN10A; (-) strand; PAM type: NRG; PAM sequence: AGG
gtctgcagttctagagtgca

SEQ ID NO: 21622 - DNA, 20 bp, Artificial Sequence
  Description of Artificial Sequence: Synthetic oligonucleotide
  Target: SCN10A; (-) strand; PAM type: NRG; PAM sequence: AAG
ggtctgcagttctagagtgc

SEQ ID NO: 21623 - DNA, 20 bp, Artificial Sequence
  Description of Artificial Sequence: Synthetic oligonucleotide
  Target: SCN10A; (-) strand; PAM type: NRG; PAM sequence: GAG
ggctctggtctgcagttcta

SEQ ID NO: 21624 - DNA, 20 bp, Artificial Sequence
  Description of Artificial Sequence: Synthetic oligonucleotide
  Target: SCN10A; (-) strand; PAM type: NRG; PAM sequence: TAG
gaggctctggtctgcagttc

SEQ ID NO: 21625 - DNA, 20 bp, Artificial Sequence
  Description of Artificial Sequence: Synthetic oligonucleotide
  Target: SCN10A; (-) strand; PAM type: NRG; PAM sequence: CAG
ccttctgaggctctggtctg

SEQ ID NO: 21626 - DNA, 20 bp, Artificial Sequence
  Description of Artificial Sequence: Synthetic oligonucleotide
  Target: SCN10A; (-) strand; PAM type: NRG; PAM sequence: TGG
tcagcttccttctgaggctc

SEQ ID NO: 21627 - DNA, 20 bp, Artificial Sequence
  Description of Artificial Sequence: Synthetic oligonucleotide
  Target: SCN10A; (-) strand; PAM type: NRG; PAM sequence: AGG
caaaggtcagcttccttctg

SEQ ID NO: 21628 - DNA, 20 bp, Artificial Sequence
  Description of Artificial Sequence: Synthetic oligonucleotide
  Target: SCN10A; (-) strand; PAM type: NRG; PAM sequence: GAG
tcaaaggtcagcttccttct

SEQ ID NO: 21629 - DNA, 20 bp, Artificial Sequence
  Description of Artificial Sequence: Synthetic oligonucleotide
  Target: SCN10A; (-) strand; PAM type: NRG; PAM sequence: CAG
tgtctgcggacatcaaaggt

SEQ ID NO: 21630 - DNA, 20 bp, Artificial Sequence
  Description of Artificial Sequence: Synthetic oligonucleotide
  Target: SCN10A; (-) strand; PAM type: NRG; PAM sequence: AGG
aaggtgtctgcggacatcaa

SEQ ID NO: 21631 - DNA, 20 bp, Artificial Sequence
  Description of Artificial Sequence: Synthetic oligonucleotide
  Target: SCN10A; (-) strand; PAM type: NRG; PAM sequence: AAG
taaggtgtctgcggacatca

SEQ ID NO: 21632 - DNA, 20 bp, Artificial Sequence
  Description of Artificial Sequence: Synthetic oligonucleotide
  Target: SCN10A; (-) strand; PAM type: NRG; PAM sequence: CGG
tgccaatcttaaggtgtctg

SEQ ID NO: 21633 - DNA, 20 bp, Artificial Sequence
  Description of Artificial Sequence: Synthetic oligonucleotide
  Target: SCN10A; (-) strand; PAM type: NRG; PAM sequence: AGG
tactgaacatgccaatctta

SEQ ID NO: 21634 - DNA, 20 bp, Artificial Sequence
  Description of Artificial Sequence: Synthetic oligonucleotide
  Target: SCN10A; (-) strand; PAM type: NRG; PAM sequence: AAG
atactgaacatgccaatctt

SEQ ID NO: 21635 - DNA, 20 bp, Artificial Sequence
  Description of Artificial Sequence: Synthetic oligonucleotide
  Target: SCN10A; (-) strand; PAM type: NRG; PAM sequence: AAG
cggtttgtaggaaaggtggg

SEQ ID NO: 21636 - DNA, 20 bp, Artificial Sequence
  Description of Artificial Sequence: Synthetic oligonucleotide
  Target: SCN10A; (-) strand; PAM type: NRG; PAM sequence: GGG
ccccggtttgtaggaaaggt

SEQ ID NO: 21637 - DNA, 20 bp, Artificial Sequence
  Description of Artificial Sequence: Synthetic oligonucleotide
  Target: SCN10A; (-) strand; PAM type: NRG; PAM sequence: TGG
accccggtttgtaggaaagg

SEQ ID NO: 21638 - DNA, 20 bp, Artificial Sequence
  Description of Artificial Sequence: Synthetic oligonucleotide
  Target: SCN10A; (-) strand; PAM type: NRG; PAM sequence: AGG
agaaccccggtttgtaggaa

SEQ ID NO: 21639 - DNA, 20 bp, Artificial Sequence
  Description of Artificial Sequence: Synthetic oligonucleotide
  Target: SCN10A; (-) strand; PAM type: NRG; PAM sequence: AAG
aagaaccccggtttgtagga

SEQ ID NO: 21640 - DNA, 20 bp, Artificial Sequence
  Description of Artificial Sequence: Synthetic oligonucleotide
  Target: SCN10A; (-) strand; PAM type: NRG; PAM sequence: AGG
gaggaagaaccccggtttgt

SEQ ID NO: 21641 - DNA, 20 bp, Artificial Sequence
  Description of Artificial Sequence: Synthetic oligonucleotide
  Target: SCN10A; (-) strand; PAM type: NRG; PAM sequence: TAG
ggaggaagaaccccggtttg

SEQ ID NO: 21642 - DNA, 20 bp, Artificial Sequence
  Description of Artificial Sequence: Synthetic oligonucleotide
  Target: SCN10A; (-) strand; PAM type: NRG; PAM sequence: CGG
ggacactggaggaagaaccc

SEQ ID NO: 21643 - DNA, 20 bp, Artificial Sequence
  Description of Artificial Sequence: Synthetic oligonucleotide
  Target: SCN10A; (-) strand; PAM type: NRG; PAM sequence: AAG
caagatgaggacactggagg

SEQ ID NO: 21644 - DNA, 20 bp, Artificial Sequence
  Description of Artificial Sequence: Synthetic oligonucleotide
  Target: SCN10A; (-) strand; PAM type: NRG; PAM sequence: AGG
ttccaagatgaggacactgg

SEQ ID NO: 21645 - DNA, 20 bp, Artificial Sequence
  Description of Artificial Sequence: Synthetic oligonucleotide
  Target: SCN10A; (-) strand; PAM type: NRG; PAM sequence: GAG
attccaagatgaggacactg

SEQ ID NO: 21646 - DNA, 20 bp, Artificial Sequence
  Description of Artificial Sequence: Synthetic oligonucleotide
  Target: SCN10A; (-) strand; PAM type: NRG; PAM sequence: TGG
tgattccaagatgaggacac

SEQ ID NO: 21647 - DNA, 20 bp, Artificial Sequence
  Description of Artificial Sequence: Synthetic oligonucleotide
  Target: SCN10A; (-) strand; PAM type: NRG; PAM sequence: AGG
tgggtggtgattccaagatg

SEQ ID NO: 21648 - DNA, 20 bp, Artificial Sequence
  Description of Artificial Sequence: Synthetic oligonucleotide
  Target: SCN10A; (-) strand; PAM type: NRG; PAM sequence: GAG
atgggtggtgattccaagat

SEQ ID NO: 21649 - DNA, 20 bp, Artificial Sequence
  Description of Artificial Sequence: Synthetic oligonucleotide
  Target: SCN10A; (-) strand; PAM type: NRG; PAM sequence: AAG
atcaaatgggtggtgattcc

SEQ ID NO: 21650 - DNA, 20 bp, Artificial Sequence
  Description of Artificial Sequence: Synthetic oligonucleotide
  Target: SCN10A; (-) strand; PAM type: NRG; PAM sequence: TGG
ggattgggcaatcaaatggg

SEQ ID NO: 21651 - DNA, 20 bp, Artificial Sequence
  Description of Artificial Sequence: Synthetic oligonucleotide
  Target: SCN10A; (-) strand; PAM type: NRG; PAM sequence: GGG
tcaggattgggcaatcaaat

SEQ ID NO: 21652 - DNA, 20 bp, Artificial Sequence
  Description of Artificial Sequence: Synthetic oligonucleotide
  Target: SCN10A; (-) strand; PAM type: NRG; PAM sequence: TGG
ttcaggattgggcaatcaaa

SEQ ID NO: 21653 - DNA, 20 bp, Artificial Sequence
  Description of Artificial Sequence: Synthetic oligonucleotide
  Target: SCN10A; (-) strand; PAM type: NRG; PAM sequence: GGG
gactcccaggtttcaggatt

SEQ ID NO: 21654 - DNA, 20 bp, Artificial Sequence
  Description of Artificial Sequence: Synthetic oligonucleotide
  Target: SCN10A; (-) strand; PAM type: NRG; PAM sequence: TGG
tgactcccaggtttcaggat

SEQ ID NO: 21655 - DNA, 20 bp, Artificial Sequence
  Description of Artificial Sequence: Synthetic oligonucleotide
  Target: SCN10A; (-) strand; PAM type: NRG; PAM sequence: AGG
caatttgactcccaggtttc

SEQ ID NO: 21656 - DNA, 20 bp, Artificial Sequence
  Description of Artificial Sequence: Synthetic oligonucleotide
  Target: SCN10A; (-) strand; PAM type: NRG; PAM sequence: CAG
ccaatttgactcccaggttt

SEQ ID NO: 21657 - DNA, 20 bp, Artificial Sequence
  Description of Artificial Sequence: Synthetic oligonucleotide
  Target: SCN10A; (-) strand; PAM type: NRG; PAM sequence: AGG
gggagtccaatttgactccc

SEQ ID NO: 21658 - DNA, 20 bp, Artificial Sequence
  Description of Artificial Sequence: Synthetic oligonucleotide
  Target: SCN10A; (-) strand; PAM type: NRG; PAM sequence: CAG
ggggagtccaatttgactcc

SEQ ID NO: 21659 - DNA, 20 bp, Artificial Sequence
  Description of Artificial Sequence: Synthetic oligonucleotide
  Target: SCN10A; (-) strand; PAM type: NRG; PAM sequence: GAG
actgtggaaaaaggaaaggg

SEQ ID NO: 21660 - DNA, 20 bp, Artificial Sequence
  Description of Artificial Sequence: Synthetic oligonucleotide
  Target: SCN10A; (-) strand; PAM type: NRG; PAM sequence: GGG
ggactgtggaaaaaggaaag

SEQ ID NO: 21661 - DNA, 20 bp, Artificial Sequence
  Description of Artificial Sequence: Synthetic oligonucleotide
  Target: SCN10A; (-) strand; PAM type: NRG; PAM sequence: GGG
tggactgtggaaaaaggaaa

SEQ ID NO: 21662 - DNA, 20 bp, Artificial Sequence
  Description of Artificial Sequence: Synthetic oligonucleotide
  Target: SCN10A; (-) strand; PAM type: NRG; PAM sequence: AGG
gtggactgtggaaaaaggaa

SEQ ID NO: 21663 - DNA, 20 bp, Artificial Sequence
  Description of Artificial Sequence: Synthetic oligonucleotide
  Target: SCN10A; (-) strand; PAM type: NRG; PAM sequence: AAG
tgtggactgtggaaaaagga

SEQ ID NO: 21664 - DNA, 20 bp, Artificial Sequence
  Description of Artificial Sequence: Synthetic oligonucleotide
  Target: SCN10A; (-) strand; PAM type: NRG; PAM sequence: AGG
ggattgtggactgtggaaaa

SEQ ID NO: 21665 - DNA, 20 bp, Artificial Sequence
  Description of Artificial Sequence: Synthetic oligonucleotide
  Target: SCN10A; (-) strand; PAM type: NRG; PAM sequence: AAG
gggattgtggactgtggaaa

SEQ ID NO: 21666 - DNA, 20 bp, Artificial Sequence
  Description of Artificial Sequence: Synthetic oligonucleotide
  Target: SCN10A; (-) strand; PAM type: NRG; PAM sequence: TGG
aagattgggattgtggactg

SEQ ID NO: 21667 - DNA, 20 bp, Artificial Sequence
  Description of Artificial Sequence: Synthetic oligonucleotide
  Target: SCN10A; (-) strand; PAM type: NRG; PAM sequence: TGG
gatcaacaagattgggattg

SEQ ID NO: 21668 - DNA, 20 bp, Artificial Sequence
  Description of Artificial Sequence: Synthetic oligonucleotide
  Target: SCN10A; (-) strand; PAM type: NRG; PAM sequence: GGG
ggaagtggatcaacaagatt

SEQ ID NO: 21669 - DNA, 20 bp, Artificial Sequence
  Description of Artificial Sequence: Synthetic oligonucleotide
  Target: SCN10A; (-) strand; PAM type: NRG; PAM sequence: TGG
gggaagtggatcaacaagat

SEQ ID NO: 21670 - DNA, 20 bp, Artificial Sequence
  Description of Artificial Sequence: Synthetic oligonucleotide
  Target: SCN10A; (-) strand; PAM type: NRG; PAM sequence: AAG
ccttagggaagtggatcaac

SEQ ID NO: 21671 - DNA, 20 bp, Artificial Sequence
  Description of Artificial Sequence: Synthetic oligonucleotide
  Target: SCN10A; (-) strand; PAM type: NRG; PAM sequence: TGG
ataaggacaccttagggaag

SEQ ID NO: 21672 - DNA, 20 bp, Artificial Sequence
  Description of Artificial Sequence: Synthetic oligonucleotide
  Target: SCN10A; (-) strand; PAM type: NRG; PAM sequence: AAG
attataaggacaccttaggg

SEQ ID NO: 21673 - DNA, 20 bp, Artificial Sequence
  Description of Artificial Sequence: Synthetic oligonucleotide
  Target: SCN10A; (-) strand; PAM type: NRG; PAM sequence: GGG
tgaattataaggacacctta

SEQ ID NO: 21674 - DNA, 20 bp, Artificial Sequence
  Description of Artificial Sequence: Synthetic oligonucleotide
  Target: SCN10A; (-) strand; PAM type: NRG; PAM sequence: AGG
gtgaattataaggacacctt

SEQ ID NO: 21675 - DNA, 20 bp, Artificial Sequence
  Description of Artificial Sequence: Synthetic oligonucleotide
  Target: SCN10A; (-) strand; PAM type: NRG; PAM sequence: TAG
ggtgaattataaggacacct

SEQ ID NO: 21676 - DNA, 20 bp, Artificial Sequence
  Description of Artificial Sequence: Synthetic oligonucleotide
  Target: SCN10A; (-) strand; PAM type: NRG; PAM sequence: AGG
gggaaaaggggtgaattata

SEQ ID NO: 21677 - DNA, 20 bp, Artificial Sequence
  Description of Artificial Sequence: Synthetic oligonucleotide
  Target: SCN10A; (-) strand; PAM type: NRG; PAM sequence: AAG
ggggaaaaggggtgaattat

SEQ ID NO: 21678 - DNA, 20 bp, Artificial Sequence
  Description of Artificial Sequence: Synthetic oligonucleotide
  Target: SCN10A; (-) strand; PAM type: NRG; PAM sequence: GGG
taattatagatggggaaaag

SEQ ID NO: 21679 - DNA, 20 bp, Artificial Sequence
  Description of Artificial Sequence: Synthetic oligonucleotide
  Target: SCN10A; (-) strand; PAM type: NRG; PAM sequence: GGG
gtaattatagatggggaaaa

SEQ ID NO: 21680 - DNA, 20 bp, Artificial Sequence
  Description of Artificial Sequence: Synthetic oligonucleotide
  Target: SCN10A; (-) strand; PAM type: NRG; PAM sequence: AGG
tgtaattatagatggggaaa

SEQ ID NO: 21681 - DNA, 20 bp, Artificial Sequence
  Description of Artificial Sequence: Synthetic oligonucleotide
  Target: SCN10A; (-) strand; PAM type: NRG; PAM sequence: AAG
gtgtaattatagatggggaa

SEQ ID NO: 21682 - DNA, 20 bp, Artificial Sequence
  Description of Artificial Sequence: Synthetic oligonucleotide
  Target: SCN10A; (-) strand; PAM type: NRG; PAM sequence: GGG
ggaaagtgtaattatagatg

SEQ ID NO: 21683 - DNA, 20 bp, Artificial Sequence
  Description of Artificial Sequence: Synthetic oligonucleotide
  Target: SCN10A; (-) strand; PAM type: NRG; PAM sequence: GGG
aggaaagtgtaattatagat

SEQ ID NO: 21684 - DNA, 20 bp, Artificial Sequence
  Description of Artificial Sequence: Synthetic oligonucleotide
  Target: SCN10A; (-) strand; PAM type: NRG; PAM sequence: TGG
taggaaagtgtaattataga

SEQ ID NO: 21685 - DNA, 20 bp, Artificial Sequence
  Description of Artificial Sequence: Synthetic oligonucleotide
  Target: SCN10A; (-) strand; PAM type: NRG; PAM sequence: TAG
aaactaggaaagtgtaatta

SEQ ID NO: 21686 - DNA, 20 bp, Artificial Sequence
  Description of Artificial Sequence: Synthetic oligonucleotide
  Target: SCN10A; (-) strand; PAM type: NRG; PAM sequence: AAG
aatggtgtcttaaactagga

SEQ ID NO: 21687 - DNA, 20 bp, Artificial Sequence
  Description of Artificial Sequence: Synthetic oligonucleotide
  Target: SCN10A; (-) strand; PAM type: NRG; PAM sequence: AGG
ccaaaatggtgtcttaaact

SEQ ID NO: 21688 - DNA, 20 bp, Artificial Sequence
  Description of Artificial Sequence: Synthetic oligonucleotide
  Target: SCN10A; (-) strand; PAM type: NRG; PAM sequence: TAG
tccaaaatggtgtcttaaac

SEQ ID NO: 21689 - DNA, 20 bp, Artificial Sequence
  Description of Artificial Sequence: Synthetic oligonucleotide
  Target: SCN10A; (-) strand; PAM type: NRG; PAM sequence: TGG
atccagacacccctccaaaa

SEQ ID NO: 21690 - DNA, 20 bp, Artificial Sequence
  Description of Artificial Sequence: Synthetic oligonucleotide
  Target: SCN10A; (-) strand; PAM type: NRG; PAM sequence: CAG
gcatagagcctaaaaggatc

SEQ ID NO: 21691 - DNA, 20 bp, Artificial Sequence
  Description of Artificial Sequence: Synthetic oligonucleotide
  Target: SCN10A; (-) strand; PAM type: NRG; PAM sequence: AGG
ctggaggcatagagcctaaa

SEQ ID NO: 21692 - DNA, 20 bp, Artificial Sequence
  Description of Artificial Sequence: Synthetic oligonucleotide
  Target: SCN10A; (-) strand; PAM type: NRG; PAM sequence: AAG
gctggaggcatagagcctaa

SEQ ID NO: 21693 - DNA, 20 bp, Artificial Sequence
  Description of Artificial Sequence: Synthetic oligonucleotide
  Target: SCN10A; (-) strand; PAM type: NRG; PAM sequence: GAG
gagaaagagctggaggcata

SEQ ID NO: 21694 - DNA, 20 bp, Artificial Sequence
  Description of Artificial Sequence: Synthetic oligonucleotide
  Target: SCN10A; (-) strand; PAM type: NRG; PAM sequence: TAG
cagagaaagagctggaggca

SEQ ID NO: 21695 - DNA, 20 bp, Artificial Sequence
  Description of Artificial Sequence: Synthetic oligonucleotide
  Target: SCN10A; (-) strand; PAM type: NRG; PAM sequence: AGG
tgtggcagagaaagagctgg

SEQ ID NO: 21696 - DNA, 20 bp, Artificial Sequence
  Description of Artificial Sequence: Synthetic oligonucleotide
  Target: SCN10A; (-) strand; PAM type: NRG; PAM sequence: GAG
gtgtggcagagaaagagctg

SEQ ID NO: 21697 - DNA, 20 bp, Artificial Sequence
  Description of Artificial Sequence: Synthetic oligonucleotide
  Target: SCN10A; (-) strand; PAM type: NRG; PAM sequence: TGG
gtgtgtggcagagaaagagc

SEQ ID NO: 21698 - DNA, 20 bp, Artificial Sequence
  Description of Artificial Sequence: Synthetic oligonucleotide
  Target: SCN10A; (-) strand; PAM type: NRG; PAM sequence: GAG
agaggtgtgtggcagagaaa

SEQ ID NO: 21699 - DNA, 20 bp, Artificial Sequence
  Description of Artificial Sequence: Synthetic oligonucleotide
  Target: SCN10A; (-) strand; PAM type: NRG; PAM sequence: AAG
gaagaggtgtgtggcagaga

SEQ ID NO: 21700 - DNA, 20 bp, Artificial Sequence
  Description of Artificial Sequence: Synthetic oligonucleotide
  Target: SCN10A; (-) strand; PAM type: NRG; PAM sequence: GAG
gtgggaagaggtgtgtggca

SEQ ID NO: 21701 - DNA, 20 bp, Artificial Sequence
  Description of Artificial Sequence: Synthetic oligonucleotide
  Target: SCN10A; (-) strand; PAM type: NRG; PAM sequence: CAG
gagtgggaagaggtgtgtgg

SEQ ID NO: 21702 - DNA, 20 bp, Artificial Sequence
  Description of Artificial Sequence: Synthetic oligonucleotide
  Target: SCN10A; (-) strand; PAM type: NRG; PAM sequence: TGG
ttggagtgggaagaggtgtg

SEQ ID NO: 21703 - DNA, 20 bp, Artificial Sequence
  Description of Artificial Sequence: Synthetic oligonucleotide
  Target: SCN10A; (-) strand; PAM type: NRG; PAM sequence: AGG
caatgagttggagtgggaag

SEQ ID NO: 21704 - DNA, 20 bp, Artificial Sequence
  Description of Artificial Sequence: Synthetic oligonucleotide
  Target: SCN10A; (-) strand; PAM type: NRG; PAM sequence: GAG
acaatgagttggagtgggaa

SEQ ID NO: 21705 - DNA, 20 bp, Artificial Sequence
  Description of Artificial Sequence: Synthetic oligonucleotide
  Target: SCN10A; (-) strand; PAM type: NRG; PAM sequence: AAG
agacaatgagttggagtggg

SEQ ID NO: 21706 - DNA, 20 bp, Artificial Sequence
  Description of Artificial Sequence: Synthetic oligonucleotide
  Target: SCN10A; (-) strand; PAM type: NRG; PAM sequence: GGG
cgtagacaatgagttggagt

SEQ ID NO: 21707 - DNA, 20 bp, Artificial Sequence
  Description of Artificial Sequence: Synthetic oligonucleotide
  Target: SCN10A; (-) strand; PAM type: NRG; PAM sequence: TGG
ccgtagacaatgagttggag

SEQ ID NO: 21708 - DNA, 20 bp, Artificial Sequence
  Description of Artificial Sequence: Synthetic oligonucleotide
  Target: SCN10A; (-) strand; PAM type: NRG; PAM sequence: GAG
ctgccgtagacaatgagttg

SEQ ID NO: 21709 - DNA, 20 bp, Artificial Sequence
  Description of Artificial Sequence: Synthetic oligonucleotide
  Target: SCN10A; (-) strand; PAM type: NRG; PAM sequence: TGG
agctgccgtagacaatgagt

SEQ ID NO: 21710 - DNA, 20 bp, Artificial Sequence
  Description of Artificial Sequence: Synthetic oligonucleotide
  Target: SCN10A; (-) strand; PAM type: NRG; PAM sequence: GAG
ttgcagctgccgtagacaat

SEQ ID NO: 21711 - DNA, 20 bp, Artificial Sequence
  Description of Artificial Sequence: Synthetic oligonucleotide
  Target: SCN10A; (-) strand; PAM type: NRG; PAM sequence: TAG
acccaccattgcagctgccg

SEQ ID NO: 21712 - DNA, 20 bp, Artificial Sequence
  Description of Artificial Sequence: Synthetic oligonucleotide
  Target: SCN10A; (-) strand; PAM type: NRG; PAM sequence: CAG
ctaaagattacccaccattg

SEQ ID NO: 21713 - DNA, 20 bp, Artificial Sequence
  Description of Artificial Sequence: Synthetic oligonucleotide
  Target: SCN10A; (-) strand; PAM type: NRG; PAM sequence: AAG
aggctcaggtttgtgctcta

SEQ ID NO: 21714 - DNA, 20 bp, Artificial Sequence
  Description of Artificial Sequence: Synthetic oligonucleotide
  Target: SCN10A; (-) strand; PAM type: NRG; PAM sequence: AGG
cgcaggatggtaagaggctc

SEQ ID NO: 21715 - DNA, 20 bp, Artificial Sequence
  Description of Artificial Sequence: Synthetic oligonucleotide
  Target: SCN10A; (-) strand; PAM type: NRG; PAM sequence: CAG
gcgcaggatggtaagaggct

SEQ ID NO: 21716 - DNA, 20 bp, Artificial Sequence
  Description of Artificial Sequence: Synthetic oligonucleotide
  Target: SCN10A; (-) strand; PAM type: NRG; PAM sequence: AGG
aaccagcgcaggatggtaag

SEQ ID NO: 21717 - DNA, 20 bp, Artificial Sequence
  Description of Artificial Sequence: Synthetic oligonucleotide
  Target: SCN10A; (-) strand; PAM type: NRG; PAM sequence: GAG
caaccagcgcaggatggtaa

SEQ ID NO: 21718 - DNA, 20 bp, Artificial Sequence
  Description of Artificial Sequence: Synthetic oligonucleotide
  Target: SCN10A; (-) strand; PAM type: NRG; PAM sequence: AAG
tacaaccagcgcaggatggt

SEQ ID NO: 21719 - DNA, 20 bp, Artificial Sequence
  Description of Artificial Sequence: Synthetic oligonucleotide
  Target: SCN10A; (-) strand; PAM type: NRG; PAM sequence: TGG
tccttacaaccagcgcagga

SEQ ID NO: 21720 - DNA, 20 bp, Artificial Sequence
  Description of Artificial Sequence: Synthetic oligonucleotide
  Target: SCN10A; (-) strand; PAM type: NRG; PAM sequence: AGG
ctgatccttacaaccagcgc

SEQ ID NO: 21721 - DNA, 20 bp, Artificial Sequence
  Description of Artificial Sequence: Synthetic oligonucleotide
  Target: SCN10A; (-) strand; PAM type: NRG; PAM sequence: CAG
tctgatccttacaaccagcg

SEQ ID NO: 21722 - DNA, 20 bp, Artificial Sequence
  Description of Artificial Sequence: Synthetic oligonucleotide
  Target: SCN10A; (-) strand; PAM type: NRG; PAM sequence: CAG
cccgctctgatccttacaac

SEQ ID NO: 21723 - DNA, 20 bp, Artificial Sequence
  Description of Artificial Sequence: Synthetic oligonucleotide
  Target: SCN10A; (-) strand; PAM type: NRG; PAM sequence: AAG
agtgtcagagggctccacag

SEQ ID NO: 21724 - DNA, 20 bp, Artificial Sequence
  Description of Artificial Sequence: Synthetic oligonucleotide
  Target: SCN10A; (-) strand; PAM type: NRG; PAM sequence: CAG
aagagtgtcagagggctcca

SEQ ID NO: 21725 - DNA, 20 bp, Artificial Sequence
  Description of Artificial Sequence: Synthetic oligonucleotide
  Target: SCN10A; (-) strand; PAM type: NRG; PAM sequence: GGG
ataaagccaagagtgtcaga

SEQ ID NO: 21726 - DNA, 20 bp, Artificial Sequence
  Description of Artificial Sequence: Synthetic oligonucleotide
  Target: SCN10A; (-) strand; PAM type: NRG; PAM sequence: AGG
aataaagccaagagtgtcag

SEQ ID NO: 21727 - DNA, 20 bp, Artificial Sequence
  Description of Artificial Sequence: Synthetic oligonucleotide
  Target: SCN10A; (-) strand; PAM type: NRG; PAM sequence: GAG
gaataaagccaagagtgtca

SEQ ID NO: 21728 - DNA, 20 bp, Artificial Sequence
  Description of Artificial Sequence: Synthetic oligonucleotide
  Target: SCN10A; (-) strand; PAM type: NRG; PAM sequence: CAG
tagaataaagccaagagtgt

SEQ ID NO: 21729 - DNA, 20 bp, Artificial Sequence
  Description of Artificial Sequence: Synthetic oligonucleotide
  Target: SCN10A; (-) strand; PAM type: NRG; PAM sequence: GAG
aaggcatagaataaagccaa

SEQ ID NO: 21730 - DNA, 20 bp, Artificial Sequence
  Description of Artificial Sequence: Synthetic oligonucleotide
  Target: SCN10A; (-) strand; PAM type: NRG; PAM sequence: AAG
agaaggcatagaataaagcc

SEQ ID NO: 21731 - DNA, 20 bp, Artificial Sequence
  Description of Artificial Sequence: Synthetic oligonucleotide
  Target: SCN10A; (-) strand; PAM type: NRG; PAM sequence: AAG
gtgagagaaggcatagaata

SEQ ID NO: 21732 - DNA, 20 bp, Artificial Sequence
  Description of Artificial Sequence: Synthetic oligonucleotide
  Target: SCN10A; (-) strand; PAM type: NRG; PAM sequence: TAG
aatgccagtgagagaaggca

SEQ ID NO: 21733 - DNA, 20 bp, Artificial Sequence
  Description of Artificial Sequence: Synthetic oligonucleotide
  Target: SCN10A; (-) strand; PAM type: NRG; PAM sequence: AGG
ccaaaaatgccagtgagaga

SEQ ID NO: 21734 - DNA, 20 bp, Artificial Sequence
  Description of Artificial Sequence: Synthetic oligonucleotide
  Target: SCN10A; (-) strand; PAM type: NRG; PAM sequence: AAG
tccaaaaatgccagtgagag

SEQ ID NO: 21735 - DNA, 20 bp, Artificial Sequence
  Description of Artificial Sequence: Synthetic oligonucleotide
  Target: SCN10A; (-) strand; PAM type: NRG; PAM sequence: GAG
acctccaaaaatgccagtga

SEQ ID NO: 21736 - DNA, 20 bp, Artificial Sequence
  Description of Artificial Sequence: Synthetic oligonucleotide
  Target: SCN10A; (-) strand; PAM type: NRG; PAM sequence: GAG
taacctccaaaaatgccagt

SEQ ID NO: 21737 - DNA, 20 bp, Artificial Sequence
  Description of Artificial Sequence: Synthetic oligonucleotide
  Target: SCN10A; (-) strand; PAM type: NRG; PAM sequence: CAG
cctttaacctccaaaaatgc

SEQ ID NO: 21738 - DNA, 20 bp, Artificial Sequence
  Description of Artificial Sequence: Synthetic oligonucleotide
  Target: SCN10A; (-) strand; PAM type: NRG; PAM sequence: TGG
acctctctccactcccacaa

SEQ ID NO: 21739 - DNA, 20 bp, Artificial Sequence
  Description of Artificial Sequence: Synthetic oligonucleotide
  Target: SCN10A; (-) strand; PAM type: NRG; PAM sequence: GGG
cgcaggtgctagcagcacta

SEQ ID NO: 21740 - DNA, 20 bp, Artificial Sequence
  Description of Artificial Sequence: Synthetic oligonucleotide
  Target: SCN10A; (-) strand; PAM type: NRG; PAM sequence: AGG
tcgcaggtgctagcagcact

SEQ ID NO: 21741 - DNA, 20 bp, Artificial Sequence
  Description of Artificial Sequence: Synthetic oligonucleotide
  Target: SCN10A; (-) strand; PAM type: NRG; PAM sequence: TAG
ttcgcaggtgctagcagcac

SEQ ID NO: 21742 - DNA, 20 bp, Artificial Sequence
  Description of Artificial Sequence: Synthetic oligonucleotide
  Target: SCN10A; (-) strand; PAM type: NRG; PAM sequence: CAG
tctctcttcgcaggtgctag

SEQ ID NO: 21743 - DNA, 20 bp, Artificial Sequence
  Description of Artificial Sequence: Synthetic oligonucleotide
  Target: SCN10A; (-) strand; PAM type: NRG; PAM sequence: TAG
tgttctctcttcgcaggtgc

SEQ ID NO: 21744 - DNA, 20 bp, Artificial Sequence
  Description of Artificial Sequence: Synthetic oligonucleotide
  Target: SCN10A; (-) strand; PAM type: NRG; PAM sequence: AGG
acctgctgttctctcttcgc

SEQ ID NO: 21745 - DNA, 20 bp, Artificial Sequence
  Description of Artificial Sequence: Synthetic oligonucleotide
  Target: SCN10A; (-) strand; PAM type: NRG; PAM sequence: CAG
cacctgctgttctctcttcg

SEQ ID NO: 21746 - DNA, 20 bp, Artificial Sequence
  Description of Artificial Sequence: Synthetic oligonucleotide
  Target: SCN10A; (-) strand; PAM type: NRG; PAM sequence: TGG
taagtccaagcaaatactat

SEQ ID NO: 21747 - DNA, 20 bp, Artificial Sequence
  Description of Artificial Sequence: Synthetic oligonucleotide
  Target: SCN10A; (-) strand; PAM type: NRG; PAM sequence: AAG
gacacattcatgctaagtcc

SEQ ID NO: 21748 - DNA, 20 bp, Artificial Sequence
  Description of Artificial Sequence: Synthetic oligonucleotide
  Target: SCN10A; (-) strand; PAM type: NRG; PAM sequence: AAG
ctgggggacacattcatgct

SEQ ID NO: 21749 - DNA, 20 bp, Artificial Sequence
  Description of Artificial Sequence: Synthetic oligonucleotide
  Target: SCN10A; (-) strand; PAM type: NRG; PAM sequence: GGG
ccctggcaccccatgtctgg

SEQ ID NO: 21750 - DNA, 20 bp, Artificial Sequence
  Description of Artificial Sequence: Synthetic oligonucleotide
  Target: SCN10A; (-) strand; PAM type: NRG; PAM sequence: GGG
cccctggcaccccatgtctg

SEQ ID NO: 21751 - DNA, 20 bp, Artificial Sequence
  Description of Artificial Sequence: Synthetic oligonucleotide
  Target: SCN10A; (-) strand; PAM type: NRG; PAM sequence: GGG
acccctggcaccccatgtct

SEQ ID NO: 21752 - DNA, 20 bp, Artificial Sequence
  Description of Artificial Sequence: Synthetic oligonucleotide
  Target: SCN10A; (-) strand; PAM type: NRG; PAM sequence: TGG
cacccctggcaccccatgtc

SEQ ID NO: 21753 - DNA, 20 bp, Artificial Sequence
  Description of Artificial Sequence: Synthetic oligonucleotide
  Target: SCN10A; (-) strand; PAM type: NRG; PAM sequence: TGG
tgtttcagatctctcacccc

SEQ ID NO: 21754 - DNA, 20 bp, Artificial Sequence
  Description of Artificial Sequence: Synthetic oligonucleotide
  Target: SCN10A; (-) strand; PAM type: NRG; PAM sequence: CAG
acccttcagcttctctgttt

SEQ ID NO: 21755 - DNA, 20 bp, Artificial Sequence
  Description of Artificial Sequence: Synthetic oligonucleotide
  Target: SCN10A; (-) strand; PAM type: NRG; PAM sequence: CAG
ccaccctggtcctaaccctt

SEQ ID NO: 21756 - DNA, 20 bp, Artificial Sequence
  Description of Artificial Sequence: Synthetic oligonucleotide
  Target: SCN10A; (-) strand; PAM type: NRG; PAM sequence: TGG
gcctaatcccaccaccaccc

SEQ ID NO: 21757 - DNA, 20 bp, Artificial Sequence
  Description of Artificial Sequence: Synthetic oligonucleotide
  Target: SCN10A; (-) strand; PAM type: NRG; PAM sequence: TGG
cgaggtgtctgttcctgcca

SEQ ID NO: 21758 - DNA, 20 bp, Artificial Sequence
  Description of Artificial Sequence: Synthetic oligonucleotide
  Target: SCN10A; (-) strand; PAM type: NRG; PAM sequence: AGG
gaatgagtgggggtgacccg

SEQ ID NO: 21759 - DNA, 20 bp, Artificial Sequence
  Description of Artificial Sequence: Synthetic oligonucleotide
  Target: SCN10A; (-) strand; PAM type: NRG; PAM sequence: GAG
tgaatgagtgggggtgaccc

SEQ ID NO: 21760 - DNA, 20 bp, Artificial Sequence
  Description of Artificial Sequence: Synthetic oligonucleotide
  Target: SCN10A; (-) strand; PAM type: NRG; PAM sequence: GGG
agtaccccatgaatgagtgg

SEQ ID NO: 21761 - DNA, 20 bp, Artificial Sequence
  Description of Artificial Sequence: Synthetic oligonucleotide
  Target: SCN10A; (-) strand; PAM type: NRG; PAM sequence: GGG
gagtaccccatgaatgagtg

SEQ ID NO: 21762 - DNA, 20 bp, Artificial Sequence
  Description of Artificial Sequence: Synthetic oligonucleotide
  Target: SCN10A; (-) strand; PAM type: NRG; PAM sequence: GGG
agagtaccccatgaatgagt

SEQ ID NO: 21763 - DNA, 20 bp, Artificial Sequence
  Description of Artificial Sequence: Synthetic oligonucleotide
  Target: SCN10A; (-) strand; PAM type: NRG; PAM sequence: TGG
cagagtaccccatgaatgag

SEQ ID NO: 21764 - DNA, 20 bp, Artificial Sequence
  Description of Artificial Sequence: Synthetic oligonucleotide
  Target: SCN10A; (-) strand; PAM type: NRG; PAM sequence: GAG
caacagagtaccccatgaat

SEQ ID NO: 21765 - DNA, 20 bp, Artificial Sequence
  Description of Artificial Sequence: Synthetic oligonucleotide
  Target: SCN10A; (-) strand; PAM type: NRG; PAM sequence: GAG
atctgggtggggcaccaaca

SEQ ID NO: 21766 - DNA, 20 bp, Artificial Sequence
  Description of Artificial Sequence: Synthetic oligonucleotide
  Target: SCN10A; (-) strand; PAM type: NRG; PAM sequence: CAG
ggatctgggtggggcaccaa

SEQ ID NO: 21767 - DNA, 20 bp, Artificial Sequence
  Description of Artificial Sequence: Synthetic oligonucleotide
  Target: SCN10A; (-) strand; PAM type: NRG; PAM sequence: GGG
tggtgaaagggatctgggtg

SEQ ID NO: 21768 - DNA, 20 bp, Artificial Sequence
  Description of Artificial Sequence: Synthetic oligonucleotide
  Target: SCN10A; (-) strand; PAM type: NRG; PAM sequence: GGG
ctggtgaaagggatctgggt

SEQ ID NO: 21769 - DNA, 20 bp, Artificial Sequence
  Description of Artificial Sequence: Synthetic oligonucleotide
  Target: SCN10A; (-) strand; PAM type: NRG; PAM sequence: TGG
cctggtgaaagggatctggg

SEQ ID NO: 21770 - DNA, 20 bp, Artificial Sequence
  Description of Artificial Sequence: Synthetic oligonucleotide
  Target: SCN10A; (-) strand; PAM type: NRG; PAM sequence: GGG
tgacctggtgaaagggatct

SEQ ID NO: 21771 - DNA, 20 bp, Artificial Sequence
  Description of Artificial Sequence: Synthetic oligonucleotide
  Target: SCN10A; (-) strand; PAM type: NRG; PAM sequence: TGG
ctgacctggtgaaagggatc

SEQ ID NO: 21772 - DNA, 20 bp, Artificial Sequence
  Description of Artificial Sequence: Synthetic oligonucleotide
  Target: SCN10A; (-) strand; PAM type: NRG; PAM sequence: GGG
gctgtgctgacctggtgaaa

SEQ ID NO: 21773 - DNA, 20 bp, Artificial Sequence
  Description of Artificial Sequence: Synthetic oligonucleotide
  Target: SCN10A; (-) strand; PAM type: NRG; PAM sequence: AGG
agctgtgctgacctggtgaa

SEQ ID NO: 21774 - DNA, 20 bp, Artificial Sequence
  Description of Artificial Sequence: Synthetic oligonucleotide
  Target: SCN10A; (-) strand; PAM type: NRG; PAM sequence: AAG
tagctgtgctgacctggtga

SEQ ID NO: 21775 - DNA, 20 bp, Artificial Sequence
  Description of Artificial Sequence: Synthetic oligonucleotide
  Target: SCN10A; (-) strand; PAM type: NRG; PAM sequence: TGG
tcgggatagctgtgctgacc

SEQ ID NO: 21776 - DNA, 20 bp, Artificial Sequence
  Description of Artificial Sequence: Synthetic oligonucleotide
  Target: SCN10A; (-) strand; PAM type: NRG; PAM sequence: TAG
gccatgcaagcagctcggga

SEQ ID NO: 21777 - DNA, 20 bp, Artificial Sequence
  Description of Artificial Sequence: Synthetic oligonucleotide
  Target: SCN10A; (-) strand; PAM type: NRG; PAM sequence: GGG
tgctgccatgcaagcagctc

SEQ ID NO: 21778 - DNA, 20 bp, Artificial Sequence
  Description of Artificial Sequence: Synthetic oligonucleotide
  Target: SCN10A; (-) strand; PAM type: NRG; PAM sequence: CGG
ctgctgccatgcaagcagct

SEQ ID NO: 21779 - DNA, 20 bp, Artificial Sequence
  Description of Artificial Sequence: Synthetic oligonucleotide
  Target: SCN10A; (-) strand; PAM type: NRG; PAM sequence: CAG
atcagctgctgccatgcaag

SEQ ID NO: 21780 - DNA, 20 bp, Artificial Sequence
  Description of Artificial Sequence: Synthetic oligonucleotide
  Target: SCN10A; (-) strand; PAM type: NRG; PAM sequence: AAG
gccatcagctgctgccatgc

SEQ ID NO: 21781 - DNA, 20 bp, Artificial Sequence
  Description of Artificial Sequence: Synthetic oligonucleotide
  Target: SCN10A; (-) strand; PAM type: NRG; PAM sequence: CAG
atgctgcaagtatgagccat

SEQ ID NO: 21782 - DNA, 20 bp, Artificial Sequence
  Description of Artificial Sequence: Synthetic oligonucleotide
  Target: SCN10A; (-) strand; PAM type: NRG; PAM sequence: GAG
ttgtagaatgctgcaagtat

SEQ ID NO: 21783 - DNA, 20 bp, Artificial Sequence
  Description of Artificial Sequence: Synthetic oligonucleotide
  Target: SCN10A; (-) strand; PAM type: NRG; PAM sequence: AAG
ctttttttgtagaatgctgc

SEQ ID NO: 21784 - DNA, 20 bp, Artificial Sequence
  Description of Artificial Sequence: Synthetic oligonucleotide
  Target: SCN10A; (-) strand; PAM type: NRG; PAM sequence: TAG
gccaaaagagactttttttg

SEQ ID NO: 21785 - DNA, 20 bp, Artificial Sequence
  Description of Artificial Sequence: Synthetic oligonucleotide
  Target: SCN10A; (-) strand; PAM type: NRG; PAM sequence: GAG
ccagaagcaggcagccaaaa

SEQ ID NO: 21786 - DNA, 20 bp, Artificial Sequence
  Description of Artificial Sequence: Synthetic oligonucleotide
  Target: SCN10A; (-) strand; PAM type: NRG; PAM sequence: AAG
tcccagaagcaggcagccaa

SEQ ID NO: 21787 - DNA, 20 bp, Artificial Sequence
  Description of Artificial Sequence: Synthetic oligonucleotide
  Target: SCN10A; (-) strand; PAM type: NRG; PAM sequence: CAG
atacctatcccagaagcagg

SEQ ID NO: 21788 - DNA, 20 bp, Artificial Sequence
  Description of Artificial Sequence: Synthetic oligonucleotide
  Target: SCN10A; (-) strand; PAM type: NRG; PAM sequence: AGG
cccatacctatcccagaagc

SEQ ID NO: 21789 - DNA, 20 bp, Artificial Sequence
  Description of Artificial Sequence: Synthetic oligonucleotide
  Target: SCN10A; (-) strand; PAM type: NRG; PAM sequence: CAG
ccccatacctatcccagaag

SEQ ID NO: 21790 - DNA, 20 bp, Artificial Sequence
  Description of Artificial Sequence: Synthetic oligonucleotide
  Target: SCN10A; (-) strand; PAM type: NRG; PAM sequence: AAG
cctccccatacctatcccag

SEQ ID NO: 21791 - DNA, 20 bp, Artificial Sequence
  Description of Artificial Sequence: Synthetic oligonucleotide
  Target: SCN10A; (-) strand; PAM type: NRG; PAM sequence: CAG
taccctccccatacctatcc

SEQ ID NO: 21792 - DNA, 20 bp, Artificial Sequence
  Description of Artificial Sequence: Synthetic oligonucleotide
  Target: SCN10A; (-) strand; PAM type: NRG; PAM sequence: CAG
ctaccttgaggcaagggggc

SEQ ID NO: 21793 - DNA, 20 bp, Artificial Sequence
  Description of Artificial Sequence: Synthetic oligonucleotide
  Target: SCN10A; (-) strand; PAM type: NRG; PAM sequence: GGG
agtcctaccttgaggcaagg

SEQ ID NO: 21794 - DNA, 20 bp, Artificial Sequence
  Description of Artificial Sequence: Synthetic oligonucleotide
  Target: SCN10A; (-) strand; PAM type: NRG; PAM sequence: GGG
tagtcctaccttgaggcaag

SEQ ID NO: 21795 - DNA, 20 bp, Artificial Sequence
  Description of Artificial Sequence: Synthetic oligonucleotide
  Target: SCN10A; (-) strand; PAM type: NRG; PAM sequence: GGG
ttagtcctaccttgaggcaa

SEQ ID NO: 21796 - DNA, 20 bp, Artificial Sequence
  Description of Artificial Sequence: Synthetic oligonucleotide
  Target: SCN10A; (-) strand; PAM type: NRG; PAM sequence: AGG
gttagtcctaccttgaggca

SEQ ID NO: 21797 - DNA, 20 bp, Artificial Sequence
  Description of Artificial Sequence: Synthetic oligonucleotide
  Target: SCN10A; (-) strand; PAM type: NRG; PAM sequence: AAG
agttagtcctaccttgaggc

SEQ ID NO: 21798 - DNA, 20 bp, Artificial Sequence
  Description of Artificial Sequence: Synthetic oligonucleotide
  Target: SCN10A; (-) strand; PAM type: NRG; PAM sequence: AGG
ccacagttagtcctaccttg

SEQ ID NO: 21799 - DNA, 20 bp, Artificial Sequence
  Description of Artificial Sequence: Synthetic oligonucleotide
  Target: SCN10A; (-) strand; PAM type: NRG; PAM sequence: GAG
accacagttagtcctacctt

SEQ ID NO: 21800 - DNA, 20 bp, Artificial Sequence
  Description of Artificial Sequence: Synthetic oligonucleotide
  Target: SCN10A; (-) strand; PAM type: NRG; PAM sequence: TAG
ggcatgacctgtaccacagt

SEQ ID NO: 21801 - DNA, 20 bp, Artificial Sequence
  Description of Artificial Sequence: Synthetic oligonucleotide
  Target: SCN10A; (-) strand; PAM type: NRG; PAM sequence: CAG
ctggggcatgacctgtacca

SEQ ID NO: 21802 - DNA, 20 bp, Artificial Sequence
  Description of Artificial Sequence: Synthetic oligonucleotide
  Target: SCN10A; (-) strand; PAM type: NRG; PAM sequence: GGG
tgatcccatggggaactctg

SEQ ID NO: 21803 - DNA, 20 bp, Artificial Sequence
  Description of Artificial Sequence: Synthetic oligonucleotide
  Target: SCN10A; (-) strand; PAM type: NRG; PAM sequence: GGG
ttgatcccatggggaactct

SEQ ID NO: 21804 - DNA, 20 bp, Artificial Sequence
  Description of Artificial Sequence: Synthetic oligonucleotide
  Target: SCN10A; (-) strand; PAM type: NRG; PAM sequence: TGG
cttgatcccatggggaactc

SEQ ID NO: 21805 - DNA, 20 bp, Artificial Sequence
  Description of Artificial Sequence: Synthetic oligonucleotide
  Target: SCN10A; (-) strand; PAM type: NRG; PAM sequence: GGG
agcttcagcttgatcccatg

SEQ ID NO: 21806 - DNA, 20 bp, Artificial Sequence
  Description of Artificial Sequence: Synthetic oligonucleotide
  Target: SCN10A; (-) strand; PAM type: NRG; PAM sequence: GGG
cagcttcagcttgatcccat

SEQ ID NO: 21807 - DNA, 20 bp, Artificial Sequence
  Description of Artificial Sequence: Synthetic oligonucleotide
  Target: SCN10A; (-) strand; PAM type: NRG; PAM sequence: TGG
ccagcttcagcttgatccca

SEQ ID NO: 21808 - DNA, 20 bp, Artificial Sequence
  Description of Artificial Sequence: Synthetic oligonucleotide
  Target: SCN10A; (-) strand; PAM type: NRG; PAM sequence: CAG
tctcagctagagaccagctt

SEQ ID NO: 21809 - DNA, 20 bp, Artificial Sequence
  Description of Artificial Sequence: Synthetic oligonucleotide
  Target: SCN10A; (-) strand; PAM type: NRG; PAM sequence: CAG
gagtgttctcagctagagac

SEQ ID NO: 21810 - DNA, 20 bp, Artificial Sequence
  Description of Artificial Sequence: Synthetic oligonucleotide
  Target: SCN10A; (-) strand; PAM type: NRG; PAM sequence: GAG
acaaggagtgttctcagcta

SEQ ID NO: 21811 - DNA, 20 bp, Artificial Sequence
  Description of Artificial Sequence: Synthetic oligonucleotide
  Target: SCN10A; (-) strand; PAM type: NRG; PAM sequence: TAG
aaacaaggagtgttctcagc

SEQ ID NO: 21812 - DNA, 20 bp, Artificial Sequence
  Description of Artificial Sequence: Synthetic oligonucleotide
  Target: SCN10A; (-) strand; PAM type: NRG; PAM sequence: CAG
aactaaacaaggagtgttct

SEQ ID NO: 21813 - DNA, 20 bp, Artificial Sequence
  Description of Artificial Sequence: Synthetic oligonucleotide
  Target: SCN10A; (-) strand; PAM type: NRG; PAM sequence: GAG
agagggtggaactaaacaag

SEQ ID NO: 21814 - DNA, 20 bp, Artificial Sequence
  Description of Artificial Sequence: Synthetic oligonucleotide
  Target: SCN10A; (-) strand; PAM type: NRG; PAM sequence: AGG
gcagagggtggaactaaaca

SEQ ID NO: 21815 - DNA, 20 bp, Artificial Sequence
  Description of Artificial Sequence: Synthetic oligonucleotide
  Target: SCN10A; (-) strand; PAM type: NRG; PAM sequence: AAG
ggcagagggtggaactaaac

SEQ ID NO: 21816 - DNA, 20 bp, Artificial Sequence
  Description of Artificial Sequence: Synthetic oligonucleotide
  Target: SCN10A; (-) strand; PAM type: NRG; PAM sequence: TGG
aaacagaatggggcagaggg

SEQ ID NO: 21817 - DNA, 20 bp, Artificial Sequence
  Description of Artificial Sequence: Synthetic oligonucleotide
  Target: SCN10A; (-) strand; PAM type: NRG; PAM sequence: GGG
gcaaaacagaatggggcaga

SEQ ID NO: 21818 - DNA, 20 bp, Artificial Sequence
  Description of Artificial Sequence: Synthetic oligonucleotide
  Target: SCN10A; (-) strand; PAM type: NRG; PAM sequence: AGG
agcaaaacagaatggggcag

SEQ ID NO: 21819 - DNA, 20 bp, Artificial Sequence
  Description of Artificial Sequence: Synthetic oligonucleotide
  Target: SCN10A; (-) strand; PAM type: NRG; PAM sequence: GAG
aagcaaaacagaatggggca

SEQ ID NO: 21820 - DNA, 20 bp, Artificial Sequence
  Description of Artificial Sequence: Synthetic oligonucleotide
  Target: SCN10A; (-) strand; PAM type: NRG; PAM sequence: CAG
tgaagcaaaacagaatgggg

SEQ ID NO: 21821 - DNA, 20 bp, Artificial Sequence
  Description of Artificial Sequence: Synthetic oligonucleotide
  Target: SCN10A; (-) strand; PAM type: NRG; PAM sequence: GGG
gaatgaagcaaaacagaatg

SEQ ID NO: 21822 - DNA, 20 bp, Artificial Sequence
  Description of Artificial Sequence: Synthetic oligonucleotide
  Target: SCN10A; (-) strand; PAM type: NRG; PAM sequence: GGG
cgaatgaagcaaaacagaat

SEQ ID NO: 21823 - DNA, 20 bp, Artificial Sequence
  Description of Artificial Sequence: Synthetic oligonucleotide
  Target: SCN10A; (-) strand; PAM type: NRG; PAM sequence: TGG
gcgaatgaagcaaaacagaa

SEQ ID NO: 21824 - DNA, 20 bp, Artificial Sequence
  Description of Artificial Sequence: Synthetic oligonucleotide
  Target: SCN10A; (-) strand; PAM type: NRG; PAM sequence: CAG
agaaagcgaatgaagcaaaa

SEQ ID NO: 21825 - DNA, 20 bp, Artificial Sequence
  Description of Artificial Sequence: Synthetic oligonucleotide
  Target: SCN10A; (-) strand; PAM type: NRG; PAM sequence: AAG
ctctcaggagaaagcgaatg

SEQ ID NO: 21826 - DNA, 20 bp, Artificial Sequence
  Description of Artificial Sequence: Synthetic oligonucleotide
  Target: SCN10A; (-) strand; PAM type: NRG; PAM sequence: AAG
gagggagtgctctcaggaga

SEQ ID NO: 21827 - DNA, 20 bp, Artificial Sequence
  Description of Artificial Sequence: Synthetic oligonucleotide
  Target: SCN10A; (-) strand; PAM type: NRG; PAM sequence: GAG
tattgagggagtgctctcag

SEQ ID NO: 21828 - DNA, 20 bp, Artificial Sequence
  Description of Artificial Sequence: Synthetic oligonucleotide
  Target: SCN10A; (-) strand; PAM type: NRG; PAM sequence: AGG
cctattgagggagtgctctc

SEQ ID NO: 21829 - DNA, 20 bp, Artificial Sequence
  Description of Artificial Sequence: Synthetic oligonucleotide
  Target: SCN10A; (-) strand; PAM type: NRG; PAM sequence: CAG
acctattgagggagtgctct

SEQ ID NO: 21830 - DNA, 20 bp, Artificial Sequence
  Description of Artificial Sequence: Synthetic oligonucleotide
  Target: SCN10A; (-) strand; PAM type: NRG; PAM sequence: GAG
gtgcaagtgacctattgagg

SEQ ID NO: 21831 - DNA, 20 bp, Artificial Sequence
  Description of Artificial Sequence: Synthetic oligonucleotide
  Target: SCN10A; (-) strand; PAM type: NRG; PAM sequence: GGG
ttgtgcaagtgacctattga

SEQ ID NO: 21832 - DNA, 20 bp, Artificial Sequence
  Description of Artificial Sequence: Synthetic oligonucleotide
  Target: SCN10A; (-) strand; PAM type: NRG; PAM sequence: AGG
cttgtgcaagtgacctattg

SEQ ID NO: 21833 - DNA, 20 bp, Artificial Sequence
  Description of Artificial Sequence: Synthetic oligonucleotide
  Target: SCN10A; (-) strand; PAM type: NRG; PAM sequence: GAG
tcttgtgcaagtgacctatt

SEQ ID NO: 21834 - DNA, 20 bp, Artificial Sequence
  Description of Artificial Sequence: Synthetic oligonucleotide
  Target: SCN10A; (-) strand; PAM type: NRG; PAM sequence: AAG
ctaagtgaggattcttgtgc

SEQ ID NO: 21835 - DNA, 20 bp, Artificial Sequence
  Description of Artificial Sequence: Synthetic oligonucleotide
  Target: SCN10A; (-) strand; PAM type: NRG; PAM sequence: AGG
ctcaaagaagaagctaagtg

SEQ ID NO: 21836 - DNA, 20 bp, Artificial Sequence
  Description of Artificial Sequence: Synthetic oligonucleotide
  Target: SCN10A; (-) strand; PAM type: NRG; PAM sequence: GAG
tctcaaagaagaagctaagt

SEQ ID NO: 21837 - DNA, 20 bp, Artificial Sequence
  Description of Artificial Sequence: Synthetic oligonucleotide
  Target: SCN10A; (-) strand; PAM type: NRG; PAM sequence: AAG
gttttctcaaagaagaagct

SEQ ID NO: 21838 - DNA, 20 bp, Artificial Sequence
  Description of Artificial Sequence: Synthetic oligonucleotide
  Target: SCN10A; (-) strand; PAM type: NRG; PAM sequence: AAG
atcaggttttctcaaagaag

SEQ ID NO: 21839 - DNA, 20 bp, Artificial Sequence
  Description of Artificial Sequence: Synthetic oligonucleotide
  Target: SCN10A; (-) strand; PAM type: NRG; PAM sequence: AAG
tagatcaggttttctcaaag

SEQ ID NO: 21840 - DNA, 20 bp, Artificial Sequence
  Description of Artificial Sequence: Synthetic oligonucleotide
  Target: SCN10A; (-) strand; PAM type: NRG; PAM sequence: AAG
tattagatcaggttttctca

SEQ ID NO: 21841 - DNA, 20 bp, Artificial Sequence
  Description of Artificial Sequence: Synthetic oligonucleotide
  Target: SCN10A; (-) strand; PAM type: NRG; PAM sequence: AGG
ctcagggaccatattagatc

SEQ ID NO: 21842 - DNA, 20 bp, Artificial Sequence
  Description of Artificial Sequence: Synthetic oligonucleotide
  Target: SCN10A; (-) strand; PAM type: NRG; PAM sequence: CAG
cctcagggaccatattagat

SEQ ID NO: 21843 - DNA, 20 bp, Artificial Sequence
  Description of Artificial Sequence: Synthetic oligonucleotide
  Target: SCN10A; (-) strand; PAM type: NRG; PAM sequence: TAG
tcttgcctcagggaccatat

SEQ ID NO: 21844 - DNA, 20 bp, Artificial Sequence
  Description of Artificial Sequence: Synthetic oligonucleotide
  Target: SCN10A; (-) strand; PAM type: NRG; PAM sequence: GGG
ggaggaatcatcttgcctca

SEQ ID NO: 21845 - DNA, 20 bp, Artificial Sequence
  Description of Artificial Sequence: Synthetic oligonucleotide
  Target: SCN10A; (-) strand; PAM type: NRG; PAM sequence: AGG
aggaggaatcatcttgcctc

SEQ ID NO: 21846 - DNA, 20 bp, Artificial Sequence
  Description of Artificial Sequence: Synthetic oligonucleotide
  Target: SCN10A; (-) strand; PAM type: NRG; PAM sequence: CAG
taggaggaatcatcttgcct

SEQ ID NO: 21847 - DNA, 20 bp, Artificial Sequence
  Description of Artificial Sequence: Synthetic oligonucleotide
  Target: SCN10A; (-) strand; PAM type: NRG; PAM sequence: AGG
accgtttagggagctatagg

SEQ ID NO: 21848 - DNA, 20 bp, Artificial Sequence
  Description of Artificial Sequence: Synthetic oligonucleotide
  Target: SCN10A; (-) strand; PAM type: NRG; PAM sequence: GAG
caccgtttagggagctatag

SEQ ID NO: 21849 - DNA, 20 bp, Artificial Sequence
  Description of Artificial Sequence: Synthetic oligonucleotide
  Target: SCN10A; (-) strand; PAM type: NRG; PAM sequence: AGG
ggcaccgtttagggagctat

SEQ ID NO: 21850 - DNA, 20 bp, Artificial Sequence
  Description of Artificial Sequence: Synthetic oligonucleotide
  Target: SCN10A; (-) strand; PAM type: NRG; PAM sequence: TAG
gggcaccgtttagggagcta

SEQ ID NO: 21851 - DNA, 20 bp, Artificial Sequence
  Description of Artificial Sequence: Synthetic oligonucleotide
  Target: SCN10A; (-) strand; PAM type: NRG; PAM sequence: GAG
caattagggcaccgtttagg

SEQ ID NO: 21852 - DNA, 20 bp, Artificial Sequence
  Description of Artificial Sequence: Synthetic oligonucleotide
  Target: SCN10A; (-) strand; PAM type: NRG; PAM sequence: GGG
ttcaattagggcaccgttta

SEQ ID NO: 21853 - DNA, 20 bp, Artificial Sequence
  Description of Artificial Sequence: Synthetic oligonucleotide
  Target: SCN10A; (-) strand; PAM type: NRG; PAM sequence: AGG
cttcaattagggcaccgttt

SEQ ID NO: 21854 - DNA, 20 bp, Artificial Sequence
  Description of Artificial Sequence: Synthetic oligonucleotide
  Target: SCN10A; (-) strand; PAM type: NRG; PAM sequence: TAG
acttcaattagggcaccgtt

SEQ ID NO: 21855 - DNA, 20 bp, Artificial Sequence
  Description of Artificial Sequence: Synthetic oligonucleotide
  Target: SCN10A; (-) strand; PAM type: NRG; PAM sequence: GGG
tggactagccacttcaatta

SEQ ID NO: 21856 - DNA, 20 bp, Artificial Sequence
  Description of Artificial Sequence: Synthetic oligonucleotide
  Target: SCN10A; (-) strand; PAM type: NRG; PAM sequence: AGG
ctggactagccacttcaatt

SEQ ID NO: 21857 - DNA, 20 bp, Artificial Sequence
  Description of Artificial Sequence: Synthetic oligonucleotide
  Target: SCN10A; (-) strand; PAM type: NRG; PAM sequence: TAG
tctggactagccacttcaat

SEQ ID NO: 21858 - DNA, 20 bp, Artificial Sequence
  Description of Artificial Sequence: Synthetic oligonucleotide
  Target: SCN10A; (-) strand; PAM type: NRG; PAM sequence: TAG
tcttggatactgttctggac

SEQ ID NO: 21859 - DNA, 20 bp, Artificial Sequence
  Description of Artificial Sequence: Synthetic oligonucleotide
  Target: SCN10A; (-) strand; PAM type: NRG; PAM sequence: TGG
tccattcttggatactgttc

SEQ ID NO: 21860 - DNA, 20 bp, Artificial Sequence
  Description of Artificial Sequence: Synthetic oligonucleotide
  Target: SCN10A; (-) strand; PAM type: NRG; PAM sequence: TGG
ggttgcagactgtccattct

SEQ ID NO: 21861 - DNA, 20 bp, Artificial Sequence
  Description of Artificial Sequence: Synthetic oligonucleotide
  Target: SCN10A; (-) strand; PAM type: NRG; PAM sequence: CAG
aagctttgtgaagaaggttg

SEQ ID NO: 21862 - DNA, 20 bp, Artificial Sequence
  Description of Artificial Sequence: Synthetic oligonucleotide
  Target: SCN10A; (-) strand; PAM type: NRG; PAM sequence: AGG
gagtggaagctttgtgaaga

SEQ ID NO: 21863 - DNA, 20 bp, Artificial Sequence
  Description of Artificial Sequence: Synthetic oligonucleotide
  Target: SCN10A; (-) strand; PAM type: NRG; PAM sequence: AAG
ggagtggaagctttgtgaag

SEQ ID NO: 21864 - DNA, 20 bp, Artificial Sequence
  Description of Artificial Sequence: Synthetic oligonucleotide
  Target: SCN10A; (-) strand; PAM type: NRG; PAM sequence: AAG
tgaggagtggaagctttgtg

SEQ ID NO: 21865 - DNA, 20 bp, Artificial Sequence
  Description of Artificial Sequence: Synthetic oligonucleotide
  Target: SCN10A; (-) strand; PAM type: NRG; PAM sequence: AAG
aggaggtttgtgaggagtgg

SEQ ID NO: 21866 - DNA, 20 bp, Artificial Sequence
  Description of Artificial Sequence: Synthetic oligonucleotide
  Target: SCN10A; (-) strand; PAM type: NRG; PAM sequence: TGG
agcaggaggtttgtgaggag

SEQ ID NO: 21867 - DNA, 20 bp, Artificial Sequence
  Description of Artificial Sequence: Synthetic oligonucleotide
  Target: SCN10A; (-) strand; PAM type: NRG; PAM sequence: GAG
aggagcaggaggtttgtgag

SEQ ID NO: 21868 - DNA, 20 bp, Artificial Sequence
  Description of Artificial Sequence: Synthetic oligonucleotide
  Target: SCN10A; (-) strand; PAM type: NRG; PAM sequence: AGG
gaaggagcaggaggtttgtg

SEQ ID NO: 21869 - DNA, 20 bp, Artificial Sequence
  Description of Artificial Sequence: Synthetic oligonucleotide
  Target: SCN10A; (-) strand; PAM type: NRG; PAM sequence: GAG
ggaaggagcaggaggtttgt

SEQ ID NO: 21870 - DNA, 20 bp, Artificial Sequence
  Description of Artificial Sequence: Synthetic oligonucleotide
  Target: SCN10A; (-) strand; PAM type: NRG; PAM sequence: AGG
gatgctccggaaggagcagg

SEQ ID NO: 21871 - DNA, 20 bp, Artificial Sequence
  Description of Artificial Sequence: Synthetic oligonucleotide
  Target: SCN10A; (-) strand; PAM type: NRG; PAM sequence: GAG
agatgctccggaaggagcag

SEQ ID NO: 21872 - DNA, 20 bp, Artificial Sequence
  Description of Artificial Sequence: Synthetic oligonucleotide
  Target: SCN10A; (-) strand; PAM type: NRG; PAM sequence: AGG
cgagatgctccggaaggagc

SEQ ID NO: 21873 - DNA, 20 bp, Artificial Sequence
  Description of Artificial Sequence: Synthetic oligonucleotide
  Target: SCN10A; (-) strand; PAM type: NRG; PAM sequence: CAG
tcgagatgctccggaaggag

SEQ ID NO: 21874 - DNA, 20 bp, Artificial Sequence
  Description of Artificial Sequence: Synthetic oligonucleotide
  Target: SCN10A; (-) strand; PAM type: NRG; PAM sequence: GAG
ccctcgagatgctccggaag

SEQ ID NO: 21875 - DNA, 20 bp, Artificial Sequence
  Description of Artificial Sequence: Synthetic oligonucleotide
  Target: SCN10A; (-) strand; PAM type: NRG; PAM sequence: AGG
ggccctcgagatgctccgga

SEQ ID NO: 21876 - DNA, 20 bp, Artificial Sequence
  Description of Artificial Sequence: Synthetic oligonucleotide
  Target: SCN10A; (-) strand; PAM type: NRG; PAM sequence: AAG
aggccctcgagatgctccgg

SEQ ID NO: 21877 - DNA, 20 bp, Artificial Sequence
  Description of Artificial Sequence: Synthetic oligonucleotide
  Target: SCN10A; (-) strand; PAM type: NRG; PAM sequence: CGG
aggaggccctcgagatgctc

SEQ ID NO: 21878 - DNA, 20 bp, Artificial Sequence
  Description of Artificial Sequence: Synthetic oligonucleotide
  Target: SCN10A; (-) strand; PAM type: NRG; PAM sequence: GAG
agaagttccaggaggccctc

SEQ ID NO: 21879 - DNA, 20 bp, Artificial Sequence
  Description of Artificial Sequence: Synthetic oligonucleotide
  Target: SCN10A; (-) strand; PAM type: NRG; PAM sequence: AGG
aaaggagaagaagttccagg

SEQ ID NO: 21880 - DNA, 20 bp, Artificial Sequence
  Description of Artificial Sequence: Synthetic oligonucleotide
  Target: SCN10A; (-) strand; PAM type: NRG; PAM sequence: GAG
caaaggagaagaagttccag

SEQ ID NO: 21881 - DNA, 20 bp, Artificial Sequence
  Description of Artificial Sequence: Synthetic oligonucleotide
  Target: SCN10A; (-) strand; PAM type: NRG; PAM sequence: AGG
agcaaaggagaagaagttcc

SEQ ID NO: 21882 - DNA, 20 bp, Artificial Sequence
  Description of Artificial Sequence: Synthetic oligonucleotide
  Target: SCN10A; (-) strand; PAM type: NRG; PAM sequence: CAG
aagcaaaggagaagaagttc

SEQ ID NO: 21883 - DNA, 20 bp, Artificial Sequence
  Description of Artificial Sequence: Synthetic oligonucleotide
  Target: SCN10A; (-) strand; PAM type: NRG; PAM sequence: AAG
aaattgaagcaaaggagaag

SEQ ID NO: 21884 - DNA, 20 bp, Artificial Sequence
  Description of Artificial Sequence: Synthetic oligonucleotide
  Target: SCN10A; (-) strand; PAM type: NRG; PAM sequence: AAG
atgaaattgaagcaaaggag

SEQ ID NO: 21885 - DNA, 20 bp, Artificial Sequence
  Description of Artificial Sequence: Synthetic oligonucleotide
  Target: SCN10A; (-) strand; PAM type: NRG; PAM sequence: GAG
ctgatgaaattgaagcaaag

SEQ ID NO: 21886 - DNA, 20 bp, Artificial Sequence
  Description of Artificial Sequence: Synthetic oligonucleotide
  Target: SCN10A; (-) strand; PAM type: NRG; PAM sequence: AGG
cactgatgaaattgaagcaa

SEQ ID NO: 21887 - DNA, 20 bp, Artificial Sequence
  Description of Artificial Sequence: Synthetic oligonucleotide
  Target: SCN10A; (-) strand; PAM type: NRG; PAM sequence: AAG
ccactgatgaaattgaagca

SEQ ID NO: 21888 - DNA, 20 bp, Artificial Sequence
  Description of Artificial Sequence: Synthetic oligonucleotide
  Target: SCN10A; (-) strand; PAM type: NRG; PAM sequence: AAG
ggcaaccactgatgaaattg

SEQ ID NO: 21889 - DNA, 20 bp, Artificial Sequence
  Description of Artificial Sequence: Synthetic oligonucleotide
  Target: SCN10A; (-) strand; PAM type: NRG; PAM sequence: AGG
ggcgtatgaggagcagaacc

SEQ ID NO: 21890 - DNA, 20 bp, Artificial Sequence
  Description of Artificial Sequence: Synthetic oligonucleotide
  Target: SCN10A; (-) strand; PAM type: NRG; PAM sequence: CAG
tggcgtatgaggagcagaac

SEQ ID NO: 21891 - DNA, 20 bp, Artificial Sequence
  Description of Artificial Sequence: Synthetic oligonucleotide
  Target: SCN10A; (-) strand; PAM type: NRG; PAM sequence: CAG
tcaccatggcgtatgaggag

SEQ ID NO: 21892 - DNA, 20 bp, Artificial Sequence
  Description of Artificial Sequence: Synthetic oligonucleotide
  Target: SCN10A; (-) strand; PAM type: NRG; PAM sequence: GAG
tagtcaccatggcgtatgag

SEQ ID NO: 21893 - DNA, 20 bp, Artificial Sequence
  Description of Artificial Sequence: Synthetic oligonucleotide
  Target: SCN10A; (-) strand; PAM type: NRG; PAM sequence: AGG
tgtagtcaccatggcgtatg

SEQ ID NO: 21894 - DNA, 20 bp, Artificial Sequence
  Description of Artificial Sequence: Synthetic oligonucleotide
  Target: SCN10A; (-) strand; PAM type: NRG; PAM sequence: GAG
ctgtagtcaccatggcgtat

SEQ ID NO: 21895 - DNA, 20 bp, Artificial Sequence
  Description of Artificial Sequence: Synthetic oligonucleotide
  Target: SCN10A; (-) strand; PAM type: NRG; PAM sequence: TGG
gatcttggctgtagtcacca

SEQ ID NO: 21896 - DNA, 20 bp, Artificial Sequence
  Description of Artificial Sequence: Synthetic oligonucleotide
  Target: SCN10A; (-) strand; PAM type: NRG; PAM sequence: TAG
ggtcaacttgatcttggctg

SEQ ID NO: 21897 - DNA, 20 bp, Artificial Sequence
  Description of Artificial Sequence: Synthetic oligonucleotide
  Target: SCN10A; (-) strand; PAM type: NRG; PAM sequence: TGG
ctacctggtcaacttgatct

SEQ ID NO: 21898 - DNA, 20 bp, Artificial Sequence
  Description of Artificial Sequence: Synthetic oligonucleotide
  Target: SCN10A; (-) strand; PAM type: NRG; PAM sequence: TGG
cttcctgggatctttctacc

SEQ ID NO: 21899 - DNA, 20 bp, Artificial Sequence
  Description of Artificial Sequence: Synthetic oligonucleotide
  Target: SCN10A; (-) strand; PAM type: NRG; PAM sequence: GGG
tttgtgctcgtaatcttcct

SEQ ID NO: 21900 - DNA, 20 bp, Artificial Sequence
  Description of Artificial Sequence: Synthetic oligonucleotide
  Target: SCN10A; (-) strand; PAM type: NRG; PAM sequence: TGG
ttttgtgctcgtaatcttcc

SEQ ID NO: 21901 - DNA, 20 bp, Artificial Sequence
  Description of Artificial Sequence: Synthetic oligonucleotide
  Target: SCN10A; (-) strand; PAM type: NRG; PAM sequence: GGG
tgcagaccctgaggacttct

SEQ ID NO: 21902 - DNA, 20 bp, Artificial Sequence
  Description of Artificial Sequence: Synthetic oligonucleotide
  Target: SCN10A; (-) strand; PAM type: NRG; PAM sequence: TGG
ctgcagaccctgaggacttc

SEQ ID NO: 21903 - DNA, 20 bp, Artificial Sequence
  Description of Artificial Sequence: Synthetic oligonucleotide
  Target: SCN10A; (-) strand; PAM type: NRG; PAM sequence: AGG
ccttgaacctgcagaccctg

SEQ ID NO: 21904 - DNA, 20 bp, Artificial Sequence
  Description of Artificial Sequence: Synthetic oligonucleotide
  Target: SCN10A; (-) strand; PAM type: NRG; PAM sequence: GAG
cccttgaacctgcagaccct

SEQ ID NO: 21905 - DNA, 20 bp, Artificial Sequence
  Description of Artificial Sequence: Synthetic oligonucleotide
  Target: SCN10A; (-) strand; PAM type: NRG; PAM sequence: CAG
tcttctttcccttgaacctg

SEQ ID NO: 21906 - DNA, 20 bp, Artificial Sequence
  Description of Artificial Sequence: Synthetic oligonucleotide
  Target: SCN10A; (-) strand; PAM type: NRG; PAM sequence: AGG
ggtccatgtgctatgggtac

SEQ ID NO: 21907 - DNA, 20 bp, Artificial Sequence
  Description of Artificial Sequence: Synthetic oligonucleotide
  Target: SCN10A; (-) strand; PAM type: NRG; PAM sequence: CAG
gggtccatgtgctatgggta

SEQ ID NO: 21908 - DNA, 20 bp, Artificial Sequence
  Description of Artificial Sequence: Synthetic oligonucleotide
  Target: SCN10A; (-) strand; PAM type: NRG; PAM sequence: GGG
ttcaggggtccatgtgctat

SEQ ID NO: 21909 - DNA, 20 bp, Artificial Sequence
  Description of Artificial Sequence: Synthetic oligonucleotide
  Target: SCN10A; (-) strand; PAM type: NRG; PAM sequence: TGG
attcaggggtccatgtgcta

SEQ ID NO: 21910 - DNA, 20 bp, Artificial Sequence
  Description of Artificial Sequence: Synthetic oligonucleotide
  Target: SCN10A; (-) strand; PAM type: NRG; PAM sequence: GGG
ggaggctgacttaaattcag

SEQ ID NO: 21911 - DNA, 20 bp, Artificial Sequence
  Description of Artificial Sequence: Synthetic oligonucleotide
  Target: SCN10A; (-) strand; PAM type: NRG; PAM sequence: GGG
aggaggctgacttaaattca

SEQ ID NO: 21912 - DNA, 20 bp, Artificial Sequence
  Description of Artificial Sequence: Synthetic oligonucleotide
  Target: SCN10A; (-) strand; PAM type: NRG; PAM sequence: AGG
gaggaggctgacttaaattc

SEQ ID NO: 21913 - DNA, 20 bp, Artificial Sequence
  Description of Artificial Sequence: Synthetic oligonucleotide
  Target: SCN10A; (-) strand; PAM type: NRG; PAM sequence: CAG
ggaggaggctgacttaaatt

SEQ ID NO: 21914 - DNA, 20 bp, Artificial Sequence
  Description of Artificial Sequence: Synthetic oligonucleotide
  Target: SCN10A; (-) strand; PAM type: NRG; PAM sequence: AGG
ggctgtgcttttcctggagg

SEQ ID NO: 21915 - DNA, 20 bp, Artificial Sequence
  Description of Artificial Sequence: Synthetic oligonucleotide
  Target: SCN10A; (-) strand; PAM type: NRG; PAM sequence: GAG
tggctgtgcttttcctggag

SEQ ID NO: 21916 - DNA, 20 bp, Artificial Sequence
  Description of Artificial Sequence: Synthetic oligonucleotide
  Target: SCN10A; (-) strand; PAM type: NRG; PAM sequence: AGG
catggctgtgcttttcctgg

SEQ ID NO: 21917 - DNA, 20 bp, Artificial Sequence
  Description of Artificial Sequence: Synthetic oligonucleotide
  Target: SCN10A; (-) strand; PAM type: NRG; PAM sequence: GAG
gcatggctgtgcttttcctg

SEQ ID NO: 21918 - DNA, 20 bp, Artificial Sequence
  Description of Artificial Sequence: Synthetic oligonucleotide
  Target: SCN10A; (-) strand; PAM type: NRG; PAM sequence: TGG
ctgcatggctgtgcttttcc

SEQ ID NO: 21919 - DNA, 20 bp, Artificial Sequence
  Description of Artificial Sequence: Synthetic oligonucleotide
  Target: SCN10A; (-) strand; PAM type: NRG; PAM sequence: TGG
aggctggtgggtcagctgca

SEQ ID NO: 21920 - DNA, 20 bp, Artificial Sequence
  Description of Artificial Sequence: Synthetic oligonucleotide
  Target: SCN10A; (-) strand; PAM type: NRG; PAM sequence: CAG
ttggttggaggctggtgggt

SEQ ID NO: 21921 - DNA, 20 bp, Artificial Sequence
  Description of Artificial Sequence: Synthetic oligonucleotide
  Target: SCN10A; (-) strand; PAM type: NRG; PAM sequence: GGG
agacttggttggaggctggt

SEQ ID NO: 21922 - DNA, 20 bp, Artificial Sequence
  Description of Artificial Sequence: Synthetic oligonucleotide
  Target: SCN10A; (-) strand; PAM type: NRG; PAM sequence: TGG
cagacttggttggaggctgg

SEQ ID NO: 21923 - DNA, 20 bp, Artificial Sequence
  Description of Artificial Sequence: Synthetic oligonucleotide
  Target: SCN10A; (-) strand; PAM type: NRG; PAM sequence: TGG
acgcagacttggttggaggc

SEQ ID NO: 21924 - DNA, 20 bp, Artificial Sequence
  Description of Artificial Sequence: Synthetic oligonucleotide
  Target: SCN10A; (-) strand; PAM type: NRG; PAM sequence: AGG
ccccacgcagacttggttgg

SEQ ID NO: 21925 - DNA, 20 bp, Artificial Sequence
  Description of Artificial Sequence: Synthetic oligonucleotide
  Target: SCN10A; (-) strand; PAM type: NRG; PAM sequence: GAG
cccccacgcagacttggttg

SEQ ID NO: 21926 - DNA, 20 bp, Artificial Sequence
  Description of Artificial Sequence: Synthetic oligonucleotide
  Target: SCN10A; (-) strand; PAM type: NRG; PAM sequence: TGG
ttcccccacgcagacttggt

SEQ ID NO: 21927 - DNA, 20 bp, Artificial Sequence
  Description of Artificial Sequence: Synthetic oligonucleotide
  Target: SCN10A; (-) strand; PAM type: NRG; PAM sequence: TGG
tgcattcccccacgcagact

SEQ ID NO: 21928 - DNA, 20 bp, Artificial Sequence
  Description of Artificial Sequence: Synthetic oligonucleotide
  Target: SCN10A; (-) strand; PAM type: NRG; PAM sequence: CAG
ctgagctgcattcccccacg

SEQ ID NO: 21929 - DNA, 20 bp, Artificial Sequence
  Description of Artificial Sequence: Synthetic oligonucleotide
  Target: SCN10A; (-) strand; PAM type: NRG; PAM sequence: GAG
cgcctctaccagcaggtact

SEQ ID NO: 21930 - DNA, 20 bp, Artificial Sequence
  Description of Artificial Sequence: Synthetic oligonucleotide
  Target: SCN10A; (-) strand; PAM type: NRG; PAM sequence: AGG
ctgggaacgcctctaccagc

SEQ ID NO: 21931 - DNA, 20 bp, Artificial Sequence
  Description of Artificial Sequence: Synthetic oligonucleotide
  Target: SCN10A; (-) strand; PAM type: NRG; PAM sequence: CAG
cctgggaacgcctctaccag

SEQ ID NO: 21932 - DNA, 20 bp, Artificial Sequence
  Description of Artificial Sequence: Synthetic oligonucleotide
  Target: SCN10A; (-) strand; PAM type: NRG; PAM sequence: CAG
attcctgggaacgcctctac

SEQ ID NO: 21933 - DNA, 20 bp, Artificial Sequence
  Description of Artificial Sequence: Synthetic oligonucleotide
  Target: SCN10A; (-) strand; PAM type: NRG; PAM sequence: GGG
cctcatgacacaggattcct

SEQ ID NO: 21934 - DNA, 20 bp, Artificial Sequence
  Description of Artificial Sequence: Synthetic oligonucleotide
  Target: SCN10A; (-) strand; PAM type: NRG; PAM sequence: TGG
gcctcatgacacaggattcc

SEQ ID NO: 21935 - DNA, 20 bp, Artificial Sequence
  Description of Artificial Sequence: Synthetic oligonucleotide
  Target: SCN10A; (-) strand; PAM type: NRG; PAM sequence: AGG
actgttccgcctcatgacac

SEQ ID NO: 21936 - DNA, 20 bp, Artificial Sequence
  Description of Artificial Sequence: Synthetic oligonucleotide
  Target: SCN10A; (-) strand; PAM type: NRG; PAM sequence: CAG
cactgttccgcctcatgaca

SEQ ID NO: 21937 - DNA, 20 bp, Artificial Sequence
  Description of Artificial Sequence: Synthetic oligonucleotide
  Target: SCN10A; (-) strand; PAM type: NRG; PAM sequence: GGG
cagctttgattcctttgctt

SEQ ID NO: 21938 - DNA, 20 bp, Artificial Sequence
  Description of Artificial Sequence: Synthetic oligonucleotide
  Target: SCN10A; (-) strand; PAM type: NRG; PAM sequence: TGG
ccagctttgattcctttgct

SEQ ID NO: 21939 - DNA, 20 bp, Artificial Sequence
  Description of Artificial Sequence: Synthetic oligonucleotide
  Target: SCN10A; (-) strand; PAM type: NRG; PAM sequence: CAG
aacccggattttaactacac

SEQ ID NO: 21940 - DNA, 20 bp, Artificial Sequence
  Description of Artificial Sequence: Synthetic oligonucleotide
  Target: SCN10A; (-) strand; PAM type: NRG; PAM sequence: CGG
ccttaaaacttctgacaacc

SEQ ID NO: 21941 - DNA, 20 bp, Artificial Sequence
  Description of Artificial Sequence: Synthetic oligonucleotide
  Target: SCN10A; (-) strand; PAM type: NRG; PAM sequence: TGG
tgctgcagccactgccctga

SEQ ID NO: 21942 - DNA, 20 bp, Artificial Sequence
  Description of Artificial Sequence: Synthetic oligonucleotide
  Target: SCN10A; (-) strand; PAM type: NRG; PAM sequence: CAG
gaccttctctgttcttgctg

SEQ ID NO: 21943 - DNA, 20 bp, Artificial Sequence
  Description of Artificial Sequence: Synthetic oligonucleotide
  Target: SCN10A; (-) strand; PAM type: NRG; PAM sequence: GGG
accttgtctgcaataagcag

SEQ ID NO: 21944 - DNA, 20 bp, Artificial Sequence
  Description of Artificial Sequence: Synthetic oligonucleotide
  Target: SCN10A; (-) strand; PAM type: NRG; PAM sequence: GGG
taccttgtctgcaataagca

SEQ ID NO: 21945 - DNA, 20 bp, Artificial Sequence
  Description of Artificial Sequence: Synthetic oligonucleotide
  Target: SCN10A; (-) strand; PAM type: NRG; PAM sequence: AGG
ctaccttgtctgcaataagc

SEQ ID NO: 21946 - DNA, 20 bp, Artificial Sequence
  Description of Artificial Sequence: Synthetic oligonucleotide
  Target: SCN10A; (-) strand; PAM type: NRG; PAM sequence: CAG
gctaccttgtctgcaataag

SEQ ID NO: 21947 - DNA, 20 bp, Artificial Sequence
  Description of Artificial Sequence: Synthetic oligonucleotide
  Target: SCN10A; (-) strand; PAM type: NRG; PAM sequence: AAG
tgggctaccttgtctgcaat

SEQ ID NO: 21948 - DNA, 20 bp, Artificial Sequence
  Description of Artificial Sequence: Synthetic oligonucleotide
  Target: SCN10A; (-) strand; PAM type: NRG; PAM sequence: GGG
tgtggttgtctcgcagccct

SEQ ID NO: 21949 - DNA, 20 bp, Artificial Sequence
  Description of Artificial Sequence: Synthetic oligonucleotide
  Target: SCN10A; (-) strand; PAM type: NRG; PAM sequence: TGG
ctgtggttgtctcgcagccc

SEQ ID NO: 21950 - DNA, 20 bp, Artificial Sequence
  Description of Artificial Sequence: Synthetic oligonucleotide
  Target: SCN10A; (-) strand; PAM type: NRG; PAM sequence: CAG
aaaactctgtggttgtctcg

SEQ ID NO: 21951 - DNA, 20 bp, Artificial Sequence
  Description of Artificial Sequence: Synthetic oligonucleotide
  Target: SCN10A; (-) strand; PAM type: NRG; PAM sequence: TGG
atctctgacataaaactctg

SEQ ID NO: 21952 - DNA, 20 bp, Artificial Sequence
  Description of Artificial Sequence: Synthetic oligonucleotide
  Target: SCN10A; (-) strand; PAM type: NRG; PAM sequence: AGG
ctgctaataagaggaagact

SEQ ID NO: 21953 - DNA, 20 bp, Artificial Sequence
  Description of Artificial Sequence: Synthetic oligonucleotide
  Target: SCN10A; (-) strand; PAM type: NRG; PAM sequence: TAG
cctgctaataagaggaagac

SEQ ID NO: 21954 - DNA, 20 bp, Artificial Sequence
  Description of Artificial Sequence: Synthetic oligonucleotide
  Target: SCN10A; (-) strand; PAM type: NRG; PAM sequence: AAG
atcatcctgctaataagagg

SEQ ID NO: 21955 - DNA, 20 bp, Artificial Sequence
  Description of Artificial Sequence: Synthetic oligonucleotide
  Target: SCN10A; (-) strand; PAM type: NRG; PAM sequence: AGG
aagatcatcctgctaataag

SEQ ID NO: 21956 - DNA, 20 bp, Artificial Sequence
  Description of Artificial Sequence: Synthetic oligonucleotide
  Target: SCN10A; (-) strand; PAM type: NRG; PAM sequence: GAG
caagatcatcctgctaataa

SEQ ID NO: 21957 - DNA, 20 bp, Artificial Sequence
  Description of Artificial Sequence: Synthetic oligonucleotide
  Target: SCN10A; (-) strand; PAM type: NRG; PAM sequence: AAG
tccaagatcatcctgctaat

SEQ ID NO: 21958 - DNA, 20 bp, Artificial Sequence
  Description of Artificial Sequence: Synthetic oligonucleotide
  Target: SCN10A; (-) strand; PAM type: NRG; PAM sequence: AAG
cctaaacagaccaagtgtcc

SEQ ID NO: 21959 - DNA, 20 bp, Artificial Sequence
  Description of Artificial Sequence: Synthetic oligonucleotide
  Target: SCN10A; (-) strand; PAM type: NRG; PAM sequence: AAG
aaccaatacctaaacagacc

SEQ ID NO: 21960 - DNA, 20 bp, Artificial Sequence
  Description of Artificial Sequence: Synthetic oligonucleotide
  Target: SCN10A; (-) strand; PAM type: NRG; PAM sequence: CAG
aacagaaaccaatacctaaa

SEQ ID NO: 21961 - DNA, 20 bp, Artificial Sequence
  Description of Artificial Sequence: Synthetic oligonucleotide
  Target: SCN10A; (-) strand; PAM type: NRG; PAM sequence: CAG
cgtccccgttttatggataa

SEQ ID NO: 21962 - DNA, 20 bp, Artificial Sequence
  Description of Artificial Sequence: Synthetic oligonucleotide
  Target: SCN10A; (-) strand; PAM type: NRG; PAM sequence: TGG
gtattagcgtccccgtttta

SEQ ID NO: 21963 - DNA, 20 bp, Artificial Sequence
  Description of Artificial Sequence: Synthetic oligonucleotide
  Target: SCN10A; (-) strand; PAM type: NRG; PAM sequence: TAG
aaattctgacgtgaaagtat

SEQ ID NO: 21964 - DNA, 20 bp, Artificial Sequence
  Description of Artificial Sequence: Synthetic oligonucleotide
  Target: SCN10A; (-) strand; PAM type: NRG; PAM sequence: AAG
tgtatgaaattctgacgtga

SEQ ID NO: 21965 - DNA, 20 bp, Artificial Sequence
  Description of Artificial Sequence: Synthetic oligonucleotide
  Target: SCN10A; (-) strand; PAM type: NRG; PAM sequence: AGG
ggcagtcagctgccttcccc

SEQ ID NO: 21966 - DNA, 20 bp, Artificial Sequence
  Description of Artificial Sequence: Synthetic oligonucleotide
  Target: SCN10A; (-) strand; PAM type: NRG; PAM sequence: CAG
gggcagtcagctgccttccc

SEQ ID NO: 21967 - DNA, 20 bp, Artificial Sequence
  Description of Artificial Sequence: Synthetic oligonucleotide
  Target: SCN10A; (-) strand; PAM type: NRG; PAM sequence: CAG
tagtatcgtgtctgggcagt

SEQ ID NO: 21968 - DNA, 20 bp, Artificial Sequence
  Description of Artificial Sequence: Synthetic oligonucleotide
  Target: SCN10A; (-) strand; PAM type: NRG; PAM sequence: CAG
cttatagtatcgtgtctggg

SEQ ID NO: 21969 - DNA, 20 bp, Artificial Sequence
  Description of Artificial Sequence: Synthetic oligonucleotide
  Target: SCN10A; (-) strand; PAM type: NRG; PAM sequence: GGG
gagcttatagtatcgtgtct

SEQ ID NO: 21970 - DNA, 20 bp, Artificial Sequence
  Description of Artificial Sequence: Synthetic oligonucleotide
  Target: SCN10A; (-) strand; PAM type: NRG; PAM sequence: TGG
agagcttatagtatcgtgtc

SEQ ID NO: 21971 - DNA, 20 bp, Artificial Sequence
  Description of Artificial Sequence: Synthetic oligonucleotide
  Target: SCN10A; (-) strand; PAM type: NRG; PAM sequence: TAG
atgaactggcaaagagctta

SEQ ID NO: 21972 - DNA, 20 bp, Artificial Sequence
  Description of Artificial Sequence: Synthetic oligonucleotide
  Target: SCN10A; (-) strand; PAM type: NRG; PAM sequence: GAG
ccctggtatgaactggcaaa

SEQ ID NO: 21973 - DNA, 20 bp, Artificial Sequence
  Description of Artificial Sequence: Synthetic oligonucleotide
  Target: SCN10A; (-) strand; PAM type: NRG; PAM sequence: AAG
ttccctggtatgaactggca

SEQ ID NO: 21974 - DNA, 20 bp, Artificial Sequence
  Description of Artificial Sequence: Synthetic oligonucleotide
  Target: SCN10A; (-) strand; PAM type: NRG; PAM sequence: TGG
ctcatttccctggtatgaac

SEQ ID NO: 21975 - DNA, 20 bp, Artificial Sequence
  Description of Artificial Sequence: Synthetic oligonucleotide
  Target: SCN10A; (-) strand; PAM type: NRG; PAM sequence: TGG
gctactgactctcatttccc

SEQ ID NO: 21976 - DNA, 20 bp, Artificial Sequence
  Description of Artificial Sequence: Synthetic oligonucleotide
  Target: SCN10A; (-) strand; PAM type: NRG; PAM sequence: AAG
tgccaacaggctcaggtttt

SEQ ID NO: 21977 - DNA, 20 bp, Artificial Sequence
  Description of Artificial Sequence: Synthetic oligonucleotide
  Target: SCN10A; (-) strand; PAM type: NRG; PAM sequence: AGG
cagatgatgccaacaggctc

SEQ ID NO: 21978 - DNA, 20 bp, Artificial Sequence
  Description of Artificial Sequence: Synthetic oligonucleotide
  Target: SCN10A; (-) strand; PAM type: NRG; PAM sequence: CAG
gcagatgatgccaacaggct

SEQ ID NO: 21979 - DNA, 20 bp, Artificial Sequence
  Description of Artificial Sequence: Synthetic oligonucleotide
  Target: SCN10A; (-) strand; PAM type: NRG; PAM sequence: AGG
actctgcagatgatgccaac

SEQ ID NO: 21980 - DNA, 20 bp, Artificial Sequence
  Description of Artificial Sequence: Synthetic oligonucleotide
  Target: SCN10A; (-) strand; PAM type: NRG; PAM sequence: CAG
aactctgcagatgatgccaa

SEQ ID NO: 21981 - DNA, 20 bp, Artificial Sequence
  Description of Artificial Sequence: Synthetic oligonucleotide
  Target: SCN10A; (-) strand; PAM type: NRG; PAM sequence: CAG
tcccttgatagacaactctg

SEQ ID NO: 21982 - DNA, 20 bp, Artificial Sequence
  Description of Artificial Sequence: Synthetic oligonucleotide
  Target: SCN10A; (-) strand; PAM type: NRG; PAM sequence: TAG
taatgtgagacctcccttga

SEQ ID NO: 21983 - DNA, 20 bp, Artificial Sequence
  Description of Artificial Sequence: Synthetic oligonucleotide
  Target: SCN10A; (-) strand; PAM type: NRG; PAM sequence: GAG
tcagtgaacttggctaatgt

SEQ ID NO: 21984 - DNA, 20 bp, Artificial Sequence
  Description of Artificial Sequence: Synthetic oligonucleotide
  Target: SCN10A; (-) strand; PAM type: NRG; PAM sequence: TGG
atataattaatcagtgaact

SEQ ID NO: 21985 - DNA, 20 bp, Artificial Sequence
  Description of Artificial Sequence: Synthetic oligonucleotide
  Target: SCN10A; (-) strand; PAM type: NRG; PAM sequence: CAG
cactgttacatataattaat

SEQ ID NO: 21986 - DNA, 20 bp, Artificial Sequence
  Description of Artificial Sequence: Synthetic oligonucleotide
  Target: SCN10A; (-) strand; PAM type: NRG; PAM sequence: AAG
gaaagtgctcagtaagtgga

SEQ ID NO: 21987 - DNA, 20 bp, Artificial Sequence
  Description of Artificial Sequence: Synthetic oligonucleotide
  Target: SCN10A; (-) strand; PAM type: NRG; PAM sequence: TGG
cacagaaagtgctcagtaag

SEQ ID NO: 21988 - DNA, 20 bp, Artificial Sequence
  Description of Artificial Sequence: Synthetic oligonucleotide
  Target: SCN10A; (-) strand; PAM type: NRG; PAM sequence: AAG
gaacacagaaagtgctcagt

SEQ ID NO: 21989 - DNA, 20 bp, Artificial Sequence
  Description of Artificial Sequence: Synthetic oligonucleotide
  Target: SCN10A; (-) strand; PAM type: NRG; PAM sequence: CAG
agaagaacacagaaagtgct

SEQ ID NO: 21990 - DNA, 20 bp, Artificial Sequence
  Description of Artificial Sequence: Synthetic oligonucleotide
  Target: SCN10A; (-) strand; PAM type: NRG; PAM sequence: AAG
gggagagagaagaacacaga

SEQ ID NO: 21991 - DNA, 20 bp, Artificial Sequence
  Description of Artificial Sequence: Synthetic oligonucleotide
  Target: SCN10A; (-) strand; PAM type: NRG; PAM sequence: CAG
taaagggagagagaagaaca

SEQ ID NO: 21992 - DNA, 20 bp, Artificial Sequence
  Description of Artificial Sequence: Synthetic oligonucleotide
  Target: SCN10A; (-) strand; PAM type: NRG; PAM sequence: AAG
aagcacttaaagggagagag

SEQ ID NO: 21993 - DNA, 20 bp, Artificial Sequence
  Description of Artificial Sequence: Synthetic oligonucleotide
  Target: SCN10A; (-) strand; PAM type: NRG; PAM sequence: GAG
gtaaagcacttaaagggaga

SEQ ID NO: 21994 - DNA, 20 bp, Artificial Sequence
  Description of Artificial Sequence: Synthetic oligonucleotide
  Target: SCN10A; (-) strand; PAM type: NRG; PAM sequence: GAG
ttgtaaagcacttaaaggga

SEQ ID NO: 21995 - DNA, 20 bp, Artificial Sequence
  Description of Artificial Sequence: Synthetic oligonucleotide
  Target: SCN10A; (-) strand; PAM type: NRG; PAM sequence: GAG
gtttgtaaagcacttaaagg

SEQ ID NO: 21996 - DNA, 20 bp, Artificial Sequence
  Description of Artificial Sequence: Synthetic oligonucleotide
  Target: SCN10A; (-) strand; PAM type: NRG; PAM sequence: GGG
gtgtttgtaaagcacttaaa

SEQ ID NO: 21997 - DNA, 20 bp, Artificial Sequence
  Description of Artificial Sequence: Synthetic oligonucleotide
  Target: SCN10A; (-) strand; PAM type: NRG; PAM sequence: AGG
agtgtttgtaaagcacttaa

SEQ ID NO: 21998 - DNA, 20 bp, Artificial Sequence
  Description of Artificial Sequence: Synthetic oligonucleotide
  Target: SCN10A; (-) strand; PAM type: NRG; PAM sequence: AAG
tagtgtttgtaaagcactta

SEQ ID NO: 21999 - DNA, 20 bp, Artificial Sequence
  Description of Artificial Sequence: Synthetic oligonucleotide
  Target: SCN10A; (-) strand; PAM type: NRG; PAM sequence: AAG
attaaattatagtgtttgta

SEQ ID NO: 22000 - DNA, 20 bp, Artificial Sequence
  Description of Artificial Sequence: Synthetic oligonucleotide
  Target: SCN10A; (-) strand; PAM type: NRG; PAM sequence: TAG
aacattgagtgattaaatta

SEQ ID NO: 22001 - DNA, 20 bp, Artificial Sequence
  Description of Artificial Sequence: Synthetic oligonucleotide
  Target: SCN10A; (-) strand; PAM type: NRG; PAM sequence: GAG
atctgtaaagaaagaacatt

SEQ ID NO: 22002 - DNA, 20 bp, Artificial Sequence
  Description of Artificial Sequence: Synthetic oligonucleotide
  Target: SCN10A; (-) strand; PAM type: NRG; PAM sequence: AAG
agattccttatctgtaaaga

SEQ ID NO: 22003 - DNA, 20 bp, Artificial Sequence
  Description of Artificial Sequence: Synthetic oligonucleotide
  Target: SCN10A; (-) strand; PAM type: NRG; PAM sequence: AAG
ccccagattccttatctgta

SEQ ID NO: 22004 - DNA, 20 bp, Artificial Sequence
  Description of Artificial Sequence: Synthetic oligonucleotide
  Target: SCN10A; (-) strand; PAM type: NRG; PAM sequence: CAG
actgacttctttctgacccc

SEQ ID NO: 22005 - DNA, 20 bp, Artificial Sequence
  Description of Artificial Sequence: Synthetic oligonucleotide
  Target: SCN10A; (-) strand; PAM type: NRG; PAM sequence: AGG
attgacacctgcgtagtttt

SEQ ID NO: 22006 - DNA, 20 bp, Artificial Sequence
  Description of Artificial Sequence: Synthetic oligonucleotide
  Target: SCN10A; (-) strand; PAM type: NRG; PAM sequence: TAG
tattgacacctgcgtagttt

SEQ ID NO: 22007 - DNA, 20 bp, Artificial Sequence
  Description of Artificial Sequence: Synthetic oligonucleotide
  Target: SCN10A; (-) strand; PAM type: NRG; PAM sequence: TAG
taaatatattgacacctgcg

SEQ ID NO: 22008 - DNA, 20 bp, Artificial Sequence
  Description of Artificial Sequence: Synthetic oligonucleotide
  Target: SCN10A; (-) strand; PAM type: NRG; PAM sequence: CAG
tcaagtattgggctacttga

SEQ ID NO: 22009 - DNA, 20 bp, Artificial Sequence
  Description of Artificial Sequence: Synthetic oligonucleotide
  Target: SCN10A; (-) strand; PAM type: NRG; PAM sequence: GGG
gctaggctgactcaagtatt

SEQ ID NO: 22010 - DNA, 20 bp, Artificial Sequence
  Description of Artificial Sequence: Synthetic oligonucleotide
  Target: SCN10A; (-) strand; PAM type: NRG; PAM sequence: TGG
ggctaggctgactcaagtat

SEQ ID NO: 22011 - DNA, 20 bp, Artificial Sequence
  Description of Artificial Sequence: Synthetic oligonucleotide
  Target: SCN10A; (-) strand; PAM type: NRG; PAM sequence: AAG
ggaggaggctaggctgactc

SEQ ID NO: 22012 - DNA, 20 bp, Artificial Sequence
  Description of Artificial Sequence: Synthetic oligonucleotide
  Target: SCN10A; (-) strand; PAM type: NRG; PAM sequence: AGG
gccatcttcaggaggaggct

SEQ ID NO: 22013 - DNA, 20 bp, Artificial Sequence
  Description of Artificial Sequence: Synthetic oligonucleotide
  Target: SCN10A; (-) strand; PAM type: NRG; PAM sequence: TAG
ggccatcttcaggaggaggc

SEQ ID NO: 22014 - DNA, 20 bp, Artificial Sequence
  Description of Artificial Sequence: Synthetic oligonucleotide
  Target: SCN10A; (-) strand; PAM type: NRG; PAM sequence: AGG
cataggccatcttcaggagg

SEQ ID NO: 22015 - DNA, 20 bp, Artificial Sequence
  Description of Artificial Sequence: Synthetic oligonucleotide
  Target: SCN10A; (-) strand; PAM type: NRG; PAM sequence: GAG
tcataggccatcttcaggag

SEQ ID NO: 22016 - DNA, 20 bp, Artificial Sequence
  Description of Artificial Sequence: Synthetic oligonucleotide
  Target: SCN10A; (-) strand; PAM type: NRG; PAM sequence: AGG
cttcataggccatcttcagg

SEQ ID NO: 22017 - DNA, 20 bp, Artificial Sequence
  Description of Artificial Sequence: Synthetic oligonucleotide
  Target: SCN10A; (-) strand; PAM type: NRG; PAM sequence: GAG
ccttcataggccatcttcag

SEQ ID NO: 22018 - DNA, 20 bp, Artificial Sequence
  Description of Artificial Sequence: Synthetic oligonucleotide
  Target: SCN10A; (-) strand; PAM type: NRG; PAM sequence: AGG
ttccttcataggccatcttc

SEQ ID NO: 22019 - DNA, 20 bp, Artificial Sequence
  Description of Artificial Sequence: Synthetic oligonucleotide
  Target: SCN10A; (-) strand; PAM type: NRG; PAM sequence: CAG
cttccttcataggccatctt

SEQ ID NO: 22020 - DNA, 20 bp, Artificial Sequence
  Description of Artificial Sequence: Synthetic oligonucleotide
  Target: SCN10A; (-) strand; PAM type: NRG; PAM sequence: AGG
ttaatctggccttccttcat

SEQ ID NO: 22021 - DNA, 20 bp, Artificial Sequence
  Description of Artificial Sequence: Synthetic oligonucleotide
  Target: SCN10A; (-) strand; PAM type: NRG; PAM sequence: TAG
tttaatctggccttccttca

SEQ ID NO: 22022 - DNA, 20 bp, Artificial Sequence
  Description of Artificial Sequence: Synthetic oligonucleotide
  Target: SCN10A; (-) strand; PAM type: NRG; PAM sequence: TGG
ccaggcagtcatttttaatc

SEQ ID NO: 22023 - DNA, 20 bp, Artificial Sequence
  Description of Artificial Sequence: Synthetic oligonucleotide
  Target: SCN10A; (-) strand; PAM type: NRG; PAM sequence: CAG
ccacctcaatactcaccagg

SEQ ID NO: 22024 - DNA, 20 bp, Artificial Sequence
  Description of Artificial Sequence: Synthetic oligonucleotide
  Target: SCN10A; (-) strand; PAM type: NRG; PAM sequence: AGG
ttcccacctcaatactcacc

SEQ ID NO: 22025 - DNA, 20 bp, Artificial Sequence
  Description of Artificial Sequence: Synthetic oligonucleotide
  Target: SCN10A; (-) strand; PAM type: NRG; PAM sequence: CAG
attcccacctcaatactcac

SEQ ID NO: 22026 - DNA, 20 bp, Artificial Sequence
  Description of Artificial Sequence: Synthetic oligonucleotide
  Target: SCN10A; (-) strand; PAM type: NRG; PAM sequence: CAG
atgagagagaggaaggagtt

SEQ ID NO: 22027 - DNA, 20 bp, Artificial Sequence
  Description of Artificial Sequence: Synthetic oligonucleotide
  Target: SCN10A; (-) strand; PAM type: NRG; PAM sequence: GAG
ctattatgagagagaggaag

SEQ ID NO: 22028 - DNA, 20 bp, Artificial Sequence
  Description of Artificial Sequence: Synthetic oligonucleotide
  Target: SCN10A; (-) strand; PAM type: NRG; PAM sequence: AGG
tcctattatgagagagagga

SEQ ID NO: 22029 - DNA, 20 bp, Artificial Sequence
  Description of Artificial Sequence: Synthetic oligonucleotide
  Target: SCN10A; (-) strand; PAM type: NRG; PAM sequence: AAG
ctcctattatgagagagagg

SEQ ID NO: 22030 - DNA, 20 bp, Artificial Sequence
  Description of Artificial Sequence: Synthetic oligonucleotide
  Target: SCN10A; (-) strand; PAM type: NRG; PAM sequence: AGG
atcctcctattatgagagag

SEQ ID NO: 22031 - DNA, 20 bp, Artificial Sequence
  Description of Artificial Sequence: Synthetic oligonucleotide
  Target: SCN10A; (-) strand; PAM type: NRG; PAM sequence: GAG
catcctcctattatgagaga

SEQ ID NO: 22032 - DNA, 20 bp, Artificial Sequence
  Description of Artificial Sequence: Synthetic oligonucleotide
  Target: SCN10A; (-) strand; PAM type: NRG; PAM sequence: GAG
ctcatcctcctattatgaga

SEQ ID NO: 22033 - DNA, 20 bp, Artificial Sequence
  Description of Artificial Sequence: Synthetic oligonucleotide
  Target: SCN10A; (-) strand; PAM type: NRG; PAM sequence: GAG
gactcatcctcctattatga

SEQ ID NO: 22034 - DNA, 20 bp, Artificial Sequence
  Description of Artificial Sequence: Synthetic oligonucleotide
  Target: SCN10A; (-) strand; PAM type: NRG; PAM sequence: GAG
tcgactcatcctcctattat

SEQ ID NO: 22035 - DNA, 20 bp, Artificial Sequence
  Description of Artificial Sequence: Synthetic oligonucleotide
  Target: SCN10A; (-) strand; PAM type: NRG; PAM sequence: CAG
ctttacgctccctgagctga

SEQ ID NO: 22036 - DNA, 20 bp, Artificial Sequence
  Description of Artificial Sequence: Synthetic oligonucleotide
  Target: SCN10A; (-) strand; PAM type: NRG; PAM sequence: GAG
gagagcactttacgctccct

SEQ ID NO: 22037 - DNA, 20 bp, Artificial Sequence
  Description of Artificial Sequence: Synthetic oligonucleotide
  Target: SCN10A; (-) strand; PAM type: NRG; PAM sequence: GAG
atctctgctagggtggatga

SEQ ID NO: 22038 - DNA, 20 bp, Artificial Sequence
  Description of Artificial Sequence: Synthetic oligonucleotide
  Target: SCN10A; (-) strand; PAM type: NRG; PAM sequence: GAG
ccatctctgctagggtggat

SEQ ID NO: 22039 - DNA, 20 bp, Artificial Sequence
  Description of Artificial Sequence: Synthetic oligonucleotide
  Target: SCN10A; (-) strand; PAM type: NRG; PAM sequence: TGG
tcaggccatctctgctaggg

SEQ ID NO: 22040 - DNA, 20 bp, Artificial Sequence
  Description of Artificial Sequence: Synthetic oligonucleotide
  Target: SCN10A; (-) strand; PAM type: NRG; PAM sequence: GGG
tgatcaggccatctctgcta

SEQ ID NO: 22041 - DNA, 20 bp, Artificial Sequence
  Description of Artificial Sequence: Synthetic oligonucleotide
  Target: SCN10A; (-) strand; PAM type: NRG; PAM sequence: AGG
ttgatcaggccatctctgct

SEQ ID NO: 22042 - DNA, 20 bp, Artificial Sequence
  Description of Artificial Sequence: Synthetic oligonucleotide
  Target: SCN10A; (-) strand; PAM type: NRG; PAM sequence: TAG
attgatcaggccatctctgc

SEQ ID NO: 22043 - DNA, 20 bp, Artificial Sequence
  Description of Artificial Sequence: Synthetic oligonucleotide
  Target: SCN10A; (-) strand; PAM type: NRG; PAM sequence: AGG
gcattgctgtttcattgatc

SEQ ID NO: 22044 - DNA, 20 bp, Artificial Sequence
  Description of Artificial Sequence: Synthetic oligonucleotide
  Target: SCN10A; (-) strand; PAM type: NRG; PAM sequence: CAG
ggcattgctgtttcattgat

SEQ ID NO: 22045 - DNA, 20 bp, Artificial Sequence
  Description of Artificial Sequence: Synthetic oligonucleotide
  Target: SCN10A; (-) strand; PAM type: NRG; PAM sequence: AGG
ataattctggacttcaaacg

SEQ ID NO: 22046 - DNA, 20 bp, Artificial Sequence
  Description of Artificial Sequence: Synthetic oligonucleotide
  Target: SCN10A; (-) strand; PAM type: NRG; PAM sequence: GAG
aataattctggacttcaaac

SEQ ID NO: 22047 - DNA, 20 bp, Artificial Sequence
  Description of Artificial Sequence: Synthetic oligonucleotide
  Target: SCN10A; (-) strand; PAM type: NRG; PAM sequence: TGG
aaaatttaaaaaaataattc

SEQ ID NO: 22048 - DNA, 20 bp, Artificial Sequence
  Description of Artificial Sequence: Synthetic oligonucleotide
  Target: SCN10A; (-) strand; PAM type: NRG; PAM sequence: AAG
ggtaaataaaacaggagaaa

SEQ ID NO: 22049 - DNA, 20 bp, Artificial Sequence
  Description of Artificial Sequence: Synthetic oligonucleotide
  Target: SCN10A; (-) strand; PAM type: NRG; PAM sequence: GAG
aatgcaggtaaataaaacag

SEQ ID NO: 22050 - DNA, 20 bp, Artificial Sequence
  Description of Artificial Sequence: Synthetic oligonucleotide
  Target: SCN10A; (-) strand; PAM type: NRG; PAM sequence: AGG
ggaatgcaggtaaataaaac

SEQ ID NO: 22051 - DNA, 20 bp, Artificial Sequence
  Description of Artificial Sequence: Synthetic oligonucleotide
  Target: SCN10A; (-) strand; PAM type: NRG; PAM sequence: CAG
aggaatgcaggtaaataaaa

SEQ ID NO: 22052 - DNA, 20 bp, Artificial Sequence
  Description of Artificial Sequence: Synthetic oligonucleotide
  Target: SCN10A; (-) strand; PAM type: NRG; PAM sequence: AGG
catgtattcacaaggaatgc

SEQ ID NO: 22053 - DNA, 20 bp, Artificial Sequence
  Description of Artificial Sequence: Synthetic oligonucleotide
  Target: SCN10A; (-) strand; PAM type: NRG; PAM sequence: CAG
ccatgtattcacaaggaatg

SEQ ID NO: 22054 - DNA, 20 bp, Artificial Sequence
  Description of Artificial Sequence: Synthetic oligonucleotide
  Target: SCN10A; (-) strand; PAM type: NRG; PAM sequence: AGG
aagaattccatgtattcaca

SEQ ID NO: 22055 - DNA, 20 bp, Artificial Sequence
  Description of Artificial Sequence: Synthetic oligonucleotide
  Target: SCN10A; (-) strand; PAM type: NRG; PAM sequence: AAG
aaagaattccatgtattcac

SEQ ID NO: 22056 - DNA, 20 bp, Artificial Sequence
  Description of Artificial Sequence: Synthetic oligonucleotide
  Target: SCN10A; (-) strand; PAM type: NRG; PAM sequence: AAG
tggagaaatcctgggagtaa

SEQ ID NO: 22057 - DNA, 20 bp, Artificial Sequence
  Description of Artificial Sequence: Synthetic oligonucleotide
  Target: SCN10A; (-) strand; PAM type: NRG; PAM sequence: GAG
agttcatggagaaatcctgg

SEQ ID NO: 22058 - DNA, 20 bp, Artificial Sequence
  Description of Artificial Sequence: Synthetic oligonucleotide
  Target: SCN10A; (-) strand; PAM type: NRG; PAM sequence: GGG
ggagttcatggagaaatcct

SEQ ID NO: 22059 - DNA, 20 bp, Artificial Sequence
  Description of Artificial Sequence: Synthetic oligonucleotide
  Target: SCN10A; (-) strand; PAM type: NRG; PAM sequence: TGG
tggagttcatggagaaatcc

SEQ ID NO: 22060 - DNA, 20 bp, Artificial Sequence
  Description of Artificial Sequence: Synthetic oligonucleotide
  Target: SCN10A; (-) strand; PAM type: NRG; PAM sequence: GAG
cccagaggttggagttcatg

SEQ ID NO: 22061 - DNA, 20 bp, Artificial Sequence
  Description of Artificial Sequence: Synthetic oligonucleotide
  Target: SCN10A; (-) strand; PAM type: NRG; PAM sequence: TGG
gccccagaggttggagttca

SEQ ID NO: 22062 - DNA, 20 bp, Artificial Sequence
  Description of Artificial Sequence: Synthetic oligonucleotide
  Target: SCN10A; (-) strand; PAM type: NRG; PAM sequence: GAG
aaggagagccccagaggttg

SEQ ID NO: 22063 - DNA, 20 bp, Artificial Sequence
  Description of Artificial Sequence: Synthetic oligonucleotide
  Target: SCN10A; (-) strand; PAM type: NRG; PAM sequence: TGG
ataaggagagccccagaggt

SEQ ID NO: 22064 - DNA, 20 bp, Artificial Sequence
  Description of Artificial Sequence: Synthetic oligonucleotide
  Target: SCN10A; (-) strand; PAM type: NRG; PAM sequence: AGG
tgggataaggagagccccag

SEQ ID NO: 22065 - DNA, 20 bp, Artificial Sequence
  Description of Artificial Sequence: Synthetic oligonucleotide
  Target: SCN10A; (-) strand; PAM type: NRG; PAM sequence: GAG
ctgggataaggagagcccca

SEQ ID NO: 22066 - DNA, 20 bp, Artificial Sequence
  Description of Artificial Sequence: Synthetic oligonucleotide
  Target: SCN10A; (-) strand; PAM type: NRG; PAM sequence: CAG
gtctgggataaggagagccc

SEQ ID NO: 22067 - DNA, 20 bp, Artificial Sequence
  Description of Artificial Sequence: Synthetic oligonucleotide
  Target: SCN10A; (-) strand; PAM type: NRG; PAM sequence: GAG
atggatgtctgggataagga

SEQ ID NO: 22068 - DNA, 20 bp, Artificial Sequence
  Description of Artificial Sequence: Synthetic oligonucleotide
  Target: SCN10A; (-) strand; PAM type: NRG; PAM sequence: GAG
acatggatgtctgggataag

SEQ ID NO: 22069 - DNA, 20 bp, Artificial Sequence
  Description of Artificial Sequence: Synthetic oligonucleotide
  Target: SCN10A; (-) strand; PAM type: NRG; PAM sequence: AGG
tcacatggatgtctgggata

SEQ ID NO: 22070 - DNA, 20 bp, Artificial Sequence
  Description of Artificial Sequence: Synthetic oligonucleotide
  Target: SCN10A; (-) strand; PAM type: NRG; PAM sequence: AAG
ttcacatggatgtctgggat

SEQ ID NO: 22071 - DNA, 20 bp, Artificial Sequence
  Description of Artificial Sequence: Synthetic oligonucleotide
  Target: SCN10A; (-) strand; PAM type: NRG; PAM sequence: GGG
ggttgttcacatggatgtct

SEQ ID NO: 22072 - DNA, 20 bp, Artificial Sequence
  Description of Artificial Sequence: Synthetic oligonucleotide
  Target: SCN10A; (-) strand; PAM type: NRG; PAM sequence: TGG
gggttgttcacatggatgtc

SEQ ID NO: 22073 - DNA, 20 bp, Artificial Sequence
  Description of Artificial Sequence: Synthetic oligonucleotide
  Target: SCN10A; (-) strand; PAM type: NRG; PAM sequence: TGG
catggtatgggttgttcaca

SEQ ID NO: 22074 - DNA, 20 bp, Artificial Sequence
  Description of Artificial Sequence: Synthetic oligonucleotide
  Target: SCN10A; (-) strand; PAM type: NRG; PAM sequence: GGG
agagctctaatccatggtat

SEQ ID NO: 22075 - DNA, 20 bp, Artificial Sequence
  Description of Artificial Sequence: Synthetic oligonucleotide
  Target: SCN10A; (-) strand; PAM type: NRG; PAM sequence: TGG
cagagctctaatccatggta

SEQ ID NO: 22076 - DNA, 20 bp, Artificial Sequence
  Description of Artificial Sequence: Synthetic oligonucleotide
  Target: SCN10A; (-) strand; PAM type: NRG; PAM sequence: TGG
gttgtcagagctctaatcca

SEQ ID NO: 22077 - DNA, 20 bp, Artificial Sequence
  Description of Artificial Sequence: Synthetic oligonucleotide
  Target: SCN10A; (-) strand; PAM type: NRG; PAM sequence: GAG
tgattagaattaagttgtca

SEQ ID NO: 22078 - DNA, 20 bp, Artificial Sequence
  Description of Artificial Sequence: Synthetic oligonucleotide
  Target: SCN10A; (-) strand; PAM type: NRG; PAM sequence: CAG
actgattagaattaagttgt

SEQ ID NO: 22079 - DNA, 20 bp, Artificial Sequence
  Description of Artificial Sequence: Synthetic oligonucleotide
  Target: SCN10A; (-) strand; PAM type: NRG; PAM sequence: AAG
acttggaactgattagaatt

SEQ ID NO: 22080 - DNA, 20 bp, Artificial Sequence
  Description of Artificial Sequence: Synthetic oligonucleotide
  Target: SCN10A; (-) strand; PAM type: NRG; PAM sequence: TAG
gagatagacttggaactgat

SEQ ID NO: 22081 - DNA, 20 bp, Artificial Sequence
  Description of Artificial Sequence: Synthetic oligonucleotide
  Target: SCN10A; (-) strand; PAM type: NRG; PAM sequence: TGG
aatcgaagtggagatagact

SEQ ID NO: 22082 - DNA, 20 bp, Artificial Sequence
  Description of Artificial Sequence: Synthetic oligonucleotide
  Target: SCN10A; (-) strand; PAM type: NRG; PAM sequence: TAG
atcttcaatcgaagtggaga

SEQ ID NO: 22083 - DNA, 20 bp, Artificial Sequence
  Description of Artificial Sequence: Synthetic oligonucleotide
  Target: SCN10A; (-) strand; PAM type: NRG; PAM sequence: GAG
tgcaatcttcaatcgaagtg

SEQ ID NO: 22084 - DNA, 20 bp, Artificial Sequence
  Description of Artificial Sequence: Synthetic oligonucleotide
  Target: SCN10A; (-) strand; PAM type: NRG; PAM sequence: TGG
cttgcaatcttcaatcgaag

SEQ ID NO: 22085 - DNA, 20 bp, Artificial Sequence
  Description of Artificial Sequence: Synthetic oligonucleotide
  Target: SCN10A; (-) strand; PAM type: NRG; PAM sequence: AAG
gaacttgcaatcttcaatcg

SEQ ID NO: 22086 - DNA, 20 bp, Artificial Sequence
  Description of Artificial Sequence: Synthetic oligonucleotide
  Target: SCN10A; (-) strand; PAM type: NRG; PAM sequence: GGG
aatgtgggtctacaaagcca

SEQ ID NO: 22087 - DNA, 20 bp, Artificial Sequence
  Description of Artificial Sequence: Synthetic oligonucleotide
  Target: SCN10A; (-) strand; PAM type: NRG; PAM sequence: AGG
aaatgtgggtctacaaagcc

SEQ ID NO: 22088 - DNA, 20 bp, Artificial Sequence
  Description of Artificial Sequence: Synthetic oligonucleotide
  Target: SCN10A; (-) strand; PAM type: NRG; PAM sequence: CAG
taaatgtgggtctacaaagc

SEQ ID NO: 22089 - DNA, 20 bp, Artificial Sequence
  Description of Artificial Sequence: Synthetic oligonucleotide
  Target: SCN10A; (-) strand; PAM type: NRG; PAM sequence: AAG
tctttaaatgtgggtctaca

SEQ ID NO: 22090 - DNA, 20 bp, Artificial Sequence
  Description of Artificial Sequence: Synthetic oligonucleotide
  Target: SCN10A; (-) strand; PAM type: NRG; PAM sequence: GGG
aagagcctatctttaaatgt

SEQ ID NO: 22091 - DNA, 20 bp, Artificial Sequence
  Description of Artificial Sequence: Synthetic oligonucleotide
  Target: SCN10A; (-) strand; PAM type: NRG; PAM sequence: TGG
caagagcctatctttaaatg

SEQ ID NO: 22092 - DNA, 20 bp, Artificial Sequence
  Description of Artificial Sequence: Synthetic oligonucleotide
  Target: SCN10A; (-) strand; PAM type: NRG; PAM sequence: GAG
cccttggaagagcaaaccaa

SEQ ID NO: 22093 - DNA, 20 bp, Artificial Sequence
  Description of Artificial Sequence: Synthetic oligonucleotide
  Target: SCN10A; (-) strand; PAM type: NRG; PAM sequence: AAG
gccccttggaagagcaaacc

SEQ ID NO: 22094 - DNA, 20 bp, Artificial Sequence
  Description of Artificial Sequence: Synthetic oligonucleotide
  Target: SCN10A; (-) strand; PAM type: NRG; PAM sequence: GAG
ggttgcctagccccttggaa

SEQ ID NO: 22095 - DNA, 20 bp, Artificial Sequence
  Description of Artificial Sequence: Synthetic oligonucleotide
  Target: SCN10A; (-) strand; PAM type: NRG; PAM sequence: AAG
tgggttgcctagccccttgg

SEQ ID NO: 22096 - DNA, 20 bp, Artificial Sequence
  Description of Artificial Sequence: Synthetic oligonucleotide
  Target: SCN10A; (-) strand; PAM type: NRG; PAM sequence: TGG
aaatgggttgcctagcccct

SEQ ID NO: 22097 - DNA, 20 bp, Artificial Sequence
  Description of Artificial Sequence: Synthetic oligonucleotide
  Target: SCN10A; (-) strand; PAM type: NRG; PAM sequence: TAG
cctacaggaaatgggttgcc

SEQ ID NO: 22098 - DNA, 20 bp, Artificial Sequence
  Description of Artificial Sequence: Synthetic oligonucleotide
  Target: SCN10A; (-) strand; PAM type: NRG; PAM sequence: GGG
ttaagaaacctacaggaaat

SEQ ID NO: 22099 - DNA, 20 bp, Artificial Sequence
  Description of Artificial Sequence: Synthetic oligonucleotide
  Target: SCN10A; (-) strand; PAM type: NRG; PAM sequence: TGG
attaagaaacctacaggaaa

SEQ ID NO: 22100 - DNA, 20 bp, Artificial Sequence
  Description of Artificial Sequence: Synthetic oligonucleotide
  Target: SCN10A; (-) strand; PAM type: NRG; PAM sequence: AGG
gagttaattaagaaacctac

SEQ ID NO: 22101 - DNA, 20 bp, Artificial Sequence
  Description of Artificial Sequence: Synthetic oligonucleotide
  Target: SCN10A; (-) strand; PAM type: NRG; PAM sequence: CAG
agagttaattaagaaaccta

SEQ ID NO: 22102 - DNA, 20 bp, Artificial Sequence
  Description of Artificial Sequence: Synthetic oligonucleotide
  Target: SCN10A; (-) strand; PAM type: NRG; PAM sequence: AAG
ggctgccctcagagttaatt

SEQ ID NO: 22103 - DNA, 20 bp, Artificial Sequence
  Description of Artificial Sequence: Synthetic oligonucleotide
  Target: SCN10A; (-) strand; PAM type: NRG; PAM sequence: GAG
tagaaacaaggctgccctca

SEQ ID NO: 22104 - DNA, 20 bp, Artificial Sequence
  Description of Artificial Sequence: Synthetic oligonucleotide
  Target: SCN10A; (-) strand; PAM type: NRG; PAM sequence: CAG
catagaaacaaggctgccct

SEQ ID NO: 22105 - DNA, 20 bp, Artificial Sequence
  Description of Artificial Sequence: Synthetic oligonucleotide
  Target: SCN10A; (-) strand; PAM type: NRG; PAM sequence: AGG
ctacagaagacatagaaaca

SEQ ID NO: 22106 - DNA, 20 bp, Artificial Sequence
  Description of Artificial Sequence: Synthetic oligonucleotide
  Target: SCN10A; (-) strand; PAM type: NRG; PAM sequence: AAG
tctacagaagacatagaaac

SEQ ID NO: 22107 - DNA, 20 bp, Artificial Sequence
  Description of Artificial Sequence: Synthetic oligonucleotide
  Target: SCN10A; (-) strand; PAM type: NRG; PAM sequence: TAG
gtggatttctacagaagaca

SEQ ID NO: 22108 - DNA, 20 bp, Artificial Sequence
  Description of Artificial Sequence: Synthetic oligonucleotide
  Target: SCN10A; (-) strand; PAM type: NRG; PAM sequence: AAG
gctatggtggatttctacag

SEQ ID NO: 22109 - DNA, 20 bp, Artificial Sequence
  Description of Artificial Sequence: Synthetic oligonucleotide
  Target: SCN10A; (-) strand; PAM type: NRG; PAM sequence: CAG
gtggctatggtggatttcta

SEQ ID NO: 22110 - DNA, 20 bp, Artificial Sequence
  Description of Artificial Sequence: Synthetic oligonucleotide
  Target: SCN10A; (-) strand; PAM type: NRG; PAM sequence: TGG
tttatatgcagtggctatgg

SEQ ID NO: 22111 - DNA, 20 bp, Artificial Sequence
  Description of Artificial Sequence: Synthetic oligonucleotide
  Target: SCN10A; (-) strand; PAM type: NRG; PAM sequence: TGG
ctgtttatatgcagtggcta

SEQ ID NO: 22112 - DNA, 20 bp, Artificial Sequence
  Description of Artificial Sequence: Synthetic oligonucleotide
  Target: SCN10A; (-) strand; PAM type: NRG; PAM sequence: TGG
agtgaactgtttatatgcag

SEQ ID NO: 22113 - DNA, 20 bp, Artificial Sequence
  Description of Artificial Sequence: Synthetic oligonucleotide
  Target: SCN10A; (-) strand; PAM type: NRG; PAM sequence: CAG
agcagtgaactgtttatatg

SEQ ID NO: 22114 - DNA, 20 bp, Artificial Sequence
  Description of Artificial Sequence: Synthetic oligonucleotide
  Target: SCN10A; (-) strand; PAM type: NRG; PAM sequence: CAG
atctcatttaatcctcagag

SEQ ID NO: 22115 - DNA, 20 bp, Artificial Sequence
  Description of Artificial Sequence: Synthetic oligonucleotide
  Target: SCN10A; (-) strand; PAM type: NRG; PAM sequence: GAG
gtgatctcatttaatcctca

SEQ ID NO: 22116 - DNA, 20 bp, Artificial Sequence
  Description of Artificial Sequence: Synthetic oligonucleotide
  Target: SCN10A; (-) strand; PAM type: NRG; PAM sequence: CAG
cagtgatctcatttaatcct

SEQ ID NO: 22117 - DNA, 20 bp, Artificial Sequence
  Description of Artificial Sequence: Synthetic oligonucleotide
  Target: SCN10A; (-) strand; PAM type: NRG; PAM sequence: CAG
cagaagtgcaagacactata

SEQ ID NO: 22118 - DNA, 20 bp, Artificial Sequence
  Description of Artificial Sequence: Synthetic oligonucleotide
  Target: SCN10A; (-) strand; PAM type: NRG; PAM sequence: AAG
tatttactatgcagaagtgc

SEQ ID NO: 22119 - DNA, 20 bp, Artificial Sequence
  Description of Artificial Sequence: Synthetic oligonucleotide
  Target: SCN10A; (-) strand; PAM type: NRG; PAM sequence: AAG
atacaatatttactatgcag

SEQ ID NO: 22120 - DNA, 20 bp, Artificial Sequence
  Description of Artificial Sequence: Synthetic oligonucleotide
  Target: SCN10A; (-) strand; PAM type: NRG; PAM sequence: CAG
tatatacaatatttactatg

SEQ ID NO: 22121 - DNA, 20 bp, Artificial Sequence
  Description of Artificial Sequence: Synthetic oligonucleotide
  Target: SCN10A; (-) strand; PAM type: NRG; PAM sequence: CAG
acaataggaattttcctttg

SEQ ID NO: 22122 - DNA, 20 bp, Artificial Sequence
  Description of Artificial Sequence: Synthetic oligonucleotide
  Target: SCN10A; (-) strand; PAM type: NRG; PAM sequence: AGG
cttccaaggttaaaaacaat

SEQ ID NO: 22123 - DNA, 20 bp, Artificial Sequence
  Description of Artificial Sequence: Synthetic oligonucleotide
  Target: SCN10A; (-) strand; PAM type: NRG; PAM sequence: TAG
gcttccaaggttaaaaacaa

SEQ ID NO: 22124 - DNA, 20 bp, Artificial Sequence
  Description of Artificial Sequence: Synthetic oligonucleotide
  Target: SCN10A; (-) strand; PAM type: NRG; PAM sequence: AGG
tatcctttcagcagcttcca

SEQ ID NO: 22125 - DNA, 20 bp, Artificial Sequence
  Description of Artificial Sequence: Synthetic oligonucleotide
  Target: SCN10A; (-) strand; PAM type: NRG; PAM sequence: AAG
ttatcctttcagcagcttcc

SEQ ID NO: 22126 - DNA, 20 bp, Artificial Sequence
  Description of Artificial Sequence: Synthetic oligonucleotide
  Target: SCN10A; (-) strand; PAM type: NRG; PAM sequence: CAG
attccagtttatcctttcag

SEQ ID NO: 22127 - DNA, 20 bp, Artificial Sequence
  Description of Artificial Sequence: Synthetic oligonucleotide
  Target: SCN10A; (-) strand; PAM type: NRG; PAM sequence: CAG
attattccagtttatccttt

SEQ ID NO: 22128 - DNA, 20 bp, Artificial Sequence
  Description of Artificial Sequence: Synthetic oligonucleotide
  Target: SCN10A; (-) strand; PAM type: NRG; PAM sequence: CAG
ttcttccacatatattattc

SEQ ID NO: 22129 - DNA, 20 bp, Artificial Sequence
  Description of Artificial Sequence: Synthetic oligonucleotide
  Target: SCN10A; (-) strand; PAM type: NRG; PAM sequence: CAG
agaaaatagttgataatttt

SEQ ID NO: 22130 - DNA, 20 bp, Artificial Sequence
  Description of Artificial Sequence: Synthetic oligonucleotide
  Target: SCN10A; (-) strand; PAM type: NRG; PAM sequence: TAG
agaaaatggataccagaaaa

SEQ ID NO: 22131 - DNA, 20 bp, Artificial Sequence
  Description of Artificial Sequence: Synthetic oligonucleotide
  Target: SCN10A; (-) strand; PAM type: NRG; PAM sequence: CAG
tcaaggcagaaaatggatac

SEQ ID NO: 22132 - DNA, 20 bp, Artificial Sequence
  Description of Artificial Sequence: Synthetic oligonucleotide
  Target: SCN10A; (-) strand; PAM type: NRG; PAM sequence: TGG
aggggtctcaaggcagaaaa

SEQ ID NO: 22133 - DNA, 20 bp, Artificial Sequence
  Description of Artificial Sequence: Synthetic oligonucleotide
  Target: SCN10A; (-) strand; PAM type: NRG; PAM sequence: CAG
gaaggtcaggggtctcaagg

SEQ ID NO: 22134 - DNA, 20 bp, Artificial Sequence
  Description of Artificial Sequence: Synthetic oligonucleotide
  Target: SCN10A; (-) strand; PAM type: NRG; PAM sequence: AGG
gaggaaggtcaggggtctca

SEQ ID NO: 22135 - DNA, 20 bp, Artificial Sequence
  Description of Artificial Sequence: Synthetic oligonucleotide
  Target: SCN10A; (-) strand; PAM type: NRG; PAM sequence: AAG
ggaggaaggtcaggggtctc

SEQ ID NO: 22136 - DNA, 20 bp, Artificial Sequence
  Description of Artificial Sequence: Synthetic oligonucleotide
  Target: SCN10A; (-) strand; PAM type: NRG; PAM sequence: GGG
cactgtgggaggaaggtcag

SEQ ID NO: 22137 - DNA, 20 bp, Artificial Sequence
  Description of Artificial Sequence: Synthetic oligonucleotide
  Target: SCN10A; (-) strand; PAM type: NRG; PAM sequence: GGG
gcactgtgggaggaaggtca

SEQ ID NO: 22138 - DNA, 20 bp, Artificial Sequence
  Description of Artificial Sequence: Synthetic oligonucleotide
  Target: SCN10A; (-) strand; PAM type: NRG; PAM sequence: AGG
ggcactgtgggaggaaggtc

SEQ ID NO: 22139 - DNA, 20 bp, Artificial Sequence
  Description of Artificial Sequence: Synthetic oligonucleotide
  Target: SCN10A; (-) strand; PAM type: NRG; PAM sequence: CAG
tggcactgtgggaggaaggt

SEQ ID NO: 22140 - DNA, 20 bp, Artificial Sequence
  Description of Artificial Sequence: Synthetic oligonucleotide
  Target: SCN10A; (-) strand; PAM type: NRG; PAM sequence: AGG
ccaatggcactgtgggagga

SEQ ID NO: 22141 - DNA, 20 bp, Artificial Sequence
  Description of Artificial Sequence: Synthetic oligonucleotide
  Target: SCN10A; (-) strand; PAM type: NRG; PAM sequence: AAG
gccaatggcactgtgggagg

SEQ ID NO: 22142 - DNA, 20 bp, Artificial Sequence
  Description of Artificial Sequence: Synthetic oligonucleotide
  Target: SCN10A; (-) strand; PAM type: NRG; PAM sequence: AGG
ttggccaatggcactgtggg

SEQ ID NO: 22143 - DNA, 20 bp, Artificial Sequence
  Description of Artificial Sequence: Synthetic oligonucleotide
  Target: SCN10A; (-) strand; PAM type: NRG; PAM sequence: GAG
attggccaatggcactgtgg

SEQ ID NO: 22144 - DNA, 20 bp, Artificial Sequence
  Description of Artificial Sequence: Synthetic oligonucleotide
  Target: SCN10A; (-) strand; PAM type: NRG; PAM sequence: GGG
acattggccaatggcactgt

SEQ ID NO: 22145 - DNA, 20 bp, Artificial Sequence
  Description of Artificial Sequence: Synthetic oligonucleotide
  Target: SCN10A; (-) strand; PAM type: NRG; PAM sequence: TGG
cacattggccaatggcactg

SEQ ID NO: 22146 - DNA, 20 bp, Artificial Sequence
  Description of Artificial Sequence: Synthetic oligonucleotide
  Target: SCN10A; (-) strand; PAM type: NRG; PAM sequence: TGG
gaaaggcccacattggccaa

SEQ ID NO: 22147 - DNA, 20 bp, Artificial Sequence
  Description of Artificial Sequence: Synthetic oligonucleotide
  Target: SCN10A; (-) strand; PAM type: NRG; PAM sequence: TGG
tcctgaggaaaggcccacat

SEQ ID NO: 22148 - DNA, 20 bp, Artificial Sequence
  Description of Artificial Sequence: Synthetic oligonucleotide
  Target: SCN10A; (-) strand; PAM type: NRG; PAM sequence: AGG
gaagccagagtcctgaggaa

SEQ ID NO: 22149 - DNA, 20 bp, Artificial Sequence
  Description of Artificial Sequence: Synthetic oligonucleotide
  Target: SCN10A; (-) strand; PAM type: NRG; PAM sequence: AAG
agaagccagagtcctgagga

SEQ ID NO: 22150 - DNA, 20 bp, Artificial Sequence
  Description of Artificial Sequence: Synthetic oligonucleotide
  Target: SCN10A; (-) strand; PAM type: NRG; PAM sequence: AGG
gcagagaagccagagtcctg

SEQ ID NO: 22151 - DNA, 20 bp, Artificial Sequence
  Description of Artificial Sequence: Synthetic oligonucleotide
  Target: SCN10A; (-) strand; PAM type: NRG; PAM sequence: GAG
tgcagagaagccagagtcct

SEQ ID NO: 22152 - DNA, 20 bp, Artificial Sequence
  Description of Artificial Sequence: Synthetic oligonucleotide
  Target: SCN10A; (-) strand; PAM type: NRG; PAM sequence: GAG
gtggggctgcagagaagcca

SEQ ID NO: 22153 - DNA, 20 bp, Artificial Sequence
  Description of Artificial Sequence: Synthetic oligonucleotide
  Target: SCN10A; (-) strand; PAM type: NRG; PAM sequence: CAG
ctgtggggctgcagagaagc

SEQ ID NO: 22154 - DNA, 20 bp, Artificial Sequence
  Description of Artificial Sequence: Synthetic oligonucleotide
  Target: SCN10A; (-) strand; PAM type: NRG; PAM sequence: AAG
tcctctgtggggctgcagag

SEQ ID NO: 22155 - DNA, 20 bp, Artificial Sequence
  Description of Artificial Sequence: Synthetic oligonucleotide
  Target: SCN10A; (-) strand; PAM type: NRG; PAM sequence: GAG
gggtcctctgtggggctgca

SEQ ID NO: 22156 - DNA, 20 bp, Artificial Sequence
  Description of Artificial Sequence: Synthetic oligonucleotide
  Target: SCN10A; (-) strand; PAM type: NRG; PAM sequence: CAG
ctgggtcctctgtggggctg

SEQ ID NO: 22157 - DNA, 20 bp, Artificial Sequence
  Description of Artificial Sequence: Synthetic oligonucleotide
  Target: SCN10A; (-) strand; PAM type: NRG; PAM sequence: GGG
ctaaacctgggtcctctgtg

SEQ ID NO: 22158 - DNA, 20 bp, Artificial Sequence
  Description of Artificial Sequence: Synthetic oligonucleotide
  Target: SCN10A; (-) strand; PAM type: NRG; PAM sequence: GGG
gctaaacctgggtcctctgt

SEQ ID NO: 22159 - DNA, 20 bp, Artificial Sequence
  Description of Artificial Sequence: Synthetic oligonucleotide
  Target: SCN10A; (-) strand; PAM type: NRG; PAM sequence: TGG
agctaaacctgggtcctctg

SEQ ID NO: 22160 - DNA, 20 bp, Artificial Sequence
  Description of Artificial Sequence: Synthetic oligonucleotide
  Target: SCN10A; (-) strand; PAM type: NRG; PAM sequence: GGG
atgccgtgaaagctaaacct

SEQ ID NO: 22161 - DNA, 20 bp, Artificial Sequence
  Description of Artificial Sequence: Synthetic oligonucleotide
  Target: SCN10A; (-) strand; PAM type: NRG; PAM sequence: TGG
catgccgtgaaagctaaacc

SEQ ID NO: 22162 - DNA, 20 bp, Artificial Sequence
  Description of Artificial Sequence: Synthetic oligonucleotide
  Target: SCN10A; (-) strand; PAM type: NRG; PAM sequence: AAG
cctgccggggcatgccgtga

SEQ ID NO: 22163 - DNA, 20 bp, Artificial Sequence
  Description of Artificial Sequence: Synthetic oligonucleotide
  Target: SCN10A; (-) strand; PAM type: NRG; PAM sequence: GGG
ggacagagtgaaccctgccg

SEQ ID NO: 22164 - DNA, 20 bp, Artificial Sequence
  Description of Artificial Sequence: Synthetic oligonucleotide
  Target: SCN10A; (-) strand; PAM type: NRG; PAM sequence: GGG
cggacagagtgaaccctgcc

SEQ ID NO: 22165 - DNA, 20 bp, Artificial Sequence
  Description of Artificial Sequence: Synthetic oligonucleotide
  Target: SCN10A; (-) strand; PAM type: NRG; PAM sequence: CGG
acggacagagtgaaccctgc

SEQ ID NO: 22166 - DNA, 20 bp, Artificial Sequence
  Description of Artificial Sequence: Synthetic oligonucleotide
  Target: SCN10A; (-) strand; PAM type: NRG; PAM sequence: GAG
ccagctcaggataacggaca

SEQ ID NO: 22167 - DNA, 20 bp, Artificial Sequence
  Description of Artificial Sequence: Synthetic oligonucleotide
  Target: SCN10A; (-) strand; PAM type: NRG; PAM sequence: CAG
ggccagctcaggataacgga

SEQ ID NO: 22168 - DNA, 20 bp, Artificial Sequence
  Description of Artificial Sequence: Synthetic oligonucleotide
  Target: SCN10A; (-) strand; PAM type: NRG; PAM sequence: CGG
gagaggccagctcaggataa

SEQ ID NO: 22169 - DNA, 20 bp, Artificial Sequence
  Description of Artificial Sequence: Synthetic oligonucleotide
  Target: SCN10A; (-) strand; PAM type: NRG; PAM sequence: AGG
tggcagagagaggccagctc

SEQ ID NO: 22170 - DNA, 20 bp, Artificial Sequence
  Description of Artificial Sequence: Synthetic oligonucleotide
  Target: SCN10A; (-) strand; PAM type: NRG; PAM sequence: CAG
atggcagagagaggccagct

SEQ ID NO: 22171 - DNA, 20 bp, Artificial Sequence
  Description of Artificial Sequence: Synthetic oligonucleotide
  Target: SCN10A; (-) strand; PAM type: NRG; PAM sequence: CAG
ctgggatggcagagagaggc

SEQ ID NO: 22172 - DNA, 20 bp, Artificial Sequence
  Description of Artificial Sequence: Synthetic oligonucleotide
  Target: SCN10A; (-) strand; PAM type: NRG; PAM sequence: AGG
caggctgggatggcagagag

SEQ ID NO: 22173 - DNA, 20 bp, Artificial Sequence
  Description of Artificial Sequence: Synthetic oligonucleotide
  Target: SCN10A; (-) strand; PAM type: NRG; PAM sequence: GAG
ccaggctgggatggcagaga

SEQ ID NO: 22174 - DNA, 20 bp, Artificial Sequence
  Description of Artificial Sequence: Synthetic oligonucleotide
  Target: SCN10A; (-) strand; PAM type: NRG; PAM sequence: GAG
gaccaggctgggatggcaga

SEQ ID NO: 22175 - DNA, 20 bp, Artificial Sequence
  Description of Artificial Sequence: Synthetic oligonucleotide
  Target: SCN10A; (-) strand; PAM type: NRG; PAM sequence: GAG
tggaccaggctgggatggca

SEQ ID NO: 22176 - DNA, 20 bp, Artificial Sequence
  Description of Artificial Sequence: Synthetic oligonucleotide
  Target: SCN10A; (-) strand; PAM type: NRG; PAM sequence: CAG
agtggaccaggctgggatgg

SEQ ID NO: 22177 - DNA, 20 bp, Artificial Sequence
  Description of Artificial Sequence: Synthetic oligonucleotide
  Target: SCN10A; (-) strand; PAM type: NRG; PAM sequence: TGG
gggagtggaccaggctggga

SEQ ID NO: 22178 - DNA, 20 bp, Artificial Sequence
  Description of Artificial Sequence: Synthetic oligonucleotide
  Target: SCN10A; (-) strand; PAM type: NRG; PAM sequence: GGG
gtgggggagtggaccaggct

SEQ ID NO: 22179 - DNA, 20 bp, Artificial Sequence
  Description of Artificial Sequence: Synthetic oligonucleotide
  Target: SCN10A; (-) strand; PAM type: NRG; PAM sequence: TGG
agtgggggagtggaccaggc

SEQ ID NO: 22180 - DNA, 20 bp, Artificial Sequence
  Description of Artificial Sequence: Synthetic oligonucleotide
  Target: SCN10A; (-) strand; PAM type: NRG; PAM sequence: AGG
aggcagtgggggagtggacc

SEQ ID NO: 22181 - DNA, 20 bp, Artificial Sequence
  Description of Artificial Sequence: Synthetic oligonucleotide
  Target: SCN10A; (-) strand; PAM type: NRG; PAM sequence: CAG
caggcagtgggggagtggac

SEQ ID NO: 22182 - DNA, 20 bp, Artificial Sequence
  Description of Artificial Sequence: Synthetic oligonucleotide
  Target: SCN10A; (-) strand; PAM type: NRG; PAM sequence: TGG
ccagccaggcagtgggggag

SEQ ID NO: 22183 - DNA, 20 bp, Artificial Sequence
  Description of Artificial Sequence: Synthetic oligonucleotide
  Target: SCN10A; (-) strand; PAM type: NRG; PAM sequence: GAG
gtgccagccaggcagtgggg

SEQ ID NO: 22184 - DNA, 20 bp, Artificial Sequence
  Description of Artificial Sequence: Synthetic oligonucleotide
  Target: SCN10A; (-) strand; PAM type: NRG; PAM sequence: GGG
aggtgccagccaggcagtgg

SEQ ID NO: 22185 - DNA, 20 bp, Artificial Sequence
  Description of Artificial Sequence: Synthetic oligonucleotide
  Target: SCN10A; (-) strand; PAM type: NRG; PAM sequence: GGG
caggtgccagccaggcagtg

SEQ ID NO: 22186 - DNA, 20 bp, Artificial Sequence
  Description of Artificial Sequence: Synthetic oligonucleotide
  Target: SCN10A; (-) strand; PAM type: NRG; PAM sequence: GGG
gcaggtgccagccaggcagt

SEQ ID NO: 22187 - DNA, 20 bp, Artificial Sequence
  Description of Artificial Sequence: Synthetic oligonucleotide
  Target: SCN10A; (-) strand; PAM type: NRG; PAM sequence: TGG
ggcaggtgccagccaggcag

SEQ ID NO: 22188 - DNA, 20 bp, Artificial Sequence
  Description of Artificial Sequence: Synthetic oligonucleotide
  Target: SCN10A; (-) strand; PAM type: NRG; PAM sequence: CAG
ttgggcaggtgccagccagg

SEQ ID NO: 22189 - DNA, 20 bp, Artificial Sequence
  Description of Artificial Sequence: Synthetic oligonucleotide
  Target: SCN10A; (-) strand; PAM type: NRG; PAM sequence: AGG
ctattgggcaggtgccagcc

SEQ ID NO: 22190 - DNA, 20 bp, Artificial Sequence
  Description of Artificial Sequence: Synthetic oligonucleotide
  Target: SCN10A; (-) strand; PAM type: NRG; PAM sequence: CAG
gctattgggcaggtgccagc

SEQ ID NO: 22191 - DNA, 20 bp, Artificial Sequence
  Description of Artificial Sequence: Synthetic oligonucleotide
  Target: SCN10A; (-) strand; PAM type: NRG; PAM sequence: CAG
gcctgctattgggcaggtgc

SEQ ID NO: 22192 - DNA, 20 bp, Artificial Sequence
  Description of Artificial Sequence: Synthetic oligonucleotide
  Target: SCN10A; (-) strand; PAM type: NRG; PAM sequence: AGG
ggccaggcctgctattgggc

SEQ ID NO: 22193 - DNA, 20 bp, Artificial Sequence
  Description of Artificial Sequence: Synthetic oligonucleotide
  Target: SCN10A; (-) strand; PAM type: NRG; PAM sequence: CAG
aggccaggcctgctattggg

SEQ ID NO: 22194 - DNA, 20 bp, Artificial Sequence
  Description of Artificial Sequence: Synthetic oligonucleotide
  Target: SCN10A; (-) strand; PAM type: NRG; PAM sequence: GGG
gagaggccaggcctgctatt

SEQ ID NO: 22195 - DNA, 20 bp, Artificial Sequence
  Description of Artificial Sequence: Synthetic oligonucleotide
  Target: SCN10A; (-) strand; PAM type: NRG; PAM sequence: TGG
tgagaggccaggcctgctat

SEQ ID NO: 22196 - DNA, 20 bp, Artificial Sequence
  Description of Artificial Sequence: Synthetic oligonucleotide
  Target: SCN10A; (-) strand; PAM type: NRG; PAM sequence: AGG
gctcagctccctgagaggcc

SEQ ID NO: 22197 - DNA, 20 bp, Artificial Sequence
  Description of Artificial Sequence: Synthetic oligonucleotide
  Target: SCN10A; (-) strand; PAM type: NRG; PAM sequence: CAG
agctcagctccctgagaggc

SEQ ID NO: 22198 - DNA, 20 bp, Artificial Sequence
  Description of Artificial Sequence: Synthetic oligonucleotide
  Target: SCN10A; (-) strand; PAM type: NRG; PAM sequence: AGG
ctacagctcagctccctgag

SEQ ID NO: 22199 - DNA, 20 bp, Artificial Sequence
  Description of Artificial Sequence: Synthetic oligonucleotide
  Target: SCN10A; (-) strand; PAM type: NRG; PAM sequence: GAG
tctacagctcagctccctga

SEQ ID NO: 22200 - DNA, 20 bp, Artificial Sequence
  Description of Artificial Sequence: Synthetic oligonucleotide
  Target: SCN10A; (-) strand; PAM type: NRG; PAM sequence: GAG
cctctacagctcagctccct

SEQ ID NO: 22201 - DNA, 20 bp, Artificial Sequence
  Description of Artificial Sequence: Synthetic oligonucleotide
  Target: SCN10A; (-) strand; PAM type: NRG; PAM sequence: CAG
atctacacacctctacagct

SEQ ID NO: 22202 - DNA, 20 bp, Artificial Sequence
  Description of Artificial Sequence: Synthetic oligonucleotide
  Target: SCN10A; (-) strand; PAM type: NRG; PAM sequence: CAG
ggtccatctacacacctcta

SEQ ID NO: 22203 - DNA, 20 bp, Artificial Sequence
  Description of Artificial Sequence: Synthetic oligonucleotide
  Target: SCN10A; (-) strand; PAM type: NRG; PAM sequence: GGG
ctttttgtggtaaagttgtt

SEQ ID NO: 22204 - DNA, 20 bp, Artificial Sequence
  Description of Artificial Sequence: Synthetic oligonucleotide
  Target: SCN10A; (-) strand; PAM type: NRG; PAM sequence: TGG
cctttttgtggtaaagttgt

SEQ ID NO: 22205 - DNA, 20 bp, Artificial Sequence
  Description of Artificial Sequence: Synthetic oligonucleotide
  Target: SCN10A; (-) strand; PAM type: NRG; PAM sequence: AAG
ctcaagtcctttttgtggta

SEQ ID NO: 22206 - DNA, 20 bp, Artificial Sequence
  Description of Artificial Sequence: Synthetic oligonucleotide
  Target: SCN10A; (-) strand; PAM type: NRG; PAM sequence: TGG
agcagctcaagtcctttttg

SEQ ID NO: 22207 - DNA, 20 bp, Artificial Sequence
  Description of Artificial Sequence: Synthetic oligonucleotide
  Target: SCN10A; (-) strand; PAM type: NRG; PAM sequence: AAG
caatggctccagagcagctc

SEQ ID NO: 22208 - DNA, 20 bp, Artificial Sequence
  Description of Artificial Sequence: Synthetic oligonucleotide
  Target: SCN10A; (-) strand; PAM type: NRG; PAM sequence: CAG
tcaaggcaatggctccagag

SEQ ID NO: 22209 - DNA, 20 bp, Artificial Sequence
  Description of Artificial Sequence: Synthetic oligonucleotide
  Target: SCN10A; (-) strand; PAM type: NRG; PAM sequence: GAG
ttctcaaggcaatggctcca

SEQ ID NO: 22210 - DNA, 20 bp, Artificial Sequence
  Description of Artificial Sequence: Synthetic oligonucleotide
  Target: SCN10A; (-) strand; PAM type: NRG; PAM sequence: CAG
atttctcaaggcaatggctc

SEQ ID NO: 22211 - DNA, 20 bp, Artificial Sequence
  Description of Artificial Sequence: Synthetic oligonucleotide
  Target: SCN10A; (-) strand; PAM type: NRG; PAM sequence: TGG
aatggcatttctcaaggcaa

SEQ ID NO: 22212 - DNA, 20 bp, Artificial Sequence
  Description of Artificial Sequence: Synthetic oligonucleotide
  Target: SCN10A; (-) strand; PAM type: NRG; PAM sequence: AGG
ctagataatggcatttctca

SEQ ID NO: 22213 - DNA, 20 bp, Artificial Sequence
  Description of Artificial Sequence: Synthetic oligonucleotide
  Target: SCN10A; (-) strand; PAM type: NRG; PAM sequence: AAG
tctagataatggcatttctc

SEQ ID NO: 22214 - DNA, 20 bp, Artificial Sequence
  Description of Artificial Sequence: Synthetic oligonucleotide
  Target: SCN10A; (-) strand; PAM type: NRG; PAM sequence: TGG
gcatccttctgtctagataa

SEQ ID NO: 22215 - DNA, 20 bp, Artificial Sequence
  Description of Artificial Sequence: Synthetic oligonucleotide
  Target: SCN10A; (-) strand; PAM type: NRG; PAM sequence: TAG
cccctcagcatccttctgtc

SEQ ID NO: 22216 - DNA, 20 bp, Artificial Sequence
  Description of Artificial Sequence: Synthetic oligonucleotide
  Target: SCN10A; (-) strand; PAM type: NRG; PAM sequence: CAG
aatgtaaaccaagagcccct

SEQ ID NO: 22217 - DNA, 20 bp, Artificial Sequence
  Description of Artificial Sequence: Synthetic oligonucleotide
  Target: SCN10A; (-) strand; PAM type: NRG; PAM sequence: GAG
ttgacttaaatgtaaaccaa

SEQ ID NO: 22218 - DNA, 20 bp, Artificial Sequence
  Description of Artificial Sequence: Synthetic oligonucleotide
  Target: SCN10A; (-) strand; PAM type: NRG; PAM sequence: AAG
ctttgacttaaatgtaaacc

SEQ ID NO: 22219 - DNA, 20 bp, Artificial Sequence
  Description of Artificial Sequence: Synthetic oligonucleotide
  Target: SCN10A; (-) strand; PAM type: NRG; PAM sequence: CAG
tgagagggttgttctgacat

SEQ ID NO: 22220 - DNA, 20 bp, Artificial Sequence
  Description of Artificial Sequence: Synthetic oligonucleotide
  Target: SCN10A; (-) strand; PAM type: NRG; PAM sequence: GGG
tggttctttggctcatgaga

SEQ ID NO: 22221 - DNA, 20 bp, Artificial Sequence
  Description of Artificial Sequence: Synthetic oligonucleotide
  Target: SCN10A; (-) strand; PAM type: NRG; PAM sequence: AGG
ttggttctttggctcatgag

SEQ ID NO: 22222 - DNA, 20 bp, Artificial Sequence
  Description of Artificial Sequence: Synthetic oligonucleotide
  Target: SCN10A; (-) strand; PAM type: NRG; PAM sequence: GAG
tttggttctttggctcatga

SEQ ID NO: 22223 - DNA, 20 bp, Artificial Sequence
  Description of Artificial Sequence: Synthetic oligonucleotide
  Target: SCN10A; (-) strand; PAM type: NRG; PAM sequence: GAG
catttggttctttggctcat

SEQ ID NO: 22224 - DNA, 20 bp, Artificial Sequence
  Description of Artificial Sequence: Synthetic oligonucleotide
  Target: SCN10A; (-) strand; PAM type: NRG; PAM sequence: TGG
gcacttggcatttggttctt

SEQ ID NO: 22225 - DNA, 20 bp, Artificial Sequence
  Description of Artificial Sequence: Synthetic oligonucleotide
  Target: SCN10A; (-) strand; PAM type: NRG; PAM sequence: TGG
tcacaaatgcacttggcatt

SEQ ID NO: 22226 - DNA, 20 bp, Artificial Sequence
  Description of Artificial Sequence: Synthetic oligonucleotide
  Target: SCN10A; (-) strand; PAM type: NRG; PAM sequence: TGG
tgttctttcacaaatgcact

SEQ ID NO: 22227 - DNA, 20 bp, Artificial Sequence
  Description of Artificial Sequence: Synthetic oligonucleotide
  Target: SCN10A; (-) strand; PAM type: NRG; PAM sequence: TGG
ttggtcaacatcaggttcct

SEQ ID NO: 22228 - DNA, 20 bp, Artificial Sequence
  Description of Artificial Sequence: Synthetic oligonucleotide
  Target: SCN10A; (-) strand; PAM type: NRG; PAM sequence: AGG
aggagcatttggtcaacatc

SEQ ID NO: 22229 - DNA, 20 bp, Artificial Sequence
  Description of Artificial Sequence: Synthetic oligonucleotide
  Target: SCN10A; (-) strand; PAM type: NRG; PAM sequence: CAG
caggagcatttggtcaacat

SEQ ID NO: 22230 - DNA, 20 bp, Artificial Sequence
  Description of Artificial Sequence: Synthetic oligonucleotide
  Target: SCN10A; (-) strand; PAM type: NRG; PAM sequence: TGG
tggaaacaagcaggagcatt

SEQ ID NO: 22231 - DNA, 20 bp, Artificial Sequence
  Description of Artificial Sequence: Synthetic oligonucleotide
  Target: SCN10A; (-) strand; PAM type: NRG; PAM sequence: GAG
tgaggactggaaacaagcag

SEQ ID NO: 22232 - DNA, 20 bp, Artificial Sequence
  Description of Artificial Sequence: Synthetic oligonucleotide
  Target: SCN10A; (-) strand; PAM type: NRG; PAM sequence: AGG
gctgaggactggaaacaagc

SEQ ID NO: 22233 - DNA, 20 bp, Artificial Sequence
  Description of Artificial Sequence: Synthetic oligonucleotide
  Target: SCN10A; (-) strand; PAM type: NRG; PAM sequence: CAG
agctgaggactggaaacaag

SEQ ID NO: 22234 - DNA, 20 bp, Artificial Sequence
  Description of Artificial Sequence: Synthetic oligonucleotide
  Target: SCN10A; (-) strand; PAM type: NRG; PAM sequence: AAG
tggagctgaggactggaaac

SEQ ID NO: 22235 - DNA, 20 bp, Artificial Sequence
  Description of Artificial Sequence: Synthetic oligonucleotide
  Target: SCN10A; (-) strand; PAM type: NRG; PAM sequence: TGG
tctcagttggagctgaggac

SEQ ID NO: 22236 - DNA, 20 bp, Artificial Sequence
  Description of Artificial Sequence: Synthetic oligonucleotide
  Target: SCN10A; (-) strand; PAM type: NRG; PAM sequence: AGG
aactatctcagttggagctg

SEQ ID NO: 22237 - DNA, 20 bp, Artificial Sequence
  Description of Artificial Sequence: Synthetic oligonucleotide
  Target: SCN10A; (-) strand; PAM type: NRG; PAM sequence: GAG
aaactatctcagttggagct

SEQ ID NO: 22238 - DNA, 20 bp, Artificial Sequence
  Description of Artificial Sequence: Synthetic oligonucleotide
  Target: SCN10A; (-) strand; PAM type: NRG; PAM sequence: GAG
taggaaaactatctcagttg

SEQ ID NO: 22239 - DNA, 20 bp, Artificial Sequence
  Description of Artificial Sequence: Synthetic oligonucleotide
  Target: SCN10A; (-) strand; PAM type: NRG; PAM sequence: TGG
actaggaaaactatctcagt

SEQ ID NO: 22240 - DNA, 20 bp, Artificial Sequence
  Description of Artificial Sequence: Synthetic oligonucleotide
  Target: SCN10A; (-) strand; PAM type: NRG; PAM sequence: CAG
gctcactaggaaaactatct

SEQ ID NO: 22241 - DNA, 20 bp, Artificial Sequence
  Description of Artificial Sequence: Synthetic oligonucleotide
  Target: SCN10A; (-) strand; PAM type: NRG; PAM sequence: AGG
tccaccttcatcagctcact

SEQ ID NO: 22242 - DNA, 20 bp, Artificial Sequence
  Description of Artificial Sequence: Synthetic oligonucleotide
  Target: SCN10A; (-) strand; PAM type: NRG; PAM sequence: TAG
ctccaccttcatcagctcac

SEQ ID NO: 22243 - DNA, 20 bp, Artificial Sequence
  Description of Artificial Sequence: Synthetic oligonucleotide
  Target: SCN10A; (-) strand; PAM type: NRG; PAM sequence: CAG
gcatgaggctccaccttcat

SEQ ID NO: 22244 - DNA, 20 bp, Artificial Sequence
  Description of Artificial Sequence: Synthetic oligonucleotide
  Target: SCN10A; (-) strand; PAM type: NRG; PAM sequence: AGG
acctgtgtggagcctgcatg

SEQ ID NO: 22245 - DNA, 20 bp, Artificial Sequence
  Description of Artificial Sequence: Synthetic oligonucleotide
  Target: SCN10A; (-) strand; PAM type: NRG; PAM sequence: GAG
gacctgtgtggagcctgcat

SEQ ID NO: 22246 - DNA, 20 bp, Artificial Sequence
  Description of Artificial Sequence: Synthetic oligonucleotide
  Target: SCN10A; (-) strand; PAM type: NRG; PAM sequence: GAG
tgcccaggtcgacctgtgtg

SEQ ID NO: 22247 - DNA, 20 bp, Artificial Sequence
  Description of Artificial Sequence: Synthetic oligonucleotide
  Target: SCN10A; (-) strand; PAM type: NRG; PAM sequence: TGG
gttgcccaggtcgacctgtg

SEQ ID NO: 22248 - DNA, 20 bp, Artificial Sequence
  Description of Artificial Sequence: Synthetic oligonucleotide
  Target: SCN10A; (-) strand; PAM type: NRG; PAM sequence: AGG
ctgacggctccatgttgccc

SEQ ID NO: 22249 - DNA, 20 bp, Artificial Sequence
  Description of Artificial Sequence: Synthetic oligonucleotide
  Target: SCN10A; (-) strand; PAM type: NRG; PAM sequence: CAG
gctgacggctccatgttgcc

SEQ ID NO: 22250 - DNA, 20 bp, Artificial Sequence
  Description of Artificial Sequence: Synthetic oligonucleotide
  Target: SCN10A; (-) strand; PAM type: NRG; PAM sequence: CGG
cccagtgcctgagaggctga

SEQ ID NO: 22251 - DNA, 20 bp, Artificial Sequence
  Description of Artificial Sequence: Synthetic oligonucleotide
  Target: SCN10A; (-) strand; PAM type: NRG; PAM sequence: AGG
caacacccccagtgcctgag

SEQ ID NO: 22252 - DNA, 20 bp, Artificial Sequence
  Description of Artificial Sequence: Synthetic oligonucleotide
  Target: SCN10A; (-) strand; PAM type: NRG; PAM sequence: GAG
acaacacccccagtgcctga

SEQ ID NO: 22253 - DNA, 20 bp, Artificial Sequence
  Description of Artificial Sequence: Synthetic oligonucleotide
  Target: SCN10A; (-) strand; PAM type: NRG; PAM sequence: GAG
tcacaacacccccagtgcct

SEQ ID NO: 22254 - DNA, 20 bp, Artificial Sequence
  Description of Artificial Sequence: Synthetic oligonucleotide
  Target: SCN10A; (-) strand; PAM type: NRG; PAM sequence: CAG
agcagagctcacaacacccc

SEQ ID NO: 22255 - DNA, 20 bp, Artificial Sequence
  Description of Artificial Sequence: Synthetic oligonucleotide
  Target: SCN10A; (-) strand; PAM type: NRG; PAM sequence: GAG
gctgagagcttggaaaagca

SEQ ID NO: 22256 - DNA, 20 bp, Artificial Sequence
  Description of Artificial Sequence: Synthetic oligonucleotide
  Target: SCN10A; (-) strand; PAM type: NRG; PAM sequence: CAG
tggctgagagcttggaaaag

SEQ ID NO: 22257 - DNA, 20 bp, Artificial Sequence
  Description of Artificial Sequence: Synthetic oligonucleotide
  Target: SCN10A; (-) strand; PAM type: NRG; PAM sequence: AAG
ccatggctgagagcttggaa

SEQ ID NO: 22258 - DNA, 20 bp, Artificial Sequence
  Description of Artificial Sequence: Synthetic oligonucleotide
  Target: SCN10A; (-) strand; PAM type: NRG; PAM sequence: TGG
cacctccatggctgagagct

SEQ ID NO: 22259 - DNA, 20 bp, Artificial Sequence
  Description of Artificial Sequence: Synthetic oligonucleotide
  Target: SCN10A; (-) strand; PAM type: NRG; PAM sequence: GAG
tcacccacctccatggctga

SEQ ID NO: 22260 - DNA, 20 bp, Artificial Sequence
  Description of Artificial Sequence: Synthetic oligonucleotide
  Target: SCN10A; (-) strand; PAM type: NRG; PAM sequence: GAG
tctcacccacctccatggct

SEQ ID NO: 22261 - DNA, 20 bp, Artificial Sequence
  Description of Artificial Sequence: Synthetic oligonucleotide
  Target: SCN10A; (-) strand; PAM type: NRG; PAM sequence: TGG
gcccatctcacccacctcca

SEQ ID NO: 22262 - DNA, 20 bp, Artificial Sequence
  Description of Artificial Sequence: Synthetic oligonucleotide
  Target: SCN10A; (-) strand; PAM type: NRG; PAM sequence: AGG
ctttaggcaaaagatcaaaa

SEQ ID NO: 22263 - DNA, 20 bp, Artificial Sequence
  Description of Artificial Sequence: Synthetic oligonucleotide
  Target: SCN10A; (-) strand; PAM type: NRG; PAM sequence: AAG
actttaggcaaaagatcaaa

SEQ ID NO: 22264 - DNA, 20 bp, Artificial Sequence
  Description of Artificial Sequence: Synthetic oligonucleotide
  Target: SCN10A; (-) strand; PAM type: NRG; PAM sequence: AAG
agcagaaagactttaggcaa

SEQ ID NO: 22265 - DNA, 20 bp, Artificial Sequence
  Description of Artificial Sequence: Synthetic oligonucleotide
  Target: SCN10A; (-) strand; PAM type: NRG; PAM sequence: AGG
ggcatgagcagaaagacttt

SEQ ID NO: 22266 - DNA, 20 bp, Artificial Sequence
  Description of Artificial Sequence: Synthetic oligonucleotide
  Target: SCN10A; (-) strand; PAM type: NRG; PAM sequence: TAG
aggcatgagcagaaagactt

SEQ ID NO: 22267 - DNA, 20 bp, Artificial Sequence
  Description of Artificial Sequence: Synthetic oligonucleotide
  Target: SCN10A; (-) strand; PAM type: NRG; PAM sequence: AAG
tggaggaaggcatgagcaga

SEQ ID NO: 22268 - DNA, 20 bp, Artificial Sequence
  Description of Artificial Sequence: Synthetic oligonucleotide
  Target: SCN10A; (-) strand; PAM type: NRG; PAM sequence: CAG
ccactggaggaaggcatgag

SEQ ID NO: 22269 - DNA, 20 bp, Artificial Sequence
  Description of Artificial Sequence: Synthetic oligonucleotide
  Target: SCN10A; (-) strand; PAM type: NRG; PAM sequence: GAG
tggccactggaggaaggcat

SEQ ID NO: 22270 - DNA, 20 bp, Artificial Sequence
  Description of Artificial Sequence: Synthetic oligonucleotide
  Target: SCN10A; (-) strand; PAM type: NRG; PAM sequence: AGG
ctgctttggccactggagga

SEQ ID NO: 22271 - DNA, 20 bp, Artificial Sequence
  Description of Artificial Sequence: Synthetic oligonucleotide
  Target: SCN10A; (-) strand; PAM type: NRG; PAM sequence: AAG
gctgctttggccactggagg

SEQ ID NO: 22272 - DNA, 20 bp, Artificial Sequence
  Description of Artificial Sequence: Synthetic oligonucleotide
  Target: SCN10A; (-) strand; PAM type: NRG; PAM sequence: AGG
cctgctgctttggccactgg

SEQ ID NO: 22273 - DNA, 20 bp, Artificial Sequence
  Description of Artificial Sequence: Synthetic oligonucleotide
  Target: SCN10A; (-) strand; PAM type: NRG; PAM sequence: GAG
gcctgctgctttggccactg

SEQ ID NO: 22274 - DNA, 20 bp, Artificial Sequence
  Description of Artificial Sequence: Synthetic oligonucleotide
  Target: SCN10A; (-) strand; PAM type: NRG; PAM sequence: TGG
ctgcctgctgctttggccac

SEQ ID NO: 22275 - DNA, 20 bp, Artificial Sequence
  Description of Artificial Sequence: Synthetic oligonucleotide
  Target: SCN10A; (-) strand; PAM type: NRG; PAM sequence: TGG
ctcagctctgcctgctgctt

SEQ ID NO: 22276 - DNA, 20 bp, Artificial Sequence
  Description of Artificial Sequence: Synthetic oligonucleotide
  Target: SCN10A; (-) strand; PAM type: NRG; PAM sequence: CAG
gctaagggatgaggacccct

SEQ ID NO: 22277 - DNA, 20 bp, Artificial Sequence
  Description of Artificial Sequence: Synthetic oligonucleotide
  Target: SCN10A; (-) strand; PAM type: NRG; PAM sequence: AGG
tgagacaaagctaagggatg

SEQ ID NO: 22278 - DNA, 20 bp, Artificial Sequence
  Description of Artificial Sequence: Synthetic oligonucleotide
  Target: SCN10A; (-) strand; PAM type: NRG; PAM sequence: GAG
gtgagacaaagctaagggat

SEQ ID NO: 22279 - DNA, 20 bp, Artificial Sequence
  Description of Artificial Sequence: Synthetic oligonucleotide
  Target: SCN10A; (-) strand; PAM type: NRG; PAM sequence: GGG
agaatgtgagacaaagctaa

SEQ ID NO: 22280 - DNA, 20 bp, Artificial Sequence
  Description of Artificial Sequence: Synthetic oligonucleotide
  Target: SCN10A; (-) strand; PAM type: NRG; PAM sequence: AGG
cagaatgtgagacaaagcta

SEQ ID NO: 22281 - DNA, 20 bp, Artificial Sequence
  Description of Artificial Sequence: Synthetic oligonucleotide
  Target: SCN10A; (-) strand; PAM type: NRG; PAM sequence: AAG
acagaatgtgagacaaagct

SEQ ID NO: 22282 - DNA, 20 bp, Artificial Sequence
  Description of Artificial Sequence: Synthetic oligonucleotide
  Target: SCN10A; (-) strand; PAM type: NRG; PAM sequence: AAG
gcagaacagaatgtgagaca

SEQ ID NO: 22283 - DNA, 20 bp, Artificial Sequence
  Description of Artificial Sequence: Synthetic oligonucleotide
  Target: SCN10A; (-) strand; PAM type: NRG; PAM sequence: GAG
caggtggcagaacagaatgt

SEQ ID NO: 22284 - DNA, 20 bp, Artificial Sequence
  Description of Artificial Sequence: Synthetic oligonucleotide
  Target: SCN10A; (-) strand; PAM type: NRG; PAM sequence: CAG
gaccattccaggtggcagaa

SEQ ID NO: 22285 - DNA, 20 bp, Artificial Sequence
  Description of Artificial Sequence: Synthetic oligonucleotide
  Target: SCN10A; (-) strand; PAM type: NRG; PAM sequence: CAG
gcgaagaccattccaggtgg

SEQ ID NO: 22286 - DNA, 20 bp, Artificial Sequence
  Description of Artificial Sequence: Synthetic oligonucleotide
  Target: SCN10A; (-) strand; PAM type: NRG; PAM sequence: TGG
tcagcgaagaccattccagg

SEQ ID NO: 22287 - DNA, 20 bp, Artificial Sequence
  Description of Artificial Sequence: Synthetic oligonucleotide
  Target: SCN10A; (-) strand; PAM type: NRG; PAM sequence: AGG
gtttcagcgaagaccattcc

SEQ ID NO: 22288 - DNA, 20 bp, Artificial Sequence
  Description of Artificial Sequence: Synthetic oligonucleotide
  Target: SCN10A; (-) strand; PAM type: NRG; PAM sequence: CAG
agtttcagcgaagaccattc

SEQ ID NO: 22289 - DNA, 20 bp, Artificial Sequence
  Description of Artificial Sequence: Synthetic oligonucleotide
  Target: SCN10A; (-) strand; PAM type: NRG; PAM sequence: AAG
aatacgagatagtttcagcg

SEQ ID NO: 22290 - DNA, 20 bp, Artificial Sequence
  Description of Artificial Sequence: Synthetic oligonucleotide
  Target: SCN10A; (-) strand; PAM type: NRG; PAM sequence: CAG
gggtgaatacgagatagttt

SEQ ID NO: 22291 - DNA, 20 bp, Artificial Sequence
  Description of Artificial Sequence: Synthetic oligonucleotide
  Target: SCN10A; (-) strand; PAM type: NRG; PAM sequence: TAG
caggctgggtgaatacgaga

SEQ ID NO: 22292 - DNA, 20 bp, Artificial Sequence
  Description of Artificial Sequence: Synthetic oligonucleotide
  Target: SCN10A; (-) strand; PAM type: NRG; PAM sequence: GAG
tctccaggctgggtgaatac

SEQ ID NO: 22293 - DNA, 20 bp, Artificial Sequence
  Description of Artificial Sequence: Synthetic oligonucleotide
  Target: SCN10A; (-) strand; PAM type: NRG; PAM sequence: GGG
aggtaggatgtctccaggct

SEQ ID NO: 22294 - DNA, 20 bp, Artificial Sequence
  Description of Artificial Sequence: Synthetic oligonucleotide
  Target: SCN10A; (-) strand; PAM type: NRG; PAM sequence: TGG
caggtaggatgtctccaggc

SEQ ID NO: 22295 - DNA, 20 bp, Artificial Sequence
  Description of Artificial Sequence: Synthetic oligonucleotide
  Target: SCN10A; (-) strand; PAM type: NRG; PAM sequence: AGG
agggcaggtaggatgtctcc

SEQ ID NO: 22296 - DNA, 20 bp, Artificial Sequence
  Description of Artificial Sequence: Synthetic oligonucleotide
  Target: SCN10A; (-) strand; PAM type: NRG; PAM sequence: CAG
aagggcaggtaggatgtctc

SEQ ID NO: 22297 - DNA, 20 bp, Artificial Sequence
  Description of Artificial Sequence: Synthetic oligonucleotide
  Target: SCN10A; (-) strand; PAM type: NRG; PAM sequence: AGG
gtgagctttcaagggcaggt

SEQ ID NO: 22298 - DNA, 20 bp, Artificial Sequence
  Description of Artificial Sequence: Synthetic oligonucleotide
  Target: SCN10A; (-) strand; PAM type: NRG; PAM sequence: TAG
ggtgagctttcaagggcagg

SEQ ID NO: 22299 - DNA, 20 bp, Artificial Sequence
  Description of Artificial Sequence: Synthetic oligonucleotide
  Target: SCN10A; (-) strand; PAM type: NRG; PAM sequence: AGG
tgaggtgagctttcaagggc

SEQ ID NO: 22300 - DNA, 20 bp, Artificial Sequence
  Description of Artificial Sequence: Synthetic oligonucleotide
  Target: SCN10A; (-) strand; PAM type: NRG; PAM sequence: CAG
ttgaggtgagctttcaaggg

SEQ ID NO: 22301 - DNA, 20 bp, Artificial Sequence
  Description of Artificial Sequence: Synthetic oligonucleotide
  Target: SCN10A; (-) strand; PAM type: NRG; PAM sequence: GGG
tgtttgaggtgagctttcaa

SEQ ID NO: 22302 - DNA, 20 bp, Artificial Sequence
  Description of Artificial Sequence: Synthetic oligonucleotide
  Target: SCN10A; (-) strand; PAM type: NRG; PAM sequence: AGG
gtgtttgaggtgagctttca

SEQ ID NO: 22303 - DNA, 20 bp, Artificial Sequence
  Description of Artificial Sequence: Synthetic oligonucleotide
  Target: SCN10A; (-) strand; PAM type: NRG; PAM sequence: AAG
ggtgtttgaggtgagctttc

SEQ ID NO: 22304 - DNA, 20 bp, Artificial Sequence
  Description of Artificial Sequence: Synthetic oligonucleotide
  Target: SCN10A; (-) strand; PAM type: NRG; PAM sequence: GAG
ctggaggtggtgtttgaggt

SEQ ID NO: 22305 - DNA, 20 bp, Artificial Sequence
  Description of Artificial Sequence: Synthetic oligonucleotide
  Target: SCN10A; (-) strand; PAM type: NRG; PAM sequence: AGG
cttcctggaggtggtgtttg

SEQ ID NO: 22306 - DNA, 20 bp, Artificial Sequence
  Description of Artificial Sequence: Synthetic oligonucleotide
  Target: SCN10A; (-) strand; PAM type: NRG; PAM sequence: GAG
gcttcctggaggtggtgttt

SEQ ID NO: 22307 - DNA, 20 bp, Artificial Sequence
  Description of Artificial Sequence: Synthetic oligonucleotide
  Target: SCN10A; (-) strand; PAM type: NRG; PAM sequence: TGG
tagggaaggcttcctggagg

SEQ ID NO: 22308 - DNA, 20 bp, Artificial Sequence
  Description of Artificial Sequence: Synthetic oligonucleotide
  Target: SCN10A; (-) strand; PAM type: NRG; PAM sequence: AGG
aagtagggaaggcttcctgg

SEQ ID NO: 22309 - DNA, 20 bp, Artificial Sequence
  Description of Artificial Sequence: Synthetic oligonucleotide
  Target: SCN10A; (-) strand; PAM type: NRG; PAM sequence: GAG
aaagtagggaaggcttcctg

SEQ ID NO: 22310 - DNA, 20 bp, Artificial Sequence
  Description of Artificial Sequence: Synthetic oligonucleotide
  Target: SCN10A; (-) strand; PAM type: NRG; PAM sequence: TGG
agaaagtagggaaggcttcc

SEQ ID NO: 22311 - DNA, 20 bp, Artificial Sequence
  Description of Artificial Sequence: Synthetic oligonucleotide
  Target: SCN10A; (-) strand; PAM type: NRG; PAM sequence: AGG
ggcaagagagaaagtaggga

SEQ ID NO: 22312 - DNA, 20 bp, Artificial Sequence
  Description of Artificial Sequence: Synthetic oligonucleotide
  Target: SCN10A; (-) strand; PAM type: NRG; PAM sequence: AAG
aggcaagagagaaagtaggg

SEQ ID NO: 22313 - DNA, 20 bp, Artificial Sequence
  Description of Artificial Sequence: Synthetic oligonucleotide
  Target: SCN10A; (-) strand; PAM type: NRG; PAM sequence: GGG
gtgaggcaagagagaaagta

SEQ ID NO: 22314 - DNA, 20 bp, Artificial Sequence
  Description of Artificial Sequence: Synthetic oligonucleotide
  Target: SCN10A; (-) strand; PAM type: NRG; PAM sequence: AGG
tgtgaggcaagagagaaagt

SEQ ID NO: 22315 - DNA, 20 bp, Artificial Sequence
  Description of Artificial Sequence: Synthetic oligonucleotide
  Target: SCN10A; (-) strand; PAM type: NRG; PAM sequence: TAG
gtgtgaggcaagagagaaag

SEQ ID NO: 22316 - DNA, 20 bp, Artificial Sequence
  Description of Artificial Sequence: Synthetic oligonucleotide
  Target: SCN10A; (-) strand; PAM type: NRG; PAM sequence: AAG
gcggtgtgaggcaagagaga

SEQ ID NO: 22317 - DNA, 20 bp, Artificial Sequence
  Description of Artificial Sequence: Synthetic oligonucleotide
  Target: SCN10A; (-) strand; PAM type: NRG; PAM sequence: GAG
ggtggcggtgtgaggcaaga

SEQ ID NO: 22318 - DNA, 20 bp, Artificial Sequence
  Description of Artificial Sequence: Synthetic oligonucleotide
  Target: SCN10A; (-) strand; PAM type: NRG; PAM sequence: GAG
gaggtggcggtgtgaggcaa

SEQ ID NO: 22319 - DNA, 20 bp, Artificial Sequence
  Description of Artificial Sequence: Synthetic oligonucleotide
  Target: SCN10A; (-) strand; PAM type: NRG; PAM sequence: AAG
gtgaggtggcggtgtgaggc

SEQ ID NO: 22320 - DNA, 20 bp, Artificial Sequence
  Description of Artificial Sequence: Synthetic oligonucleotide
  Target: SCN10A; (-) strand; PAM type: NRG; PAM sequence: AGG
cacagtgaggtggcggtgtg

SEQ ID NO: 22321 - DNA, 20 bp, Artificial Sequence
  Description of Artificial Sequence: Synthetic oligonucleotide
  Target: SCN10A; (-) strand; PAM type: NRG; PAM sequence: GAG
acacagtgaggtggcggtgt

SEQ ID NO: 22322 - DNA, 20 bp, Artificial Sequence
  Description of Artificial Sequence: Synthetic oligonucleotide
  Target: SCN10A; (-) strand; PAM type: NRG; PAM sequence: CGG
gggcaaacacagtgaggtgg

SEQ ID NO: 22323 - DNA, 20 bp, Artificial Sequence
  Description of Artificial Sequence: Synthetic oligonucleotide
  Target: SCN10A; (-) strand; PAM type: NRG; PAM sequence: TGG
gctgggcaaacacagtgagg

SEQ ID NO: 22324 - DNA, 20 bp, Artificial Sequence
  Description of Artificial Sequence: Synthetic oligonucleotide
  Target: SCN10A; (-) strand; PAM type: NRG; PAM sequence: AGG
taggctgggcaaacacagtg

SEQ ID NO: 22325 - DNA, 20 bp, Artificial Sequence
  Description of Artificial Sequence: Synthetic oligonucleotide
  Target: SCN10A; (-) strand; PAM type: NRG; PAM sequence: GAG
ataggctgggcaaacacagt

SEQ ID NO: 22326 - DNA, 20 bp, Artificial Sequence
  Description of Artificial Sequence: Synthetic oligonucleotide
  Target: SCN10A; (-) strand; PAM type: NRG; PAM sequence: CAG
cttcataggctgggcaaaca

SEQ ID NO: 22327 - DNA, 20 bp, Artificial Sequence
  Description of Artificial Sequence: Synthetic oligonucleotide
  Target: SCN10A; (-) strand; PAM type: NRG; PAM sequence: GGG
tactagaggcttcataggct

SEQ ID NO: 22328 - DNA, 20 bp, Artificial Sequence
  Description of Artificial Sequence: Synthetic oligonucleotide
  Target: SCN10A; (-) strand; PAM type: NRG; PAM sequence: TGG
ttactagaggcttcataggc

SEQ ID NO: 22329 - DNA, 20 bp, Artificial Sequence
  Description of Artificial Sequence: Synthetic oligonucleotide
  Target: SCN10A; (-) strand; PAM type: NRG; PAM sequence: AGG
ttctttactagaggcttcat

SEQ ID NO: 22330 - DNA, 20 bp, Artificial Sequence
  Description of Artificial Sequence: Synthetic oligonucleotide
  Target: SCN10A; (-) strand; PAM type: NRG; PAM sequence: TAG
gttctttactagaggcttca

SEQ ID NO: 22331 - DNA, 20 bp, Artificial Sequence
  Description of Artificial Sequence: Synthetic oligonucleotide
  Target: SCN10A; (-) strand; PAM type: NRG; PAM sequence: AGG
gaaaacaagttctttactag

SEQ ID NO: 22332 - DNA, 20 bp, Artificial Sequence
  Description of Artificial Sequence: Synthetic oligonucleotide
  Target: SCN10A; (-) strand; PAM type: NRG; PAM sequence: GAG
ggaaaacaagttctttacta

SEQ ID NO: 22333 - DNA, 20 bp, Artificial Sequence
  Description of Artificial Sequence: Synthetic oligonucleotide
  Target: SCN10A; (-) strand; PAM type: NRG; PAM sequence: TAG
gtggaaaacaagttctttac

SEQ ID NO: 22334 - DNA, 20 bp, Artificial Sequence
  Description of Artificial Sequence: Synthetic oligonucleotide
  Target: SCN10A; (-) strand; PAM type: NRG; PAM sequence: AAG
gatgctaccctgtggaaaac

SEQ ID NO: 22335 - DNA, 20 bp, Artificial Sequence
  Description of Artificial Sequence: Synthetic oligonucleotide
  Target: SCN10A; (-) strand; PAM type: NRG; PAM sequence: TGG
gacataaagatgctaccctg

SEQ ID NO: 22336 - DNA, 20 bp, Artificial Sequence
  Description of Artificial Sequence: Synthetic oligonucleotide
  Target: SCN10A; (-) strand; PAM type: NRG; PAM sequence: AAG
atttctcattcatagacata

SEQ ID NO: 22337 - DNA, 20 bp, Artificial Sequence
  Description of Artificial Sequence: Synthetic oligonucleotide
  Target: SCN10A; (-) strand; PAM type: NRG; PAM sequence: TAG
agtttgcaatttctcattca

SEQ ID NO: 22338 - DNA, 20 bp, Artificial Sequence
  Description of Artificial Sequence: Synthetic oligonucleotide
  Target: SCN10A; (-) strand; PAM type: NRG; PAM sequence: TAG
aaatccagcctataagctgc

SEQ ID NO: 22339 - DNA, 20 bp, Artificial Sequence
  Description of Artificial Sequence: Synthetic oligonucleotide
  Target: SCN10A; (-) strand; PAM type: NRG; PAM sequence: AAG
gtgggccaaatccagcctat

SEQ ID NO: 22340 - DNA, 20 bp, Artificial Sequence
  Description of Artificial Sequence: Synthetic oligonucleotide
  Target: SCN10A; (-) strand; PAM type: NRG; PAM sequence: CAG
atatttctgtgggccaaatc

SEQ ID NO: 22341 - DNA, 20 bp, Artificial Sequence
  Description of Artificial Sequence: Synthetic oligonucleotide
  Target: SCN10A; (-) strand; PAM type: NRG; PAM sequence: GGG
gccaaacaaaatatttctgt

SEQ ID NO: 22342 - DNA, 20 bp, Artificial Sequence
  Description of Artificial Sequence: Synthetic oligonucleotide
  Target: SCN10A; (-) strand; PAM type: NRG; PAM sequence: TGG
ggccaaacaaaatatttctg

SEQ ID NO: 22343 - DNA, 20 bp, Artificial Sequence
  Description of Artificial Sequence: Synthetic oligonucleotide
  Target: SCN10A; (-) strand; PAM type: NRG; PAM sequence: GGG
aaaaatgtctacatattgtt

SEQ ID NO: 22344 - DNA, 20 bp, Artificial Sequence
  Description of Artificial Sequence: Synthetic oligonucleotide
  Target: SCN10A; (-) strand; PAM type: NRG; PAM sequence: TGG
aaaaaatgtctacatattgt

SEQ ID NO: 22345 - DNA, 20 bp, Artificial Sequence
  Description of Artificial Sequence: Synthetic oligonucleotide
  Target: SCN10A; (-) strand; PAM type: NRG; PAM sequence: TGG
aatctcccaaccgtaaacat

SEQ ID NO: 22346 - DNA, 20 bp, Artificial Sequence
  Description of Artificial Sequence: Synthetic oligonucleotide
  Target: SCN10A; (-) strand; PAM type: NRG; PAM sequence: TAG
taaaatagagataggaaatt

SEQ ID NO: 22347 - DNA, 20 bp, Artificial Sequence
  Description of Artificial Sequence: Synthetic oligonucleotide
  Target: SCN10A; (-) strand; PAM type: NRG; PAM sequence: AGG
ccaacttttaaaatagagat

SEQ ID NO: 22348 - DNA, 20 bp, Artificial Sequence
  Description of Artificial Sequence: Synthetic oligonucleotide
  Target: SCN10A; (-) strand; PAM type: NRG; PAM sequence: TAG
tccaacttttaaaatagaga

SEQ ID NO: 22349 - DNA, 20 bp, Artificial Sequence
  Description of Artificial Sequence: Synthetic oligonucleotide
  Target: SCN10A; (-) strand; PAM type: NRG; PAM sequence: GAG
ctcttccaacttttaaaata

SEQ ID NO: 22350 - DNA, 20 bp, Artificial Sequence
  Description of Artificial Sequence: Synthetic oligonucleotide
  Target: SCN10A; (-) strand; PAM type: NRG; PAM sequence: TAG
agctcttccaacttttaaaa

SEQ ID NO: 22351 - DNA, 20 bp, Artificial Sequence
  Description of Artificial Sequence: Synthetic oligonucleotide
  Target: SCN10A; (-) strand; PAM type: NRG; PAM sequence: CAG
aaatgtgggttcactgtttc

SEQ ID NO: 22352 - DNA, 20 bp, Artificial Sequence
  Description of Artificial Sequence: Synthetic oligonucleotide
  Target: SCN10A; (-) strand; PAM type: NRG; PAM sequence: GGG
tggttgccatgtggaaatgt

SEQ ID NO: 22353 - DNA, 20 bp, Artificial Sequence
  Description of Artificial Sequence: Synthetic oligonucleotide
  Target: SCN10A; (-) strand; PAM type: NRG; PAM sequence: TGG
ttggttgccatgtggaaatg

SEQ ID NO: 22354 - DNA, 20 bp, Artificial Sequence
  Description of Artificial Sequence: Synthetic oligonucleotide
  Target: SCN10A; (-) strand; PAM type: NRG; PAM sequence: TGG
tccagcttttggttgccatg

SEQ ID NO: 22355 - DNA, 20 bp, Artificial Sequence
  Description of Artificial Sequence: Synthetic oligonucleotide
  Target: SCN10A; (-) strand; PAM type: NRG; PAM sequence: TGG
ccactgctcggtccagcttt

SEQ ID NO: 22356 - DNA, 20 bp, Artificial Sequence
  Description of Artificial Sequence: Synthetic oligonucleotide
  Target: SCN10A; (-) strand; PAM type: NRG; PAM sequence: CAG
gacagccccactgctcggtc

SEQ ID NO: 22357 - DNA, 20 bp, Artificial Sequence
  Description of Artificial Sequence: Synthetic oligonucleotide
  Target: SCN10A; (-) strand; PAM type: NRG; PAM sequence: CGG
aaggggacagccccactgct

SEQ ID NO: 22358 - DNA, 20 bp, Artificial Sequence
  Description of Artificial Sequence: Synthetic oligonucleotide
  Target: SCN10A; (-) strand; PAM type: NRG; PAM sequence: CAG
catgcctcctctaaagggga

SEQ ID NO: 22359 - DNA, 20 bp, Artificial Sequence
  Description of Artificial Sequence: Synthetic oligonucleotide
  Target: SCN10A; (-) strand; PAM type: NRG; PAM sequence: GGG
agttcatgcctcctctaaag

SEQ ID NO: 22360 - DNA, 20 bp, Artificial Sequence
  Description of Artificial Sequence: Synthetic oligonucleotide
  Target: SCN10A; (-) strand; PAM type: NRG; PAM sequence: GGG
gagttcatgcctcctctaaa

SEQ ID NO: 22361 - DNA, 20 bp, Artificial Sequence
  Description of Artificial Sequence: Synthetic oligonucleotide
  Target: SCN10A; (-) strand; PAM type: NRG; PAM sequence: AGG
agagttcatgcctcctctaa

SEQ ID NO: 22362 - DNA, 20 bp, Artificial Sequence
  Description of Artificial Sequence: Synthetic oligonucleotide
  Target: SCN10A; (-) strand; PAM type: NRG; PAM sequence: AAG
gagagttcatgcctcctcta

SEQ ID NO: 22363 - DNA, 20 bp, Artificial Sequence
  Description of Artificial Sequence: Synthetic oligonucleotide
  Target: SCN10A; (-) strand; PAM type: NRG; PAM sequence: GAG
ggagggaacctaggagctga

SEQ ID NO: 22364 - DNA, 20 bp, Artificial Sequence
  Description of Artificial Sequence: Synthetic oligonucleotide
  Target: SCN10A; (-) strand; PAM type: NRG; PAM sequence: GAG
caggagggaacctaggagct

SEQ ID NO: 22365 - DNA, 20 bp, Artificial Sequence
  Description of Artificial Sequence: Synthetic oligonucleotide
  Target: SCN10A; (-) strand; PAM type: NRG; PAM sequence: GAG
tgggccaggagggaacctag

SEQ ID NO: 22366 - DNA, 20 bp, Artificial Sequence
  Description of Artificial Sequence: Synthetic oligonucleotide
  Target: SCN10A; (-) strand; PAM type: NRG; PAM sequence: AGG
agtgggccaggagggaacct

SEQ ID NO: 22367 - DNA, 20 bp, Artificial Sequence
  Description of Artificial Sequence: Synthetic oligonucleotide
  Target: SCN10A; (-) strand; PAM type: NRG; PAM sequence: TAG
gagtgggccaggagggaacc

SEQ ID NO: 22368 - DNA, 20 bp, Artificial Sequence
  Description of Artificial Sequence: Synthetic oligonucleotide
  Target: SCN10A; (-) strand; PAM type: NRG; PAM sequence: GGG
atgagtggagtgggccagga

SEQ ID NO: 22369 - DNA, 20 bp, Artificial Sequence
  Description of Artificial Sequence: Synthetic oligonucleotide
  Target: SCN10A; (-) strand; PAM type: NRG; PAM sequence: AGG
aatgagtggagtgggccagg

SEQ ID NO: 22370 - DNA, 20 bp, Artificial Sequence
  Description of Artificial Sequence: Synthetic oligonucleotide
  Target: SCN10A; (-) strand; PAM type: NRG; PAM sequence: GAG
aaatgagtggagtgggccag

SEQ ID NO: 22371 - DNA, 20 bp, Artificial Sequence
  Description of Artificial Sequence: Synthetic oligonucleotide
  Target: SCN10A; (-) strand; PAM type: NRG; PAM sequence: AGG
acaaatgagtggagtgggcc

SEQ ID NO: 22372 - DNA, 20 bp, Artificial Sequence
  Description of Artificial Sequence: Synthetic oligonucleotide
  Target: SCN10A; (-) strand; PAM type: NRG; PAM sequence: CAG
aacaaatgagtggagtgggc

SEQ ID NO: 22373 - DNA, 20 bp, Artificial Sequence
  Description of Artificial Sequence: Synthetic oligonucleotide
  Target: SCN10A; (-) strand; PAM type: NRG; PAM sequence: GGG
taacaacaaatgagtggagt

SEQ ID NO: 22374 - DNA, 20 bp, Artificial Sequence
  Description of Artificial Sequence: Synthetic oligonucleotide
  Target: SCN10A; (-) strand; PAM type: NRG; PAM sequence: TGG
ataacaacaaatgagtggag

SEQ ID NO: 22375 - DNA, 20 bp, Artificial Sequence
  Description of Artificial Sequence: Synthetic oligonucleotide
  Target: SCN10A; (-) strand; PAM type: NRG; PAM sequence: GAG
ttcataacaacaaatgagtg

SEQ ID NO: 22376 - DNA, 20 bp, Artificial Sequence
  Description of Artificial Sequence: Synthetic oligonucleotide
  Target: SCN10A; (-) strand; PAM type: NRG; PAM sequence: TGG
gattcataacaacaaatgag

SEQ ID NO: 22377 - DNA, 20 bp, Artificial Sequence
  Description of Artificial Sequence: Synthetic oligonucleotide
  Target: SCN10A; (-) strand; PAM type: NRG; PAM sequence: GAG
ccagattcataacaacaaat

SEQ ID NO: 22378 - DNA, 20 bp, Artificial Sequence
  Description of Artificial Sequence: Synthetic oligonucleotide
  Target: SCN10A; (-) strand; PAM type: NRG; PAM sequence: CAG
tttcgaattcttacagaggc

SEQ ID NO: 22379 - DNA, 20 bp, Artificial Sequence
  Description of Artificial Sequence: Synthetic oligonucleotide
  Target: SCN10A; (-) strand; PAM type: NRG; PAM sequence: AGG
gcaatttcgaattcttacag

SEQ ID NO: 22380 - DNA, 20 bp, Artificial Sequence
  Description of Artificial Sequence: Synthetic oligonucleotide
  Target: SCN10A; (-) strand; PAM type: NRG; PAM sequence: GAG
tgcaatttcgaattcttaca

SEQ ID NO: 22381 - DNA, 20 bp, Artificial Sequence
  Description of Artificial Sequence: Synthetic oligonucleotide
  Target: SCN10A; (-) strand; PAM type: NRG; PAM sequence: CAG
tttgcaatttcgaattctta

SEQ ID NO: 22382 - DNA, 20 bp, Artificial Sequence
  Description of Artificial Sequence: Synthetic oligonucleotide
  Target: SCN10A; (-) strand; PAM type: NRG; PAM sequence: CAG
agaggaaaaaacacatgtat

SEQ ID NO: 22383 - DNA, 20 bp, Artificial Sequence
  Description of Artificial Sequence: Synthetic oligonucleotide
  Target: SCN10A; (-) strand; PAM type: NRG; PAM sequence: AGG
cacattaccctcacaagtag

SEQ ID NO: 22384 - DNA, 20 bp, Artificial Sequence
  Description of Artificial Sequence: Synthetic oligonucleotide
  Target: SCN10A; (-) strand; PAM type: NRG; PAM sequence: GAG
ccacattaccctcacaagta

SEQ ID NO: 22385 - DNA, 20 bp, Artificial Sequence
  Description of Artificial Sequence: Synthetic oligonucleotide
  Target: SCN10A; (-) strand; PAM type: NRG; PAM sequence: TAG
agccacattaccctcacaag

SEQ ID NO: 22386 - DNA, 20 bp, Artificial Sequence
  Description of Artificial Sequence: Synthetic oligonucleotide
  Target: SCN10A; (-) strand; PAM type: NRG; PAM sequence: AAG
tatagccacattaccctcac

SEQ ID NO: 22387 - DNA, 20 bp, Artificial Sequence
  Description of Artificial Sequence: Synthetic oligonucleotide
  Target: SCN10A; (-) strand; PAM type: NRG; PAM sequence: TAG
tcacagctaactccattcta

SEQ ID NO: 22388 - DNA, 20 bp, Artificial Sequence
  Description of Artificial Sequence: Synthetic oligonucleotide
  Target: SCN10A; (-) strand; PAM type: NRG; PAM sequence: CAG
tgctctacacttaatcatca

SEQ ID NO: 22389 - DNA, 20 bp, Artificial Sequence
  Description of Artificial Sequence: Synthetic oligonucleotide
  Target: SCN10A; (-) strand; PAM type: NRG; PAM sequence: AGG
ataaataatctaccccagga

SEQ ID NO: 22390 - DNA, 20 bp, Artificial Sequence
  Description of Artificial Sequence: Synthetic oligonucleotide
  Target: SCN10A; (-) strand; PAM type: NRG; PAM sequence: AAG
aataaataatctaccccagg

SEQ ID NO: 22391 - DNA, 20 bp, Artificial Sequence
  Description of Artificial Sequence: Synthetic oligonucleotide
  Target: SCN10A; (-) strand; PAM type: NRG; PAM sequence: AGG
tttaataaataatctacccc

SEQ ID NO: 22392 - DNA, 20 bp, Artificial Sequence
  Description of Artificial Sequence: Synthetic oligonucleotide
  Target: SCN10A; (-) strand; PAM type: NRG; PAM sequence: CAG
ttttaataaataatctaccc

SEQ ID NO: 22393 - DNA, 20 bp, Artificial Sequence
  Description of Artificial Sequence: Synthetic oligonucleotide
  Target: SCN10A; (-) strand; PAM type: NRG; PAM sequence: TAG
atacatagagacaagaatta

SEQ ID NO: 22394 - DNA, 20 bp, Artificial Sequence
  Description of Artificial Sequence: Synthetic oligonucleotide
  Target: SCN10A; (-) strand; PAM type: NRG; PAM sequence: AAG
gggtgtggatacatagagac

SEQ ID NO: 22395 - DNA, 20 bp, Artificial Sequence
  Description of Artificial Sequence: Synthetic oligonucleotide
  Target: SCN10A; (-) strand; PAM type: NRG; PAM sequence: GAG
ggaaagggtgtggatacata

SEQ ID NO: 22396 - DNA, 20 bp, Artificial Sequence
  Description of Artificial Sequence: Synthetic oligonucleotide
  Target: SCN10A; (-) strand; PAM type: NRG; PAM sequence: TAG
ttggaaagggtgtggataca

SEQ ID NO: 22397 - DNA, 20 bp, Artificial Sequence
  Description of Artificial Sequence: Synthetic oligonucleotide
  Target: SCN10A; (-) strand; PAM type: NRG; PAM sequence: TGG
aagtcacattggaaagggtg

SEQ ID NO: 22398 - DNA, 20 bp, Artificial Sequence
  Description of Artificial Sequence: Synthetic oligonucleotide
  Target: SCN10A; (-) strand; PAM type: NRG; PAM sequence: GGG
ctgaaaagtcacattggaaa

SEQ ID NO: 22399 - DNA, 20 bp, Artificial Sequence
  Description of Artificial Sequence: Synthetic oligonucleotide
  Target: SCN10A; (-) strand; PAM type: NRG; PAM sequence: AGG
gctgaaaagtcacattggaa

SEQ ID NO: 22400 - DNA, 20 bp, Artificial Sequence
  Description of Artificial Sequence: Synthetic oligonucleotide
  Target: SCN10A; (-) strand; PAM type: NRG; PAM sequence: AAG
agctgaaaagtcacattgga

SEQ ID NO: 22401 - DNA, 20 bp, Artificial Sequence
  Description of Artificial Sequence: Synthetic oligonucleotide
  Target: SCN10A; (-) strand; PAM type: NRG; PAM sequence: TGG
aaagagctgaaaagtcacat

SEQ ID NO: 22402 - DNA, 20 bp, Artificial Sequence
  Description of Artificial Sequence: Synthetic oligonucleotide
  Target: SCN10A; (-) strand; PAM type: NRG; PAM sequence: AAG
actcaatggaaagagctgaa

SEQ ID NO: 22403 - DNA, 20 bp, Artificial Sequence
  Description of Artificial Sequence: Synthetic oligonucleotide
  Target: SCN10A; (-) strand; PAM type: NRG; PAM sequence: GAG
acttcatcactcaatggaaa

SEQ ID NO: 22404 - DNA, 20 bp, Artificial Sequence
  Description of Artificial Sequence: Synthetic oligonucleotide
  Target: SCN10A; (-) strand; PAM type: NRG; PAM sequence: AAG
agacttcatcactcaatgga

SEQ ID NO: 22405 - DNA, 20 bp, Artificial Sequence
  Description of Artificial Sequence: Synthetic oligonucleotide
  Target: SCN10A; (-) strand; PAM type: NRG; PAM sequence: TGG
aaatagacttcatcactcaa

SEQ ID NO: 22406 - DNA, 20 bp, Artificial Sequence
  Description of Artificial Sequence: Synthetic oligonucleotide
  Target: SCN10A; (-) strand; PAM type: NRG; PAM sequence: TAG
agatccaagagacagagaaa

SEQ ID NO: 22407 - DNA, 20 bp, Artificial Sequence
  Description of Artificial Sequence: Synthetic oligonucleotide
  Target: SCN10A; (-) strand; PAM type: NRG; PAM sequence: GAG
cagtagagatccaagagaca

SEQ ID NO: 22408 - DNA, 20 bp, Artificial Sequence
  Description of Artificial Sequence: Synthetic oligonucleotide
  Target: SCN10A; (-) strand; PAM type: NRG; PAM sequence: CAG
tccagtagagatccaagaga

SEQ ID NO: 22409 - DNA, 20 bp, Artificial Sequence
  Description of Artificial Sequence: Synthetic oligonucleotide
  Target: SCN10A; (-) strand; PAM type: NRG; PAM sequence: GAG
gcagtccagtagagatccaa

SEQ ID NO: 22410 - DNA, 20 bp, Artificial Sequence
  Description of Artificial Sequence: Synthetic oligonucleotide
  Target: SCN10A; (-) strand; PAM type: NRG; PAM sequence: AAG
ttgcagtccagtagagatcc

SEQ ID NO: 22411 - DNA, 20 bp, Artificial Sequence
  Description of Artificial Sequence: Synthetic oligonucleotide
  Target: SCN10A; (-) strand; PAM type: NRG; PAM sequence: GAG
aagcaagttgcagtccagta

SEQ ID NO: 22412 - DNA, 20 bp, Artificial Sequence
  Description of Artificial Sequence: Synthetic oligonucleotide
  Target: SCN10A; (-) strand; PAM type: NRG; PAM sequence: TAG
taaagcaagttgcagtccag

SEQ ID NO: 22413 - DNA, 20 bp, Artificial Sequence
  Description of Artificial Sequence: Synthetic oligonucleotide
  Target: SCN10A; (-) strand; PAM type: NRG; PAM sequence: CAG
gactaaagcaagttgcagtc

SEQ ID NO: 22414 - DNA, 20 bp, Artificial Sequence
  Description of Artificial Sequence: Synthetic oligonucleotide
  Target: SCN10A; (-) strand; PAM type: NRG; PAM sequence: CAG
ttcttgactaaagcaagttg

SEQ ID NO: 22415 - DNA, 20 bp, Artificial Sequence
  Description of Artificial Sequence: Synthetic oligonucleotide
  Target: SCN10A; (-) strand; PAM type: NRG; PAM sequence: AAG
gatacattcttgactaaagc

SEQ ID NO: 22416 - DNA, 20 bp, Artificial Sequence
  Description of Artificial Sequence: Synthetic oligonucleotide
  Target: SCN10A; (-) strand; PAM type: NRG; PAM sequence: AAG
ttctgatacattcttgacta

SEQ ID NO: 22417 - DNA, 20 bp, Artificial Sequence
  Description of Artificial Sequence: Synthetic oligonucleotide
  Target: SCN10A; (-) strand; PAM type: NRG; PAM sequence: TAG
ggcttcttcaggcctaggct

SEQ ID NO: 22418 - DNA, 20 bp, Artificial Sequence
  Description of Artificial Sequence: Synthetic oligonucleotide
  Target: SCN10A; (-) strand; PAM type: NRG; PAM sequence: AGG
tgcaaggcttcttcaggcct

SEQ ID NO: 22419 - DNA, 20 bp, Artificial Sequence
  Description of Artificial Sequence: Synthetic oligonucleotide
  Target: SCN10A; (-) strand; PAM type: NRG; PAM sequence: TAG
ttgcaaggcttcttcaggcc

SEQ ID NO: 22420 - DNA, 20 bp, Artificial Sequence
  Description of Artificial Sequence: Synthetic oligonucleotide
  Target: SCN10A; (-) strand; PAM type: NRG; PAM sequence: AGG
gaagtttgcaaggcttcttc

SEQ ID NO: 22421 - DNA, 20 bp, Artificial Sequence
  Description of Artificial Sequence: Synthetic oligonucleotide
  Target: SCN10A; (-) strand; PAM type: NRG; PAM sequence: CAG
ggaagtttgcaaggcttctt

SEQ ID NO: 22422 - DNA, 20 bp, Artificial Sequence
  Description of Artificial Sequence: Synthetic oligonucleotide
  Target: SCN10A; (-) strand; PAM type: NRG; PAM sequence: AGG
aaaaacagtggaagtttgca

SEQ ID NO: 22423 - DNA, 20 bp, Artificial Sequence
  Description of Artificial Sequence: Synthetic oligonucleotide
  Target: SCN10A; (-) strand; PAM type: NRG; PAM sequence: AAG
gaaaaacagtggaagtttgc

SEQ ID NO: 22424 - DNA, 20 bp, Artificial Sequence
  Description of Artificial Sequence: Synthetic oligonucleotide
  Target: SCN10A; (-) strand; PAM type: NRG; PAM sequence: AAG
tgttcccagaaaaacagtgg

SEQ ID NO: 22425 - DNA, 20 bp, Artificial Sequence
  Description of Artificial Sequence: Synthetic oligonucleotide
  Target: SCN10A; (-) strand; PAM type: NRG; PAM sequence: TGG
cagtgttcccagaaaaacag

SEQ ID NO: 22426 - DNA, 20 bp, Artificial Sequence
  Description of Artificial Sequence: Synthetic oligonucleotide
  Target: SCN10A; (-) strand; PAM type: NRG; PAM sequence: CAG
tggcagtgttcccagaaaaa

SEQ ID NO: 22427 - DNA, 20 bp, Artificial Sequence
  Description of Artificial Sequence: Synthetic oligonucleotide
  Target: SCN10A; (-) strand; PAM type: NRG; PAM sequence: CAG
tgttctcatggcagtgttcc

SEQ ID NO: 22428 - DNA, 20 bp, Artificial Sequence
  Description of Artificial Sequence: Synthetic oligonucleotide
  Target: SCN10A; (-) strand; PAM type: NRG; PAM sequence: CAG
gcctgggcctgttctcatgg

SEQ ID NO: 22429 - DNA, 20 bp, Artificial Sequence
  Description of Artificial Sequence: Synthetic oligonucleotide
  Target: SCN10A; (-) strand; PAM type: NRG; PAM sequence: TGG
ttagcctgggcctgttctca

SEQ ID NO: 22430 - DNA, 20 bp, Artificial Sequence
  Description of Artificial Sequence: Synthetic oligonucleotide
  Target: SCN10A; (-) strand; PAM type: NRG; PAM sequence: GGG
acccccaaacaggttagcct

SEQ ID NO: 22431 - DNA, 20 bp, Artificial Sequence
  Description of Artificial Sequence: Synthetic oligonucleotide
  Target: SCN10A; (-) strand; PAM type: NRG; PAM sequence: TGG
cacccccaaacaggttagcc

SEQ ID NO: 22432 - DNA, 20 bp, Artificial Sequence
  Description of Artificial Sequence: Synthetic oligonucleotide
  Target: SCN10A; (-) strand; PAM type: NRG; PAM sequence: TAG
cctctcacccccaaacaggt

SEQ ID NO: 22433 - DNA, 20 bp, Artificial Sequence
  Description of Artificial Sequence: Synthetic oligonucleotide
  Target: SCN10A; (-) strand; PAM type: NRG; PAM sequence: AGG
gtggcctctcacccccaaac

SEQ ID NO: 22434 - DNA, 20 bp, Artificial Sequence
  Description of Artificial Sequence: Synthetic oligonucleotide
  Target: SCN10A; (-) strand; PAM type: NRG; PAM sequence: CAG
tgtggcctctcacccccaaa

SEQ ID NO: 22435 - DNA, 20 bp, Artificial Sequence
  Description of Artificial Sequence: Synthetic oligonucleotide
  Target: SCN10A; (-) strand; PAM type: NRG; PAM sequence: TGG
acgtcctgtctctgctcatg

SEQ ID NO: 22436 - DNA, 20 bp, Artificial Sequence
  Description of Artificial Sequence: Synthetic oligonucleotide
  Target: SCN10A; (-) strand; PAM type: NRG; PAM sequence: AGG
aacttggagatggctggtct

SEQ ID NO: 22437 - DNA, 20 bp, Artificial Sequence
  Description of Artificial Sequence: Synthetic oligonucleotide
  Target: SCN10A; (-) strand; PAM type: NRG; PAM sequence: TAG
taacttggagatggctggtc

SEQ ID NO: 22438 - DNA, 20 bp, Artificial Sequence
  Description of Artificial Sequence: Synthetic oligonucleotide
  Target: SCN10A; (-) strand; PAM type: NRG; PAM sequence: TGG
catattaacttggagatggc

SEQ ID NO: 22439 - DNA, 20 bp, Artificial Sequence
  Description of Artificial Sequence: Synthetic oligonucleotide
  Target: SCN10A; (-) strand; PAM type: NRG; PAM sequence: TGG
acagcatattaacttggaga

SEQ ID NO: 22440 - DNA, 20 bp, Artificial Sequence
  Description of Artificial Sequence: Synthetic oligonucleotide
  Target: SCN10A; (-) strand; PAM type: NRG; PAM sequence: GAG
gcagacagcatattaacttg

SEQ ID NO: 22441 - DNA, 20 bp, Artificial Sequence
  Description of Artificial Sequence: Synthetic oligonucleotide
  Target: SCN10A; (-) strand; PAM type: NRG; PAM sequence: TGG
atgcagacagcatattaact

SEQ ID NO: 22442 - DNA, 20 bp, Artificial Sequence
  Description of Artificial Sequence: Synthetic oligonucleotide
  Target: SCN10A; (-) strand; PAM type: NRG; PAM sequence: CAG
ctcattcatgcatatgcaga

SEQ ID NO: 22443 - DNA, 20 bp, Artificial Sequence
  Description of Artificial Sequence: Synthetic oligonucleotide
  Target: SCN10A; (-) strand; PAM type: NRG; PAM sequence: CAG
taggctcattcatgcatatg

SEQ ID NO: 22444 - DNA, 20 bp, Artificial Sequence
  Description of Artificial Sequence: Synthetic oligonucleotide
  Target: SCN10A; (-) strand; PAM type: NRG; PAM sequence: AGG
ggcattgggtgacattgact

SEQ ID NO: 22445 - DNA, 20 bp, Artificial Sequence
  Description of Artificial Sequence: Synthetic oligonucleotide
  Target: SCN10A; (-) strand; PAM type: NRG; PAM sequence: TAG
gggcattgggtgacattgac

SEQ ID NO: 22446 - DNA, 20 bp, Artificial Sequence
  Description of Artificial Sequence: Synthetic oligonucleotide
  Target: SCN10A; (-) strand; PAM type: NRG; PAM sequence: GGG
actgggatcagatgggcatt

SEQ ID NO: 22447 - DNA, 20 bp, Artificial Sequence
  Description of Artificial Sequence: Synthetic oligonucleotide
  Target: SCN10A; (-) strand; PAM type: NRG; PAM sequence: TGG
gactgggatcagatgggcat

SEQ ID NO: 22448 - DNA, 20 bp, Artificial Sequence
  Description of Artificial Sequence: Synthetic oligonucleotide
  Target: SCN10A; (-) strand; PAM type: NRG; PAM sequence: GGG
attttggactgggatcagat

SEQ ID NO: 22449 - DNA, 20 bp, Artificial Sequence
  Description of Artificial Sequence: Synthetic oligonucleotide
  Target: SCN10A; (-) strand; PAM type: NRG; PAM sequence: TGG
cattttggactgggatcaga

SEQ ID NO: 22450 - DNA, 20 bp, Artificial Sequence
  Description of Artificial Sequence: Synthetic oligonucleotide
  Target: SCN10A; (-) strand; PAM type: NRG; PAM sequence: CAG
tcagcattttggactgggat

SEQ ID NO: 22451 - DNA, 20 bp, Artificial Sequence
  Description of Artificial Sequence: Synthetic oligonucleotide
  Target: SCN10A; (-) strand; PAM type: NRG; PAM sequence: GGG
gtgcatcagcattttggact

SEQ ID NO: 22452 - DNA, 20 bp, Artificial Sequence
  Description of Artificial Sequence: Synthetic oligonucleotide
  Target: SCN10A; (-) strand; PAM type: NRG; PAM sequence: TGG
tgtgcatcagcattttggac

SEQ ID NO: 22453 - DNA, 20 bp, Artificial Sequence
  Description of Artificial Sequence: Synthetic oligonucleotide
  Target: SCN10A; (-) strand; PAM type: NRG; PAM sequence: TGG
gattctgtgcatcagcattt

SEQ ID NO: 22454 - DNA, 20 bp, Artificial Sequence
  Description of Artificial Sequence: Synthetic oligonucleotide
  Target: SCN10A; (-) strand; PAM type: NRG; PAM sequence: CAG
taattcatgattctgtgcat

SEQ ID NO: 22455 - DNA, 20 bp, Artificial Sequence
  Description of Artificial Sequence: Synthetic oligonucleotide
  Target: SCN10A; (-) strand; PAM type: NRG; PAM sequence: TAG
tggggagggaatgtatgagt

SEQ ID NO: 22456 - DNA, 20 bp, Artificial Sequence
  Description of Artificial Sequence: Synthetic oligonucleotide
  Target: SCN10A; (-) strand; PAM type: NRG; PAM sequence: GAG
ctcatggggagggaatgtat

SEQ ID NO: 22457 - DNA, 20 bp, Artificial Sequence
  Description of Artificial Sequence: Synthetic oligonucleotide
  Target: SCN10A; (-) strand; PAM type: NRG; PAM sequence: GGG
caacccagagctcatgggga

SEQ ID NO: 22458 - DNA, 20 bp, Artificial Sequence
  Description of Artificial Sequence: Synthetic oligonucleotide
  Target: SCN10A; (-) strand; PAM type: NRG; PAM sequence: AGG
ccaacccagagctcatgggg

SEQ ID NO: 22459 - DNA, 20 bp, Artificial Sequence
  Description of Artificial Sequence: Synthetic oligonucleotide
  Target: SCN10A; (-) strand; PAM type: NRG; PAM sequence: GAG
gccaacccagagctcatggg

SEQ ID NO: 22460 - DNA, 20 bp, Artificial Sequence
  Description of Artificial Sequence: Synthetic oligonucleotide
  Target: SCN10A; (-) strand; PAM type: NRG; PAM sequence: GGG
ttgccaacccagagctcatg

SEQ ID NO: 22461 - DNA, 20 bp, Artificial Sequence
  Description of Artificial Sequence: Synthetic oligonucleotide
  Target: SCN10A; (-) strand; PAM type: NRG; PAM sequence: GGG
tttgccaacccagagctcat

SEQ ID NO: 22462 - DNA, 20 bp, Artificial Sequence
  Description of Artificial Sequence: Synthetic oligonucleotide
  Target: SCN10A; (-) strand; PAM type: NRG; PAM sequence: TGG
ctttgccaacccagagctca

SEQ ID NO: 22463 - DNA, 20 bp, Artificial Sequence
  Description of Artificial Sequence: Synthetic oligonucleotide
  Target: SCN10A; (-) strand; PAM type: NRG; PAM sequence: GAG
tcatggcctttgccaaccca

SEQ ID NO: 22464 - DNA, 20 bp, Artificial Sequence
  Description of Artificial Sequence: Synthetic oligonucleotide
  Target: SCN10A; (-) strand; PAM type: NRG; PAM sequence: CAG
aatcatggcctttgccaacc

SEQ ID NO: 22465 - DNA, 20 bp, Artificial Sequence
  Description of Artificial Sequence: Synthetic oligonucleotide
  Target: SCN10A; (-) strand; PAM type: NRG; PAM sequence: TGG
atgtataaataaataaatca

SEQ ID NO: 22466 - DNA, 20 bp, Artificial Sequence
  Description of Artificial Sequence: Synthetic oligonucleotide
  Target: SCN10A; (-) strand; PAM type: NRG; PAM sequence: AAG
tggggttgcaggtcctggga

SEQ ID NO: 22467 - DNA, 20 bp, Artificial Sequence
  Description of Artificial Sequence: Synthetic oligonucleotide
  Target: SCN10A; (-) strand; PAM type: NRG; PAM sequence: GGG
cagatggggttgcaggtcct

SEQ ID NO: 22468 - DNA, 20 bp, Artificial Sequence
  Description of Artificial Sequence: Synthetic oligonucleotide
  Target: SCN10A; (-) strand; PAM type: NRG; PAM sequence: TGG
acagatggggttgcaggtcc

SEQ ID NO: 22469 - DNA, 20 bp, Artificial Sequence
  Description of Artificial Sequence: Synthetic oligonucleotide
  Target: SCN10A; (-) strand; PAM type: NRG; PAM sequence: AGG
atgggcacagatggggttgc

SEQ ID NO: 22470 - DNA, 20 bp, Artificial Sequence
  Description of Artificial Sequence: Synthetic oligonucleotide
  Target: SCN10A; (-) strand; PAM type: NRG; PAM sequence: CAG
tatgggcacagatggggttg

SEQ ID NO: 22471 - DNA, 20 bp, Artificial Sequence
  Description of Artificial Sequence: Synthetic oligonucleotide
  Target: SCN10A; (-) strand; PAM type: NRG; PAM sequence: GGG
gcatattatgggcacagatg

SEQ ID NO: 22472 - DNA, 20 bp, Artificial Sequence
  Description of Artificial Sequence: Synthetic oligonucleotide
  Target: SCN10A; (-) strand; PAM type: NRG; PAM sequence: GGG
ggcatattatgggcacagat

SEQ ID NO: 22473 - DNA, 20 bp, Artificial Sequence
  Description of Artificial Sequence: Synthetic oligonucleotide
  Target: SCN10A; (-) strand; PAM type: NRG; PAM sequence: TGG
tggcatattatgggcacaga

SEQ ID NO: 22474 - DNA, 20 bp, Artificial Sequence
  Description of Artificial Sequence: Synthetic oligonucleotide
  Target: SCN10A; (-) strand; PAM type: NRG; PAM sequence: CAG
tccttggcatattatgggca

SEQ ID NO: 22475 - DNA, 20 bp, Artificial Sequence
  Description of Artificial Sequence: Synthetic oligonucleotide
  Target: SCN10A; (-) strand; PAM type: NRG; PAM sequence: GGG
tcttgtccttggcatattat

SEQ ID NO: 22476 - DNA, 20 bp, Artificial Sequence
  Description of Artificial Sequence: Synthetic oligonucleotide
  Target: SCN10A; (-) strand; PAM type: NRG; PAM sequence: TGG
atcttgtccttggcatatta

SEQ ID NO: 22477 - DNA, 20 bp, Artificial Sequence
  Description of Artificial Sequence: Synthetic oligonucleotide
  Target: SCN10A; (-) strand; PAM type: NRG; PAM sequence: TGG
ttccttctccatcttgtcct

SEQ ID NO: 22478 - DNA, 20 bp, Artificial Sequence
  Description of Artificial Sequence: Synthetic oligonucleotide
  Target: SCN10A; (-) strand; PAM type: NRG; PAM sequence: GAG
cccaacttatgacaaagcac

SEQ ID NO: 22479 - DNA, 20 bp, Artificial Sequence
  Description of Artificial Sequence: Synthetic oligonucleotide
  Target: SCN10A; (-) strand; PAM type: NRG; PAM sequence: AAG
tgagttcccaacttatgaca

SEQ ID NO: 22480 - DNA, 20 bp, Artificial Sequence
  Description of Artificial Sequence: Synthetic oligonucleotide
  Target: SCN10A; (-) strand; PAM type: NRG; PAM sequence: GAG
caatggatctgactcagggt

SEQ ID NO: 22481 - DNA, 20 bp, Artificial Sequence
  Description of Artificial Sequence: Synthetic oligonucleotide
  Target: SCN10A; (-) strand; PAM type: NRG; PAM sequence: GGG
gtggcaatggatctgactca

SEQ ID NO: 22482 - DNA, 20 bp, Artificial Sequence
  Description of Artificial Sequence: Synthetic oligonucleotide
  Target: SCN10A; (-) strand; PAM type: NRG; PAM sequence: AGG
tgtggcaatggatctgactc

SEQ ID NO: 22483 - DNA, 20 bp, Artificial Sequence
  Description of Artificial Sequence: Synthetic oligonucleotide
  Target: SCN10A; (-) strand; PAM type: NRG; PAM sequence: CAG
gtgtggcaatggatctgact

SEQ ID NO: 22484 - DNA, 20 bp, Artificial Sequence
  Description of Artificial Sequence: Synthetic oligonucleotide
  Target: SCN10A; (-) strand; PAM type: NRG; PAM sequence: TGG
gaccccttactgtgtggcaa

SEQ ID NO: 22485 - DNA, 20 bp, Artificial Sequence
  Description of Artificial Sequence: Synthetic oligonucleotide
  Target: SCN10A; (-) strand; PAM type: NRG; PAM sequence: TGG
acttctgaccccttactgtg

SEQ ID NO: 22486 - DNA, 20 bp, Artificial Sequence
  Description of Artificial Sequence: Synthetic oligonucleotide
  Target: SCN10A; (-) strand; PAM type: NRG; PAM sequence: AGG
gatatctacataaataagcg

SEQ ID NO: 22487 - DNA, 20 bp, Artificial Sequence
  Description of Artificial Sequence: Synthetic oligonucleotide
  Target: SCN10A; (-) strand; PAM type: NRG; PAM sequence: GAG
agatatctacataaataagc

SEQ ID NO: 22488 - DNA, 20 bp, Artificial Sequence
  Description of Artificial Sequence: Synthetic oligonucleotide
  Target: SCN10A; (-) strand; PAM type: NRG; PAM sequence: AAG
cagcagatatctacataaat

SEQ ID NO: 22489 - DNA, 20 bp, Artificial Sequence
  Description of Artificial Sequence: Synthetic oligonucleotide
  Target: SCN10A; (-) strand; PAM type: NRG; PAM sequence: CAG
tcttttcttcctttcttcag

SEQ ID NO: 22490 - DNA, 20 bp, Artificial Sequence
  Description of Artificial Sequence: Synthetic oligonucleotide
  Target: SCN10A; (-) strand; PAM type: NRG; PAM sequence: CAG
ctttcttttcttcctttctt

SEQ ID NO: 22491 - DNA, 20 bp, Artificial Sequence
  Description of Artificial Sequence: Synthetic oligonucleotide
  Target: SCN10A; (-) strand; PAM type: NRG; PAM sequence: AGG
agggttcagaaccatctgtg

SEQ ID NO: 22492 - DNA, 20 bp, Artificial Sequence
  Description of Artificial Sequence: Synthetic oligonucleotide
  Target: SCN10A; (-) strand; PAM type: NRG; PAM sequence: GAG
gagggttcagaaccatctgt

SEQ ID NO: 22493 - DNA, 20 bp, Artificial Sequence
  Description of Artificial Sequence: Synthetic oligonucleotide
  Target: SCN10A; (-) strand; PAM type: NRG; PAM sequence: CAG
aaggcttgggttggagggtt

SEQ ID NO: 22494 - DNA, 20 bp, Artificial Sequence
  Description of Artificial Sequence: Synthetic oligonucleotide
  Target: SCN10A; (-) strand; PAM type: NRG; PAM sequence: GGG
cacacaaggcttgggttgga

SEQ ID NO: 22495 - DNA, 20 bp, Artificial Sequence
  Description of Artificial Sequence: Synthetic oligonucleotide
  Target: SCN10A; (-) strand; PAM type: NRG; PAM sequence: AGG
ccacacaaggcttgggttgg

SEQ ID NO: 22496 - DNA, 20 bp, Artificial Sequence
  Description of Artificial Sequence: Synthetic oligonucleotide
  Target: SCN10A; (-) strand; PAM type: NRG; PAM sequence: GAG
accacacaaggcttgggttg

SEQ ID NO: 22497 - DNA, 20 bp, Artificial Sequence
  Description of Artificial Sequence: Synthetic oligonucleotide
  Target: SCN10A; (-) strand; PAM type: NRG; PAM sequence: TGG
tcaccacacaaggcttgggt

SEQ ID NO: 22498 - DNA, 20 bp, Artificial Sequence
  Description of Artificial Sequence: Synthetic oligonucleotide
  Target: SCN10A; (-) strand; PAM type: NRG; PAM sequence: GGG
gcattcaccacacaaggctt

SEQ ID NO: 22499 - DNA, 20 bp, Artificial Sequence
  Description of Artificial Sequence: Synthetic oligonucleotide
  Target: SCN10A; (-) strand; PAM type: NRG; PAM sequence: TGG
tgcattcaccacacaaggct

SEQ ID NO: 22500 - DNA, 20 bp, Artificial Sequence
  Description of Artificial Sequence: Synthetic oligonucleotide
  Target: SCN10A; (-) strand; PAM type: NRG; PAM sequence: AGG
aatattgcattcaccacaca

SEQ ID NO: 22501 - DNA, 20 bp, Artificial Sequence
  Description of Artificial Sequence: Synthetic oligonucleotide
  Target: SCN10A; (-) strand; PAM type: NRG; PAM sequence: AAG
gaatattgcattcaccacac

SEQ ID NO: 22502 - DNA, 20 bp, Artificial Sequence
  Description of Artificial Sequence: Synthetic oligonucleotide
  Target: SCN10A; (-) strand; PAM type: NRG; PAM sequence: GGG
gagctcactttggaagactt

SEQ ID NO: 22503 - DNA, 20 bp, Artificial Sequence
  Description of Artificial Sequence: Synthetic oligonucleotide
  Target: SCN10A; (-) strand; PAM type: NRG; PAM sequence: TGG
ggagctcactttggaagact

SEQ ID NO: 22504 - DNA, 20 bp, Artificial Sequence
  Description of Artificial Sequence: Synthetic oligonucleotide
  Target: SCN10A; (-) strand; PAM type: NRG; PAM sequence: AAG
gccaaaggagctcactttgg

SEQ ID NO: 22505 - DNA, 20 bp, Artificial Sequence
  Description of Artificial Sequence: Synthetic oligonucleotide
  Target: SCN10A; (-) strand; PAM type: NRG; PAM sequence: TGG
gtagccaaaggagctcactt

SEQ ID NO: 22506 - DNA, 20 bp, Artificial Sequence
  Description of Artificial Sequence: Synthetic oligonucleotide
  Target: SCN10A; (-) strand; PAM type: NRG; PAM sequence: GAG
ctgagtacatgtagccaaag

SEQ ID NO: 22507 - DNA, 20 bp, Artificial Sequence
  Description of Artificial Sequence: Synthetic oligonucleotide
  Target: SCN10A; (-) strand; PAM type: NRG; PAM sequence: AGG
cactgagtacatgtagccaa

SEQ ID NO: 22508 - DNA, 20 bp, Artificial Sequence
  Description of Artificial Sequence: Synthetic oligonucleotide
  Target: SCN10A; (-) strand; PAM type: NRG; PAM sequence: AAG
ccactgagtacatgtagcca

SEQ ID NO: 22509 - DNA, 20 bp, Artificial Sequence
  Description of Artificial Sequence: Synthetic oligonucleotide
  Target: SCN10A; (-) strand; PAM type: NRG; PAM sequence: TAG
gcatgcccactgagtacatg

SEQ ID NO: 22510 - DNA, 20 bp, Artificial Sequence
  Description of Artificial Sequence: Synthetic oligonucleotide
  Target: SCN10A; (-) strand; PAM type: NRG; PAM sequence: GAG
tgtggcccagcatgcccact

SEQ ID NO: 22511 - DNA, 20 bp, Artificial Sequence
  Description of Artificial Sequence: Synthetic oligonucleotide
  Target: SCN10A; (-) strand; PAM type: NRG; PAM sequence: CAG
tttacaacttccatgtggcc

SEQ ID NO: 22512 - DNA, 20 bp, Artificial Sequence
  Description of Artificial Sequence: Synthetic oligonucleotide
  Target: SCN10A; (-) strand; PAM type: NRG; PAM sequence: TGG
gtgactttacaacttccatg

SEQ ID NO: 22513 - DNA, 20 bp, Artificial Sequence
  Description of Artificial Sequence: Synthetic oligonucleotide
  Target: SCN10A; (-) strand; PAM type: NRG; PAM sequence: CAG
ctgcttagctcttctctttt

SEQ ID NO: 22514 - DNA, 20 bp, Artificial Sequence
  Description of Artificial Sequence: Synthetic oligonucleotide
  Target: SCN10A; (-) strand; PAM type: NRG; PAM sequence: TAG
tgagagccgaagtcactgct

SEQ ID NO: 22515 - DNA, 20 bp, Artificial Sequence
  Description of Artificial Sequence: Synthetic oligonucleotide
  Target: SCN10A; (-) strand; PAM type: NRG; PAM sequence: AAG
ctgggggagattgagagccg

SEQ ID NO: 22516 - DNA, 20 bp, Artificial Sequence
  Description of Artificial Sequence: Synthetic oligonucleotide
  Target: SCN10A; (-) strand; PAM type: NRG; PAM sequence: GAG
cctctgctgggggagattga

SEQ ID NO: 22517 - DNA, 20 bp, Artificial Sequence
  Description of Artificial Sequence: Synthetic oligonucleotide
  Target: SCN10A; (-) strand; PAM type: NRG; PAM sequence: GAG
tacctctgctgggggagatt

SEQ ID NO: 22518 - DNA, 20 bp, Artificial Sequence
  Description of Artificial Sequence: Synthetic oligonucleotide
  Target: SCN10A; (-) strand; PAM type: NRG; PAM sequence: GAG
tcattctacctctgctgggg

SEQ ID NO: 22519 - DNA, 20 bp, Artificial Sequence
  Description of Artificial Sequence: Synthetic oligonucleotide
  Target: SCN10A; (-) strand; PAM type: NRG; PAM sequence: GGG
agtcattctacctctgctgg

SEQ ID NO: 22520 - DNA, 20 bp, Artificial Sequence
  Description of Artificial Sequence: Synthetic oligonucleotide
  Target: SCN10A; (-) strand; PAM type: NRG; PAM sequence: GGG
aagtcattctacctctgctg

SEQ ID NO: 22521 - DNA, 20 bp, Artificial Sequence
  Description of Artificial Sequence: Synthetic oligonucleotide
  Target: SCN10A; (-) strand; PAM type: NRG; PAM sequence: GGG
caagtcattctacctctgct

SEQ ID NO: 22522 - DNA, 20 bp, Artificial Sequence
  Description of Artificial Sequence: Synthetic oligonucleotide
  Target: SCN10A; (-) strand; PAM type: NRG; PAM sequence: TGG
gcaagtcattctacctctgc

SEQ ID NO: 22523 - DNA, 20 bp, Artificial Sequence
  Description of Artificial Sequence: Synthetic oligonucleotide
  Target: SCN10A; (-) strand; PAM type: NRG; PAM sequence: AAG
tgagccataaatctagaggc

SEQ ID NO: 22524 - DNA, 20 bp, Artificial Sequence
  Description of Artificial Sequence: Synthetic oligonucleotide
  Target: SCN10A; (-) strand; PAM type: NRG; PAM sequence: AGG
gaaatgagccataaatctag

SEQ ID NO: 22525 - DNA, 20 bp, Artificial Sequence
  Description of Artificial Sequence: Synthetic oligonucleotide
  Target: SCN10A; (-) strand; PAM type: NRG; PAM sequence: GAG
ggaaatgagccataaatcta

SEQ ID NO: 22526 - DNA, 20 bp, Artificial Sequence
  Description of Artificial Sequence: Synthetic oligonucleotide
  Target: SCN10A; (-) strand; PAM type: NRG; PAM sequence: TAG
aaggaaatgagccataaatc

SEQ ID NO: 22527 - DNA, 20 bp, Artificial Sequence
  Description of Artificial Sequence: Synthetic oligonucleotide
  Target: SCN10A; (-) strand; PAM type: NRG; PAM sequence: GAG
catccctcttgcaaggaaat

SEQ ID NO: 22528 - DNA, 20 bp, Artificial Sequence
  Description of Artificial Sequence: Synthetic oligonucleotide
  Target: SCN10A; (-) strand; PAM type: NRG; PAM sequence: AGG
tgctcagcatccctcttgca

SEQ ID NO: 22529 - DNA, 20 bp, Artificial Sequence
  Description of Artificial Sequence: Synthetic oligonucleotide
  Target: SCN10A; (-) strand; PAM type: NRG; PAM sequence: AAG
ttgctcagcatccctcttgc

SEQ ID NO: 22530 - DNA, 20 bp, Artificial Sequence
  Description of Artificial Sequence: Synthetic oligonucleotide
  Target: SCN10A; (-) strand; PAM type: NRG; PAM sequence: CAG
gtattctatttcctgttgct

SEQ ID NO: 22531 - DNA, 20 bp, Artificial Sequence
  Description of Artificial Sequence: Synthetic oligonucleotide
  Target: SCN10A; (-) strand; PAM type: NRG; PAM sequence: GGG
ttgagttgtgttttactttt

SEQ ID NO: 22532 - DNA, 20 bp, Artificial Sequence
  Description of Artificial Sequence: Synthetic oligonucleotide
  Target: SCN10A; (-) strand; PAM type: NRG; PAM sequence: TGG
cttgagttgtgttttacttt

SEQ ID NO: 22533 - DNA, 20 bp, Artificial Sequence
  Description of Artificial Sequence: Synthetic oligonucleotide
  Target: SCN10A; (-) strand; PAM type: NRG; PAM sequence: GAG
cctgccaaaatggttctctt

SEQ ID NO: 22534 - DNA, 20 bp, Artificial Sequence
  Description of Artificial Sequence: Synthetic oligonucleotide
  Target: SCN10A; (-) strand; PAM type: NRG; PAM sequence: TGG
actcccctttcctgccaaaa

SEQ ID NO: 22535 - DNA, 20 bp, Artificial Sequence
  Description of Artificial Sequence: Synthetic oligonucleotide
  Target: SCN10A; (-) strand; PAM type: NRG; PAM sequence: TAG
ggagcccctgtgtgtgtgta

SEQ ID NO: 22536 - DNA, 20 bp, Artificial Sequence
  Description of Artificial Sequence: Synthetic oligonucleotide
  Target: SCN10A; (-) strand; PAM type: NRG; PAM sequence: GAG
atatagggacaggggatatg

SEQ ID NO: 22537 - DNA, 20 bp, Artificial Sequence
  Description of Artificial Sequence: Synthetic oligonucleotide
  Target: SCN10A; (-) strand; PAM type: NRG; PAM sequence: TGG
tcatatagggacaggggata

SEQ ID NO: 22538 - DNA, 20 bp, Artificial Sequence
  Description of Artificial Sequence: Synthetic oligonucleotide
  Target: SCN10A; (-) strand; PAM type: NRG; PAM sequence: GGG
ttggtatcatatagggacag

SEQ ID NO: 22539 - DNA, 20 bp, Artificial Sequence
  Description of Artificial Sequence: Synthetic oligonucleotide
  Target: SCN10A; (-) strand; PAM type: NRG; PAM sequence: GGG
cttggtatcatatagggaca

SEQ ID NO: 22540 - DNA, 20 bp, Artificial Sequence
  Description of Artificial Sequence: Synthetic oligonucleotide
  Target: SCN10A; (-) strand; PAM type: NRG; PAM sequence: AGG
ccttggtatcatatagggac

SEQ ID NO: 22541 - DNA, 20 bp, Artificial Sequence
  Description of Artificial Sequence: Synthetic oligonucleotide
  Target: SCN10A; (-) strand; PAM type: NRG; PAM sequence: CAG
cccttggtatcatataggga

SEQ ID NO: 22542 - DNA, 20 bp, Artificial Sequence
  Description of Artificial Sequence: Synthetic oligonucleotide
  Target: SCN10A; (-) strand; PAM type: NRG; PAM sequence: GGG
tggacccttggtatcatata

SEQ ID NO: 22543 - DNA, 20 bp, Artificial Sequence
  Description of Artificial Sequence: Synthetic oligonucleotide
  Target: SCN10A; (-) strand; PAM type: NRG; PAM sequence: AGG
ttggacccttggtatcatat

SEQ ID NO: 22544 - DNA, 20 bp, Artificial Sequence
  Description of Artificial Sequence: Synthetic oligonucleotide
  Target: SCN10A; (-) strand; PAM type: NRG; PAM sequence: TAG
gttggacccttggtatcata

SEQ ID NO: 22545 - DNA, 20 bp, Artificial Sequence
  Description of Artificial Sequence: Synthetic oligonucleotide
  Target: SCN10A; (-) strand; PAM type: NRG; PAM sequence: TGG
ccaaggtctggttggaccct

SEQ ID NO: 22546 - DNA, 20 bp, Artificial Sequence
  Description of Artificial Sequence: Synthetic oligonucleotide
  Target: SCN10A; (-) strand; PAM type: NRG; PAM sequence: TGG
catagggaccaaggtctggt

SEQ ID NO: 22547 - DNA, 20 bp, Artificial Sequence
  Description of Artificial Sequence: Synthetic oligonucleotide
  Target: SCN10A; (-) strand; PAM type: NRG; PAM sequence: TGG
cttccatagggaccaaggtc

SEQ ID NO: 22548 - DNA, 20 bp, Artificial Sequence
  Description of Artificial Sequence: Synthetic oligonucleotide
  Target: SCN10A; (-) strand; PAM type: NRG; PAM sequence: AGG
agtctcttccatagggacca

SEQ ID NO: 22549 - DNA, 20 bp, Artificial Sequence
  Description of Artificial Sequence: Synthetic oligonucleotide
  Target: SCN10A; (-) strand; PAM type: NRG; PAM sequence: AAG
gagtctcttccatagggacc

SEQ ID NO: 22550 - DNA, 20 bp, Artificial Sequence
  Description of Artificial Sequence: Synthetic oligonucleotide
  Target: SCN10A; (-) strand; PAM type: NRG; PAM sequence: GGG
tgagtggagtctcttccata

SEQ ID NO: 22551 - DNA, 20 bp, Artificial Sequence
  Description of Artificial Sequence: Synthetic oligonucleotide
  Target: SCN10A; (-) strand; PAM type: NRG; PAM sequence: AGG
gtgagtggagtctcttccat

SEQ ID NO: 22552 - DNA, 20 bp, Artificial Sequence
  Description of Artificial Sequence: Synthetic oligonucleotide
  Target: SCN10A; (-) strand; PAM type: NRG; PAM sequence: TAG
cgtgagtggagtctcttcca

SEQ ID NO: 22553 - DNA, 20 bp, Artificial Sequence
  Description of Artificial Sequence: Synthetic oligonucleotide
  Target: SCN10A; (-) strand; PAM type: NRG; PAM sequence: GAG
tctcacagaaaacgtgagtg

SEQ ID NO: 22554 - DNA, 20 bp, Artificial Sequence
  Description of Artificial Sequence: Synthetic oligonucleotide
  Target: SCN10A; (-) strand; PAM type: NRG; PAM sequence: TGG
catctcacagaaaacgtgag

SEQ ID NO: 22555 - DNA, 20 bp, Artificial Sequence
  Description of Artificial Sequence: Synthetic oligonucleotide
  Target: SCN10A; (-) strand; PAM type: NRG; PAM sequence: GAG
actcatctcacagaaaacgt

SEQ ID NO: 22556 - DNA, 20 bp, Artificial Sequence
  Description of Artificial Sequence: Synthetic oligonucleotide
  Target: SCN10A; (-) strand; PAM type: NRG; PAM sequence: CAG
acaaccaactactcatctca

SEQ ID NO: 22557 - DNA, 20 bp, Artificial Sequence
  Description of Artificial Sequence: Synthetic oligonucleotide
  Target: SCN10A; (-) strand; PAM type: NRG; PAM sequence: GAG
agaatgacatggctgtcaat

SEQ ID NO: 22558 - DNA, 20 bp, Artificial Sequence
  Description of Artificial Sequence: Synthetic oligonucleotide
  Target: SCN10A; (-) strand; PAM type: NRG; PAM sequence: TGG
taaatgtgtcaagaatgaca

SEQ ID NO: 22559 - DNA, 20 bp, Artificial Sequence
  Description of Artificial Sequence: Synthetic oligonucleotide
  Target: SCN10A; (-) strand; PAM type: NRG; PAM sequence: AAG
acctcaaaaataaatgtgtc

SEQ ID NO: 22560 - DNA, 20 bp, Artificial Sequence
  Description of Artificial Sequence: Synthetic oligonucleotide
  Target: SCN10A; (-) strand; PAM type: NRG; PAM sequence: GGG
gtggggctgcaactcttcaa

SEQ ID NO: 22561 - DNA, 20 bp, Artificial Sequence
  Description of Artificial Sequence: Synthetic oligonucleotide
  Target: SCN10A; (-) strand; PAM type: NRG; PAM sequence: AGG
ggtggggctgcaactcttca

SEQ ID NO: 22562 - DNA, 20 bp, Artificial Sequence
  Description of Artificial Sequence: Synthetic oligonucleotide
  Target: SCN10A; (-) strand; PAM type: NRG; PAM sequence: AAG
tggtggggctgcaactcttc

SEQ ID NO: 22563 - DNA, 20 bp, Artificial Sequence
  Description of Artificial Sequence: Synthetic oligonucleotide
  Target: SCN10A; (-) strand; PAM type: NRG; PAM sequence: GGG
taagtgtttttgccttggtg

SEQ ID NO: 22564 - DNA, 20 bp, Artificial Sequence
  Description of Artificial Sequence: Synthetic oligonucleotide
  Target: SCN10A; (-) strand; PAM type: NRG; PAM sequence: GGG
ctaagtgtttttgccttggt

SEQ ID NO: 22565 - DNA, 20 bp, Artificial Sequence
  Description of Artificial Sequence: Synthetic oligonucleotide
  Target: SCN10A; (-) strand; PAM type: NRG; PAM sequence: TGG
cctaagtgtttttgccttgg

SEQ ID NO: 22566 - DNA, 20 bp, Artificial Sequence
  Description of Artificial Sequence: Synthetic oligonucleotide
  Target: SCN10A; (-) strand; PAM type: NRG; PAM sequence: TGG
ctgcctaagtgtttttgcct

SEQ ID NO: 22567 - DNA, 20 bp, Artificial Sequence
  Description of Artificial Sequence: Synthetic oligonucleotide
  Target: SCN10A; (-) strand; PAM type: NRG; PAM sequence: AAG
atcctcaccatcttctgcct

SEQ ID NO: 22568 - DNA, 20 bp, Artificial Sequence
  Description of Artificial Sequence: Synthetic oligonucleotide
  Target: SCN10A; (-) strand; PAM type: NRG; PAM sequence: TGG
gattcactcagtgaagaaac

SEQ ID NO: 22569 - DNA, 20 bp, Artificial Sequence
  Description of Artificial Sequence: Synthetic oligonucleotide
  Target: SCN10A; (-) strand; PAM type: NRG; PAM sequence: AAG
gggccctgattcactcagtg

SEQ ID NO: 22570 - DNA, 20 bp, Artificial Sequence
  Description of Artificial Sequence: Synthetic oligonucleotide
  Target: SCN10A; (-) strand; PAM type: NRG; PAM sequence: CAG
tgtgggggccctgattcact

SEQ ID NO: 22571 - DNA, 20 bp, Artificial Sequence
  Description of Artificial Sequence: Synthetic oligonucleotide
  Target: SCN10A; (-) strand; PAM type: NRG; PAM sequence: GGG
aggcctgaaggtcattgtgg

SEQ ID NO: 22572 - DNA, 20 bp, Artificial Sequence
  Description of Artificial Sequence: Synthetic oligonucleotide
  Target: SCN10A; (-) strand; PAM type: NRG; PAM sequence: GGG
caggcctgaaggtcattgtg

SEQ ID NO: 22573 - DNA, 20 bp, Artificial Sequence
  Description of Artificial Sequence: Synthetic oligonucleotide
  Target: SCN10A; (-) strand; PAM type: NRG; PAM sequence: GGG
gcaggcctgaaggtcattgt

SEQ ID NO: 22574 - DNA, 20 bp, Artificial Sequence
  Description of Artificial Sequence: Synthetic oligonucleotide
  Target: SCN10A; (-) strand; PAM type: NRG; PAM sequence: TGG
cgcaggcctgaaggtcattg

SEQ ID NO: 22575 - DNA, 20 bp, Artificial Sequence
  Description of Artificial Sequence: Synthetic oligonucleotide
  Target: SCN10A; (-) strand; PAM type: NRG; PAM sequence: AGG
tcatcttcccgcaggcctga

SEQ ID NO: 22576 - DNA, 20 bp, Artificial Sequence
  Description of Artificial Sequence: Synthetic oligonucleotide
  Target: SCN10A; (-) strand; PAM type: NRG; PAM sequence: AAG
gtcatcttcccgcaggcctg

SEQ ID NO: 22577 - DNA, 20 bp, Artificial Sequence
  Description of Artificial Sequence: Synthetic oligonucleotide
  Target: SCN10A; (-) strand; PAM type: NRG; PAM sequence: AGG
taccactgtcatcttcccgc

SEQ ID NO: 22578 - DNA, 20 bp, Artificial Sequence
  Description of Artificial Sequence: Synthetic oligonucleotide
  Target: SCN10A; (-) strand; PAM type: NRG; PAM sequence: CAG
ataccactgtcatcttcccg

SEQ ID NO: 22579 - DNA, 20 bp, Artificial Sequence
  Description of Artificial Sequence: Synthetic oligonucleotide
  Target: SCN10A; (-) strand; PAM type: NRG; PAM sequence: TGG
tgtgtgctacctcatccatg

SEQ ID NO: 22580 - DNA, 20 bp, Artificial Sequence
  Description of Artificial Sequence: Synthetic oligonucleotide
  Target: SCN10A; (-) strand; PAM type: NRG; PAM sequence: AAG
ggaggatggctaagatgaag

SEQ ID NO: 22581 - DNA, 20 bp, Artificial Sequence
  Description of Artificial Sequence: Synthetic oligonucleotide
  Target: SCN10A; (-) strand; PAM type: NRG; PAM sequence: AAG
gaaggaggatggctaagatg

SEQ ID NO: 22582 - DNA, 20 bp, Artificial Sequence
  Description of Artificial Sequence: Synthetic oligonucleotide
  Target: SCN10A; (-) strand; PAM type: NRG; PAM sequence: AAG
agagatgaaggaggatggct

SEQ ID NO: 22583 - DNA, 20 bp, Artificial Sequence
  Description of Artificial Sequence: Synthetic oligonucleotide
  Target: SCN10A; (-) strand; PAM type: NRG; PAM sequence: TGG
tatgtagagatgaaggagga

SEQ ID NO: 22584 - DNA, 20 bp, Artificial Sequence
  Description of Artificial Sequence: Synthetic oligonucleotide
  Target: SCN10A; (-) strand; PAM type: NRG; PAM sequence: AGG
cctgtatgtagagatgaagg

SEQ ID NO: 22585 - DNA, 20 bp, Artificial Sequence
  Description of Artificial Sequence: Synthetic oligonucleotide
  Target: SCN10A; (-) strand; PAM type: NRG; PAM sequence: GAG
tcctgtatgtagagatgaag

SEQ ID NO: 22586 - DNA, 20 bp, Artificial Sequence
  Description of Artificial Sequence: Synthetic oligonucleotide
  Target: SCN10A; (-) strand; PAM type: NRG; PAM sequence: AGG
actcctgtatgtagagatga

SEQ ID NO: 22587 - DNA, 20 bp, Artificial Sequence
  Description of Artificial Sequence: Synthetic oligonucleotide
  Target: SCN10A; (-) strand; PAM type: NRG; PAM sequence: AAG
cactcctgtatgtagagatg

SEQ ID NO: 22588 - DNA, 20 bp, Artificial Sequence
  Description of Artificial Sequence: Synthetic oligonucleotide
  Target: SCN10A; (-) strand; PAM type: NRG; PAM sequence: GAG
atacttcactcctgtatgta

SEQ ID NO: 22589 - DNA, 20 bp, Artificial Sequence
  Description of Artificial Sequence: Synthetic oligonucleotide
  Target: SCN10A; (-) strand; PAM type: NRG; PAM sequence: TAG
acatacttcactcctgtatg

SEQ ID NO: 22590 - DNA, 20 bp, Artificial Sequence
  Description of Artificial Sequence: Synthetic oligonucleotide
  Target: SCN10A; (-) strand; PAM type: NRG; PAM sequence: GAG
aaggtcttggaactgccctg

SEQ ID NO: 22591 - DNA, 20 bp, Artificial Sequence
  Description of Artificial Sequence: Synthetic oligonucleotide
  Target: SCN10A; (-) strand; PAM type: NRG; PAM sequence: TGG
gaaaggtcttggaactgccc

SEQ ID NO: 22592 - DNA, 20 bp, Artificial Sequence
  Description of Artificial Sequence: Synthetic oligonucleotide
  Target: SCN10A; (-) strand; PAM type: NRG; PAM sequence: TGG
gcttcggatgagaaaggtct

SEQ ID NO: 22593 - DNA, 20 bp, Artificial Sequence
  Description of Artificial Sequence: Synthetic oligonucleotide
  Target: SCN10A; (-) strand; PAM type: NRG; PAM sequence: AGG
atgcaagcttcggatgagaa

SEQ ID NO: 22594 - DNA, 20 bp, Artificial Sequence
  Description of Artificial Sequence: Synthetic oligonucleotide
  Target: SCN10A; (-) strand; PAM type: NRG; PAM sequence: AAG
aatgcaagcttcggatgaga

SEQ ID NO: 22595 - DNA, 20 bp, Artificial Sequence
  Description of Artificial Sequence: Synthetic oligonucleotide
  Target: SCN10A; (-) strand; PAM type: NRG; PAM sequence: GAG
agtaaatgcaagcttcggat

SEQ ID NO: 22596 - DNA, 20 bp, Artificial Sequence
  Description of Artificial Sequence: Synthetic oligonucleotide
  Target: SCN10A; (-) strand; PAM type: NRG; PAM sequence: CGG
ctcagagtaaatgcaagctt

SEQ ID NO: 22597 - DNA, 20 bp, Artificial Sequence
  Description of Artificial Sequence: Synthetic oligonucleotide
  Target: SCN10A; (-) strand; PAM type: NRG; PAM sequence: AAG
ctgcctctcagagtaaatgc

SEQ ID NO: 22598 - DNA, 20 bp, Artificial Sequence
  Description of Artificial Sequence: Synthetic oligonucleotide
  Target: SCN10A; (-) strand; PAM type: NRG; PAM sequence: GAG
gactctctgcctgcctctca

SEQ ID NO: 22599 - DNA, 20 bp, Artificial Sequence
  Description of Artificial Sequence: Synthetic oligonucleotide
  Target: SCN10A; (-) strand; PAM type: NRG; PAM sequence: CAG
ctgactctctgcctgcctct

SEQ ID NO: 22600 - DNA, 20 bp, Artificial Sequence
  Description of Artificial Sequence: Synthetic oligonucleotide
  Target: SCN10A; (-) strand; PAM type: NRG; PAM sequence: TAG
catcgtctttataatgagaa

SEQ ID NO: 22601 - DNA, 20 bp, Artificial Sequence
  Description of Artificial Sequence: Synthetic oligonucleotide
  Target: SCN10A; (-) strand; PAM type: NRG; PAM sequence: GAG
agttgcatcgtctttataat

SEQ ID NO: 22602 - DNA, 20 bp, Artificial Sequence
  Description of Artificial Sequence: Synthetic oligonucleotide
  Target: SCN10A; (-) strand; PAM type: NRG; PAM sequence: CAG
aaaatgcattgcctgggtct

SEQ ID NO: 22603 - DNA, 20 bp, Artificial Sequence
  Description of Artificial Sequence: Synthetic oligonucleotide
  Target: SCN10A; (-) strand; PAM type: NRG; PAM sequence: GGG
tgataaaaaatgcattgcct

SEQ ID NO: 22604 - DNA, 20 bp, Artificial Sequence
  Description of Artificial Sequence: Synthetic oligonucleotide
  Target: SCN10A; (-) strand; PAM type: NRG; PAM sequence: TGG
atgataaaaaatgcattgcc

SEQ ID NO: 22605 - DNA, 20 bp, Artificial Sequence
  Description of Artificial Sequence: Synthetic oligonucleotide
  Target: SCN10A; (-) strand; PAM type: NRG; PAM sequence: AAG
tcaggaattttattagcctc

SEQ ID NO: 22606 - DNA, 20 bp, Artificial Sequence
  Description of Artificial Sequence: Synthetic oligonucleotide
  Target: SCN10A; (-) strand; PAM type: NRG; PAM sequence: TAG
gctagtgtcaggaattttat

SEQ ID NO: 22607 - DNA, 20 bp, Artificial Sequence
  Description of Artificial Sequence: Synthetic oligonucleotide
  Target: SCN10A; (-) strand; PAM type: NRG; PAM sequence: AGG
taaattgaattgctagtgtc

SEQ ID NO: 22608 - DNA, 20 bp, Artificial Sequence
  Description of Artificial Sequence: Synthetic oligonucleotide
  Target: SCN10A; (-) strand; PAM type: NRG; PAM sequence: CAG
ttaaattgaattgctagtgt

SEQ ID NO: 22609 - DNA, 20 bp, Artificial Sequence
  Description of Artificial Sequence: Synthetic oligonucleotide
  Target: SCN10A; (-) strand; PAM type: NRG; PAM sequence: TAG
aattatttaaattgaattgc

SEQ ID NO: 22610 - DNA, 20 bp, Artificial Sequence
  Description of Artificial Sequence: Synthetic oligonucleotide
  Target: SCN10A; (-) strand; PAM type: NRG; PAM sequence: CAG
gcctggaaaaagtaggtact

SEQ ID NO: 22611 - DNA, 20 bp, Artificial Sequence
  Description of Artificial Sequence: Synthetic oligonucleotide
  Target: SCN10A; (-) strand; PAM type: NRG; PAM sequence: AGG
gcacagtgcctggaaaaagt

SEQ ID NO: 22612 - DNA, 20 bp, Artificial Sequence
  Description of Artificial Sequence: Synthetic oligonucleotide
  Target: SCN10A; (-) strand; PAM type: NRG; PAM sequence: TAG
agcacagtgcctggaaaaag

SEQ ID NO: 22613 - DNA, 20 bp, Artificial Sequence
  Description of Artificial Sequence: Synthetic oligonucleotide
  Target: SCN10A; (-) strand; PAM type: NRG; PAM sequence: AAG
cctagcacagtgcctggaaa

SEQ ID NO: 22614 - DNA, 20 bp, Artificial Sequence
  Description of Artificial Sequence: Synthetic oligonucleotide
  Target: SCN10A; (-) strand; PAM type: NRG; PAM sequence: TGG
ttcatgcctagcacagtgcc

SEQ ID NO: 22615 - DNA, 20 bp, Artificial Sequence
  Description of Artificial Sequence: Synthetic oligonucleotide
  Target: SCN10A; (-) strand; PAM type: NRG; PAM sequence: CAG
tagtagcttcatgcctagca

SEQ ID NO: 22616 - DNA, 20 bp, Artificial Sequence
  Description of Artificial Sequence: Synthetic oligonucleotide
  Target: SCN10A; (-) strand; PAM type: NRG; PAM sequence: TAG
gaagttagtagcttcatgcc

SEQ ID NO: 22617 - DNA, 20 bp, Artificial Sequence
  Description of Artificial Sequence: Synthetic oligonucleotide
  Target: SCN10A; (-) strand; PAM type: NRG; PAM sequence: TAG
aattactggggtgaagttag

SEQ ID NO: 22618 - DNA, 20 bp, Artificial Sequence
  Description of Artificial Sequence: Synthetic oligonucleotide
  Target: SCN10A; (-) strand; PAM type: NRG; PAM sequence: TAG
ccaaattactggggtgaagt

SEQ ID NO: 22619 - DNA, 20 bp, Artificial Sequence
  Description of Artificial Sequence: Synthetic oligonucleotide
  Target: SCN10A; (-) strand; PAM type: NRG; PAM sequence: AAG
gatgccaaattactggggtg

SEQ ID NO: 22620 - DNA, 20 bp, Artificial Sequence
  Description of Artificial Sequence: Synthetic oligonucleotide
  Target: SCN10A; (-) strand; PAM type: NRG; PAM sequence: GGG
agacagatgccaaattactg

SEQ ID NO: 22621 - DNA, 20 bp, Artificial Sequence
  Description of Artificial Sequence: Synthetic oligonucleotide
  Target: SCN10A; (-) strand; PAM type: NRG; PAM sequence: GGG
aagacagatgccaaattact

SEQ ID NO: 22622 - DNA, 20 bp, Artificial Sequence
  Description of Artificial Sequence: Synthetic oligonucleotide
  Target: SCN10A; (-) strand; PAM type: NRG; PAM sequence: TGG
aaagacagatgccaaattac

SEQ ID NO: 22623 - DNA, 20 bp, Artificial Sequence
  Description of Artificial Sequence: Synthetic oligonucleotide
  Target: SCN10A; (-) strand; PAM type: NRG; PAM sequence: CAG
cccagatgcatgcagaaaga

SEQ ID NO: 22624 - DNA, 20 bp, Artificial Sequence
  Description of Artificial Sequence: Synthetic oligonucleotide
  Target: SCN10A; (-) strand; PAM type: NRG; PAM sequence: AAG
gcctcccagatgcatgcaga

SEQ ID NO: 22625 - DNA, 20 bp, Artificial Sequence
  Description of Artificial Sequence: Synthetic oligonucleotide
  Target: SCN10A; (-) strand; PAM type: NRG; PAM sequence: CAG
agctgcctcccagatgcatg

SEQ ID NO: 22626 - DNA, 20 bp, Artificial Sequence
  Description of Artificial Sequence: Synthetic oligonucleotide
  Target: SCN10A; (-) strand; PAM type: NRG; PAM sequence: CAG
ccaagtctcaagctgcctcc

SEQ ID NO: 22627 - DNA, 20 bp, Artificial Sequence
  Description of Artificial Sequence: Synthetic oligonucleotide
  Target: SCN10A; (-) strand; PAM type: NRG; PAM sequence: AAG
gttcatgtgtcccaagtctc

SEQ ID NO: 22628 - DNA, 20 bp, Artificial Sequence
  Description of Artificial Sequence: Synthetic oligonucleotide
  Target: SCN10A; (-) strand; PAM type: NRG; PAM sequence: AAG
cagtgaggttcatgtgtccc

SEQ ID NO: 22629 - DNA, 20 bp, Artificial Sequence
  Description of Artificial Sequence: Synthetic oligonucleotide
  Target: SCN10A; (-) strand; PAM type: NRG; PAM sequence: AGG
acacacactcacacacagtg

SEQ ID NO: 22630 - DNA, 20 bp, Artificial Sequence
  Description of Artificial Sequence: Synthetic oligonucleotide
  Target: SCN10A; (-) strand; PAM type: NRG; PAM sequence: GAG
cacacacactcacacacagt

SEQ ID NO: 22631 - DNA, 20 bp, Artificial Sequence
  Description of Artificial Sequence: Synthetic oligonucleotide
  Target: SCN10A; (-) strand; PAM type: NRG; PAM sequence: CAG
cacacacacacactcacaca

SEQ ID NO: 22632 - DNA, 20 bp, Artificial Sequence
  Description of Artificial Sequence: Synthetic oligonucleotide
  Target: SCN10A; (-) strand; PAM type: NRG; PAM sequence: TGG
ctctttctttttctttctct

SEQ ID NO: 22633 - DNA, 20 bp, Artificial Sequence
  Description of Artificial Sequence: Synthetic oligonucleotide
  Target: SCN10A; (-) strand; PAM type: NRG; PAM sequence: TAG
gactgtctcagtgtttctta

SEQ ID NO: 22634 - DNA, 20 bp, Artificial Sequence
  Description of Artificial Sequence: Synthetic oligonucleotide
  Target: SCN10A; (-) strand; PAM type: NRG; PAM sequence: CAG
ttatgccccagtgactgtct

SEQ ID NO: 22635 - DNA, 20 bp, Artificial Sequence
  Description of Artificial Sequence: Synthetic oligonucleotide
  Target: SCN10A; (-) strand; PAM type: NRG; PAM sequence: CAG
cacaagttctatttatgccc

SEQ ID NO: 22636 - DNA, 20 bp, Artificial Sequence
  Description of Artificial Sequence: Synthetic oligonucleotide
  Target: SCN10A; (-) strand; PAM type: NRG; PAM sequence: AAG
ctgccagctgtgcttggcac

SEQ ID NO: 22637 - DNA, 20 bp, Artificial Sequence
  Description of Artificial Sequence: Synthetic oligonucleotide
  Target: SCN10A; (-) strand; PAM type: NRG; PAM sequence: TGG
tctttgctgccagctgtgct

SEQ ID NO: 22638 - DNA, 20 bp, Artificial Sequence
  Description of Artificial Sequence: Synthetic oligonucleotide
  Target: SCN10A; (-) strand; PAM type: NRG; PAM sequence: CAG
ggtgtatccttctttgctgc

SEQ ID NO: 22639 - DNA, 20 bp, Artificial Sequence
  Description of Artificial Sequence: Synthetic oligonucleotide
  Target: SCN10A; (-) strand; PAM type: NRG; PAM sequence: AGG
tcatccctccttaaacaagc

SEQ ID NO: 22640 - DNA, 20 bp, Artificial Sequence
  Description of Artificial Sequence: Synthetic oligonucleotide
  Target: SCN10A; (-) strand; PAM type: NRG; PAM sequence: CAG
atcatccctccttaaacaag

SEQ ID NO: 22641 - DNA, 20 bp, Artificial Sequence
  Description of Artificial Sequence: Synthetic oligonucleotide
  Target: SCN10A; (-) strand; PAM type: NRG; PAM sequence: AAG
caaatcatccctccttaaac

SEQ ID NO: 22642 - DNA, 20 bp, Artificial Sequence
  Description of Artificial Sequence: Synthetic oligonucleotide
  Target: SCN10A; (-) strand; PAM type: NRG; PAM sequence: GAG
gaagttgattttacttacca

SEQ ID NO: 22643 - DNA, 20 bp, Artificial Sequence
  Description of Artificial Sequence: Synthetic oligonucleotide
  Target: SCN10A; (-) strand; PAM type: NRG; PAM sequence: CAG
aagaagttgattttacttac

SEQ ID NO: 22644 - DNA, 20 bp, Artificial Sequence
  Description of Artificial Sequence: Synthetic oligonucleotide
  Target: SCN10A; (-) strand; PAM type: NRG; PAM sequence: AAG
gcgaagctgctctcccaaag

SEQ ID NO: 22645 - DNA, 20 bp, Artificial Sequence
  Description of Artificial Sequence: Synthetic oligonucleotide
  Target: SCN10A; (-) strand; PAM type: NRG; PAM sequence: AAG
cctgcgaagctgctctccca

SEQ ID NO: 22646 - DNA, 20 bp, Artificial Sequence
  Description of Artificial Sequence: Synthetic oligonucleotide
  Target: SCN10A; (-) strand; PAM type: NRG; PAM sequence: AAG
agctctttctgctacctgcg

SEQ ID NO: 22647 - DNA, 20 bp, Artificial Sequence
  Description of Artificial Sequence: Synthetic oligonucleotide
  Target: SCN10A; (-) strand; PAM type: NRG; PAM sequence: GAG
ctagattgcttccctggtca

SEQ ID NO: 22648 - DNA, 20 bp, Artificial Sequence
  Description of Artificial Sequence: Synthetic oligonucleotide
  Target: SCN10A; (-) strand; PAM type: NRG; PAM sequence: CAG
tcctagattgcttccctggt

SEQ ID NO: 22649 - DNA, 20 bp, Artificial Sequence
  Description of Artificial Sequence: Synthetic oligonucleotide
  Target: SCN10A; (-) strand; PAM type: NRG; PAM sequence: TGG
taaatcctagattgcttccc

SEQ ID NO: 22650 - DNA, 20 bp, Artificial Sequence
  Description of Artificial Sequence: Synthetic oligonucleotide
  Target: SCN10A; (-) strand; PAM type: NRG; PAM sequence: TAG
gactaaccaaaaataaatcc

SEQ ID NO: 22651 - DNA, 20 bp, Artificial Sequence
  Description of Artificial Sequence: Synthetic oligonucleotide
  Target: SCN10A; (-) strand; PAM type: NRG; PAM sequence: TGG
ctgacacatgtagtgctcag

SEQ ID NO: 22652 - DNA, 20 bp, Artificial Sequence
  Description of Artificial Sequence: Synthetic oligonucleotide
  Target: SCN10A; (-) strand; PAM type: NRG; PAM sequence: CAG
ggactgacacatgtagtgct

SEQ ID NO: 22653 - DNA, 20 bp, Artificial Sequence
  Description of Artificial Sequence: Synthetic oligonucleotide
  Target: SCN10A; (-) strand; PAM type: NRG; PAM sequence: TAG
agtccagggactgacacatg

SEQ ID NO: 22654 - DNA, 20 bp, Artificial Sequence
  Description of Artificial Sequence: Synthetic oligonucleotide
  Target: SCN10A; (-) strand; PAM type: NRG; PAM sequence: GGG
atcactcagctcccagtcca

SEQ ID NO: 22655 - DNA, 20 bp, Artificial Sequence
  Description of Artificial Sequence: Synthetic oligonucleotide
  Target: SCN10A; (-) strand; PAM type: NRG; PAM sequence: AGG
catcactcagctcccagtcc

SEQ ID NO: 22656 - DNA, 20 bp, Artificial Sequence
  Description of Artificial Sequence: Synthetic oligonucleotide
  Target: SCN10A; (-) strand; PAM type: NRG; PAM sequence: CAG
ccatcactcagctcccagtc

SEQ ID NO: 22657 - DNA, 20 bp, Artificial Sequence
  Description of Artificial Sequence: Synthetic oligonucleotide
  Target: SCN10A; (-) strand; PAM type: NRG; PAM sequence: CAG
cttagccatcactcagctcc

SEQ ID NO: 22658 - DNA, 20 bp, Artificial Sequence
  Description of Artificial Sequence: Synthetic oligonucleotide
  Target: SCN10A; (-) strand; PAM type: NRG; PAM sequence: CAG
ctgctgccttagccatcact

SEQ ID NO: 22659 - DNA, 20 bp, Artificial Sequence
  Description of Artificial Sequence: Synthetic oligonucleotide
  Target: SCN10A; (-) strand; PAM type: NRG; PAM sequence: TAG
cactcgacatgctgctgcct

SEQ ID NO: 22660 - DNA, 20 bp, Artificial Sequence
  Description of Artificial Sequence: Synthetic oligonucleotide
  Target: SCN10A; (-) strand; PAM type: NRG; PAM sequence: CGG
tcccctcaattgtcagacaa

SEQ ID NO: 22661 - DNA, 20 bp, Artificial Sequence
  Description of Artificial Sequence: Synthetic oligonucleotide
  Target: SCN10A; (-) strand; PAM type: NRG; PAM sequence: CAG
cagactttcccctcaattgt

SEQ ID NO: 22662 - DNA, 20 bp, Artificial Sequence
  Description of Artificial Sequence: Synthetic oligonucleotide
  Target: SCN10A; (-) strand; PAM type: NRG; PAM sequence: CAG
ccatctgctcagtaatgcta

SEQ ID NO: 22663 - DNA, 20 bp, Artificial Sequence
  Description of Artificial Sequence: Synthetic oligonucleotide
  Target: SCN10A; (-) strand; PAM type: NRG; PAM sequence: CAG
cccctgtgtgcccatctgct

SEQ ID NO: 22664 - DNA, 20 bp, Artificial Sequence
  Description of Artificial Sequence: Synthetic oligonucleotide
  Target: SCN10A; (-) strand; PAM type: NRG; PAM sequence: GGG
acctctggaacttcagttaa

SEQ ID NO: 22665 - DNA, 20 bp, Artificial Sequence
  Description of Artificial Sequence: Synthetic oligonucleotide
  Target: SCN10A; (-) strand; PAM type: NRG; PAM sequence: AGG
cacctctggaacttcagtta

SEQ ID NO: 22666 - DNA, 20 bp, Artificial Sequence
  Description of Artificial Sequence: Synthetic oligonucleotide
  Target: SCN10A; (-) strand; PAM type: NRG; PAM sequence: AAG
ccacctctggaacttcagtt

SEQ ID NO: 22667 - DNA, 20 bp, Artificial Sequence
  Description of Artificial Sequence: Synthetic oligonucleotide
  Target: SCN10A; (-) strand; PAM type: NRG; PAM sequence: CAG
cattcccacctctggaactt

SEQ ID NO: 22668 - DNA, 20 bp, Artificial Sequence
  Description of Artificial Sequence: Synthetic oligonucleotide
  Target: SCN10A; (-) strand; PAM type: NRG; PAM sequence: TGG
acccaccccattcccacctc

SEQ ID NO: 22669 - DNA, 20 bp, Artificial Sequence
  Description of Artificial Sequence: Synthetic oligonucleotide
  Target: SCN10A; (-) strand; PAM type: NRG; PAM sequence: TGG
ccaaggttttacctcctccc

SEQ ID NO: 22670 - DNA, 20 bp, Artificial Sequence
  Description of Artificial Sequence: Synthetic oligonucleotide
  Target: SCN10A; (-) strand; PAM type: NRG; PAM sequence: AGG
cattcctcagggctctgcca

SEQ ID NO: 22671 - DNA, 20 bp, Artificial Sequence
  Description of Artificial Sequence: Synthetic oligonucleotide
  Target: SCN10A; (-) strand; PAM type: NRG; PAM sequence: AAG
tcattcctcagggctctgcc

SEQ ID NO: 22672 - DNA, 20 bp, Artificial Sequence
  Description of Artificial Sequence: Synthetic oligonucleotide
  Target: SCN10A; (-) strand; PAM type: NRG; PAM sequence: GGG
caactcacactcattcctca

SEQ ID NO: 22673 - DNA, 20 bp, Artificial Sequence
  Description of Artificial Sequence: Synthetic oligonucleotide
  Target: SCN10A; (-) strand; PAM type: NRG; PAM sequence: AGG
tcaactcacactcattcctc

SEQ ID NO: 22674 - DNA, 20 bp, Artificial Sequence
  Description of Artificial Sequence: Synthetic oligonucleotide
  Target: SCN10A; (-) strand; PAM type: NRG; PAM sequence: CAG
ctcaactcacactcattcct

SEQ ID NO: 22675 - DNA, 20 bp, Artificial Sequence
  Description of Artificial Sequence: Synthetic oligonucleotide
  Target: SCN10A; (-) strand; PAM type: NRG; PAM sequence: GGG
actgtgctgccccttcttct

SEQ ID NO: 22676 - DNA, 20 bp, Artificial Sequence
  Description of Artificial Sequence: Synthetic oligonucleotide
  Target: SCN10A; (-) strand; PAM type: NRG; PAM sequence: TGG
tactgtgctgccccttcttc

SEQ ID NO: 22677 - DNA, 20 bp, Artificial Sequence
  Description of Artificial Sequence: Synthetic oligonucleotide
  Target: SCN10A; (-) strand; PAM type: NRG; PAM sequence: CAG
ccacaccattgctcacctcc

SEQ ID NO: 22678 - DNA, 20 bp, Artificial Sequence
  Description of Artificial Sequence: Synthetic oligonucleotide
  Target: SCN10A; (-) strand; PAM type: NRG; PAM sequence: CGG
catgctctggaatccaccta

SEQ ID NO: 22679 - DNA, 20 bp, Artificial Sequence
  Description of Artificial Sequence: Synthetic oligonucleotide
  Target: SCN10A; (-) strand; PAM type: NRG; PAM sequence: TGG
cctcacatctcaccatgctc

SEQ ID NO: 22680 - DNA, 20 bp, Artificial Sequence
  Description of Artificial Sequence: Synthetic oligonucleotide
  Target: SCN10A; (-) strand; PAM type: NRG; PAM sequence: TGG
tgagtcttatttgcaagacc

SEQ ID NO: 22681 - DNA, 20 bp, Artificial Sequence
  Description of Artificial Sequence: Synthetic oligonucleotide
  Target: SCN10A; (-) strand; PAM type: NRG; PAM sequence: AAG
agaccctgagtcttatttgc

SEQ ID NO: 22682 - DNA, 20 bp, Artificial Sequence
  Description of Artificial Sequence: Synthetic oligonucleotide
  Target: SCN10A; (-) strand; PAM type: NRG; PAM sequence: GAG
ctctcaactgggaagaccct

SEQ ID NO: 22683 - DNA, 20 bp, Artificial Sequence
  Description of Artificial Sequence: Synthetic oligonucleotide
  Target: SCN10A; (-) strand; PAM type: NRG; PAM sequence: AAG
ctcacttactctcaactggg

SEQ ID NO: 22684 - DNA, 20 bp, Artificial Sequence
  Description of Artificial Sequence: Synthetic oligonucleotide
  Target: SCN10A; (-) strand; PAM type: NRG; PAM sequence: GGG
tctctcacttactctcaact

SEQ ID NO: 22685 - DNA, 20 bp, Artificial Sequence
  Description of Artificial Sequence: Synthetic oligonucleotide
  Target: SCN10A; (-) strand; PAM type: NRG; PAM sequence: TGG
ctctctcacttactctcaac

SEQ ID NO: 22686 - DNA, 20 bp, Artificial Sequence
  Description of Artificial Sequence: Synthetic oligonucleotide
  Target: SCN10A; (-) strand; PAM type: NRG; PAM sequence: TGG
acacctcttgaagagagccc

SEQ ID NO: 22687 - DNA, 20 bp, Artificial Sequence
  Description of Artificial Sequence: Synthetic oligonucleotide
  Target: SCN10A; (-) strand; PAM type: NRG; PAM sequence: GAG
ctggacacacctcttgaaga

SEQ ID NO: 22688 - DNA, 20 bp, Artificial Sequence
  Description of Artificial Sequence: Synthetic oligonucleotide
  Target: SCN10A; (-) strand; PAM type: NRG; PAM sequence: GAG
cactggacacacctcttgaa

SEQ ID NO: 22689 - DNA, 20 bp, Artificial Sequence
  Description of Artificial Sequence: Synthetic oligonucleotide
  Target: SCN10A; (-) strand; PAM type: NRG; PAM sequence: AAG
cccactggacacacctcttg

SEQ ID NO: 22690 - DNA, 20 bp, Artificial Sequence
  Description of Artificial Sequence: Synthetic oligonucleotide
  Target: SCN10A; (-) strand; PAM type: NRG; PAM sequence: TGG
aactctctgccaattcccac

SEQ ID NO: 22691 - DNA, 20 bp, Artificial Sequence
  Description of Artificial Sequence: Synthetic oligonucleotide
  Target: SCN10A; (-) strand; PAM type: NRG; PAM sequence: AGG
ctggctctgcagggaaagat

SEQ ID NO: 22692 - DNA, 20 bp, Artificial Sequence
  Description of Artificial Sequence: Synthetic oligonucleotide
  Target: SCN10A; (-) strand; PAM type: NRG; PAM sequence: TAG
tctggctctgcagggaaaga

SEQ ID NO: 22693 - DNA, 20 bp, Artificial Sequence
  Description of Artificial Sequence: Synthetic oligonucleotide
  Target: SCN10A; (-) strand; PAM type: NRG; PAM sequence: AAG
cttgtctggctctgcaggga

SEQ ID NO: 22694 - DNA, 20 bp, Artificial Sequence
  Description of Artificial Sequence: Synthetic oligonucleotide
  Target: SCN10A; (-) strand; PAM type: NRG; PAM sequence: GGG
atttcttgtctggctctgca

SEQ ID NO: 22695 - DNA, 20 bp, Artificial Sequence
  Description of Artificial Sequence: Synthetic oligonucleotide
  Target: SCN10A; (-) strand; PAM type: NRG; PAM sequence: AGG
catttcttgtctggctctgc

SEQ ID NO: 22696 - DNA, 20 bp, Artificial Sequence
  Description of Artificial Sequence: Synthetic oligonucleotide
  Target: SCN10A; (-) strand; PAM type: NRG; PAM sequence: CAG
ccatttcttgtctggctctg

SEQ ID NO: 22697 - DNA, 20 bp, Artificial Sequence
  Description of Artificial Sequence: Synthetic oligonucleotide
  Target: SCN10A; (-) strand; PAM type: NRG; PAM sequence: TGG
cttttctaccatttcttgtc

SEQ ID NO: 22698 - DNA, 20 bp, Artificial Sequence
  Description of Artificial Sequence: Synthetic oligonucleotide
  Target: SCN10A; (-) strand; PAM type: NRG; PAM sequence: AAG
aaacacccattctagagtgg

SEQ ID NO: 22699 - DNA, 20 bp, Artificial Sequence
  Description of Artificial Sequence: Synthetic oligonucleotide
  Target: SCN10A; (-) strand; PAM type: NRG; PAM sequence: TGG
cagaaacacccattctagag

SEQ ID NO: 22700 - DNA, 20 bp, Artificial Sequence
  Description of Artificial Sequence: Synthetic oligonucleotide
  Target: SCN10A; (-) strand; PAM type: NRG; PAM sequence: GAG
aaacagaaacacccattcta

SEQ ID NO: 22701 - DNA, 20 bp, Artificial Sequence
  Description of Artificial Sequence: Synthetic oligonucleotide
  Target: SCN10A; (-) strand; PAM type: NRG; PAM sequence: TAG
gtaaacagaaacacccattc

SEQ ID NO: 22702 - DNA, 20 bp, Artificial Sequence
  Description of Artificial Sequence: Synthetic oligonucleotide
  Target: SCN10A; (-) strand; PAM type: NRG; PAM sequence: CAG
ttcgttctcttatctgtaaa

SEQ ID NO: 22703 - DNA, 20 bp, Artificial Sequence
  Description of Artificial Sequence: Synthetic oligonucleotide
  Target: SCN10A; (-) strand; PAM type: NRG; PAM sequence: AAG
aggttctctcctctcacccc

SEQ ID NO: 22704 - DNA, 20 bp, Artificial Sequence
  Description of Artificial Sequence: Synthetic oligonucleotide
  Target: SCN10A; (-) strand; PAM type: NRG; PAM sequence: AGG
cttcccctctgtggcctgat

SEQ ID NO: 22705 - DNA, 20 bp, Artificial Sequence
  Description of Artificial Sequence: Synthetic oligonucleotide
  Target: SCN10A; (-) strand; PAM type: NRG; PAM sequence: TAG
gcttcccctctgtggcctga

SEQ ID NO: 22706 - DNA, 20 bp, Artificial Sequence
  Description of Artificial Sequence: Synthetic oligonucleotide
  Target: SCN10A; (-) strand; PAM type: NRG; PAM sequence: TGG
gacttgatgcttcccctctg

SEQ ID NO: 22707 - DNA, 20 bp, Artificial Sequence
  Description of Artificial Sequence: Synthetic oligonucleotide
  Target: SCN10A; (-) strand; PAM type: NRG; PAM sequence: GGG
caaggcaaactttctgaaat

SEQ ID NO: 22708 - DNA, 20 bp, Artificial Sequence
  Description of Artificial Sequence: Synthetic oligonucleotide
  Target: SCN10A; (-) strand; PAM type: NRG; PAM sequence: TGG
acaaggcaaactttctgaaa

SEQ ID NO: 22709 - DNA, 20 bp, Artificial Sequence
  Description of Artificial Sequence: Synthetic oligonucleotide
  Target: SCN10A; (-) strand; PAM type: NRG; PAM sequence: AGG
ggatggggaggccagagaca

SEQ ID NO: 22710 - DNA, 20 bp, Artificial Sequence
  Description of Artificial Sequence: Synthetic oligonucleotide
  Target: SCN10A; (-) strand; PAM type: NRG; PAM sequence: AAG
aggatggggaggccagagac

SEQ ID NO: 22711 - DNA, 20 bp, Artificial Sequence
  Description of Artificial Sequence: Synthetic oligonucleotide
  Target: SCN10A; (-) strand; PAM type: NRG; PAM sequence: GAG
tggtgaggatggggaggcca

SEQ ID NO: 22712 - DNA, 20 bp, Artificial Sequence
  Description of Artificial Sequence: Synthetic oligonucleotide
  Target: SCN10A; (-) strand; PAM type: NRG; PAM sequence: CAG
gatggtgaggatggggaggc

SEQ ID NO: 22713 - DNA, 20 bp, Artificial Sequence
  Description of Artificial Sequence: Synthetic oligonucleotide
  Target: SCN10A; (-) strand; PAM type: NRG; PAM sequence: AGG
ggttgatggtgaggatgggg

SEQ ID NO: 22714 - DNA, 20 bp, Artificial Sequence
  Description of Artificial Sequence: Synthetic oligonucleotide
  Target: SCN10A; (-) strand; PAM type: NRG; PAM sequence: GAG
aggttgatggtgaggatggg

SEQ ID NO: 22715 - DNA, 20 bp, Artificial Sequence
  Description of Artificial Sequence: Synthetic oligonucleotide
  Target: SCN10A; (-) strand; PAM type: NRG; PAM sequence: GGG
tgaggttgatggtgaggatg

SEQ ID NO: 22716 - DNA, 20 bp, Artificial Sequence
  Description of Artificial Sequence: Synthetic oligonucleotide
  Target: SCN10A; (-) strand; PAM type: NRG; PAM sequence: GGG
atgaggttgatggtgaggat

SEQ ID NO: 22717 - DNA, 20 bp, Artificial Sequence
  Description of Artificial Sequence: Synthetic oligonucleotide
  Target: SCN10A; (-) strand; PAM type: NRG; PAM sequence: TGG
catgaggttgatggtgagga

SEQ ID NO: 22718 - DNA, 20 bp, Artificial Sequence
  Description of Artificial Sequence: Synthetic oligonucleotide
  Target: SCN10A; (-) strand; PAM type: NRG; PAM sequence: AGG
cccccatgaggttgatggtg

SEQ ID NO: 22719 - DNA, 20 bp, Artificial Sequence
  Description of Artificial Sequence: Synthetic oligonucleotide
  Target: SCN10A; (-) strand; PAM type: NRG; PAM sequence: GAG
gcccccatgaggttgatggt

SEQ ID NO: 22720 - DNA, 20 bp, Artificial Sequence
  Description of Artificial Sequence: Synthetic oligonucleotide
  Target: SCN10A; (-) strand; PAM type: NRG; PAM sequence: TGG
ttcagcccccatgaggttga

SEQ ID NO: 22721 - DNA, 20 bp, Artificial Sequence
  Description of Artificial Sequence: Synthetic oligonucleotide
  Target: SCN10A; (-) strand; PAM type: NRG; PAM sequence: AGG
actactcttcagcccccatg

SEQ ID NO: 22722 - DNA, 20 bp, Artificial Sequence
  Description of Artificial Sequence: Synthetic oligonucleotide
  Target: SCN10A; (-) strand; PAM type: NRG; PAM sequence: GAG
gactactcttcagcccccat

SEQ ID NO: 22723 - DNA, 20 bp, Artificial Sequence
  Description of Artificial Sequence: Synthetic oligonucleotide
  Target: SCN10A; (-) strand; PAM type: NRG; PAM sequence: CAG
gtagcccagcgactactctt

SEQ ID NO: 22724 - DNA, 20 bp, Artificial Sequence
  Description of Artificial Sequence: Synthetic oligonucleotide
  Target: SCN10A; (-) strand; PAM type: NRG; PAM sequence: CAG
ctccactgtcaccagtagcc

SEQ ID NO: 22725 - DNA, 20 bp, Artificial Sequence
  Description of Artificial Sequence: Synthetic oligonucleotide
  Target: SCN10A; (-) strand; PAM type: NRG; PAM sequence: TAG
aagatctccactgtcaccag

SEQ ID NO: 22726 - DNA, 20 bp, Artificial Sequence
  Description of Artificial Sequence: Synthetic oligonucleotide
  Target: SCN10A; (-) strand; PAM type: NRG; PAM sequence: CAG
tctaagatctccactgtcac

SEQ ID NO: 22727 - DNA, 20 bp, Artificial Sequence
  Description of Artificial Sequence: Synthetic oligonucleotide
  Target: SCN10A; (-) strand; PAM type: NRG; PAM sequence: AAG
gctcattgtgtggggcctct

SEQ ID NO: 22728 - DNA, 20 bp, Artificial Sequence
  Description of Artificial Sequence: Synthetic oligonucleotide
  Target: SCN10A; (-) strand; PAM type: NRG; PAM sequence: GGG
ccatcaaagctcattgtgtg

SEQ ID NO: 22729 - DNA, 20 bp, Artificial Sequence
  Description of Artificial Sequence: Synthetic oligonucleotide
  Target: SCN10A; (-) strand; PAM type: NRG; PAM sequence: GGG
tccatcaaagctcattgtgt

SEQ ID NO: 22730 - DNA, 20 bp, Artificial Sequence
  Description of Artificial Sequence: Synthetic oligonucleotide
  Target: SCN10A; (-) strand; PAM type: NRG; PAM sequence: TGG
gtccatcaaagctcattgtg

SEQ ID NO: 22731 - DNA, 20 bp, Artificial Sequence
  Description of Artificial Sequence: Synthetic oligonucleotide
  Target: SCN10A; (-) strand; PAM type: NRG; PAM sequence: AAG
gaaacaaaagtagtccatca

SEQ ID NO: 22732 - DNA, 20 bp, Artificial Sequence
  Description of Artificial Sequence: Synthetic oligonucleotide
  Target: SCN10A; (-) strand; PAM type: NRG; PAM sequence: TAG
tgagaattcagaaacaaaag

SEQ ID NO: 22733 - DNA, 20 bp, Artificial Sequence
  Description of Artificial Sequence: Synthetic oligonucleotide
  Target: SCN10A; (-) strand; PAM type: NRG; PAM sequence: AAG
tactgagaattcagaaacaa

SEQ ID NO: 22734 - DNA, 20 bp, Artificial Sequence
  Description of Artificial Sequence: Synthetic oligonucleotide
  Target: SCN10A; (-) strand; PAM type: NRG; PAM sequence: CAG
attcttgattactgagaatt

SEQ ID NO: 22735 - DNA, 20 bp, Artificial Sequence
  Description of Artificial Sequence: Synthetic oligonucleotide
  Target: SCN10A; (-) strand; PAM type: NRG; PAM sequence: GAG
ttaggcaattcttgattact

SEQ ID NO: 22736 - DNA, 20 bp, Artificial Sequence
  Description of Artificial Sequence: Synthetic oligonucleotide
  Target: SCN10A; (-) strand; PAM type: NRG; PAM sequence: AGG
acccagaggaaaaaagaatt

SEQ ID NO: 22737 - DNA, 20 bp, Artificial Sequence
  Description of Artificial Sequence: Synthetic oligonucleotide
  Target: SCN10A; (-) strand; PAM type: NRG; PAM sequence: TAG
cacccagaggaaaaaagaat

SEQ ID NO: 22738 - DNA, 20 bp, Artificial Sequence
  Description of Artificial Sequence: Synthetic oligonucleotide
  Target: SCN10A; (-) strand; PAM type: NRG; PAM sequence: AAG
tttagacacccagaggaaaa

SEQ ID NO: 22739 - DNA, 20 bp, Artificial Sequence
  Description of Artificial Sequence: Synthetic oligonucleotide
  Target: SCN10A; (-) strand; PAM type: NRG; PAM sequence: AGG
tcctgtctttagacacccag

SEQ ID NO: 22740 - DNA, 20 bp, Artificial Sequence
  Description of Artificial Sequence: Synthetic oligonucleotide
  Target: SCN10A; (-) strand; PAM type: NRG; PAM sequence: GAG
atcctgtctttagacaccca

SEQ ID NO: 22741 - DNA, 20 bp, Artificial Sequence
  Description of Artificial Sequence: Synthetic oligonucleotide
  Target: SCN10A; (-) strand; PAM type: NRG; PAM sequence: CAG
aaatcctgtctttagacacc

SEQ ID NO: 22742 - DNA, 20 bp, Artificial Sequence
  Description of Artificial Sequence: Synthetic oligonucleotide
  Target: SCN10A; (-) strand; PAM type: NRG; PAM sequence: TAG
taggtctaaaatcctgtctt

SEQ ID NO: 22743 - DNA, 20 bp, Artificial Sequence
  Description of Artificial Sequence: Synthetic oligonucleotide
  Target: SCN10A; (-) strand; PAM type: NRG; PAM sequence: AGG
agtatcttcactgtttccgt

SEQ ID NO: 22744 - DNA, 20 bp, Artificial Sequence
  Description of Artificial Sequence: Synthetic oligonucleotide
  Target: SCN10A; (-) strand; PAM type: NRG; PAM sequence: TAG
cagtatcttcactgtttccg

SEQ ID NO: 22745 - DNA, 20 bp, Artificial Sequence
  Description of Artificial Sequence: Synthetic oligonucleotide
  Target: SCN10A; (-) strand; PAM type: NRG; PAM sequence: CAG
aggaagggagaaagcagtcc

SEQ ID NO: 22746 - DNA, 20 bp, Artificial Sequence
  Description of Artificial Sequence: Synthetic oligonucleotide
  Target: SCN10A; (-) strand; PAM type: NRG; PAM sequence: CAG
atggggaggaagggagaaag

SEQ ID NO: 22747 - DNA, 20 bp, Artificial Sequence
  Description of Artificial Sequence: Synthetic oligonucleotide
  Target: SCN10A; (-) strand; PAM type: NRG; PAM sequence: AAG
gaaatggggaggaagggaga

SEQ ID NO: 22748 - DNA, 20 bp, Artificial Sequence
  Description of Artificial Sequence: Synthetic oligonucleotide
  Target: SCN10A; (-) strand; PAM type: NRG; PAM sequence: GAG
cttggaaatggggaggaagg

SEQ ID NO: 22749 - DNA, 20 bp, Artificial Sequence
  Description of Artificial Sequence: Synthetic oligonucleotide
  Target: SCN10A; (-) strand; PAM type: NRG; PAM sequence: GGG
aacttggaaatggggaggaa

SEQ ID NO: 22750 - DNA, 20 bp, Artificial Sequence
  Description of Artificial Sequence: Synthetic oligonucleotide
  Target: SCN10A; (-) strand; PAM type: NRG; PAM sequence: AGG
aaacttggaaatggggagga

SEQ ID NO: 22751 - DNA, 20 bp, Artificial Sequence
  Description of Artificial Sequence: Synthetic oligonucleotide
  Target: SCN10A; (-) strand; PAM type: NRG; PAM sequence: AAG
taaacttggaaatggggagg

SEQ ID NO: 22752 - DNA, 20 bp, Artificial Sequence
  Description of Artificial Sequence: Synthetic oligonucleotide
  Target: SCN10A; (-) strand; PAM type: NRG; PAM sequence: AGG
gattaaacttggaaatgggg

SEQ ID NO: 22753 - DNA, 20 bp, Artificial Sequence
  Description of Artificial Sequence: Synthetic oligonucleotide
  Target: SCN10A; (-) strand; PAM type: NRG; PAM sequence: GAG
ggattaaacttggaaatggg

SEQ ID NO: 22754 - DNA, 20 bp, Artificial Sequence
  Description of Artificial Sequence: Synthetic oligonucleotide
  Target: SCN10A; (-) strand; PAM type: NRG; PAM sequence: GGG
aaggattaaacttggaaatg

SEQ ID NO: 22755 - DNA, 20 bp, Artificial Sequence
  Description of Artificial Sequence: Synthetic oligonucleotide
  Target: SCN10A; (-) strand; PAM type: NRG; PAM sequence: GGG
aaaggattaaacttggaaat

SEQ ID NO: 22756 - DNA, 20 bp, Artificial Sequence
  Description of Artificial Sequence: Synthetic oligonucleotide
  Target: SCN10A; (-) strand; PAM type: NRG; PAM sequence: TGG
taaaggattaaacttggaaa

SEQ ID NO: 22757 - DNA, 20 bp, Artificial Sequence
  Description of Artificial Sequence: Synthetic oligonucleotide
  Target: SCN10A; (-) strand; PAM type: NRG; PAM sequence: TGG
ttaaactaaaggattaaact

SEQ ID NO: 22758 - DNA, 20 bp, Artificial Sequence
  Description of Artificial Sequence: Synthetic oligonucleotide
  Target: SCN10A; (-) strand; PAM type: NRG; PAM sequence: AGG
ttatttataccttaaactaa

SEQ ID NO: 22759 - DNA, 20 bp, Artificial Sequence
  Description of Artificial Sequence: Synthetic oligonucleotide
  Target: SCN10A; (-) strand; PAM type: NRG; PAM sequence: AAG
tttatttataccttaaacta

SEQ ID NO: 22760 - DNA, 20 bp, Artificial Sequence
  Description of Artificial Sequence: Synthetic oligonucleotide
  Target: SCN10A; (-) strand; PAM type: NRG; PAM sequence: CAG
gggattcaggcaagacccct

SEQ ID NO: 22761 - DNA, 20 bp, Artificial Sequence
  Description of Artificial Sequence: Synthetic oligonucleotide
  Target: SCN10A; (-) strand; PAM type: NRG; PAM sequence: AAG
tctggttgtgggattcaggc

SEQ ID NO: 22762 - DNA, 20 bp, Artificial Sequence
  Description of Artificial Sequence: Synthetic oligonucleotide
  Target: SCN10A; (-) strand; PAM type: NRG; PAM sequence: AGG
ctgttctggttgtgggattc

SEQ ID NO: 22763 - DNA, 20 bp, Artificial Sequence
  Description of Artificial Sequence: Synthetic oligonucleotide
  Target: SCN10A; (-) strand; PAM type: NRG; PAM sequence: CAG
tctgttctggttgtgggatt

SEQ ID NO: 22764 - DNA, 20 bp, Artificial Sequence
  Description of Artificial Sequence: Synthetic oligonucleotide
  Target: SCN10A; (-) strand; PAM type: NRG; PAM sequence: GGG
tcactttctgttctggttgt

SEQ ID NO: 22765 - DNA, 20 bp, Artificial Sequence
  Description of Artificial Sequence: Synthetic oligonucleotide
  Target: SCN10A; (-) strand; PAM type: NRG; PAM sequence: TGG
ttcactttctgttctggttg

SEQ ID NO: 22766 - DNA, 20 bp, Artificial Sequence
  Description of Artificial Sequence: Synthetic oligonucleotide
  Target: SCN10A; (-) strand; PAM type: NRG; PAM sequence: TGG
catgtcttcactttctgttc

SEQ ID NO: 22767 - DNA, 20 bp, Artificial Sequence
  Description of Artificial Sequence: Synthetic oligonucleotide
  Target: SCN10A; (-) strand; PAM type: NRG; PAM sequence: GGG
caatcaatacgtaacaggag

SEQ ID NO: 22768 - DNA, 20 bp, Artificial Sequence
  Description of Artificial Sequence: Synthetic oligonucleotide
  Target: SCN10A; (-) strand; PAM type: NRG; PAM sequence: GGG
acaatcaatacgtaacagga

SEQ ID NO: 22769 - DNA, 20 bp, Artificial Sequence
  Description of Artificial Sequence: Synthetic oligonucleotide
  Target: SCN10A; (-) strand; PAM type: NRG; PAM sequence: AGG
cacaatcaatacgtaacagg

SEQ ID NO: 22770 - DNA, 20 bp, Artificial Sequence
  Description of Artificial Sequence: Synthetic oligonucleotide
  Target: SCN10A; (-) strand; PAM type: NRG; PAM sequence: GAG
tcacaatcaatacgtaacag

SEQ ID NO: 22771 - DNA, 20 bp, Artificial Sequence
  Description of Artificial Sequence: Synthetic oligonucleotide
  Target: SCN10A; (-) strand; PAM type: NRG; PAM sequence: AGG
cctcacaatcaatacgtaac

SEQ ID NO: 22772 - DNA, 20 bp, Artificial Sequence
  Description of Artificial Sequence: Synthetic oligonucleotide
  Target: SCN10A; (-) strand; PAM type: NRG; PAM sequence: CAG
gcctcacaatcaatacgtaa

SEQ ID NO: 22773 - DNA, 20 bp, Artificial Sequence
  Description of Artificial Sequence: Synthetic oligonucleotide
  Target: SCN10A; (-) strand; PAM type: NRG; PAM sequence: TGG
tgctcttcccacataccaca

SEQ ID NO: 22774 - DNA, 20 bp, Artificial Sequence
  Description of Artificial Sequence: Synthetic oligonucleotide
  Target: SCN10A; (-) strand; PAM type: NRG; PAM sequence: CAG
tattgtcccaactcctaggc

SEQ ID NO: 22775 - DNA, 20 bp, Artificial Sequence
  Description of Artificial Sequence: Synthetic oligonucleotide
  Target: SCN10A; (-) strand; PAM type: NRG; PAM sequence: AGG
agcctattgtcccaactcct

SEQ ID NO: 22776 - DNA, 20 bp, Artificial Sequence
  Description of Artificial Sequence: Synthetic oligonucleotide
  Target: SCN10A; (-) strand; PAM type: NRG; PAM sequence: TAG
aagcctattgtcccaactcc

SEQ ID NO: 22777 - DNA, 20 bp, Artificial Sequence
  Description of Artificial Sequence: Synthetic oligonucleotide
  Target: SCN10A; (-) strand; PAM type: NRG; PAM sequence: AAG
taagagacagtgtgacctgg

SEQ ID NO: 22778 - DNA, 20 bp, Artificial Sequence
  Description of Artificial Sequence: Synthetic oligonucleotide
  Target: SCN10A; (-) strand; PAM type: NRG; PAM sequence: TGG
tagtaagagacagtgtgacc

SEQ ID NO: 22779 - DNA, 20 bp, Artificial Sequence
  Description of Artificial Sequence: Synthetic oligonucleotide
  Target: SCN10A; (-) strand; PAM type: NRG; PAM sequence: CAG
gcctcttcactagtaagaga

SEQ ID NO: 22780 - DNA, 20 bp, Artificial Sequence
  Description of Artificial Sequence: Synthetic oligonucleotide
  Target: SCN10A; (-) strand; PAM type: NRG; PAM sequence: GAG
caaggcctcttcactagtaa

SEQ ID NO: 22781 - DNA, 20 bp, Artificial Sequence
  Description of Artificial Sequence: Synthetic oligonucleotide
  Target: SCN10A; (-) strand; PAM type: NRG; PAM sequence: AAG
cccaaggcctcttcactagt

SEQ ID NO: 22782 - DNA, 20 bp, Artificial Sequence
  Description of Artificial Sequence: Synthetic oligonucleotide
  Target: SCN10A; (-) strand; PAM type: NRG; PAM sequence: TAG
taaacccaaggcctcttcac

SEQ ID NO: 22783 - DNA, 20 bp, Artificial Sequence
  Description of Artificial Sequence: Synthetic oligonucleotide
  Target: SCN10A; (-) strand; PAM type: NRG; PAM sequence: AGG
gtataggaaacataaaccca

SEQ ID NO: 22784 - DNA, 20 bp, Artificial Sequence
  Description of Artificial Sequence: Synthetic oligonucleotide
  Target: SCN10A; (-) strand; PAM type: NRG; PAM sequence: AAG
agtataggaaacataaaccc

SEQ ID NO: 22785 - DNA, 20 bp, Artificial Sequence
  Description of Artificial Sequence: Synthetic oligonucleotide
  Target: SCN10A; (-) strand; PAM type: NRG; PAM sequence: AGG
ggaactgaggcctggagtat

SEQ ID NO: 22786 - DNA, 20 bp, Artificial Sequence
  Description of Artificial Sequence: Synthetic oligonucleotide
  Target: SCN10A; (-) strand; PAM type: NRG; PAM sequence: TAG
aggaactgaggcctggagta

SEQ ID NO: 22787 - DNA, 20 bp, Artificial Sequence
  Description of Artificial Sequence: Synthetic oligonucleotide
  Target: SCN10A; (-) strand; PAM type: NRG; PAM sequence: GAG
gacaaaggaactgaggcctg

SEQ ID NO: 22788 - DNA, 20 bp, Artificial Sequence
  Description of Artificial Sequence: Synthetic oligonucleotide
  Target: SCN10A; (-) strand; PAM type: NRG; PAM sequence: TGG
aagacaaaggaactgaggcc

SEQ ID NO: 22789 - DNA, 20 bp, Artificial Sequence
  Description of Artificial Sequence: Synthetic oligonucleotide
  Target: SCN10A; (-) strand; PAM type: NRG; PAM sequence: AGG
cttacaagacaaaggaactg

SEQ ID NO: 22790 - DNA, 20 bp, Artificial Sequence
  Description of Artificial Sequence: Synthetic oligonucleotide
  Target: SCN10A; (-) strand; PAM type: NRG; PAM sequence: GAG
acttacaagacaaaggaact

SEQ ID NO: 22791 - DNA, 20 bp, Artificial Sequence
  Description of Artificial Sequence: Synthetic oligonucleotide
  Target: SCN10A; (-) strand; PAM type: NRG; PAM sequence: AGG
tgtccccacttacaagacaa

SEQ ID NO: 22792 - DNA, 20 bp, Artificial Sequence
  Description of Artificial Sequence: Synthetic oligonucleotide
  Target: SCN10A; (-) strand; PAM type: NRG; PAM sequence: AAG
ttgtccccacttacaagaca

SEQ ID NO: 22793 - DNA, 20 bp, Artificial Sequence
  Description of Artificial Sequence: Synthetic oligonucleotide
  Target: SCN10A; (-) strand; PAM type: NRG; PAM sequence: AAG
agactattgtccccacttac

SEQ ID NO: 22794 - DNA, 20 bp, Artificial Sequence
  Description of Artificial Sequence: Synthetic oligonucleotide
  Target: SCN10A; (-) strand; PAM type: NRG; PAM sequence: AAG
ccctgtaaggttccagggca

SEQ ID NO: 22795 - DNA, 20 bp, Artificial Sequence
  Description of Artificial Sequence: Synthetic oligonucleotide
  Target: SCN10A; (-) strand; PAM type: NRG; PAM sequence: GGG
aagaaccctgtaaggttcca

SEQ ID NO: 22796 - DNA, 20 bp, Artificial Sequence
  Description of Artificial Sequence: Synthetic oligonucleotide
  Target: SCN10A; (-) strand; PAM type: NRG; PAM sequence: AGG
caagaaccctgtaaggttcc

SEQ ID NO: 22797 - DNA, 20 bp, Artificial Sequence
  Description of Artificial Sequence: Synthetic oligonucleotide
  Target: SCN10A; (-) strand; PAM type: NRG; PAM sequence: CAG
acaagaaccctgtaaggttc

SEQ ID NO: 22798 - DNA, 20 bp, Artificial Sequence
  Description of Artificial Sequence: Synthetic oligonucleotide
  Target: SCN10A; (-) strand; PAM type: NRG; PAM sequence: AGG
attttcacaagaaccctgta

SEQ ID NO: 22799 - DNA, 20 bp, Artificial Sequence
  Description of Artificial Sequence: Synthetic oligonucleotide
  Target: SCN10A; (-) strand; PAM type: NRG; PAM sequence: AAG
aattttcacaagaaccctgt

SEQ ID NO: 22800 - DNA, 20 bp, Artificial Sequence
  Description of Artificial Sequence: Synthetic oligonucleotide
  Target: SCN10A; (-) strand; PAM type: NRG; PAM sequence: AAG
ctcccttctctaattttcac

SEQ ID NO: 22801 - DNA, 20 bp, Artificial Sequence
  Description of Artificial Sequence: Synthetic oligonucleotide
  Target: SCN10A; (-) strand; PAM type: NRG; PAM sequence: CAG
agagcatatgttggttttca

SEQ ID NO: 22802 - DNA, 20 bp, Artificial Sequence
  Description of Artificial Sequence: Synthetic oligonucleotide
  Target: SCN10A; (-) strand; PAM type: NRG; PAM sequence: TGG
tttattcacagagcatatgt

SEQ ID NO: 22803 - DNA, 20 bp, Artificial Sequence
  Description of Artificial Sequence: Synthetic oligonucleotide
  Target: SCN10A; (-) strand; PAM type: NRG; PAM sequence: GAG
caggtgagcatttattcaca

SEQ ID NO: 22804 - DNA, 20 bp, Artificial Sequence
  Description of Artificial Sequence: Synthetic oligonucleotide
  Target: SCN10A; (-) strand; PAM type: NRG; PAM sequence: CAG
cccaggtgagcatttattca

SEQ ID NO: 22805 - DNA, 20 bp, Artificial Sequence
  Description of Artificial Sequence: Synthetic oligonucleotide
  Target: SCN10A; (-) strand; PAM type: NRG; PAM sequence: GAG
cagtttctgtgatcccaggt

SEQ ID NO: 22806 - DNA, 20 bp, Artificial Sequence
  Description of Artificial Sequence: Synthetic oligonucleotide
  Target: SCN10A; (-) strand; PAM type: NRG; PAM sequence: AGG
aaaacagtttctgtgatccc

SEQ ID NO: 22807 - DNA, 20 bp, Artificial Sequence
  Description of Artificial Sequence: Synthetic oligonucleotide
  Target: SCN10A; (-) strand; PAM type: NRG; PAM sequence: CAG
aaaaacagtttctgtgatcc

SEQ ID NO: 22808 - DNA, 20 bp, Artificial Sequence
  Description of Artificial Sequence: Synthetic oligonucleotide
  Target: SCN10A; (-) strand; PAM type: NRG; PAM sequence: CAG
agttcttagagcattaaaaa

SEQ ID NO: 22809 - DNA, 20 bp, Artificial Sequence
  Description of Artificial Sequence: Synthetic oligonucleotide
  Target: SCN10A; (-) strand; PAM type: NRG; PAM sequence: GAG
gcggacattcagagttctta

SEQ ID NO: 22810 - DNA, 20 bp, Artificial Sequence
  Description of Artificial Sequence: Synthetic oligonucleotide
  Target: SCN10A; (-) strand; PAM type: NRG; PAM sequence: TAG
ctgcggacattcagagttct

SEQ ID NO: 22811 - DNA, 20 bp, Artificial Sequence
  Description of Artificial Sequence: Synthetic oligonucleotide
  Target: SCN10A; (-) strand; PAM type: NRG; PAM sequence: GAG
ctcaggcctgcggacattca

SEQ ID NO: 22812 - DNA, 20 bp, Artificial Sequence
  Description of Artificial Sequence: Synthetic oligonucleotide
  Target: SCN10A; (-) strand; PAM type: NRG; PAM sequence: CAG
atctcaggcctgcggacatt

SEQ ID NO: 22813 - DNA, 20 bp, Artificial Sequence
  Description of Artificial Sequence: Synthetic oligonucleotide
  Target: SCN10A; (-) strand; PAM type: NRG; PAM sequence: CGG
tccgtgggatctcaggcctg

SEQ ID NO: 22814 - DNA, 20 bp, Artificial Sequence
  Description of Artificial Sequence: Synthetic oligonucleotide
  Target: SCN10A; (-) strand; PAM type: NRG; PAM sequence: AGG
atagatctccgtgggatctc

SEQ ID NO: 22815 - DNA, 20 bp, Artificial Sequence
  Description of Artificial Sequence: Synthetic oligonucleotide
  Target: SCN10A; (-) strand; PAM type: NRG; PAM sequence: CAG
aatagatctccgtgggatct

SEQ ID NO: 22816 - DNA, 20 bp, Artificial Sequence
  Description of Artificial Sequence: Synthetic oligonucleotide
  Target: SCN10A; (-) strand; PAM type: NRG; PAM sequence: GGG
gcacagcaatagatctccgt

SEQ ID NO: 22817 - DNA, 20 bp, Artificial Sequence
  Description of Artificial Sequence: Synthetic oligonucleotide
  Target: SCN10A; (-) strand; PAM type: NRG; PAM sequence: TGG
ggcacagcaatagatctccg

SEQ ID NO: 22818 - DNA, 20 bp, Artificial Sequence
  Description of Artificial Sequence: Synthetic oligonucleotide
  Target: SCN10A; (-) strand; PAM type: NRG; PAM sequence: TAG
cagatatgttggcacagcaa

SEQ ID NO: 22819 - DNA, 20 bp, Artificial Sequence
  Description of Artificial Sequence: Synthetic oligonucleotide
  Target: SCN10A; (-) strand; PAM type: NRG; PAM sequence: CAG
gtcctacagatatgttggca

SEQ ID NO: 22820 - DNA, 20 bp, Artificial Sequence
  Description of Artificial Sequence: Synthetic oligonucleotide
  Target: SCN10A; (-) strand; PAM type: NRG; PAM sequence: TGG
ttctggtcctacagatatgt

SEQ ID NO: 22821 - DNA, 20 bp, Artificial Sequence
  Description of Artificial Sequence: Synthetic oligonucleotide
  Target: SCN10A; (-) strand; PAM type: NRG; PAM sequence: CAG
ctgactaacttctggtccta

SEQ ID NO: 22822 - DNA, 20 bp, Artificial Sequence
  Description of Artificial Sequence: Synthetic oligonucleotide
  Target: SCN10A; (-) strand; PAM type: NRG; PAM sequence: TGG
cagagatgctgactaacttc

SEQ ID NO: 22823 - DNA, 20 bp, Artificial Sequence
  Description of Artificial Sequence: Synthetic oligonucleotide
  Target: SCN10A; (-) strand; PAM type: NRG; PAM sequence: GAG
ccccaggacccttgcttgca

SEQ ID NO: 22824 - DNA, 20 bp, Artificial Sequence
  Description of Artificial Sequence: Synthetic oligonucleotide
  Target: SCN10A; (-) strand; PAM type: NRG; PAM sequence: CAG
atccccaggacccttgcttg

SEQ ID NO: 22825 - DNA, 20 bp, Artificial Sequence
  Description of Artificial Sequence: Synthetic oligonucleotide
  Target: SCN10A; (-) strand; PAM type: NRG; PAM sequence: AGG
tttatgctgcatgcatcccc

SEQ ID NO: 22826 - DNA, 20 bp, Artificial Sequence
  Description of Artificial Sequence: Synthetic oligonucleotide
  Target: SCN10A; (-) strand; PAM type: NRG; PAM sequence: CAG
atttatgctgcatgcatccc

SEQ ID NO: 22827 - DNA, 20 bp, Artificial Sequence
  Description of Artificial Sequence: Synthetic oligonucleotide
  Target: SCN10A; (-) strand; PAM type: NRG; PAM sequence: AGG
ttctaggctaatgatacccc

SEQ ID NO: 22828 - DNA, 20 bp, Artificial Sequence
  Description of Artificial Sequence: Synthetic oligonucleotide
  Target: SCN10A; (-) strand; PAM type: NRG; PAM sequence: CAG
tttctaggctaatgataccc

SEQ ID NO: 22829 - DNA, 20 bp, Artificial Sequence
  Description of Artificial Sequence: Synthetic oligonucleotide
  Target: SCN10A; (-) strand; PAM type: NRG; PAM sequence: AGG
gtccattctgcatcctttct

SEQ ID NO: 22830 - DNA, 20 bp, Artificial Sequence
  Description of Artificial Sequence: Synthetic oligonucleotide
  Target: SCN10A; (-) strand; PAM type: NRG; PAM sequence: TAG
tgtccattctgcatcctttc

SEQ ID NO: 22831 - DNA, 20 bp, Artificial Sequence
  Description of Artificial Sequence: Synthetic oligonucleotide
  Target: SCN10A; (-) strand; PAM type: NRG; PAM sequence: AAG
tggcagtgtcactagattct

SEQ ID NO: 22832 - DNA, 20 bp, Artificial Sequence
  Description of Artificial Sequence: Synthetic oligonucleotide
  Target: SCN10A; (-) strand; PAM type: NRG; PAM sequence: TAG
tctatagatggcagtgtcac

SEQ ID NO: 22833 - DNA, 20 bp, Artificial Sequence
  Description of Artificial Sequence: Synthetic oligonucleotide
  Target: SCN10A; (-) strand; PAM type: NRG; PAM sequence: CAG
cagtgtcagtctatagatgg

SEQ ID NO: 22834 - DNA, 20 bp, Artificial Sequence
  Description of Artificial Sequence: Synthetic oligonucleotide
  Target: SCN10A; (-) strand; PAM type: NRG; PAM sequence: TGG
tgtcagtgtcagtctataga

SEQ ID NO: 22835 - DNA, 20 bp, Artificial Sequence
  Description of Artificial Sequence: Synthetic oligonucleotide
  Target: SCN10A; (-) strand; PAM type: NRG; PAM sequence: TAG
tcagtgtcagtgtcagtcta

SEQ ID NO: 22836 - DNA, 20 bp, Artificial Sequence
  Description of Artificial Sequence: Synthetic oligonucleotide
  Target: SCN10A; (-) strand; PAM type: NRG; PAM sequence: CAG
aatgaaatcagtgtcagtgt

SEQ ID NO: 22837 - DNA, 20 bp, Artificial Sequence
  Description of Artificial Sequence: Synthetic oligonucleotide
  Target: SCN10A; (-) strand; PAM type: NRG; PAM sequence: CAG
tgcaataatgaaatcagtgt

SEQ ID NO: 22838 - DNA, 20 bp, Artificial Sequence
  Description of Artificial Sequence: Synthetic oligonucleotide
  Target: SCN10A; (-) strand; PAM type: NRG; PAM sequence: CAG
agatgttgcaataatgaaat

SEQ ID NO: 22839 - DNA, 20 bp, Artificial Sequence
  Description of Artificial Sequence: Synthetic oligonucleotide
  Target: SCN10A; (-) strand; PAM type: NRG; PAM sequence: AAG
tctcaaagggtccactctga

SEQ ID NO: 22840 - DNA, 20 bp, Artificial Sequence
  Description of Artificial Sequence: Synthetic oligonucleotide
  Target: SCN10A; (-) strand; PAM type: NRG; PAM sequence: GGG
tcacaatgcatcttctcaaa

SEQ ID NO: 22841 - DNA, 20 bp, Artificial Sequence
  Description of Artificial Sequence: Synthetic oligonucleotide
  Target: SCN10A; (-) strand; PAM type: NRG; PAM sequence: AGG
atcacaatgcatcttctcaa

SEQ ID NO: 22842 - DNA, 20 bp, Artificial Sequence
  Description of Artificial Sequence: Synthetic oligonucleotide
  Target: SCN10A; (-) strand; PAM type: NRG; PAM sequence: AAG
gatcacaatgcatcttctca

SEQ ID NO: 22843 - DNA, 20 bp, Artificial Sequence
  Description of Artificial Sequence: Synthetic oligonucleotide
  Target: SCN10A; (-) strand; PAM type: NRG; PAM sequence: TAG
cgtccacatgcagtgttgcc

SEQ ID NO: 22844 - DNA, 20 bp, Artificial Sequence
  Description of Artificial Sequence: Synthetic oligonucleotide
  Target: SCN10A; (-) strand; PAM type: NRG; PAM sequence: CAG
tttgaagatccgtccacatg

SEQ ID NO: 22845 - DNA, 20 bp, Artificial Sequence
  Description of Artificial Sequence: Synthetic oligonucleotide
  Target: SCN10A; (-) strand; PAM type: NRG; PAM sequence: AAG
tggtcaaactcctgtgtttg

SEQ ID NO: 22846 - DNA, 20 bp, Artificial Sequence
  Description of Artificial Sequence: Synthetic oligonucleotide
  Target: SCN10A; (-) strand; PAM type: NRG; PAM sequence: TGG
cagtgtctgaggagactggt

SEQ ID NO: 22847 - DNA, 20 bp, Artificial Sequence
  Description of Artificial Sequence: Synthetic oligonucleotide
  Target: SCN10A; (-) strand; PAM type: NRG; PAM sequence: TGG
aaatcagtgtctgaggagac

SEQ ID NO: 22848 - DNA, 20 bp, Artificial Sequence
  Description of Artificial Sequence: Synthetic oligonucleotide
  Target: SCN10A; (-) strand; PAM type: NRG; PAM sequence: GAG
ctgagaaatcagtgtctgag

SEQ ID NO: 22849 - DNA, 20 bp, Artificial Sequence
  Description of Artificial Sequence: Synthetic oligonucleotide
  Target: SCN10A; (-) strand; PAM type: NRG; PAM sequence: AGG
ttctgagaaatcagtgtctg

SEQ ID NO: 22850 - DNA, 20 bp, Artificial Sequence
  Description of Artificial Sequence: Synthetic oligonucleotide
  Target: SCN10A; (-) strand; PAM type: NRG; PAM sequence: GAG
cttctgagaaatcagtgtct

SEQ ID NO: 22851 - DNA, 20 bp, Artificial Sequence
  Description of Artificial Sequence: Synthetic oligonucleotide
  Target: SCN10A; (-) strand; PAM type: NRG; PAM sequence: CAG
gcggtctccttctgagaaat

SEQ ID NO: 22852 - DNA, 20 bp, Artificial Sequence
  Description of Artificial Sequence: Synthetic oligonucleotide
  Target: SCN10A; (-) strand; PAM type: NRG; PAM sequence: GAG
tgacatggcggtctccttct

SEQ ID NO: 22853 - DNA, 20 bp, Artificial Sequence
  Description of Artificial Sequence: Synthetic oligonucleotide
  Target: SCN10A; (-) strand; PAM type: NRG; PAM sequence: CGG
cttgtacccccctgacatgg

SEQ ID NO: 22854 - DNA, 20 bp, Artificial Sequence
  Description of Artificial Sequence: Synthetic oligonucleotide
  Target: SCN10A; (-) strand; PAM type: NRG; PAM sequence: TGG
agccttgtacccccctgaca

SEQ ID NO: 22855 - DNA, 20 bp, Artificial Sequence
  Description of Artificial Sequence: Synthetic oligonucleotide
  Target: SCN10A; (-) strand; PAM type: NRG; PAM sequence: CAG
acagtggatcagaaaaggcc

SEQ ID NO: 22856 - DNA, 20 bp, Artificial Sequence
  Description of Artificial Sequence: Synthetic oligonucleotide
  Target: SCN10A; (-) strand; PAM type: NRG; PAM sequence: AGG
ctgtcacagtggatcagaaa

SEQ ID NO: 22857 - DNA, 20 bp, Artificial Sequence
  Description of Artificial Sequence: Synthetic oligonucleotide
  Target: SCN10A; (-) strand; PAM type: NRG; PAM sequence: AAG
cctgtcacagtggatcagaa

SEQ ID NO: 22858 - DNA, 20 bp, Artificial Sequence
  Description of Artificial Sequence: Synthetic oligonucleotide
  Target: SCN10A; (-) strand; PAM type: NRG; PAM sequence: CAG
gttagcctgtcacagtggat

SEQ ID NO: 22859 - DNA, 20 bp, Artificial Sequence
  Description of Artificial Sequence: Synthetic oligonucleotide
  Target: SCN10A; (-) strand; PAM type: NRG; PAM sequence: TGG
taacagttagcctgtcacag

SEQ ID NO: 22860 - DNA, 20 bp, Artificial Sequence
  Description of Artificial Sequence: Synthetic oligonucleotide
  Target: SCN10A; (-) strand; PAM type: NRG; PAM sequence: CAG
agataacagttagcctgtca

SEQ ID NO: 22861 - DNA, 20 bp, Artificial Sequence
  Description of Artificial Sequence: Synthetic oligonucleotide
  Target: SCN10A; (-) strand; PAM type: NRG; PAM sequence: TAG
ctcaaatctgagataacagt

SEQ ID NO: 22862 - DNA, 20 bp, Artificial Sequence
  Description of Artificial Sequence: Synthetic oligonucleotide
  Target: SCN10A; (-) strand; PAM type: NRG; PAM sequence: CAG
agacctcaaatctgagataa

SEQ ID NO: 22863 - DNA, 20 bp, Artificial Sequence
  Description of Artificial Sequence: Synthetic oligonucleotide
  Target: SCN10A; (-) strand; PAM type: NRG; PAM sequence: GAG
atgtcagagacctcaaatct

SEQ ID NO: 22864 - DNA, 20 bp, Artificial Sequence
  Description of Artificial Sequence: Synthetic oligonucleotide
  Target: SCN10A; (-) strand; PAM type: NRG; PAM sequence: GAG
atgcccatgaggagatgtca

SEQ ID NO: 22865 - DNA, 20 bp, Artificial Sequence
  Description of Artificial Sequence: Synthetic oligonucleotide
  Target: SCN10A; (-) strand; PAM type: NRG; PAM sequence: CAG
ccatgcccatgaggagatgt

SEQ ID NO: 22866 - DNA, 20 bp, Artificial Sequence
  Description of Artificial Sequence: Synthetic oligonucleotide
  Target: SCN10A; (-) strand; PAM type: NRG; PAM sequence: GAG
attagtcccatgcccatgag

SEQ ID NO: 22867 - DNA, 20 bp, Artificial Sequence
  Description of Artificial Sequence: Synthetic oligonucleotide
  Target: SCN10A; (-) strand; PAM type: NRG; PAM sequence: AGG
agattagtcccatgcccatg

SEQ ID NO: 22868 - DNA, 20 bp, Artificial Sequence
  Description of Artificial Sequence: Synthetic oligonucleotide
  Target: SCN10A; (-) strand; PAM type: NRG; PAM sequence: GAG
aagattagtcccatgcccat

SEQ ID NO: 22869 - DNA, 20 bp, Artificial Sequence
  Description of Artificial Sequence: Synthetic oligonucleotide
  Target: SCN10A; (-) strand; PAM type: NRG; PAM sequence: TAG
cgggggttgctttccaagat

SEQ ID NO: 22870 - DNA, 20 bp, Artificial Sequence
  Description of Artificial Sequence: Synthetic oligonucleotide
  Target: SCN10A; (-) strand; PAM type: NRG; PAM sequence: AAG
cgcttcgggggttgctttcc

SEQ ID NO: 22871 - DNA, 20 bp, Artificial Sequence
  Description of Artificial Sequence: Synthetic oligonucleotide
  Target: SCN10A; (-) strand; PAM type: NRG; PAM sequence: GGG
gccacagagtaccgcttcgg

SEQ ID NO: 22872 - DNA, 20 bp, Artificial Sequence
  Description of Artificial Sequence: Synthetic oligonucleotide
  Target: SCN10A; (-) strand; PAM type: NRG; PAM sequence: GGG
tgccacagagtaccgcttcg

SEQ ID NO: 22873 - DNA, 20 bp, Artificial Sequence
  Description of Artificial Sequence: Synthetic oligonucleotide
  Target: SCN10A; (-) strand; PAM type: NRG; PAM sequence: GGG
ttgccacagagtaccgcttc

SEQ ID NO: 22874 - DNA, 20 bp, Artificial Sequence
  Description of Artificial Sequence: Synthetic oligonucleotide
  Target: SCN10A; (-) strand; PAM type: NRG; PAM sequence: CGG
cttgccacagagtaccgctt

SEQ ID NO: 22875 - DNA, 20 bp, Artificial Sequence
  Description of Artificial Sequence: Synthetic oligonucleotide
  Target: SCN10A; (-) strand; PAM type: NRG; PAM sequence: GAG
ggcctggggttcttgccaca

SEQ ID NO: 22876 - DNA, 20 bp, Artificial Sequence
  Description of Artificial Sequence: Synthetic oligonucleotide
  Target: SCN10A; (-) strand; PAM type: NRG; PAM sequence: CAG
atggcctggggttcttgcca

SEQ ID NO: 22877 - DNA, 20 bp, Artificial Sequence
  Description of Artificial Sequence: Synthetic oligonucleotide
  Target: SCN10A; (-) strand; PAM type: NRG; PAM sequence: GGG
atttggaattgtatggcctg

SEQ ID NO: 22878 - DNA, 20 bp, Artificial Sequence
  Description of Artificial Sequence: Synthetic oligonucleotide
  Target: SCN10A; (-) strand; PAM type: NRG; PAM sequence: GGG
catttggaattgtatggcct

SEQ ID NO: 22879 - DNA, 20 bp, Artificial Sequence
  Description of Artificial Sequence: Synthetic oligonucleotide
  Target: SCN10A; (-) strand; PAM type: NRG; PAM sequence: TGG
tcatttggaattgtatggcc

SEQ ID NO: 22880 - DNA, 20 bp, Artificial Sequence
  Description of Artificial Sequence: Synthetic oligonucleotide
  Target: SCN10A; (-) strand; PAM type: NRG; PAM sequence: TGG
cttcctcatttggaattgta

SEQ ID NO: 22881 - DNA, 20 bp, Artificial Sequence
  Description of Artificial Sequence: Synthetic oligonucleotide
  Target: SCN10A; (-) strand; PAM type: NRG; PAM sequence: TGG
ctcagttcagcttcctcatt

SEQ ID NO: 22882 - DNA, 20 bp, Artificial Sequence
  Description of Artificial Sequence: Synthetic oligonucleotide
  Target: SCN10A; (-) strand; PAM type: NRG; PAM sequence: CAG
gaaggttcttcatctcagtt

SEQ ID NO: 22883 - DNA, 20 bp, Artificial Sequence
  Description of Artificial Sequence: Synthetic oligonucleotide
  Target: SCN10A; (-) strand; PAM type: NRG; PAM sequence: CAG
ctgaagaaggttcttcatct

SEQ ID NO: 22884 - DNA, 20 bp, Artificial Sequence
  Description of Artificial Sequence: Synthetic oligonucleotide
  Target: SCN10A; (-) strand; PAM type: NRG; PAM sequence: AGG
ccaggctcacactctgaaga

SEQ ID NO: 22885 - DNA, 20 bp, Artificial Sequence
  Description of Artificial Sequence: Synthetic oligonucleotide
  Target: SCN10A; (-) strand; PAM type: NRG; PAM sequence: AAG
tccaggctcacactctgaag

SEQ ID NO: 22886 - DNA, 20 bp, Artificial Sequence
  Description of Artificial Sequence: Synthetic oligonucleotide
  Target: SCN10A; (-) strand; PAM type: NRG; PAM sequence: AAG
gtatccaggctcacactctg

SEQ ID NO: 22887 - DNA, 20 bp, Artificial Sequence
  Description of Artificial Sequence: Synthetic oligonucleotide
  Target: SCN10A; (-) strand; PAM type: NRG; PAM sequence: AGG
tggggcttatgggtgtatcc

SEQ ID NO: 22888 - DNA, 20 bp, Artificial Sequence
  Description of Artificial Sequence: Synthetic oligonucleotide
  Target: SCN10A; (-) strand; PAM type: NRG; PAM sequence: CAG
gtggggcttatgggtgtatc

SEQ ID NO: 22889 - DNA, 20 bp, Artificial Sequence
  Description of Artificial Sequence: Synthetic oligonucleotide
  Target: SCN10A; (-) strand; PAM type: NRG; PAM sequence: GGG
ggtgtccatgtggggcttat

SEQ ID NO: 22890 - DNA, 20 bp, Artificial Sequence
  Description of Artificial Sequence: Synthetic oligonucleotide
  Target: SCN10A; (-) strand; PAM type: NRG; PAM sequence: TGG
gggtgtccatgtggggctta

SEQ ID NO: 22891 - DNA, 20 bp, Artificial Sequence
  Description of Artificial Sequence: Synthetic oligonucleotide
  Target: SCN10A; (-) strand; PAM type: NRG; PAM sequence: GGG
tttgcatgggtgtccatgtg

SEQ ID NO: 22892 - DNA, 20 bp, Artificial Sequence
  Description of Artificial Sequence: Synthetic oligonucleotide
  Target: SCN10A; (-) strand; PAM type: NRG; PAM sequence: GGG
atttgcatgggtgtccatgt

SEQ ID NO: 22893 - DNA, 20 bp, Artificial Sequence
  Description of Artificial Sequence: Synthetic oligonucleotide
  Target: SCN10A; (-) strand; PAM type: NRG; PAM sequence: TGG
gatttgcatgggtgtccatg

SEQ ID NO: 22894 - DNA, 20 bp, Artificial Sequence
  Description of Artificial Sequence: Synthetic oligonucleotide
  Target: SCN10A; (-) strand; PAM type: NRG; PAM sequence: GGG
taaaataaaaagatttgcat

SEQ ID NO: 22895 - DNA, 20 bp, Artificial Sequence
  Description of Artificial Sequence: Synthetic oligonucleotide
  Target: SCN10A; (-) strand; PAM type: NRG; PAM sequence: TGG
ataaaataaaaagatttgca

SEQ ID NO: 22896 - DNA, 20 bp, Artificial Sequence
  Description of Artificial Sequence: Synthetic oligonucleotide
  Target: SCN10A; (-) strand; PAM type: NRG; PAM sequence: AAG
ttgaaataaaataaaataaa

SEQ ID NO: 22897 - DNA, 20 bp, Artificial Sequence
  Description of Artificial Sequence: Synthetic oligonucleotide
  Target: SCN10A; (-) strand; PAM type: NRG; PAM sequence: AAG
aaactattgaaatacaaata

SEQ ID NO: 22898 - DNA, 20 bp, Artificial Sequence
  Description of Artificial Sequence: Synthetic oligonucleotide
  Target: SCN10A; (-) strand; PAM type: NRG; PAM sequence: AAG
aatctcagaaatcagcgtta

SEQ ID NO: 22899 - DNA, 20 bp, Artificial Sequence
  Description of Artificial Sequence: Synthetic oligonucleotide
  Target: SCN10A; (-) strand; PAM type: NRG; PAM sequence: CAG
tgcaccaaaatctcagaaat

SEQ ID NO: 22900 - DNA, 20 bp, Artificial Sequence
  Description of Artificial Sequence: Synthetic oligonucleotide
  Target: SCN10A; (-) strand; PAM type: NRG; PAM sequence: CAG
gtgatggtgcaccaaaatct

SEQ ID NO: 22901 - DNA, 20 bp, Artificial Sequence
  Description of Artificial Sequence: Synthetic oligonucleotide
  Target: SCN10A; (-) strand; PAM type: NRG; PAM sequence: TGG
agtgtacactgctcgggtga

SEQ ID NO: 22902 - DNA, 20 bp, Artificial Sequence
  Description of Artificial Sequence: Synthetic oligonucleotide
  Target: SCN10A; (-) strand; PAM type: NRG; PAM sequence: GGG
gggtacagtgtacactgctc

SEQ ID NO: 22903 - DNA, 20 bp, Artificial Sequence
  Description of Artificial Sequence: Synthetic oligonucleotide
  Target: SCN10A; (-) strand; PAM type: NRG; PAM sequence: CGG
tgggtacagtgtacactgct

SEQ ID NO: 22904 - DNA, 20 bp, Artificial Sequence
  Description of Artificial Sequence: Synthetic oligonucleotide
  Target: SCN10A; (-) strand; PAM type: NRG; PAM sequence: CAG
aagagactacacactgggta

SEQ ID NO: 22905 - DNA, 20 bp, Artificial Sequence
  Description of Artificial Sequence: Synthetic oligonucleotide
  Target: SCN10A; (-) strand; PAM type: NRG; PAM sequence: GGG
gggataagagactacacact

SEQ ID NO: 22906 - DNA, 20 bp, Artificial Sequence
  Description of Artificial Sequence: Synthetic oligonucleotide
  Target: SCN10A; (-) strand; PAM type: NRG; PAM sequence: TGG
agggataagagactacacac

SEQ ID NO: 22907 - DNA, 20 bp, Artificial Sequence
  Description of Artificial Sequence: Synthetic oligonucleotide
  Target: SCN10A; (-) strand; PAM type: NRG; PAM sequence: GAG
gagacgaaggtaagggataa

SEQ ID NO: 22908 - DNA, 20 bp, Artificial Sequence
  Description of Artificial Sequence: Synthetic oligonucleotide
  Target: SCN10A; (-) strand; PAM type: NRG; PAM sequence: AAG
gtgagacgaaggtaagggat

SEQ ID NO: 22909 - DNA, 20 bp, Artificial Sequence
  Description of Artificial Sequence: Synthetic oligonucleotide
  Target: SCN10A; (-) strand; PAM type: NRG; PAM sequence: GGG
gaaaggtgagacgaaggtaa

SEQ ID NO: 22910 - DNA, 20 bp, Artificial Sequence
  Description of Artificial Sequence: Synthetic oligonucleotide
  Target: SCN10A; (-) strand; PAM type: NRG; PAM sequence: AGG
ggaaaggtgagacgaaggta

SEQ ID NO: 22911 - DNA, 20 bp, Artificial Sequence
  Description of Artificial Sequence: Synthetic oligonucleotide
  Target: SCN10A; (-) strand; PAM type: NRG; PAM sequence: AAG
aggaaaggtgagacgaaggt

SEQ ID NO: 22912 - DNA, 20 bp, Artificial Sequence
  Description of Artificial Sequence: Synthetic oligonucleotide
  Target: SCN10A; (-) strand; PAM type: NRG; PAM sequence: AGG
tgggaggaaaggtgagacga

SEQ ID NO: 22913 - DNA, 20 bp, Artificial Sequence
  Description of Artificial Sequence: Synthetic oligonucleotide
  Target: SCN10A; (-) strand; PAM type: NRG; PAM sequence: AAG
ttgggaggaaaggtgagacg

SEQ ID NO: 22914 - DNA, 20 bp, Artificial Sequence
  Description of Artificial Sequence: Synthetic oligonucleotide
  Target: SCN10A; (-) strand; PAM type: NRG; PAM sequence: GAG
ggggacttgggaggaaaggt

SEQ ID NO: 22915 - DNA, 20 bp, Artificial Sequence
  Description of Artificial Sequence: Synthetic oligonucleotide
  Target: SCN10A; (-) strand; PAM type: NRG; PAM sequence: AGG
ctttggggacttgggaggaa

SEQ ID NO: 22916 - DNA, 20 bp, Artificial Sequence
  Description of Artificial Sequence: Synthetic oligonucleotide
  Target: SCN10A; (-) strand; PAM type: NRG; PAM sequence: AAG
actttggggacttgggagga

SEQ ID NO: 22917 - DNA, 20 bp, Artificial Sequence
  Description of Artificial Sequence: Synthetic oligonucleotide
  Target: SCN10A; (-) strand; PAM type: NRG; PAM sequence: AGG
atggactttggggacttggg

SEQ ID NO: 22918 - DNA, 20 bp, Artificial Sequence
  Description of Artificial Sequence: Synthetic oligonucleotide
  Target: SCN10A; (-) strand; PAM type: NRG; PAM sequence: GAG
aatggactttggggacttgg

SEQ ID NO: 22919 - DNA, 20 bp, Artificial Sequence
  Description of Artificial Sequence: Synthetic oligonucleotide
  Target: SCN10A; (-) strand; PAM type: NRG; PAM sequence: GGG
ataatggactttggggactt

SEQ ID NO: 22920 - DNA, 20 bp, Artificial Sequence
  Description of Artificial Sequence: Synthetic oligonucleotide
  Target: SCN10A; (-) strand; PAM type: NRG; PAM sequence: TGG
cataatggactttggggact

SEQ ID NO: 22921 - DNA, 20 bp, Artificial Sequence
  Description of Artificial Sequence: Synthetic oligonucleotide
  Target: SCN10A; (-) strand; PAM type: NRG; PAM sequence: GGG
caatgacataatggactttg

SEQ ID NO: 22922 - DNA, 20 bp, Artificial Sequence
  Description of Artificial Sequence: Synthetic oligonucleotide
  Target: SCN10A; (-) strand; PAM type: NRG; PAM sequence: GGG
acaatgacataatggacttt

SEQ ID NO: 22923 - DNA, 20 bp, Artificial Sequence
  Description of Artificial Sequence: Synthetic oligonucleotide
  Target: SCN10A; (-) strand; PAM type: NRG; PAM sequence: TGG
aacaatgacataatggactt

SEQ ID NO: 22924 - DNA, 20 bp, Artificial Sequence
  Description of Artificial Sequence: Synthetic oligonucleotide
  Target: SCN10A; (-) strand; PAM type: NRG; PAM sequence: TGG
aaggcataacaatgacataa

SEQ ID NO: 22925 - DNA, 20 bp, Artificial Sequence
  Description of Artificial Sequence: Synthetic oligonucleotide
  Target: SCN10A; (-) strand; PAM type: NRG; PAM sequence: AGG
gctaagctgtgaggatgcaa

SEQ ID NO: 22926 - DNA, 20 bp, Artificial Sequence
  Description of Artificial Sequence: Synthetic oligonucleotide
  Target: SCN10A; (-) strand; PAM type: NRG; PAM sequence: AAG
agctaagctgtgaggatgca

SEQ ID NO: 22927 - DNA, 20 bp, Artificial Sequence
  Description of Artificial Sequence: Synthetic oligonucleotide
  Target: SCN10A; (-) strand; PAM type: NRG; PAM sequence: AGG
caagcaggagctaagctgtg

SEQ ID NO: 22928 - DNA, 20 bp, Artificial Sequence
  Description of Artificial Sequence: Synthetic oligonucleotide
  Target: SCN10A; (-) strand; PAM type: NRG; PAM sequence: GAG
acaagcaggagctaagctgt

SEQ ID NO: 22929 - DNA, 20 bp, Artificial Sequence
  Description of Artificial Sequence: Synthetic oligonucleotide
  Target: SCN10A; (-) strand; PAM type: NRG; PAM sequence: AAG
cttaattacaagcaggagct

SEQ ID NO: 22930 - DNA, 20 bp, Artificial Sequence
  Description of Artificial Sequence: Synthetic oligonucleotide
  Target: SCN10A; (-) strand; PAM type: NRG; PAM sequence: GAG
gtgttcttaattacaagcag

SEQ ID NO: 22931 - DNA, 20 bp, Artificial Sequence
  Description of Artificial Sequence: Synthetic oligonucleotide
  Target: SCN10A; (-) strand; PAM type: NRG; PAM sequence: AGG
atgtgttcttaattacaagc

SEQ ID NO: 22932 - DNA, 20 bp, Artificial Sequence
  Description of Artificial Sequence: Synthetic oligonucleotide
  Target: SCN10A; (-) strand; PAM type: NRG; PAM sequence: CAG
catgtgttcttaattacaag

SEQ ID NO: 22933 - DNA, 20 bp, Artificial Sequence
  Description of Artificial Sequence: Synthetic oligonucleotide
  Target: SCN10A; (-) strand; PAM type: NRG; PAM sequence: AAG
catcatgtgttcttaattac

SEQ ID NO: 22934 - DNA, 20 bp, Artificial Sequence
  Description of Artificial Sequence: Synthetic oligonucleotide
  Target: SCN10A; (-) strand; PAM type: NRG; PAM sequence: AAG
taactcaggaatagaaagtc

SEQ ID NO: 22935 - DNA, 20 bp, Artificial Sequence
  Description of Artificial Sequence: Synthetic oligonucleotide
  Target: SCN10A; (-) strand; PAM type: NRG; PAM sequence: AAG
tgaagtaactcaggaataga

SEQ ID NO: 22936 - DNA, 20 bp, Artificial Sequence
  Description of Artificial Sequence: Synthetic oligonucleotide
  Target: SCN10A; (-) strand; PAM type: NRG; PAM sequence: TAG
taaatgaagtaactcaggaa

SEQ ID NO: 22937 - DNA, 20 bp, Artificial Sequence
  Description of Artificial Sequence: Synthetic oligonucleotide
  Target: SCN10A; (-) strand; PAM type: NRG; PAM sequence: AGG
tattctaaatgaagtaactc

SEQ ID NO: 22938 - DNA, 20 bp, Artificial Sequence
  Description of Artificial Sequence: Synthetic oligonucleotide
  Target: SCN10A; (-) strand; PAM type: NRG; PAM sequence: CAG
ttattctaaatgaagtaact

SEQ ID NO: 22939 - DNA, 20 bp, Artificial Sequence
  Description of Artificial Sequence: Synthetic oligonucleotide
  Target: SCN10A; (-) strand; PAM type: NRG; PAM sequence: AAG
ggagactattattctaaatg

SEQ ID NO: 22940 - DNA, 20 bp, Artificial Sequence
  Description of Artificial Sequence: Synthetic oligonucleotide
  Target: SCN10A; (-) strand; PAM type: NRG; PAM sequence: GAG
cagcaagctggatggagttg

SEQ ID NO: 22941 - DNA, 20 bp, Artificial Sequence
  Description of Artificial Sequence: Synthetic oligonucleotide
  Target: SCN10A; (-) strand; PAM type: NRG; PAM sequence: TGG
ggcagcaagctggatggagt

SEQ ID NO: 22942 - DNA, 20 bp, Artificial Sequence
  Description of Artificial Sequence: Synthetic oligonucleotide
  Target: SCN10A; (-) strand; PAM type: NRG; PAM sequence: GAG
cattggcagcaagctggatg

SEQ ID NO: 22943 - DNA, 20 bp, Artificial Sequence
  Description of Artificial Sequence: Synthetic oligonucleotide
  Target: SCN10A; (-) strand; PAM type: NRG; PAM sequence: TGG
ggcattggcagcaagctgga

SEQ ID NO: 22944 - DNA, 20 bp, Artificial Sequence
  Description of Artificial Sequence: Synthetic oligonucleotide
  Target: SCN10A; (-) strand; PAM type: NRG; PAM sequence: TGG
taatggcattggcagcaagc

SEQ ID NO: 22945 - DNA, 20 bp, Artificial Sequence
  Description of Artificial Sequence: Synthetic oligonucleotide
  Target: SCN10A; (-) strand; PAM type: NRG; PAM sequence: AAG
gaaataatggcattggcagc

SEQ ID NO: 22946 - DNA, 20 bp, Artificial Sequence
  Description of Artificial Sequence: Synthetic oligonucleotide
  Target: SCN10A; (-) strand; PAM type: NRG; PAM sequence: CAG
gaatgaaataatggcattgg

SEQ ID NO: 22947 - DNA, 20 bp, Artificial Sequence
  Description of Artificial Sequence: Synthetic oligonucleotide
  Target: SCN10A; (-) strand; PAM type: NRG; PAM sequence: TGG
aaggaatgaaataatggcat

SEQ ID NO: 22948 - DNA, 20 bp, Artificial Sequence
  Description of Artificial Sequence: Synthetic oligonucleotide
  Target: SCN10A; (-) strand; PAM type: NRG; PAM sequence: TGG
tgtaaaaaggaatgaaataa

SEQ ID NO: 22949 - DNA, 20 bp, Artificial Sequence
  Description of Artificial Sequence: Synthetic oligonucleotide
  Target: SCN10A; (-) strand; PAM type: NRG; PAM sequence: AGG
aatactactcagttgtaaaa

SEQ ID NO: 22950 - DNA, 20 bp, Artificial Sequence
  Description of Artificial Sequence: Synthetic oligonucleotide
  Target: SCN10A; (-) strand; PAM type: NRG; PAM sequence: AAG
gaatactactcagttgtaaa

SEQ ID NO: 22951 - DNA, 20 bp, Artificial Sequence
  Description of Artificial Sequence: Synthetic oligonucleotide
  Target: SCN10A; (-) strand; PAM type: NRG; PAM sequence: CAG
gcataccatggaatactact

SEQ ID NO: 22952 - DNA, 20 bp, Artificial Sequence
  Description of Artificial Sequence: Synthetic oligonucleotide
  Target: SCN10A; (-) strand; PAM type: NRG; PAM sequence: TGG
aatatggtgtatgcatacca

SEQ ID NO: 22953 - DNA, 20 bp, Artificial Sequence
  Description of Artificial Sequence: Synthetic oligonucleotide
  Target: SCN10A; (-) strand; PAM type: NRG; PAM sequence: TGG
acaagtgcataaagaaaata

SEQ ID NO: 22954 - DNA, 20 bp, Artificial Sequence
  Description of Artificial Sequence: Synthetic oligonucleotide
  Target: SCN10A; (-) strand; PAM type: NRG; PAM sequence: AAG
catcaaccaacaagtgcata

SEQ ID NO: 22955 - DNA, 20 bp, Artificial Sequence
  Description of Artificial Sequence: Synthetic oligonucleotide
  Target: SCN10A; (-) strand; PAM type: NRG; PAM sequence: AAG
ctaaatgcccatcaaccaac

SEQ ID NO: 22956 - DNA, 20 bp, Artificial Sequence
  Description of Artificial Sequence: Synthetic oligonucleotide
  Target: SCN10A; (-) strand; PAM type: NRG; PAM sequence: CAG
caactgcaaaaatatggaac

SEQ ID NO: 22957 - DNA, 20 bp, Artificial Sequence
  Description of Artificial Sequence: Synthetic oligonucleotide
  Target: SCN10A; (-) strand; PAM type: NRG; PAM sequence: TGG
agtttacaactgcaaaaata

SEQ ID NO: 22958 - DNA, 20 bp, Artificial Sequence
  Description of Artificial Sequence: Synthetic oligonucleotide
  Target: SCN10A; (-) strand; PAM type: NRG; PAM sequence: CAG
tatgcatgcttatagcagca

SEQ ID NO: 22959 - DNA, 20 bp, Artificial Sequence
  Description of Artificial Sequence: Synthetic oligonucleotide
  Target: SCN10A; (-) strand; PAM type: NRG; PAM sequence: CAG
ttgcatatgcatgcttatag

SEQ ID NO: 22960 - DNA, 20 bp, Artificial Sequence
  Description of Artificial Sequence: Synthetic oligonucleotide
  Target: SCN10A; (-) strand; PAM type: NRG; PAM sequence: TAG
cacttgcatatgcatgctta

SEQ ID NO: 22961 - DNA, 20 bp, Artificial Sequence
  Description of Artificial Sequence: Synthetic oligonucleotide
  Target: SCN10A; (-) strand; PAM type: NRG; PAM sequence: AAG
gaaaataagccattattaaa

SEQ ID NO: 22962 - DNA, 20 bp, Artificial Sequence
  Description of Artificial Sequence: Synthetic oligonucleotide
  Target: SCN10A; (-) strand; PAM type: NRG; PAM sequence: AAG
gtatctacccagaggaaaat

SEQ ID NO: 22963 - DNA, 20 bp, Artificial Sequence
  Description of Artificial Sequence: Synthetic oligonucleotide
  Target: SCN10A; (-) strand; PAM type: NRG; PAM sequence: AGG
actactgggtatctacccag

SEQ ID NO: 22964 - DNA, 20 bp, Artificial Sequence
  Description of Artificial Sequence: Synthetic oligonucleotide
  Target: SCN10A; (-) strand; PAM type: NRG; PAM sequence: GAG
cactactgggtatctaccca

SEQ ID NO: 22965 - DNA, 20 bp, Artificial Sequence
  Description of Artificial Sequence: Synthetic oligonucleotide
  Target: SCN10A; (-) strand; PAM type: NRG; PAM sequence: CAG
cccactactgggtatctacc

SEQ ID NO: 22966 - DNA, 20 bp, Artificial Sequence
  Description of Artificial Sequence: Synthetic oligonucleotide
  Target: SCN10A; (-) strand; PAM type: NRG; PAM sequence: GGG
ggtccagcaatcccactact

SEQ ID NO: 22967 - DNA, 20 bp, Artificial Sequence
  Description of Artificial Sequence: Synthetic oligonucleotide
  Target: SCN10A; (-) strand; PAM type: NRG; PAM sequence: TGG
tggtccagcaatcccactac

SEQ ID NO: 22968 - DNA, 20 bp, Artificial Sequence
  Description of Artificial Sequence: Synthetic oligonucleotide
  Target: SCN10A; (-) strand; PAM type: NRG; PAM sequence: CAG
agtagaactaccatttggtc

SEQ ID NO: 22969 - DNA, 20 bp, Artificial Sequence
  Description of Artificial Sequence: Synthetic oligonucleotide
  Target: SCN10A; (-) strand; PAM type: NRG; PAM sequence: TGG
ctaaaagtagaactaccatt

SEQ ID NO: 22970 - DNA, 20 bp, Artificial Sequence
  Description of Artificial Sequence: Synthetic oligonucleotide
  Target: SCN10A; (-) strand; PAM type: NRG; PAM sequence: TAG
attccttaaagaactaaaag

SEQ ID NO: 22971 - DNA, 20 bp, Artificial Sequence
  Description of Artificial Sequence: Synthetic oligonucleotide
  Target: SCN10A; (-) strand; PAM type: NRG; PAM sequence: AAG
gagattccttaaagaactaa

SEQ ID NO: 22972 - DNA, 20 bp, Artificial Sequence
  Description of Artificial Sequence: Synthetic oligonucleotide
  Target: SCN10A; (-) strand; PAM type: NRG; PAM sequence: AAG
aacgttatggagattcctta

SEQ ID NO: 22973 - DNA, 20 bp, Artificial Sequence
  Description of Artificial Sequence: Synthetic oligonucleotide
  Target: SCN10A; (-) strand; PAM type: NRG; PAM sequence: GAG
ccactaaggaaaacgttatg

SEQ ID NO: 22974 - DNA, 20 bp, Artificial Sequence
  Description of Artificial Sequence: Synthetic oligonucleotide
  Target: SCN10A; (-) strand; PAM type: NRG; PAM sequence: TGG
aaccactaaggaaaacgtta

SEQ ID NO: 22975 - DNA, 20 bp, Artificial Sequence
  Description of Artificial Sequence: Synthetic oligonucleotide
  Target: SCN10A; (-) strand; PAM type: NRG; PAM sequence: AGG
gtaaactagtacaaccacta

SEQ ID NO: 22976 - DNA, 20 bp, Artificial Sequence
  Description of Artificial Sequence: Synthetic oligonucleotide
  Target: SCN10A; (-) strand; PAM type: NRG; PAM sequence: AAG
tgtaaactagtacaaccact

SEQ ID NO: 22977 - DNA, 20 bp, Artificial Sequence
  Description of Artificial Sequence: Synthetic oligonucleotide
  Target: SCN10A; (-) strand; PAM type: NRG; PAM sequence: TAG
ctgctggtgggaatgtaaac

SEQ ID NO: 22978 - DNA, 20 bp, Artificial Sequence
  Description of Artificial Sequence: Synthetic oligonucleotide
  Target: SCN10A; (-) strand; PAM type: NRG; PAM sequence: GGG
aacaattttacactgctggt

SEQ ID NO: 22979 - DNA, 20 bp, Artificial Sequence
  Description of Artificial Sequence: Synthetic oligonucleotide
  Target: SCN10A; (-) strand; PAM type: NRG; PAM sequence: TGG
aaacaattttacactgctgg

SEQ ID NO: 22980 - DNA, 20 bp, Artificial Sequence
  Description of Artificial Sequence: Synthetic oligonucleotide
  Target: SCN10A; (-) strand; PAM type: NRG; PAM sequence: TGG
aggaaacaattttacactgc

SEQ ID NO: 22981 - DNA, 20 bp, Artificial Sequence
  Description of Artificial Sequence: Synthetic oligonucleotide
  Target: SCN10A; (-) strand; PAM type: NRG; PAM sequence: AGG
ttggcatggatgtaatgaaa

SEQ ID NO: 22982 - DNA, 20 bp, Artificial Sequence
  Description of Artificial Sequence: Synthetic oligonucleotide
  Target: SCN10A; (-) strand; PAM type: NRG; PAM sequence: AAG
gttggcatggatgtaatgaa

SEQ ID NO: 22983 - DNA, 20 bp, Artificial Sequence
  Description of Artificial Sequence: Synthetic oligonucleotide
  Target: SCN10A; (-) strand; PAM type: NRG; PAM sequence: TGG
aaaaataatagatgttggca

SEQ ID NO: 22984 - DNA, 20 bp, Artificial Sequence
  Description of Artificial Sequence: Synthetic oligonucleotide
  Target: SCN10A; (-) strand; PAM type: NRG; PAM sequence: TGG
aaccaaaaaataatagatgt

SEQ ID NO: 22985 - DNA, 20 bp, Artificial Sequence
  Description of Artificial Sequence: Synthetic oligonucleotide
  Target: SCN10A; (-) strand; PAM type: NRG; PAM sequence: TAG
tggccataaccaaaaaataa

SEQ ID NO: 22986 - DNA, 20 bp, Artificial Sequence
  Description of Artificial Sequence: Synthetic oligonucleotide
  Target: SCN10A; (-) strand; PAM type: NRG; PAM sequence: TGG
ccaccttactcctgcaagaa

SEQ ID NO: 22987 - DNA, 20 bp, Artificial Sequence
  Description of Artificial Sequence: Synthetic oligonucleotide
  Target: SCN10A; (-) strand; PAM type: NRG; PAM sequence: AAG
agataccaccttactcctgc

SEQ ID NO: 22988 - DNA, 20 bp, Artificial Sequence
  Description of Artificial Sequence: Synthetic oligonucleotide
  Target: SCN10A; (-) strand; PAM type: NRG; PAM sequence: GAG
atgcaaattaaaaccacaat

SEQ ID NO: 22989 - DNA, 20 bp, Artificial Sequence
  Description of Artificial Sequence: Synthetic oligonucleotide
  Target: SCN10A; (-) strand; PAM type: NRG; PAM sequence: GGG
ctcaacatcattaattatca

SEQ ID NO: 22990 - DNA, 20 bp, Artificial Sequence
  Description of Artificial Sequence: Synthetic oligonucleotide
  Target: SCN10A; (-) strand; PAM type: NRG; PAM sequence: AGG
gctcaacatcattaattatc

SEQ ID NO: 22991 - DNA, 20 bp, Artificial Sequence
  Description of Artificial Sequence: Synthetic oligonucleotide
  Target: SCN10A; (-) strand; PAM type: NRG; PAM sequence: CAG
tgctcaacatcattaattat

SEQ ID NO: 22992 - DNA, 20 bp, Artificial Sequence
  Description of Artificial Sequence: Synthetic oligonucleotide
  Target: SCN10A; (-) strand; PAM type: NRG; PAM sequence: AGG
tatataaatggccaatgaac

SEQ ID NO: 22993 - DNA, 20 bp, Artificial Sequence
  Description of Artificial Sequence: Synthetic oligonucleotide
  Target: SCN10A; (-) strand; PAM type: NRG; PAM sequence: CAG
atatataaatggccaatgaa

SEQ ID NO: 22994 - DNA, 20 bp, Artificial Sequence
  Description of Artificial Sequence: Synthetic oligonucleotide
  Target: SCN10A; (-) strand; PAM type: NRG; PAM sequence: TGG
ctcaaaagaagatatataaa

SEQ ID NO: 22995 - DNA, 20 bp, Artificial Sequence
  Description of Artificial Sequence: Synthetic oligonucleotide
  Target: SCN10A; (-) strand; PAM type: NRG; PAM sequence: AAG
gaatacgcaattctcaaaag

SEQ ID NO: 22996 - DNA, 20 bp, Artificial Sequence
  Description of Artificial Sequence: Synthetic oligonucleotide
  Target: SCN10A; (-) strand; PAM type: NRG; PAM sequence: AAG
caagaatacgcaattctcaa

SEQ ID NO: 22997 - DNA, 20 bp, Artificial Sequence
  Description of Artificial Sequence: Synthetic oligonucleotide
  Target: SCN10A; (-) strand; PAM type: NRG; PAM sequence: AAG
tccaaaagtgggcaaaggac

SEQ ID NO: 22998 - DNA, 20 bp, Artificial Sequence
  Description of Artificial Sequence: Synthetic oligonucleotide
  Target: SCN10A; (-) strand; PAM type: NRG; PAM sequence: AGG
tcccatccaaaagtgggcaa

SEQ ID NO: 22999 - DNA, 20 bp, Artificial Sequence
  Description of Artificial Sequence: Synthetic oligonucleotide
  Target: SCN10A; (-) strand; PAM type: NRG; PAM sequence: AAG
atcccatccaaaagtgggca

SEQ ID NO: 23000 - DNA, 20 bp, Artificial Sequence
  Description of Artificial Sequence: Synthetic oligonucleotide
  Target: SCN10A; (-) strand; PAM type: NRG; PAM sequence: GGG
aaataatcccatccaaaagt

SEQ ID NO: 23001 - DNA, 20 bp, Artificial Sequence
  Description of Artificial Sequence: Synthetic oligonucleotide
  Target: SCN10A; (-) strand; PAM type: NRG; PAM sequence: TGG
caaataatcccatccaaaag

SEQ ID NO: 23002 - DNA, 20 bp, Artificial Sequence
  Description of Artificial Sequence: Synthetic oligonucleotide
  Target: SCN10A; (-) strand; PAM type: NRG; PAM sequence: AAG
aaacaaataatcccatccaa

SEQ ID NO: 23003 - DNA, 20 bp, Artificial Sequence
  Description of Artificial Sequence: Synthetic oligonucleotide
  Target: SCN10A; (-) strand; PAM type: NRG; PAM sequence: AAG
agaaacacaaataaatcagc

SEQ ID NO: 23004 - DNA, 20 bp, Artificial Sequence
  Description of Artificial Sequence: Synthetic oligonucleotide
  Target: SCN10A; (-) strand; PAM type: NRG; PAM sequence: CAG
tataagaaacacaaataaat

SEQ ID NO: 23005 - DNA, 20 bp, Artificial Sequence
  Description of Artificial Sequence: Synthetic oligonucleotide
  Target: SCN10A; (-) strand; PAM type: NRG; PAM sequence: AAG
gactaatatccagcatctat

SEQ ID NO: 23006 - DNA, 20 bp, Artificial Sequence
  Description of Artificial Sequence: Synthetic oligonucleotide
  Target: SCN10A; (-) strand; PAM type: NRG; PAM sequence: CAG
tccagcaaaagactaatatc

SEQ ID NO: 23007 - DNA, 20 bp, Artificial Sequence
  Description of Artificial Sequence: Synthetic oligonucleotide
  Target: SCN10A; (-) strand; PAM type: NRG; PAM sequence: AAG
gttatctatgcttccagcaa

SEQ ID NO: 23008 - DNA, 20 bp, Artificial Sequence
  Description of Artificial Sequence: Synthetic oligonucleotide
  Target: SCN10A; (-) strand; PAM type: NRG; PAM sequence: CAG
atctttgttatctatgcttc

SEQ ID NO: 23009 - DNA, 20 bp, Artificial Sequence
  Description of Artificial Sequence: Synthetic oligonucleotide
  Target: SCN10A; (-) strand; PAM type: NRG; PAM sequence: GAG
acagacaacccataggatga

SEQ ID NO: 23010 - DNA, 20 bp, Artificial Sequence
  Description of Artificial Sequence: Synthetic oligonucleotide
  Target: SCN10A; (-) strand; PAM type: NRG; PAM sequence: GAG
aaacagacaacccataggat

SEQ ID NO: 23011 - DNA, 20 bp, Artificial Sequence
  Description of Artificial Sequence: Synthetic oligonucleotide
  Target: SCN10A; (-) strand; PAM type: NRG; PAM sequence: AGG
caagtaaacagacaacccat

SEQ ID NO: 23012 - DNA, 20 bp, Artificial Sequence
  Description of Artificial Sequence: Synthetic oligonucleotide
  Target: SCN10A; (-) strand; PAM type: NRG; PAM sequence: TAG
ccaagtaaacagacaaccca

SEQ ID NO: 23013 - DNA, 20 bp, Artificial Sequence
  Description of Artificial Sequence: Synthetic oligonucleotide
  Target: SCN10A; (-) strand; PAM type: NRG; PAM sequence: CAG
gaaataatcatccaagtaaa

SEQ ID NO: 23014 - DNA, 20 bp, Artificial Sequence
  Description of Artificial Sequence: Synthetic oligonucleotide
  Target: SCN10A; (-) strand; PAM type: NRG; PAM sequence: AAG
agcaagagaaataatcatcc

SEQ ID NO: 23015 - DNA, 20 bp, Artificial Sequence
  Description of Artificial Sequence: Synthetic oligonucleotide
  Target: SCN10A; (-) strand; PAM type: NRG; PAM sequence: GAG
aaaaagctgttgcacagcaa

SEQ ID NO: 23016 - DNA, 20 bp, Artificial Sequence
  Description of Artificial Sequence: Synthetic oligonucleotide
  Target: SCN10A; (-) strand; PAM type: NRG; PAM sequence: AAG
ctaaaaagctgttgcacagc

SEQ ID NO: 23017 - DNA, 20 bp, Artificial Sequence
  Description of Artificial Sequence: Synthetic oligonucleotide
  Target: SCN10A; (-) strand; PAM type: NRG; PAM sequence: CAG
taaactaaaaagctgttgca

SEQ ID NO: 23018 - DNA, 20 bp, Artificial Sequence
  Description of Artificial Sequence: Synthetic oligonucleotide
  Target: SCN10A; (-) strand; PAM type: NRG; PAM sequence: AAG
tgggatctaattaaactaaa

SEQ ID NO: 23019 - DNA, 20 bp, Artificial Sequence
  Description of Artificial Sequence: Synthetic oligonucleotide
  Target: SCN10A; (-) strand; PAM type: NRG; PAM sequence: GGG
aaaaacaaaaataaatagat

SEQ ID NO: 23020 - DNA, 20 bp, Artificial Sequence
  Description of Artificial Sequence: Synthetic oligonucleotide
  Target: SCN10A; (-) strand; PAM type: NRG; PAM sequence: TGG
caaaaacaaaaataaataga

SEQ ID NO: 23021 - DNA, 20 bp, Artificial Sequence
  Description of Artificial Sequence: Synthetic oligonucleotide
  Target: SCN10A; (-) strand; PAM type: NRG; PAM sequence: TAG
ccaacaaaaacaaaaataaa

SEQ ID NO: 23022 - DNA, 20 bp, Artificial Sequence
  Description of Artificial Sequence: Synthetic oligonucleotide
  Target: SCN10A; (-) strand; PAM type: NRG; PAM sequence: AAG
cgttcctgaccaaggaccca

SEQ ID NO: 23023 - DNA, 20 bp, Artificial Sequence
  Description of Artificial Sequence: Synthetic oligonucleotide
  Target: SCN10A; (-) strand; PAM type: NRG; PAM sequence: AGG
aggcaaaacgttcctgacca

SEQ ID NO: 23024 - DNA, 20 bp, Artificial Sequence
  Description of Artificial Sequence: Synthetic oligonucleotide
  Target: SCN10A; (-) strand; PAM type: NRG; PAM sequence: AAG
taggcaaaacgttcctgacc

SEQ ID NO: 23025 - DNA, 20 bp, Artificial Sequence
  Description of Artificial Sequence: Synthetic oligonucleotide
  Target: SCN10A; (-) strand; PAM type: NRG; PAM sequence: AGG
actcttctagacattggctt

SEQ ID NO: 23026 - DNA, 20 bp, Artificial Sequence
  Description of Artificial Sequence: Synthetic oligonucleotide
  Target: SCN10A; (-) strand; PAM type: NRG; PAM sequence: TAG
aactcttctagacattggct

SEQ ID NO: 23027 - DNA, 20 bp, Artificial Sequence
  Description of Artificial Sequence: Synthetic oligonucleotide
  Target: SCN10A; (-) strand; PAM type: NRG; PAM sequence: TGG
ggaaaaactcttctagacat

SEQ ID NO: 23028 - DNA, 20 bp, Artificial Sequence
  Description of Artificial Sequence: Synthetic oligonucleotide
  Target: SCN10A; (-) strand; PAM type: NRG; PAM sequence: TAG
taacattggaaaaactcttc

SEQ ID NO: 23029 - DNA, 20 bp, Artificial Sequence
  Description of Artificial Sequence: Synthetic oligonucleotide
  Target: SCN10A; (-) strand; PAM type: NRG; PAM sequence: TGG
aaaattctagaagataacat

SEQ ID NO: 23030 - DNA, 20 bp, Artificial Sequence
  Description of Artificial Sequence: Synthetic oligonucleotide
  Target: SCN10A; (-) strand; PAM type: NRG; PAM sequence: AAG
gaaattataaaaaattctag

SEQ ID NO: 23031 - DNA, 20 bp, Artificial Sequence
  Description of Artificial Sequence: Synthetic oligonucleotide
  Target: SCN10A; (-) strand; PAM type: NRG; PAM sequence: TAG
cctgaaattataaaaaattc

SEQ ID NO: 23032 - DNA, 20 bp, Artificial Sequence
  Description of Artificial Sequence: Synthetic oligonucleotide
  Target: SCN10A; (-) strand; PAM type: NRG; PAM sequence: AAG
tggataaaaggcttaaatct

SEQ ID NO: 23033 - DNA, 20 bp, Artificial Sequence
  Description of Artificial Sequence: Synthetic oligonucleotide
  Target: SCN10A; (-) strand; PAM type: NRG; PAM sequence: AGG
atcaattcaagatggataaa

SEQ ID NO: 23034 - DNA, 20 bp, Artificial Sequence
  Description of Artificial Sequence: Synthetic oligonucleotide
  Target: SCN10A; (-) strand; PAM type: NRG; PAM sequence: AAG
aatcaattcaagatggataa

SEQ ID NO: 23035 - DNA, 20 bp, Artificial Sequence
  Description of Artificial Sequence: Synthetic oligonucleotide
  Target: SCN10A; (-) strand; PAM type: NRG; PAM sequence: TGG
atacaaaaatcaattcaaga

SEQ ID NO: 23036 - DNA, 20 bp, Artificial Sequence
  Description of Artificial Sequence: Synthetic oligonucleotide
  Target: SCN10A; (-) strand; PAM type: NRG; PAM sequence: AAG
ccttatacaaaaatcaattc

SEQ ID NO: 23037 - DNA, 20 bp, Artificial Sequence
  Description of Artificial Sequence: Synthetic oligonucleotide
  Target: SCN10A; (-) strand; PAM type: NRG; PAM sequence: AAG
agcaagccacatgtggaaga

SEQ ID NO: 23038 - DNA, 20 bp, Artificial Sequence
  Description of Artificial Sequence: Synthetic oligonucleotide
  Target: SCN10A; (-) strand; PAM type: NRG; PAM sequence: AAG
aattagcaagccacatgtgg

SEQ ID NO: 23039 - DNA, 20 bp, Artificial Sequence
  Description of Artificial Sequence: Synthetic oligonucleotide
  Target: SCN10A; (-) strand; PAM type: NRG; PAM sequence: TGG
gataattagcaagccacatg

SEQ ID NO: 23040 - DNA, 20 bp, Artificial Sequence
  Description of Artificial Sequence: Synthetic oligonucleotide
  Target: SCN10A; (-) strand; PAM type: NRG; PAM sequence: AAG
atggtgctgggataattagc

SEQ ID NO: 23041 - DNA, 20 bp, Artificial Sequence
  Description of Artificial Sequence: Synthetic oligonucleotide
  Target: SCN10A; (-) strand; PAM type: NRG; PAM sequence: TAG
acaaatggtgctgggataat

SEQ ID NO: 23042 - DNA, 20 bp, Artificial Sequence
  Description of Artificial Sequence: Synthetic oligonucleotide
  Target: SCN10A; (-) strand; PAM type: NRG; PAM sequence: GGG
cctattcaacaaatggtgct

SEQ ID NO: 23043 - DNA, 20 bp, Artificial Sequence
  Description of Artificial Sequence: Synthetic oligonucleotide
  Target: SCN10A; (-) strand; PAM type: NRG; PAM sequence: TGG
ccctattcaacaaatggtgc

SEQ ID NO: 23044 - DNA, 20 bp, Artificial Sequence
  Description of Artificial Sequence: Synthetic oligonucleotide
  Target: SCN10A; (-) strand; PAM type: NRG; PAM sequence: TGG
aggacaccctattcaacaaa

SEQ ID NO: 23045 - DNA, 20 bp, Artificial Sequence
  Description of Artificial Sequence: Synthetic oligonucleotide
  Target: SCN10A; (-) strand; PAM type: NRG; PAM sequence: AGG
acaaaaacgtaagtggggaa

SEQ ID NO: 23046 - DNA, 20 bp, Artificial Sequence
  Description of Artificial Sequence: Synthetic oligonucleotide
  Target: SCN10A; (-) strand; PAM type: NRG; PAM sequence: AAG
aacaaaaacgtaagtgggga

SEQ ID NO: 23047 - DNA, 20 bp, Artificial Sequence
  Description of Artificial Sequence: Synthetic oligonucleotide
  Target: SCN10A; (-) strand; PAM type: NRG; PAM sequence: GGG
agcaaacaaaaacgtaagtg

SEQ ID NO: 23048 - DNA, 20 bp, Artificial Sequence
  Description of Artificial Sequence: Synthetic oligonucleotide
  Target: SCN10A; (-) strand; PAM type: NRG; PAM sequence: GGG
aagcaaacaaaaacgtaagt

SEQ ID NO: 23049 - DNA, 20 bp, Artificial Sequence
  Description of Artificial Sequence: Synthetic oligonucleotide
  Target: SCN10A; (-) strand; PAM type: NRG; PAM sequence: TGG
aaagcaaacaaaaacgtaag

SEQ ID NO: 23050 - DNA, 20 bp, Artificial Sequence
  Description of Artificial Sequence: Synthetic oligonucleotide
  Target: SCN10A; (-) strand; PAM type: NRG; PAM sequence: AAG
gaaaaagcaaacaaaaacgt

SEQ ID NO: 23051 - DNA, 20 bp, Artificial Sequence
  Description of Artificial Sequence: Synthetic oligonucleotide
  Target: SCN10A; (-) strand; PAM type: NRG; PAM sequence: AAG
caagcaactgatctttgaaa

SEQ ID NO: 23052 - DNA, 20 bp, Artificial Sequence
  Description of Artificial Sequence: Synthetic oligonucleotide
  Target: SCN10A; (-) strand; PAM type: NRG; PAM sequence: AAG
aaataaagccaaatacttac

SEQ ID NO: 23053 - DNA, 20 bp, Artificial Sequence
  Description of Artificial Sequence: Synthetic oligonucleotide
  Target: SCN10A; (-) strand; PAM type: NRG; PAM sequence: AAG
gaatagagaactcagaaata

SEQ ID NO: 23054 - DNA, 20 bp, Artificial Sequence
  Description of Artificial Sequence: Synthetic oligonucleotide
  Target: SCN10A; (-) strand; PAM type: NRG; PAM sequence: CAG
atggaaaagaatagagaact

SEQ ID NO: 23055 - DNA, 20 bp, Artificial Sequence
  Description of Artificial Sequence: Synthetic oligonucleotide
  Target: SCN10A; (-) strand; PAM type: NRG; PAM sequence: GAG
tagaccaatggaaaagaata

SEQ ID NO: 23056 - DNA, 20 bp, Artificial Sequence
  Description of Artificial Sequence: Synthetic oligonucleotide
  Target: SCN10A; (-) strand; PAM type: NRG; PAM sequence: TAG
catagaccaatggaaaagaa

SEQ ID NO: 23057 - DNA, 20 bp, Artificial Sequence
  Description of Artificial Sequence: Synthetic oligonucleotide
  Target: SCN10A; (-) strand; PAM type: NRG; PAM sequence: AAG
aagcacatagaccaatggaa

SEQ ID NO: 23058 - DNA, 20 bp, Artificial Sequence
  Description of Artificial Sequence: Synthetic oligonucleotide
  Target: SCN10A; (-) strand; PAM type: NRG; PAM sequence: TGG
aaaataagcacatagaccaa

SEQ ID NO: 23059 - DNA, 20 bp, Artificial Sequence
  Description of Artificial Sequence: Synthetic oligonucleotide
  Target: SCN10A; (-) strand; PAM type: NRG; PAM sequence: TAG
ctggtataaaaataagcaca

SEQ ID NO: 23060 - DNA, 20 bp, Artificial Sequence
  Description of Artificial Sequence: Synthetic oligonucleotide
  Target: SCN10A; (-) strand; PAM type: NRG; PAM sequence: AAG
catgatactggtataaaaat

SEQ ID NO: 23061 - DNA, 20 bp, Artificial Sequence
  Description of Artificial Sequence: Synthetic oligonucleotide
  Target: SCN10A; (-) strand; PAM type: NRG; PAM sequence: TGG
gtaccaaaacagcatgatac

SEQ ID NO: 23062 - DNA, 20 bp, Artificial Sequence
  Description of Artificial Sequence: Synthetic oligonucleotide
  Target: SCN10A; (-) strand; PAM type: NRG; PAM sequence: CAG
tagtatagcctgtaccaaaa

SEQ ID NO: 23063 - DNA, 20 bp, Artificial Sequence
  Description of Artificial Sequence: Synthetic oligonucleotide
  Target: SCN10A; (-) strand; PAM type: NRG; PAM sequence: TAG
tatactacaaggctatagta

SEQ ID NO: 23064 - DNA, 20 bp, Artificial Sequence
  Description of Artificial Sequence: Synthetic oligonucleotide
  Target: SCN10A; (-) strand; PAM type: NRG; PAM sequence: TAG
caaactatactacaaggcta

SEQ ID NO: 23065 - DNA, 20 bp, Artificial Sequence
  Description of Artificial Sequence: Synthetic oligonucleotide
  Target: SCN10A; (-) strand; PAM type: NRG; PAM sequence: AGG
tgatttcaaactatactaca

SEQ ID NO: 23066 - DNA, 20 bp, Artificial Sequence
  Description of Artificial Sequence: Synthetic oligonucleotide
  Target: SCN10A; (-) strand; PAM type: NRG; PAM sequence: AAG
ctgatttcaaactatactac

SEQ ID NO: 23067 - DNA, 20 bp, Artificial Sequence
  Description of Artificial Sequence: Synthetic oligonucleotide
  Target: SCN10A; (-) strand; PAM type: NRG; PAM sequence: TAG
caaatctggaggcatcacct

SEQ ID NO: 23068 - DNA, 20 bp, Artificial Sequence
  Description of Artificial Sequence: Synthetic oligonucleotide
  Target: SCN10A; (-) strand; PAM type: NRG; PAM sequence: AGG
agcaagaataacaaatctgg

SEQ ID NO: 23069 - DNA, 20 bp, Artificial Sequence
  Description of Artificial Sequence: Synthetic oligonucleotide
  Target: SCN10A; (-) strand; PAM type: NRG; PAM sequence: GAG
aagcaagaataacaaatctg

SEQ ID NO: 23070 - DNA, 20 bp, Artificial Sequence
  Description of Artificial Sequence: Synthetic oligonucleotide
  Target: SCN10A; (-) strand; PAM type: NRG; PAM sequence: TGG
ctaagcaagaataacaaatc

SEQ ID NO: 23071 - DNA, 20 bp, Artificial Sequence
  Description of Artificial Sequence: Synthetic oligonucleotide
  Target: SCN10A; (-) strand; PAM type: NRG; PAM sequence: AAG
tagccaaagcaagactaagc

SEQ ID NO: 23072 - DNA, 20 bp, Artificial Sequence
  Description of Artificial Sequence: Synthetic oligonucleotide
  Target: SCN10A; (-) strand; PAM type: NRG; PAM sequence: AAG
cacatagccaaagcaagact

SEQ ID NO: 23073 - DNA, 20 bp, Artificial Sequence
  Description of Artificial Sequence: Synthetic oligonucleotide
  Target: SCN10A; (-) strand; PAM type: NRG; PAM sequence: AAG
ggaatccacatagccaaagc

SEQ ID NO: 23074 - DNA, 20 bp, Artificial Sequence
  Description of Artificial Sequence: Synthetic oligonucleotide
  Target: SCN10A; (-) strand; PAM type: NRG; PAM sequence: AAG
aaaaggaatccacatagcca

SEQ ID NO: 23075 - DNA, 20 bp, Artificial Sequence
  Description of Artificial Sequence: Synthetic oligonucleotide
  Target: SCN10A; (-) strand; PAM type: NRG; PAM sequence: TAG
gaaccaaaaaggaatccaca

SEQ ID NO: 23076 - DNA, 20 bp, Artificial Sequence
  Description of Artificial Sequence: Synthetic oligonucleotide
  Target: SCN10A; (-) strand; PAM type: NRG; PAM sequence: AGG
aaattcatagggaaccaaaa

SEQ ID NO: 23077 - DNA, 20 bp, Artificial Sequence
  Description of Artificial Sequence: Synthetic oligonucleotide
  Target: SCN10A; (-) strand; PAM type: NRG; PAM sequence: AAG
aaaattcatagggaaccaaa

SEQ ID NO: 23078 - DNA, 20 bp, Artificial Sequence
  Description of Artificial Sequence: Synthetic oligonucleotide
  Target: SCN10A; (-) strand; PAM type: NRG; PAM sequence: GGG
taacaaccctaaaattcata

SEQ ID NO: 23079 - DNA, 20 bp, Artificial Sequence
  Description of Artificial Sequence: Synthetic oligonucleotide
  Target: SCN10A; (-) strand; PAM type: NRG; PAM sequence: AGG
ataacaaccctaaaattcat

SEQ ID NO: 23080 - DNA, 20 bp, Artificial Sequence
  Description of Artificial Sequence: Synthetic oligonucleotide
  Target: SCN10A; (-) strand; PAM type: NRG; PAM sequence: TAG
aataacaaccctaaaattca

SEQ ID NO: 23081 - DNA, 20 bp, Artificial Sequence
  Description of Artificial Sequence: Synthetic oligonucleotide
  Target: SCN10A; (-) strand; PAM type: NRG; PAM sequence: TAG
cacatcattcttcacagaaa

SEQ ID NO: 23082 - DNA, 20 bp, Artificial Sequence
  Description of Artificial Sequence: Synthetic oligonucleotide
  Target: SCN10A; (-) strand; PAM type: NRG; PAM sequence: CAG
aagtaccacatcattcttca

SEQ ID NO: 23083 - DNA, 20 bp, Artificial Sequence
  Description of Artificial Sequence: Synthetic oligonucleotide
  Target: SCN10A; (-) strand; PAM type: NRG; PAM sequence: AAG
attcaatacaatttccattg

SEQ ID NO: 23084 - DNA, 20 bp, Artificial Sequence
  Description of Artificial Sequence: Synthetic oligonucleotide
  Target: SCN10A; (-) strand; PAM type: NRG; PAM sequence: CAG
ttactgccaaaagcaatata

SEQ ID NO: 23085 - DNA, 20 bp, Artificial Sequence
  Description of Artificial Sequence: Synthetic oligonucleotide
  Target: SCN10A; (-) strand; PAM type: NRG; PAM sequence: AAG
gaaaatgaccttactgccaa

SEQ ID NO: 23086 - DNA, 20 bp, Artificial Sequence
  Description of Artificial Sequence: Synthetic oligonucleotide
  Target: SCN10A; (-) strand; PAM type: NRG; PAM sequence: TGG
acacatcccatgctcatgga

SEQ ID NO: 23087 - DNA, 20 bp, Artificial Sequence
  Description of Artificial Sequence: Synthetic oligonucleotide
  Target: SCN10A; (-) strand; PAM type: NRG; PAM sequence: TGG
gggaacacatcccatgctca

SEQ ID NO: 23088 - DNA, 20 bp, Artificial Sequence
  Description of Artificial Sequence: Synthetic oligonucleotide
  Target: SCN10A; (-) strand; PAM type: NRG; PAM sequence: GGG
cacagatgacacaaacaaat

SEQ ID NO: 23089 - DNA, 20 bp, Artificial Sequence
  Description of Artificial Sequence: Synthetic oligonucleotide
  Target: SCN10A; (-) strand; PAM type: NRG; PAM sequence: TGG
tcacagatgacacaaacaaa

SEQ ID NO: 23090 - DNA, 20 bp, Artificial Sequence
  Description of Artificial Sequence: Synthetic oligonucleotide
  Target: SCN10A; (-) strand; PAM type: NRG; PAM sequence: CAG
aacactgctaaaataaatca

SEQ ID NO: 23091 - DNA, 20 bp, Artificial Sequence
  Description of Artificial Sequence: Synthetic oligonucleotide
  Target: SCN10A; (-) strand; PAM type: NRG; PAM sequence: AGG
aaaggtgaaagatttctaca

SEQ ID NO: 23092 - DNA, 20 bp, Artificial Sequence
  Description of Artificial Sequence: Synthetic oligonucleotide
  Target: SCN10A; (-) strand; PAM type: NRG; PAM sequence: AAG
aaaaggtgaaagatttctac

SEQ ID NO: 23093 - DNA, 20 bp, Artificial Sequence
  Description of Artificial Sequence: Synthetic oligonucleotide
  Target: SCN10A; (-) strand; PAM type: NRG; PAM sequence: AAG
atacctaaccaaaaaggtga

SEQ ID NO: 23094 - DNA, 20 bp, Artificial Sequence
  Description of Artificial Sequence: Synthetic oligonucleotide
  Target: SCN10A; (-) strand; PAM type: NRG; PAM sequence: AGG
aggaatatacctaaccaaaa

SEQ ID NO: 23095 - DNA, 20 bp, Artificial Sequence
  Description of Artificial Sequence: Synthetic oligonucleotide
  Target: SCN10A; (-) strand; PAM type: NRG; PAM sequence: AAG
taggaatatacctaaccaaa

SEQ ID NO: 23096 - DNA, 20 bp, Artificial Sequence
  Description of Artificial Sequence: Synthetic oligonucleotide
  Target: SCN10A; (-) strand; PAM type: NRG; PAM sequence: AGG
aataaaaacaaaaaaatctt

SEQ ID NO: 23097 - DNA, 20 bp, Artificial Sequence
  Description of Artificial Sequence: Synthetic oligonucleotide
  Target: SCN10A; (-) strand; PAM type: NRG; PAM sequence: TAG
aaataaaaacaaaaaaatct

SEQ ID NO: 23098 - DNA, 20 bp, Artificial Sequence
  Description of Artificial Sequence: Synthetic oligonucleotide
  Target: SCN10A; (-) strand; PAM type: NRG; PAM sequence: CAG
gaactcaatcccttttacaa

SEQ ID NO: 23099 - DNA, 20 bp, Artificial Sequence
  Description of Artificial Sequence: Synthetic oligonucleotide
  Target: SCN10A; (-) strand; PAM type: NRG; PAM sequence: AAG
accaagctgaggaacaaatc

SEQ ID NO: 23100 - DNA, 20 bp, Artificial Sequence
  Description of Artificial Sequence: Synthetic oligonucleotide
  Target: SCN10A; (-) strand; PAM type: NRG; PAM sequence: AGG
caccaccagaaaccaagctg

SEQ ID NO: 23101 - DNA, 20 bp, Artificial Sequence
  Description of Artificial Sequence: Synthetic oligonucleotide
  Target: SCN10A; (-) strand; PAM type: NRG; PAM sequence: GAG
acaccaccagaaaccaagct

SEQ ID NO: 23102 - DNA, 20 bp, Artificial Sequence
  Description of Artificial Sequence: Synthetic oligonucleotide
  Target: SCN10A; (-) strand; PAM type: NRG; PAM sequence: AAG
actgtacaccaccagaaacc

SEQ ID NO: 23103 - DNA, 20 bp, Artificial Sequence
  Description of Artificial Sequence: Synthetic oligonucleotide
  Target: SCN10A; (-) strand; PAM type: NRG; PAM sequence: CAG
gcagcactactgtacaccac

SEQ ID NO: 23104 - DNA, 20 bp, Artificial Sequence
  Description of Artificial Sequence: Synthetic oligonucleotide
  Target: SCN10A; (-) strand; PAM type: NRG; PAM sequence: CAG
aaacaatgtatacaaatcag

SEQ ID NO: 23105 - DNA, 20 bp, Artificial Sequence
  Description of Artificial Sequence: Synthetic oligonucleotide
  Target: SCN10A; (-) strand; PAM type: NRG; PAM sequence: CAG
caaaaacaatgtatacaaat

SEQ ID NO: 23106 - DNA, 20 bp, Artificial Sequence
  Description of Artificial Sequence: Synthetic oligonucleotide
  Target: SCN10A; (-) strand; PAM type: NRG; PAM sequence: AGG
aatgaattcagtaaagtttc

SEQ ID NO: 23107 - DNA, 20 bp, Artificial Sequence
  Description of Artificial Sequence: Synthetic oligonucleotide
  Target: SCN10A; (-) strand; PAM type: NRG; PAM sequence: CAG
aaatgaattcagtaaagttt

SEQ ID NO: 23108 - DNA, 20 bp, Artificial Sequence
  Description of Artificial Sequence: Synthetic oligonucleotide
  Target: SCN10A; (-) strand; PAM type: NRG; PAM sequence: AAG
tctaataaatgaattcagta

SEQ ID NO: 23109 - DNA, 20 bp, Artificial Sequence
  Description of Artificial Sequence: Synthetic oligonucleotide
  Target: SCN10A; (-) strand; PAM type: NRG; PAM sequence: CAG
ctagatctaataaatgaatt

SEQ ID NO: 23110 - DNA, 20 bp, Artificial Sequence
  Description of Artificial Sequence: Synthetic oligonucleotide
  Target: SCN10A; (-) strand; PAM type: NRG; PAM sequence: TAG
agactcatccaaaaagctcc

SEQ ID NO: 23111 - DNA, 20 bp, Artificial Sequence
  Description of Artificial Sequence: Synthetic oligonucleotide
  Target: SCN10A; (-) strand; PAM type: NRG; PAM sequence: AAG
accctaaagactcatccaaa

SEQ ID NO: 23112 - DNA, 20 bp, Artificial Sequence
  Description of Artificial Sequence: Synthetic oligonucleotide
  Target: SCN10A; (-) strand; PAM type: NRG; PAM sequence: AAG
cgtatgcctaggaaacccta

SEQ ID NO: 23113 - DNA, 20 bp, Artificial Sequence
  Description of Artificial Sequence: Synthetic oligonucleotide
  Target: SCN10A; (-) strand; PAM type: NRG; PAM sequence: AGG
aatgatatgatcgtatgcct

SEQ ID NO: 23114 - DNA, 20 bp, Artificial Sequence
  Description of Artificial Sequence: Synthetic oligonucleotide
  Target: SCN10A; (-) strand; PAM type: NRG; PAM sequence: TAG
caatgatatgatcgtatgcc

SEQ ID NO: 23115 - DNA, 20 bp, Artificial Sequence
  Description of Artificial Sequence: Synthetic oligonucleotide
  Target: SCN10A; (-) strand; PAM type: NRG; PAM sequence: AAG
aatccaaatcagtaaagggg

SEQ ID NO: 23116 - DNA, 20 bp, Artificial Sequence
  Description of Artificial Sequence: Synthetic oligonucleotide
  Target: SCN10A; (-) strand; PAM type: NRG; PAM sequence: GGG
gggaatccaaatcagtaaag

SEQ ID NO: 23117 - DNA, 20 bp, Artificial Sequence
  Description of Artificial Sequence: Synthetic oligonucleotide
  Target: SCN10A; (-) strand; PAM type: NRG; PAM sequence: GGG
agggaatccaaatcagtaaa

SEQ ID NO: 23118 - DNA, 20 bp, Artificial Sequence
  Description of Artificial Sequence: Synthetic oligonucleotide
  Target: SCN10A; (-) strand; PAM type: NRG; PAM sequence: AGG
aagggaatccaaatcagtaa

SEQ ID NO: 23119 - DNA, 20 bp, Artificial Sequence
  Description of Artificial Sequence: Synthetic oligonucleotide
  Target: SCN10A; (-) strand; PAM type: NRG; PAM sequence: AAG
aaagggaatccaaatcagta

SEQ ID NO: 23120 - DNA, 20 bp, Artificial Sequence
  Description of Artificial Sequence: Synthetic oligonucleotide
  Target: SCN10A; (-) strand; PAM type: NRG; PAM sequence: CAG
taaataaagggaatccaaat

SEQ ID NO: 23121 - DNA, 20 bp, Artificial Sequence
  Description of Artificial Sequence: Synthetic oligonucleotide
  Target: SCN10A; (-) strand; PAM type: NRG; PAM sequence: GGG
agacaagagaaataaataaa

SEQ ID NO: 23122 - DNA, 20 bp, Artificial Sequence
  Description of Artificial Sequence: Synthetic oligonucleotide
  Target: SCN10A; (-) strand; PAM type: NRG; PAM sequence: AGG
cagacaagagaaataaataa

SEQ ID NO: 23123 - DNA, 20 bp, Artificial Sequence
  Description of Artificial Sequence: Synthetic oligonucleotide
  Target: SCN10A; (-) strand; PAM type: NRG; PAM sequence: AAG
tcagacaagagaaataaata

SEQ ID NO: 23124 - DNA, 20 bp, Artificial Sequence
  Description of Artificial Sequence: Synthetic oligonucleotide
  Target: SCN10A; (-) strand; PAM type: NRG; PAM sequence: GAG
tagccagagcaatcagacaa

SEQ ID NO: 23125 - DNA, 20 bp, Artificial Sequence
  Description of Artificial Sequence: Synthetic oligonucleotide
  Target: SCN10A; (-) strand; PAM type: NRG; PAM sequence: AAG
cctagccagagcaatcagac

SEQ ID NO: 23126 - DNA, 20 bp, Artificial Sequence
  Description of Artificial Sequence: Synthetic oligonucleotide
  Target: SCN10A; (-) strand; PAM type: NRG; PAM sequence: CAG
gaagtcctagccagagcaat

SEQ ID NO: 23127 - DNA, 20 bp, Artificial Sequence
  Description of Artificial Sequence: Synthetic oligonucleotide
  Target: SCN10A; (-) strand; PAM type: NRG; PAM sequence: GAG
agtactggaagtcctagcca

SEQ ID NO: 23128 - DNA, 20 bp, Artificial Sequence
  Description of Artificial Sequence: Synthetic oligonucleotide
  Target: SCN10A; (-) strand; PAM type: NRG; PAM sequence: CAG
atagtactggaagtcctagc

SEQ ID NO: 23129 - DNA, 20 bp, Artificial Sequence
  Description of Artificial Sequence: Synthetic oligonucleotide
  Target: SCN10A; (-) strand; PAM type: NRG; PAM sequence: TAG
caacatagtactggaagtcc

SEQ ID NO: 23130 - DNA, 20 bp, Artificial Sequence
  Description of Artificial Sequence: Synthetic oligonucleotide
  Target: SCN10A; (-) strand; PAM type: NRG; PAM sequence: AAG
tctatccaacatagtactgg

SEQ ID NO: 23131 - DNA, 20 bp, Artificial Sequence
  Description of Artificial Sequence: Synthetic oligonucleotide
  Target: SCN10A; (-) strand; PAM type: NRG; PAM sequence: TGG
atttctatccaacatagtac

SEQ ID NO: 23132 - DNA, 20 bp, Artificial Sequence
  Description of Artificial Sequence: Synthetic oligonucleotide
  Target: SCN10A; (-) strand; PAM type: NRG; PAM sequence: TAG
ttcaccatttctatccaaca

SEQ ID NO: 23133 - DNA, 20 bp, Artificial Sequence
  Description of Artificial Sequence: Synthetic oligonucleotide
  Target: SCN10A; (-) strand; PAM type: NRG; PAM sequence: AGG
ctgagaactgaaacaagaca

SEQ ID NO: 23134 - DNA, 20 bp, Artificial Sequence
  Description of Artificial Sequence: Synthetic oligonucleotide
  Target: SCN10A; (-) strand; PAM type: NRG; PAM sequence: AAG
cctgagaactgaaacaagac

SEQ ID NO: 23135 - DNA, 20 bp, Artificial Sequence
  Description of Artificial Sequence: Synthetic oligonucleotide
  Target: SCN10A; (-) strand; PAM type: NRG; PAM sequence: AAG
ttccccctgagaactgaaac

SEQ ID NO: 23136 - DNA, 20 bp, Artificial Sequence
  Description of Artificial Sequence: Synthetic oligonucleotide
  Target: SCN10A; (-) strand; PAM type: NRG; PAM sequence: GAG
aagttgaaagcattccccct

SEQ ID NO: 23137 - DNA, 20 bp, Artificial Sequence
  Description of Artificial Sequence: Synthetic oligonucleotide
  Target: SCN10A; (-) strand; PAM type: NRG; PAM sequence: AAG
accaaacagggaaaagttga

SEQ ID NO: 23138 - DNA, 20 bp, Artificial Sequence
  Description of Artificial Sequence: Synthetic oligonucleotide
  Target: SCN10A; (-) strand; PAM type: NRG; PAM sequence: AAG
acattataccaaacagggaa

SEQ ID NO: 23139 - DNA, 20 bp, Artificial Sequence
  Description of Artificial Sequence: Synthetic oligonucleotide
  Target: SCN10A; (-) strand; PAM type: NRG; PAM sequence: GGG
agccaacattataccaaaca

SEQ ID NO: 23140 - DNA, 20 bp, Artificial Sequence
  Description of Artificial Sequence: Synthetic oligonucleotide
  Target: SCN10A; (-) strand; PAM type: NRG; PAM sequence: AGG
cagccaacattataccaaac

SEQ ID NO: 23141 - DNA, 20 bp, Artificial Sequence
  Description of Artificial Sequence: Synthetic oligonucleotide
  Target: SCN10A; (-) strand; PAM type: NRG; PAM sequence: CAG
acagccaacattataccaaa

SEQ ID NO: 23142 - DNA, 20 bp, Artificial Sequence
  Description of Artificial Sequence: Synthetic oligonucleotide
  Target: SCN10A; (-) strand; PAM type: NRG; PAM sequence: CAG
agccatctatgacaaatcca

SEQ ID NO: 23143 - DNA, 20 bp, Artificial Sequence
  Description of Artificial Sequence: Synthetic oligonucleotide
  Target: SCN10A; (-) strand; PAM type: NRG; PAM sequence: AAG
gacatactccaaggtaataa

SEQ ID NO: 23144 - DNA, 20 bp, Artificial Sequence
  Description of Artificial Sequence: Synthetic oligonucleotide
  Target: SCN10A; (-) strand; PAM type: NRG; PAM sequence: AGG
catagaagggacatactcca

SEQ ID NO: 23145 - DNA, 20 bp, Artificial Sequence
  Description of Artificial Sequence: Synthetic oligonucleotide
  Target: SCN10A; (-) strand; PAM type: NRG; PAM sequence: AAG
gcatagaagggacatactcc

SEQ ID NO: 23146 - DNA, 20 bp, Artificial Sequence
  Description of Artificial Sequence: Synthetic oligonucleotide
  Target: SCN10A; (-) strand; PAM type: NRG; PAM sequence: GGG
tcaaccaaattggcatagaa

SEQ ID NO: 23147 - DNA, 20 bp, Artificial Sequence
  Description of Artificial Sequence: Synthetic oligonucleotide
  Target: SCN10A; (-) strand; PAM type: NRG; PAM sequence: AGG
ctcaaccaaattggcataga

SEQ ID NO: 23148 - DNA, 20 bp, Artificial Sequence
  Description of Artificial Sequence: Synthetic oligonucleotide
  Target: SCN10A; (-) strand; PAM type: NRG; PAM sequence: AAG
cctcaaccaaattggcatag

SEQ ID NO: 23149 - DNA, 20 bp, Artificial Sequence
  Description of Artificial Sequence: Synthetic oligonucleotide
  Target: SCN10A; (-) strand; PAM type: NRG; PAM sequence: TAG
aaccctcaaccaaattggca

SEQ ID NO: 23150 - DNA, 20 bp, Artificial Sequence
  Description of Artificial Sequence: Synthetic oligonucleotide
  Target: SCN10A; (-) strand; PAM type: NRG; PAM sequence: TGG
attaaaaccctcaaccaaat

SEQ ID NO: 23151 - DNA, 20 bp, Artificial Sequence
  Description of Artificial Sequence: Synthetic oligonucleotide
  Target: SCN10A; (-) strand; PAM type: NRG; PAM sequence: CAG
gaaaagcatttgacaaaatc

SEQ ID NO: 23152 - DNA, 20 bp, Artificial Sequence
  Description of Artificial Sequence: Synthetic oligonucleotide
  Target: SCN10A; (-) strand; PAM type: NRG; PAM sequence: AAG
catctcaataggtgcaggaa

SEQ ID NO: 23153 - DNA, 20 bp, Artificial Sequence
  Description of Artificial Sequence: Synthetic oligonucleotide
  Target: SCN10A; (-) strand; PAM type: NRG; PAM sequence: AGG
atgatcatctcaataggtgc

SEQ ID NO: 23154 - DNA, 20 bp, Artificial Sequence
  Description of Artificial Sequence: Synthetic oligonucleotide
  Target: SCN10A; (-) strand; PAM type: NRG; PAM sequence: CAG
tatgatcatctcaataggtg

SEQ ID NO: 23155 - DNA, 20 bp, Artificial Sequence
  Description of Artificial Sequence: Synthetic oligonucleotide
  Target: SCN10A; (-) strand; PAM type: NRG; PAM sequence: AGG
aatcatatgatcatctcaat

SEQ ID NO: 23156 - DNA, 20 bp, Artificial Sequence
  Description of Artificial Sequence: Synthetic oligonucleotide
  Target: SCN10A; (-) strand; PAM type: NRG; PAM sequence: TAG
aaatcatatgatcatctcaa

SEQ ID NO: 23157 - DNA, 20 bp, Artificial Sequence
  Description of Artificial Sequence: Synthetic oligonucleotide
  Target: SCN10A; (-) strand; PAM type: NRG; PAM sequence: CAG
aatgctgcacgtcacataaa

SEQ ID NO: 23158 - DNA, 20 bp, Artificial Sequence
  Description of Artificial Sequence: Synthetic oligonucleotide
  Target: SCN10A; (-) strand; PAM type: NRG; PAM sequence: AAG
agggatgatttaacatacac

SEQ ID NO: 23159 - DNA, 20 bp, Artificial Sequence
  Description of Artificial Sequence: Synthetic oligonucleotide
  Target: SCN10A; (-) strand; PAM type: NRG; PAM sequence: GGG
ggtttcataccagggaggta

SEQ ID NO: 23160 - DNA, 20 bp, Artificial Sequence
  Description of Artificial Sequence: Synthetic oligonucleotide
  Target: SCN10A; (-) strand; PAM type: NRG; PAM sequence: AGG
gggtttcataccagggaggt

SEQ ID NO: 23161 - DNA, 20 bp, Artificial Sequence
  Description of Artificial Sequence: Synthetic oligonucleotide
  Target: SCN10A; (-) strand; PAM type: NRG; PAM sequence: TAG
ggggtttcataccagggagg

SEQ ID NO: 23162 - DNA, 20 bp, Artificial Sequence
  Description of Artificial Sequence: Synthetic oligonucleotide
  Target: SCN10A; (-) strand; PAM type: NRG; PAM sequence: AGG
aagggggtttcataccaggg

SEQ ID NO: 23163 - DNA, 20 bp, Artificial Sequence
  Description of Artificial Sequence: Synthetic oligonucleotide
  Target: SCN10A; (-) strand; PAM type: NRG; PAM sequence: GAG
caagggggtttcataccagg

SEQ ID NO: 23164 - DNA, 20 bp, Artificial Sequence
  Description of Artificial Sequence: Synthetic oligonucleotide
  Target: SCN10A; (-) strand; PAM type: NRG; PAM sequence: GGG
atcaagggggtttcatacca

SEQ ID NO: 23165 - DNA, 20 bp, Artificial Sequence
  Description of Artificial Sequence: Synthetic oligonucleotide
  Target: SCN10A; (-) strand; PAM type: NRG; PAM sequence: AGG
gatcaagggggtttcatacc

SEQ ID NO: 23166 - DNA, 20 bp, Artificial Sequence
  Description of Artificial Sequence: Synthetic oligonucleotide
  Target: SCN10A; (-) strand; PAM type: NRG; PAM sequence: CAG
tgatcaagggggtttcatac

SEQ ID NO: 23167 - DNA, 20 bp, Artificial Sequence
  Description of Artificial Sequence: Synthetic oligonucleotide
  Target: SCN10A; (-) strand; PAM type: NRG; PAM sequence: GGG
ataacacaccatgatcaagg

SEQ ID NO: 23168 - DNA, 20 bp, Artificial Sequence
  Description of Artificial Sequence: Synthetic oligonucleotide
  Target: SCN10A; (-) strand; PAM type: NRG; PAM sequence: GGG
gataacacaccatgatcaag

SEQ ID NO: 23169 - DNA, 20 bp, Artificial Sequence
  Description of Artificial Sequence: Synthetic oligonucleotide
  Target: SCN10A; (-) strand; PAM type: NRG; PAM sequence: GGG
agataacacaccatgatcaa

SEQ ID NO: 23170 - DNA, 20 bp, Artificial Sequence
  Description of Artificial Sequence: Synthetic oligonucleotide
  Target: SCN10A; (-) strand; PAM type: NRG; PAM sequence: AGG
aagataacacaccatgatca

SEQ ID NO: 23171 - DNA, 20 bp, Artificial Sequence
  Description of Artificial Sequence: Synthetic oligonucleotide
  Target: SCN10A; (-) strand; PAM type: NRG; PAM sequence: AAG
aaagataacacaccatgatc

SEQ ID NO: 23172 - DNA, 20 bp, Artificial Sequence
  Description of Artificial Sequence: Synthetic oligonucleotide
  Target: SCN10A; (-) strand; PAM type: NRG; PAM sequence: AAG
tgaatccaacacatatccaa

SEQ ID NO: 23173 - DNA, 20 bp, Artificial Sequence
  Description of Artificial Sequence: Synthetic oligonucleotide
  Target: SCN10A; (-) strand; PAM type: NRG; PAM sequence: TAG
aaaaatcctcaacaaaatgc

SEQ ID NO: 23174 - DNA, 20 bp, Artificial Sequence
  Description of Artificial Sequence: Synthetic oligonucleotide
  Target: SCN10A; (-) strand; PAM type: NRG; PAM sequence: TAG
gacaatatccctgatgaaca

SEQ ID NO: 23175 - DNA, 20 bp, Artificial Sequence
  Description of Artificial Sequence: Synthetic oligonucleotide
  Target: SCN10A; (-) strand; PAM type: NRG; PAM sequence: CAG
ggacttttaaaaaagaacta

SEQ ID NO: 23176 - DNA, 20 bp, Artificial Sequence
  Description of Artificial Sequence: Synthetic oligonucleotide
  Target: SCN10A; (-) strand; PAM type: NRG; PAM sequence: AAG
ccagaaaaggacttttaaaa

SEQ ID NO: 23177 - DNA, 20 bp, Artificial Sequence
  Description of Artificial Sequence: Synthetic oligonucleotide
  Target: SCN10A; (-) strand; PAM type: NRG; PAM sequence: AGG
cctaataccaaaaccagaaa

SEQ ID NO: 23178 - DNA, 20 bp, Artificial Sequence
  Description of Artificial Sequence: Synthetic oligonucleotide
  Target: SCN10A; (-) strand; PAM type: NRG; PAM sequence: AAG
ccctaataccaaaaccagaa

SEQ ID NO: 23179 - DNA, 20 bp, Artificial Sequence
  Description of Artificial Sequence: Synthetic oligonucleotide
  Target: SCN10A; (-) strand; PAM type: NRG; PAM sequence: CAG
tatcaccctaataccaaaac

SEQ ID NO: 23180 - DNA, 20 bp, Artificial Sequence
  Description of Artificial Sequence: Synthetic oligonucleotide
  Target: SCN10A; (-) strand; PAM type: NRG; PAM sequence: CAG
cctaaatcattttatgaagc

SEQ ID NO: 23181 - DNA, 20 bp, Artificial Sequence
  Description of Artificial Sequence: Synthetic oligonucleotide
  Target: SCN10A; (-) strand; PAM type: NRG; PAM sequence: AAG
tcctcctaaatcattttatg

SEQ ID NO: 23182 - DNA, 20 bp, Artificial Sequence
  Description of Artificial Sequence: Synthetic oligonucleotide
  Target: SCN10A; (-) strand; PAM type: NRG; PAM sequence: GGG
ttccaaaagatgcagaaaga

SEQ ID NO: 23183 - DNA, 20 bp, Artificial Sequence
  Description of Artificial Sequence: Synthetic oligonucleotide
  Target: SCN10A; (-) strand; PAM type: NRG; PAM sequence: AGG
attccaaaagatgcagaaag

SEQ ID NO: 23184 - DNA, 20 bp, Artificial Sequence
  Description of Artificial Sequence: Synthetic oligonucleotide
  Target: SCN10A; (-) strand; PAM type: NRG; PAM sequence: GAG
tattccaaaagatgcagaaa

SEQ ID NO: 23185 - DNA, 20 bp, Artificial Sequence
  Description of Artificial Sequence: Synthetic oligonucleotide
  Target: SCN10A; (-) strand; PAM type: NRG; PAM sequence: AAG
actattccaaaagatgcaga

SEQ ID NO: 23186 - DNA, 20 bp, Artificial Sequence
  Description of Artificial Sequence: Synthetic oligonucleotide
  Target: SCN10A; (-) strand; PAM type: NRG; PAM sequence: CAG
tgaaactattccaaaagatg

SEQ ID NO: 23187 - DNA, 20 bp, Artificial Sequence
  Description of Artificial Sequence: Synthetic oligonucleotide
  Target: SCN10A; (-) strand; PAM type: NRG; PAM sequence: AAG
ttttattgaaactattccaa

SEQ ID NO: 23188 - DNA, 20 bp, Artificial Sequence
  Description of Artificial Sequence: Synthetic oligonucleotide
  Target: SCN10A; (-) strand; PAM type: NRG; PAM sequence: TGG
tcagacattcaaagaagaat

SEQ ID NO: 23189 - DNA, 20 bp, Artificial Sequence
  Description of Artificial Sequence: Synthetic oligonucleotide
  Target: SCN10A; (-) strand; PAM type: NRG; PAM sequence: AAG
attctatcagacattcaaag

SEQ ID NO: 23190 - DNA, 20 bp, Artificial Sequence
  Description of Artificial Sequence: Synthetic oligonucleotide
  Target: SCN10A; (-) strand; PAM type: NRG; PAM sequence: AAG
tgaattctatcagacattca

SEQ ID NO: 23191 - DNA, 20 bp, Artificial Sequence
  Description of Artificial Sequence: Synthetic oligonucleotide
  Target: SCN10A; (-) strand; PAM type: NRG; PAM sequence: CAG
gattcacagctgaattctat

SEQ ID NO: 23192 - DNA, 20 bp, Artificial Sequence
  Description of Artificial Sequence: Synthetic oligonucleotide
  Target: SCN10A; (-) strand; PAM type: NRG; PAM sequence: CAG
ccaggagcagactggattca

SEQ ID NO: 23193 - DNA, 20 bp, Artificial Sequence
  Description of Artificial Sequence: Synthetic oligonucleotide
  Target: SCN10A; (-) strand; PAM type: NRG; PAM sequence: TGG
aaaaaagtccaggagcagac

SEQ ID NO: 23194 - DNA, 20 bp, Artificial Sequence
  Description of Artificial Sequence: Synthetic oligonucleotide
  Target: SCN10A; (-) strand; PAM type: NRG; PAM sequence: CAG
aaggaaaaaaagtccaggag

SEQ ID NO: 23195 - DNA, 20 bp, Artificial Sequence
  Description of Artificial Sequence: Synthetic oligonucleotide
  Target: SCN10A; (-) strand; PAM type: NRG; PAM sequence: GAG
gccaaggaaaaaaagtccag

SEQ ID NO: 23196 - DNA, 20 bp, Artificial Sequence
  Description of Artificial Sequence: Synthetic oligonucleotide
  Target: SCN10A; (-) strand; PAM type: NRG; PAM sequence: AGG
ttgccaaggaaaaaaagtcc

SEQ ID NO: 23197 - DNA, 20 bp, Artificial Sequence
  Description of Artificial Sequence: Synthetic oligonucleotide
  Target: SCN10A; (-) strand; PAM type: NRG; PAM sequence: CAG
attgccaaggaaaaaaagtc

SEQ ID NO: 23198 - DNA, 20 bp, Artificial Sequence
  Description of Artificial Sequence: Synthetic oligonucleotide
  Target: SCN10A; (-) strand; PAM type: NRG; PAM sequence: AAG
caaaaattgccaaggaaaaa

SEQ ID NO: 23199 - DNA, 20 bp, Artificial Sequence
  Description of Artificial Sequence: Synthetic oligonucleotide
  Target: SCN10A; (-) strand; PAM type: NRG; PAM sequence: AGG
cagtaattcaaaaattgcca

SEQ ID NO: 23200 - DNA, 20 bp, Artificial Sequence
  Description of Artificial Sequence: Synthetic oligonucleotide
  Target: SCN10A; (-) strand; PAM type: NRG; PAM sequence: AAG
acagtaattcaaaaattgcc

SEQ ID NO: 23201 - DNA, 20 bp, Artificial Sequence
  Description of Artificial Sequence: Synthetic oligonucleotide
  Target: SCN10A; (-) strand; PAM type: NRG; PAM sequence: CAG
aacaagtagcgagattgaaa

SEQ ID NO: 23202 - DNA, 20 bp, Artificial Sequence
  Description of Artificial Sequence: Synthetic oligonucleotide
  Target: SCN10A; (-) strand; PAM type: NRG; PAM sequence: GAG
acagaccaataacaagtagc

SEQ ID NO: 23203 - DNA, 20 bp, Artificial Sequence
  Description of Artificial Sequence: Synthetic oligonucleotide
  Target: SCN10A; (-) strand; PAM type: NRG; PAM sequence: TAG
ctaaacagaccaataacaag

SEQ ID NO: 23204 - DNA, 20 bp, Artificial Sequence
  Description of Artificial Sequence: Synthetic oligonucleotide
  Target: SCN10A; (-) strand; PAM type: NRG; PAM sequence: AAG
actctaaacagaccaataac

SEQ ID NO: 23205 - DNA, 20 bp, Artificial Sequence
  Description of Artificial Sequence: Synthetic oligonucleotide
  Target: SCN10A; (-) strand; PAM type: NRG; PAM sequence: CAG
aaagtaatagaaactctaaa

SEQ ID NO: 23206 - DNA, 20 bp, Artificial Sequence
  Description of Artificial Sequence: Synthetic oligonucleotide
  Target: SCN10A; (-) strand; PAM type: NRG; PAM sequence: TAG
tagattaaatcagaaagtaa

SEQ ID NO: 23207 - DNA, 20 bp, Artificial Sequence
  Description of Artificial Sequence: Synthetic oligonucleotide
  Target: SCN10A; (-) strand; PAM type: NRG; PAM sequence: AAG
ctgtcttagattaaatcaga

SEQ ID NO: 23208 - DNA, 20 bp, Artificial Sequence
  Description of Artificial Sequence: Synthetic oligonucleotide
  Target: SCN10A; (-) strand; PAM type: NRG; PAM sequence: CAG
acaactgtcttagattaaat

SEQ ID NO: 23209 - DNA, 20 bp, Artificial Sequence
  Description of Artificial Sequence: Synthetic oligonucleotide
  Target: SCN10A; (-) strand; PAM type: NRG; PAM sequence: TAG
ctggaaatatacaactgtct

SEQ ID NO: 23210 - DNA, 20 bp, Artificial Sequence
  Description of Artificial Sequence: Synthetic oligonucleotide
  Target: SCN10A; (-) strand; PAM type: NRG; PAM sequence: TGG
agaggagatgaataaattcc

SEQ ID NO: 23211 - DNA, 20 bp, Artificial Sequence
  Description of Artificial Sequence: Synthetic oligonucleotide
  Target: SCN10A; (-) strand; PAM type: NRG; PAM sequence: GAG
acaaactagaaaatttagag

SEQ ID NO: 23212 - DNA, 20 bp, Artificial Sequence
  Description of Artificial Sequence: Synthetic oligonucleotide
  Target: SCN10A; (-) strand; PAM type: NRG; PAM sequence: AGG
gcacaaactagaaaatttag

SEQ ID NO: 23213 - DNA, 20 bp, Artificial Sequence
  Description of Artificial Sequence: Synthetic oligonucleotide
  Target: SCN10A; (-) strand; PAM type: NRG; PAM sequence: GAG
tgcacaaactagaaaattta

SEQ ID NO: 23214 - DNA, 20 bp, Artificial Sequence
  Description of Artificial Sequence: Synthetic oligonucleotide
  Target: SCN10A; (-) strand; PAM type: NRG; PAM sequence: TAG
tttgcacaaactagaaaatt

SEQ ID NO: 23215 - DNA, 20 bp, Artificial Sequence
  Description of Artificial Sequence: Synthetic oligonucleotide
  Target: SCN10A; (-) strand; PAM type: NRG; PAM sequence: TAG
acacctttatttgcacaaac

SEQ ID NO: 23216 - DNA, 20 bp, Artificial Sequence
  Description of Artificial Sequence: Synthetic oligonucleotide
  Target: SCN10A; (-) strand; PAM type: NRG; PAM sequence: AGG
tacaaaaaaaaaatcattca

SEQ ID NO: 23217 - DNA, 20 bp, Artificial Sequence
  Description of Artificial Sequence: Synthetic oligonucleotide
  Target: SCN10A; (-) strand; PAM type: NRG; PAM sequence: AAG
atacaaaaaaaaaatcattc

SEQ ID NO: 23218 - DNA, 20 bp, Artificial Sequence
  Description of Artificial Sequence: Synthetic oligonucleotide
  Target: SCN10A; (-) strand; PAM type: NRG; PAM sequence: CAG
agatattacaactgatacca

SEQ ID NO: 23219 - DNA, 20 bp, Artificial Sequence
  Description of Artificial Sequence: Synthetic oligonucleotide
  Target: SCN10A; (-) strand; PAM type: NRG; PAM sequence: GAG
ctcaattagaaataaaatgg

SEQ ID NO: 23220 - DNA, 20 bp, Artificial Sequence
  Description of Artificial Sequence: Synthetic oligonucleotide
  Target: SCN10A; (-) strand; PAM type: NRG; PAM sequence: GGG
agctcaattagaaataaaat

SEQ ID NO: 23221 - DNA, 20 bp, Artificial Sequence
  Description of Artificial Sequence: Synthetic oligonucleotide
  Target: SCN10A; (-) strand; PAM type: NRG; PAM sequence: TGG
aagctcaattagaaataaaa

SEQ ID NO: 23222 - DNA, 20 bp, Artificial Sequence
  Description of Artificial Sequence: Synthetic oligonucleotide
  Target: SCN10A; (-) strand; PAM type: NRG; PAM sequence: TAG
aagatccaaataagctcaat

SEQ ID NO: 23223 - DNA, 20 bp, Artificial Sequence
  Description of Artificial Sequence: Synthetic oligonucleotide
  Target: SCN10A; (-) strand; PAM type: NRG; PAM sequence: AAG
agaagagagaagatccaaat

SEQ ID NO: 23224 - DNA, 20 bp, Artificial Sequence
  Description of Artificial Sequence: Synthetic oligonucleotide
  Target: SCN10A; (-) strand; PAM type: NRG; PAM sequence: AAG
taaccaagaaaagaagagag

SEQ ID NO: 23225 - DNA, 20 bp, Artificial Sequence
  Description of Artificial Sequence: Synthetic oligonucleotide
  Target: SCN10A; (-) strand; PAM type: NRG; PAM sequence: GAG
gattaaccaagaaaagaaga

SEQ ID NO: 23226 - DNA, 20 bp, Artificial Sequence
  Description of Artificial Sequence: Synthetic oligonucleotide
  Target: SCN10A; (-) strand; PAM type: NRG; PAM sequence: GAG
aagattaaccaagaaaagaa

SEQ ID NO: 23227 - DNA, 20 bp, Artificial Sequence
  Description of Artificial Sequence: Synthetic oligonucleotide
  Target: SCN10A; (-) strand; PAM type: NRG; PAM sequence: AAG
gcaagattaaccaagaaaag

SEQ ID NO: 23228 - DNA, 20 bp, Artificial Sequence
  Description of Artificial Sequence: Synthetic oligonucleotide
  Target: SCN10A; (-) strand; PAM type: NRG; PAM sequence: AAG
ttggcaagattaaccaagaa

SEQ ID NO: 23229 - DNA, 20 bp, Artificial Sequence
  Description of Artificial Sequence: Synthetic oligonucleotide
  Target: SCN10A; (-) strand; PAM type: NRG; PAM sequence: AAG
gaccattggcaagattaacc

SEQ ID NO: 23230 - DNA, 20 bp, Artificial Sequence
  Description of Artificial Sequence: Synthetic oligonucleotide
  Target: SCN10A; (-) strand; PAM type: NRG; PAM sequence: AAG
aaaattgattgaccattggc

SEQ ID NO: 23231 - DNA, 20 bp, Artificial Sequence
  Description of Artificial Sequence: Synthetic oligonucleotide
  Target: SCN10A; (-) strand; PAM type: NRG; PAM sequence: TGG
atagaaaattgattgaccat

SEQ ID NO: 23232 - DNA, 20 bp, Artificial Sequence
  Description of Artificial Sequence: Synthetic oligonucleotide
  Target: SCN10A; (-) strand; PAM type: NRG; PAM sequence: TAG
gcgggttctttaaaaagata

SEQ ID NO: 23233 - DNA, 20 bp, Artificial Sequence
  Description of Artificial Sequence: Synthetic oligonucleotide
  Target: SCN10A; (-) strand; PAM type: NRG; PAM sequence: AAG
caaaaagcgggttctttaaa

SEQ ID NO: 23234 - DNA, 20 bp, Artificial Sequence
  Description of Artificial Sequence: Synthetic oligonucleotide
  Target: SCN10A; (-) strand; PAM type: NRG; PAM sequence: GGG
agataagtgaaacaaaaagc

SEQ ID NO: 23235 - DNA, 20 bp, Artificial Sequence
  Description of Artificial Sequence: Synthetic oligonucleotide
  Target: SCN10A; (-) strand; PAM type: NRG; PAM sequence: CGG
aagataagtgaaacaaaaag

SEQ ID NO: 23236 - DNA, 20 bp, Artificial Sequence
  Description of Artificial Sequence: Synthetic oligonucleotide
  Target: SCN10A; (-) strand; PAM type: NRG; PAM sequence: AAG
caaaagataagtgaaacaaa

SEQ ID NO: 23237 - DNA, 20 bp, Artificial Sequence
  Description of Artificial Sequence: Synthetic oligonucleotide
  Target: SCN10A; (-) strand; PAM type: NRG; PAM sequence: AAG
ataataataatacaaaagat

SEQ ID NO: 23238 - DNA, 20 bp, Artificial Sequence
  Description of Artificial Sequence: Synthetic oligonucleotide
  Target: SCN10A; (-) strand; PAM type: NRG; PAM sequence: AAG
taaaaataataataatacaa

SEQ ID NO: 23239 - DNA, 20 bp, Artificial Sequence
  Description of Artificial Sequence: Synthetic oligonucleotide
  Target: SCN10A; (-) strand; PAM type: NRG; PAM sequence: CAG
aggaataacaaagatcaggg

SEQ ID NO: 23240 - DNA, 20 bp, Artificial Sequence
  Description of Artificial Sequence: Synthetic oligonucleotide
  Target: SCN10A; (-) strand; PAM type: NRG; PAM sequence: GGG
aaaaggaataacaaagatca

SEQ ID NO: 23241 - DNA, 20 bp, Artificial Sequence
  Description of Artificial Sequence: Synthetic oligonucleotide
  Target: SCN10A; (-) strand; PAM type: NRG; PAM sequence: AGG
gaaaaggaataacaaagatc

SEQ ID NO: 23242 - DNA, 20 bp, Artificial Sequence
  Description of Artificial Sequence: Synthetic oligonucleotide
  Target: SCN10A; (-) strand; PAM type: NRG; PAM sequence: CAG
agaaaaggaataacaaagat

SEQ ID NO: 23243 - DNA, 20 bp, Artificial Sequence
  Description of Artificial Sequence: Synthetic oligonucleotide
  Target: SCN10A; (-) strand; PAM type: NRG; PAM sequence: AAG
gcagaagaaaaggaataaca

SEQ ID NO: 23244 - DNA, 20 bp, Artificial Sequence
  Description of Artificial Sequence: Synthetic oligonucleotide
  Target: SCN10A; (-) strand; PAM type: NRG; PAM sequence: AGG
cccaaaccaagcagaagaaa

SEQ ID NO: 23245 - DNA, 20 bp, Artificial Sequence
  Description of Artificial Sequence: Synthetic oligonucleotide
  Target: SCN10A; (-) strand; PAM type: NRG; PAM sequence: AAG
acccaaaccaagcagaagaa

SEQ ID NO: 23246 - DNA, 20 bp, Artificial Sequence
  Description of Artificial Sequence: Synthetic oligonucleotide
  Target: SCN10A; (-) strand; PAM type: NRG; PAM sequence: AAG
aacagacccaaaccaagcag

SEQ ID NO: 23247 - DNA, 20 bp, Artificial Sequence
  Description of Artificial Sequence: Synthetic oligonucleotide
  Target: SCN10A; (-) strand; PAM type: NRG; PAM sequence: CAG
caaaacagacccaaaccaag

SEQ ID NO: 23248 - DNA, 20 bp, Artificial Sequence
  Description of Artificial Sequence: Synthetic oligonucleotide
  Target: SCN10A; (-) strand; PAM type: NRG; PAM sequence: AAG
gaacaaaacagacccaaacc

SEQ ID NO: 23249 - DNA, 20 bp, Artificial Sequence
  Description of Artificial Sequence: Synthetic oligonucleotide
  Target: SCN10A; (-) strand; PAM type: NRG; PAM sequence: CAG
ttagagaaacaagaacaaaa

SEQ ID NO: 23250 - DNA, 20 bp, Artificial Sequence
  Description of Artificial Sequence: Synthetic oligonucleotide
  Target: SCN10A; (-) strand; PAM type: NRG; PAM sequence: AAG
cctcaaggaattagagaaac

SEQ ID NO: 23251 - DNA, 20 bp, Artificial Sequence
  Description of Artificial Sequence: Synthetic oligonucleotide
  Target: SCN10A; (-) strand; PAM type: NRG; PAM sequence: GAG
ggtcacacctcaaggaatta

SEQ ID NO: 23252 - DNA, 20 bp, Artificial Sequence
  Description of Artificial Sequence: Synthetic oligonucleotide
  Target: SCN10A; (-) strand; PAM type: NRG; PAM sequence: TAG
aaggtcacacctcaaggaat

SEQ ID NO: 23253 - DNA, 20 bp, Artificial Sequence
  Description of Artificial Sequence: Synthetic oligonucleotide
  Target: SCN10A; (-) strand; PAM type: NRG; PAM sequence: AGG
taatctaaggtcacacctca

SEQ ID NO: 23254 - DNA, 20 bp, Artificial Sequence
  Description of Artificial Sequence: Synthetic oligonucleotide
  Target: SCN10A; (-) strand; PAM type: NRG; PAM sequence: AAG
ataatctaaggtcacacctc

SEQ ID NO: 23255 - DNA, 20 bp, Artificial Sequence
  Description of Artificial Sequence: Synthetic oligonucleotide
  Target: SCN10A; (-) strand; PAM type: NRG; PAM sequence: AGG
gaggacaaatagataatcta

SEQ ID NO: 23256 - DNA, 20 bp, Artificial Sequence
  Description of Artificial Sequence: Synthetic oligonucleotide
  Target: SCN10A; (-) strand; PAM type: NRG; PAM sequence: AAG
agaggacaaatagataatct

SEQ ID NO: 23257 - DNA, 20 bp, Artificial Sequence
  Description of Artificial Sequence: Synthetic oligonucleotide
  Target: SCN10A; (-) strand; PAM type: NRG; PAM sequence: TAG
aaagtatgaaagaggacaaa

SEQ ID NO: 23258 - DNA, 20 bp, Artificial Sequence
  Description of Artificial Sequence: Synthetic oligonucleotide
  Target: SCN10A; (-) strand; PAM type: NRG; PAM sequence: AGG
tacatcaaaaagtatgaaag

SEQ ID NO: 23259 - DNA, 20 bp, Artificial Sequence
  Description of Artificial Sequence: Synthetic oligonucleotide
  Target: SCN10A; (-) strand; PAM type: NRG; PAM sequence: GAG
ctacatcaaaaagtatgaaa

SEQ ID NO: 23260 - DNA, 20 bp, Artificial Sequence
  Description of Artificial Sequence: Synthetic oligonucleotide
  Target: SCN10A; (-) strand; PAM type: NRG; PAM sequence: AAG
acctacatcaaaaagtatga

SEQ ID NO: 23261 - DNA, 20 bp, Artificial Sequence
  Description of Artificial Sequence: Synthetic oligonucleotide
  Target: SCN10A; (-) strand; PAM type: NRG; PAM sequence: AAG
cattaaatacctacatcaaa

SEQ ID NO: 23262 - DNA, 20 bp, Artificial Sequence
  Description of Artificial Sequence: Synthetic oligonucleotide
  Target: SCN10A; (-) strand; PAM type: NRG; PAM sequence: TAG
agtgctaagaggaaagctca

SEQ ID NO: 23263 - DNA, 20 bp, Artificial Sequence
  Description of Artificial Sequence: Synthetic oligonucleotide
  Target: SCN10A; (-) strand; PAM type: NRG; PAM sequence: AAG
ctaaagcagtgctaagagga

SEQ ID NO: 23264 - DNA, 20 bp, Artificial Sequence
  Description of Artificial Sequence: Synthetic oligonucleotide
  Target: SCN10A; (-) strand; PAM type: NRG; PAM sequence: AGG
acagctaaagcagtgctaag

SEQ ID NO: 23265 - DNA, 20 bp, Artificial Sequence
  Description of Artificial Sequence: Synthetic oligonucleotide
  Target: SCN10A; (-) strand; PAM type: NRG; PAM sequence: GAG
tacagctaaagcagtgctaa

SEQ ID NO: 23266 - DNA, 20 bp, Artificial Sequence
  Description of Artificial Sequence: Synthetic oligonucleotide
  Target: SCN10A; (-) strand; PAM type: NRG; PAM sequence: AAG
gatacagctaaagcagtgct

SEQ ID NO: 23267 - DNA, 20 bp, Artificial Sequence
  Description of Artificial Sequence: Synthetic oligonucleotide
  Target: SCN10A; (-) strand; PAM type: NRG; PAM sequence: CAG
cctctgggatacagctaaag

SEQ ID NO: 23268 - DNA, 20 bp, Artificial Sequence
  Description of Artificial Sequence: Synthetic oligonucleotide
  Target: SCN10A; (-) strand; PAM type: NRG; PAM sequence: AAG
aaacctctgggatacagcta

SEQ ID NO: 23269 - DNA, 20 bp, Artificial Sequence
  Description of Artificial Sequence: Synthetic oligonucleotide
  Target: SCN10A; (-) strand; PAM type: NRG; PAM sequence: CAG
ttatcaaaacctctgggata

SEQ ID NO: 23270 - DNA, 20 bp, Artificial Sequence
  Description of Artificial Sequence: Synthetic oligonucleotide
  Target: SCN10A; (-) strand; PAM type: NRG; PAM sequence: GGG
cacaacttatcaaaacctct

SEQ ID NO: 23271 - DNA, 20 bp, Artificial Sequence
  Description of Artificial Sequence: Synthetic oligonucleotide
  Target: SCN10A; (-) strand; PAM type: NRG; PAM sequence: TGG
acacaacttatcaaaacctc

SEQ ID NO: 23272 - DNA, 20 bp, Artificial Sequence
  Description of Artificial Sequence: Synthetic oligonucleotide
  Target: SCN10A; (-) strand; PAM type: NRG; PAM sequence: TAG
ttttttgaactgaatgataa

SEQ ID NO: 23273 - DNA, 20 bp, Artificial Sequence
  Description of Artificial Sequence: Synthetic oligonucleotide
  Target: SCN10A; (-) strand; PAM type: NRG; PAM sequence: AAG
caacaatgaaatcaagatgg

SEQ ID NO: 23274 - DNA, 20 bp, Artificial Sequence
  Description of Artificial Sequence: Synthetic oligonucleotide
  Target: SCN10A; (-) strand; PAM type: NRG; PAM sequence: TGG
ggtcaacaatgaaatcaaga

SEQ ID NO: 23275 - DNA, 20 bp, Artificial Sequence
  Description of Artificial Sequence: Synthetic oligonucleotide
  Target: SCN10A; (-) strand; PAM type: NRG; PAM sequence: AAG
tttgggtcaacaatgaaatc

SEQ ID NO: 23276 - DNA, 20 bp, Artificial Sequence
  Description of Artificial Sequence: Synthetic oligonucleotide
  Target: SCN10A; (-) strand; PAM type: NRG; PAM sequence: GGG
tctgctcttgaatgatcttt

SEQ ID NO: 23277 - DNA, 20 bp, Artificial Sequence
  Description of Artificial Sequence: Synthetic oligonucleotide
  Target: SCN10A; (-) strand; PAM type: NRG; PAM sequence: TGG
atctgctcttgaatgatctt

SEQ ID NO: 23278 - DNA, 20 bp, Artificial Sequence
  Description of Artificial Sequence: Synthetic oligonucleotide
  Target: SCN10A; (-) strand; PAM type: NRG; PAM sequence: AAG
aacctcggagttaactccaa

SEQ ID NO: 23279 - DNA, 20 bp, Artificial Sequence
  Description of Artificial Sequence: Synthetic oligonucleotide
  Target: SCN10A; (-) strand; PAM type: NRG; PAM sequence: GAG
gcacagtcgaataaacctcg

SEQ ID NO: 23280 - DNA, 20 bp, Artificial Sequence
  Description of Artificial Sequence: Synthetic oligonucleotide
  Target: SCN10A; (-) strand; PAM type: NRG; PAM sequence: CGG
gagcacagtcgaataaacct

SEQ ID NO: 23281 - DNA, 20 bp, Artificial Sequence
  Description of Artificial Sequence: Synthetic oligonucleotide
  Target: SCN10A; (-) strand; PAM type: NRG; PAM sequence: CAG
tcaggtatcctctcagagca

SEQ ID NO: 23282 - DNA, 20 bp, Artificial Sequence
  Description of Artificial Sequence: Synthetic oligonucleotide
  Target: SCN10A; (-) strand; PAM type: NRG; PAM sequence: GAG
ttatgtcaggtatcctctca

SEQ ID NO: 23283 - DNA, 20 bp, Artificial Sequence
  Description of Artificial Sequence: Synthetic oligonucleotide
  Target: SCN10A; (-) strand; PAM type: NRG; PAM sequence: CAG
aattatgtcaggtatcctct

SEQ ID NO: 23284 - DNA, 20 bp, Artificial Sequence
  Description of Artificial Sequence: Synthetic oligonucleotide
  Target: SCN10A; (-) strand; PAM type: NRG; PAM sequence: AGG
aagaaaatagaaattatgtc

SEQ ID NO: 23285 - DNA, 20 bp, Artificial Sequence
  Description of Artificial Sequence: Synthetic oligonucleotide
  Target: SCN10A; (-) strand; PAM type: NRG; PAM sequence: CAG
taagaaaatagaaattatgt

SEQ ID NO: 23286 - DNA, 20 bp, Artificial Sequence
  Description of Artificial Sequence: Synthetic oligonucleotide
  Target: SCN10A; (-) strand; PAM type: NRG; PAM sequence: TAG
tctcaataaatttaagaaaa

SEQ ID NO: 23287 - DNA, 20 bp, Artificial Sequence
  Description of Artificial Sequence: Synthetic oligonucleotide
  Target: SCN10A; (-) strand; PAM type: NRG; PAM sequence: AAG
taacaaatctcaataaattt

SEQ ID NO: 23288 - DNA, 20 bp, Artificial Sequence
  Description of Artificial Sequence: Synthetic oligonucleotide
  Target: SCN10A; (-) strand; PAM type: NRG; PAM sequence: TAG
ctctaagatagaccacgtga

SEQ ID NO: 23289 - DNA, 20 bp, Artificial Sequence
  Description of Artificial Sequence: Synthetic oligonucleotide
  Target: SCN10A; (-) strand; PAM type: NRG; PAM sequence: TAG
acatggaatattctctaaga

SEQ ID NO: 23290 - DNA, 20 bp, Artificial Sequence
  Description of Artificial Sequence: Synthetic oligonucleotide
  Target: SCN10A; (-) strand; PAM type: NRG; PAM sequence: AAG
cagcacatggaatattctct

SEQ ID NO: 23291 - DNA, 20 bp, Artificial Sequence
  Description of Artificial Sequence: Synthetic oligonucleotide
  Target: SCN10A; (-) strand; PAM type: NRG; PAM sequence: TGG
acattcttttcatcagcaca

SEQ ID NO: 23292 - DNA, 20 bp, Artificial Sequence
  Description of Artificial Sequence: Synthetic oligonucleotide
  Target: SCN10A; (-) strand; PAM type: NRG; PAM sequence: CAG
agaatatacattcttttcat

SEQ ID NO: 23293 - DNA, 20 bp, Artificial Sequence
  Description of Artificial Sequence: Synthetic oligonucleotide
  Target: SCN10A; (-) strand; PAM type: NRG; PAM sequence: CAG
aacattctaccaaacaactg

SEQ ID NO: 23294 - DNA, 20 bp, Artificial Sequence
  Description of Artificial Sequence: Synthetic oligonucleotide
  Target: SCN10A; (-) strand; PAM type: NRG; PAM sequence: CAG
cctagaacaaatggacttaa

SEQ ID NO: 23295 - DNA, 20 bp, Artificial Sequence
  Description of Artificial Sequence: Synthetic oligonucleotide
  Target: SCN10A; (-) strand; PAM type: NRG; PAM sequence: TGG
aaactgtaacctagaacaaa

SEQ ID NO: 23296 - DNA, 20 bp, Artificial Sequence
  Description of Artificial Sequence: Synthetic oligonucleotide
  Target: SCN10A; (-) strand; PAM type: NRG; PAM sequence: TAG
aatgaacttaaactgtaacc

SEQ ID NO: 23297 - DNA, 20 bp, Artificial Sequence
  Description of Artificial Sequence: Synthetic oligonucleotide
  Target: SCN10A; (-) strand; PAM type: NRG; PAM sequence: AAG
atcaagacagaaagtcaaca

SEQ ID NO: 23298 - DNA, 20 bp, Artificial Sequence
  Description of Artificial Sequence: Synthetic oligonucleotide
  Target: SCN10A; (-) strand; PAM type: NRG; PAM sequence: AAG
agacaggtcatcaagacaga

SEQ ID NO: 23299 - DNA, 20 bp, Artificial Sequence
  Description of Artificial Sequence: Synthetic oligonucleotide
  Target: SCN10A; (-) strand; PAM type: NRG; PAM sequence: CAG
cactagacaggtcatcaaga

SEQ ID NO: 23300 - DNA, 20 bp, Artificial Sequence
  Description of Artificial Sequence: Synthetic oligonucleotide
  Target: SCN10A; (-) strand; PAM type: NRG; PAM sequence: AAG
acagcactagacaggtcatc

SEQ ID NO: 23301 - DNA, 20 bp, Artificial Sequence
  Description of Artificial Sequence: Synthetic oligonucleotide
  Target: SCN10A; (-) strand; PAM type: NRG; PAM sequence: AGG
ttccactgacagcactagac

SEQ ID NO: 23302 - DNA, 20 bp, Artificial Sequence
  Description of Artificial Sequence: Synthetic oligonucleotide
  Target: SCN10A; (-) strand; PAM type: NRG; PAM sequence: CAG
attccactgacagcactaga

SEQ ID NO: 23303 - DNA, 20 bp, Artificial Sequence
  Description of Artificial Sequence: Synthetic oligonucleotide
  Target: SCN10A; (-) strand; PAM type: NRG; PAM sequence: TAG
caatattccactgacagcac

SEQ ID NO: 23304 - DNA, 20 bp, Artificial Sequence
  Description of Artificial Sequence: Synthetic oligonucleotide
  Target: SCN10A; (-) strand; PAM type: NRG; PAM sequence: CAG
ggggatcaatattccactga

SEQ ID NO: 23305 - DNA, 20 bp, Artificial Sequence
  Description of Artificial Sequence: Synthetic oligonucleotide
  Target: SCN10A; (-) strand; PAM type: NRG; PAM sequence: GGG
cagcaatataataatagtgg

SEQ ID NO: 23306 - DNA, 20 bp, Artificial Sequence
  Description of Artificial Sequence: Synthetic oligonucleotide
  Target: SCN10A; (-) strand; PAM type: NRG; PAM sequence: GGG
acagcaatataataatagtg

SEQ ID NO: 23307 - DNA, 20 bp, Artificial Sequence
  Description of Artificial Sequence: Synthetic oligonucleotide
  Target: SCN10A; (-) strand; PAM type: NRG; PAM sequence: GGG
gacagcaatataataatagt

SEQ ID NO: 23308 - DNA, 20 bp, Artificial Sequence
  Description of Artificial Sequence: Synthetic oligonucleotide
  Target: SCN10A; (-) strand; PAM type: NRG; PAM sequence: TGG
agacagcaatataataatag

SEQ ID NO: 23309 - DNA, 20 bp, Artificial Sequence
  Description of Artificial Sequence: Synthetic oligonucleotide
  Target: SCN10A; (-) strand; PAM type: NRG; PAM sequence: TAG
aatagacagcaatataataa

SEQ ID NO: 23310 - DNA, 20 bp, Artificial Sequence
  Description of Artificial Sequence: Synthetic oligonucleotide
  Target: SCN10A; (-) strand; PAM type: NRG; PAM sequence: CAG
gacctaagaaatgaaataga

SEQ ID NO: 23311 - DNA, 20 bp, Artificial Sequence
  Description of Artificial Sequence: Synthetic oligonucleotide
  Target: SCN10A; (-) strand; PAM type: NRG; PAM sequence: TAG
actagacctaagaaatgaaa

SEQ ID NO: 23312 - DNA, 20 bp, Artificial Sequence
  Description of Artificial Sequence: Synthetic oligonucleotide
  Target: SCN10A; (-) strand; PAM type: NRG; PAM sequence: AAG
aaacaattactactagacct

SEQ ID NO: 23313 - DNA, 20 bp, Artificial Sequence
  Description of Artificial Sequence: Synthetic oligonucleotide
  Target: SCN10A; (-) strand; PAM type: NRG; PAM sequence: TAG
atttataaaacaattactac

SEQ ID NO: 23314 - DNA, 20 bp, Artificial Sequence
  Description of Artificial Sequence: Synthetic oligonucleotide
  Target: SCN10A; (-) strand; PAM type: NRG; PAM sequence: GAG
tacatatgcacctaacactg

SEQ ID NO: 23315 - DNA, 20 bp, Artificial Sequence
  Description of Artificial Sequence: Synthetic oligonucleotide
  Target: SCN10A; (-) strand; PAM type: NRG; PAM sequence: TGG
aatacatatgcacctaacac

SEQ ID NO: 23316 - DNA, 20 bp, Artificial Sequence
  Description of Artificial Sequence: Synthetic oligonucleotide
  Target: SCN10A; (-) strand; PAM type: NRG; PAM sequence: TGG
tgataaaataattggtctaa

SEQ ID NO: 23317 - DNA, 20 bp, Artificial Sequence
  Description of Artificial Sequence: Synthetic oligonucleotide
  Target: SCN10A; (-) strand; PAM type: NRG; PAM sequence: TGG
atatataatgataaaataat

SEQ ID NO: 23318 - DNA, 20 bp, Artificial Sequence
  Description of Artificial Sequence: Synthetic oligonucleotide
  Target: SCN10A; (-) strand; PAM type: NRG; PAM sequence: GGG
cagttaaaaaaagacaaaga

SEQ ID NO: 23319 - DNA, 20 bp, Artificial Sequence
  Description of Artificial Sequence: Synthetic oligonucleotide
  Target: SCN10A; (-) strand; PAM type: NRG; PAM sequence: AGG
acagttaaaaaaagacaaag

SEQ ID NO: 23320 - DNA, 20 bp, Artificial Sequence
  Description of Artificial Sequence: Synthetic oligonucleotide
  Target: SCN10A; (-) strand; PAM type: NRG; PAM sequence: GAG
aacagttaaaaaaagacaaa

SEQ ID NO: 23321 - DNA, 20 bp, Artificial Sequence
  Description of Artificial Sequence: Synthetic oligonucleotide
  Target: SCN10A; (-) strand; PAM type: NRG; PAM sequence: AAG
acaacagttaaaaaaagaca

SEQ ID NO: 23322 - DNA, 20 bp, Artificial Sequence
  Description of Artificial Sequence: Synthetic oligonucleotide
  Target: SCN10A; (-) strand; PAM type: NRG; PAM sequence: AAG
aaagcaacaacagttaaaaa

SEQ ID NO: 23323 - DNA, 20 bp, Artificial Sequence
  Description of Artificial Sequence: Synthetic oligonucleotide
  Target: SCN10A; (-) strand; PAM type: NRG; PAM sequence: CAG
aacagaccttaaagcaacaa

SEQ ID NO: 23324 - DNA, 20 bp, Artificial Sequence
  Description of Artificial Sequence: Synthetic oligonucleotide
  Target: SCN10A; (-) strand; PAM type: NRG; PAM sequence: AAG
atcagagaaaacagacctta

SEQ ID NO: 23325 - DNA, 20 bp, Artificial Sequence
  Description of Artificial Sequence: Synthetic oligonucleotide
  Target: SCN10A; (-) strand; PAM type: NRG; PAM sequence: CAG
tattcttatatcagagaaaa

SEQ ID NO: 23326 - DNA, 20 bp, Artificial Sequence
  Description of Artificial Sequence: Synthetic oligonucleotide
  Target: SCN10A; (-) strand; PAM type: NRG; PAM sequence: GAG
gagtagctattcttatatca

SEQ ID NO: 23327 - DNA, 20 bp, Artificial Sequence
  Description of Artificial Sequence: Synthetic oligonucleotide
  Target: SCN10A; (-) strand; PAM type: NRG; PAM sequence: CAG
aggagtagctattcttatat

SEQ ID NO: 23328 - DNA, 20 bp, Artificial Sequence
  Description of Artificial Sequence: Synthetic oligonucleotide
  Target: SCN10A; (-) strand; PAM type: NRG; PAM sequence: TAG
aaaccaaaagcaagcaggag

SEQ ID NO: 23329 - DNA, 20 bp, Artificial Sequence
  Description of Artificial Sequence: Synthetic oligonucleotide
  Target: SCN10A; (-) strand; PAM type: NRG; PAM sequence: GAG
tggaaaccaaaagcaagcag

SEQ ID NO: 23330 - DNA, 20 bp, Artificial Sequence
  Description of Artificial Sequence: Synthetic oligonucleotide
  Target: SCN10A; (-) strand; PAM type: NRG; PAM sequence: AGG
aatggaaaccaaaagcaagc

SEQ ID NO: 23331 - DNA, 20 bp, Artificial Sequence
  Description of Artificial Sequence: Synthetic oligonucleotide
  Target: SCN10A; (-) strand; PAM type: NRG; PAM sequence: CAG
aaatggaaaccaaaagcaag

SEQ ID NO: 23332 - DNA, 20 bp, Artificial Sequence
  Description of Artificial Sequence: Synthetic oligonucleotide
  Target: SCN10A; (-) strand; PAM type: NRG; PAM sequence: AAG
tgcaaatggaaaccaaaagc

SEQ ID NO: 23333 - DNA, 20 bp, Artificial Sequence
  Description of Artificial Sequence: Synthetic oligonucleotide
  Target: SCN10A; (-) strand; PAM type: NRG; PAM sequence: AAG
tccatgcaaatggaaaccaa

SEQ ID NO: 23334 - DNA, 20 bp, Artificial Sequence
  Description of Artificial Sequence: Synthetic oligonucleotide
  Target: SCN10A; (-) strand; PAM type: NRG; PAM sequence: TGG
gaaaagatattccatgcaaa

SEQ ID NO: 23335 - DNA, 20 bp, Artificial Sequence
  Description of Artificial Sequence: Synthetic oligonucleotide
  Target: SCN10A; (-) strand; PAM type: NRG; PAM sequence: AAG
ttaaggtaaagagatgggaa

SEQ ID NO: 23336 - DNA, 20 bp, Artificial Sequence
  Description of Artificial Sequence: Synthetic oligonucleotide
  Target: SCN10A; (-) strand; PAM type: NRG; PAM sequence: GGG
taaacttaaggtaaagagat

SEQ ID NO: 23337 - DNA, 20 bp, Artificial Sequence
  Description of Artificial Sequence: Synthetic oligonucleotide
  Target: SCN10A; (-) strand; PAM type: NRG; PAM sequence: TGG
ataaacttaaggtaaagaga

SEQ ID NO: 23338 - DNA, 20 bp, Artificial Sequence
  Description of Artificial Sequence: Synthetic oligonucleotide
  Target: SCN10A; (-) strand; PAM type: NRG; PAM sequence: GAG
ccacataaacttaaggtaaa

SEQ ID NO: 23339 - DNA, 20 bp, Artificial Sequence
  Description of Artificial Sequence: Synthetic oligonucleotide
  Target: SCN10A; (-) strand; PAM type: NRG; PAM sequence: AAG
agccacataaacttaaggta

SEQ ID NO: 23340 - DNA, 20 bp, Artificial Sequence
  Description of Artificial Sequence: Synthetic oligonucleotide
  Target: SCN10A; (-) strand; PAM type: NRG; PAM sequence: AGG
taaggagccacataaactta

SEQ ID NO: 23341 - DNA, 20 bp, Artificial Sequence
  Description of Artificial Sequence: Synthetic oligonucleotide
  Target: SCN10A; (-) strand; PAM type: NRG; PAM sequence: AAG
ataaggagccacataaactt

SEQ ID NO: 23342 - DNA, 20 bp, Artificial Sequence
  Description of Artificial Sequence: Synthetic oligonucleotide
  Target: SCN10A; (-) strand; PAM type: NRG; PAM sequence: GAG
agactcacctaacacataag

SEQ ID NO: 23343 - DNA, 20 bp, Artificial Sequence
  Description of Artificial Sequence: Synthetic oligonucleotide
  Target: SCN10A; (-) strand; PAM type: NRG; PAM sequence: AGG
agagactcacctaacacata

SEQ ID NO: 23344 - DNA, 20 bp, Artificial Sequence
  Description of Artificial Sequence: Synthetic oligonucleotide
  Target: SCN10A; (-) strand; PAM type: NRG; PAM sequence: AAG
aagagactcacctaacacat

SEQ ID NO: 23345 - DNA, 20 bp, Artificial Sequence
  Description of Artificial Sequence: Synthetic oligonucleotide
  Target: SCN10A; (-) strand; PAM type: NRG; PAM sequence: GAG
caagtatctactgtcttcaa

SEQ ID NO: 23346 - DNA, 20 bp, Artificial Sequence
  Description of Artificial Sequence: Synthetic oligonucleotide
  Target: SCN10A; (-) strand; PAM type: NRG; PAM sequence: AAG
accaagtatctactgtcttc

SEQ ID NO: 23347 - DNA, 20 bp, Artificial Sequence
  Description of Artificial Sequence: Synthetic oligonucleotide
  Target: SCN10A; (-) strand; PAM type: NRG; PAM sequence: AAG
aaaaaaaaaatccaccaacc

SEQ ID NO: 23348 - DNA, 20 bp, Artificial Sequence
  Description of Artificial Sequence: Synthetic oligonucleotide
  Target: SCN10A; (-) strand; PAM type: NRG; PAM sequence: AGG
aaatatacagaagggcagaa

SEQ ID NO: 23349 - DNA, 20 bp, Artificial Sequence
  Description of Artificial Sequence: Synthetic oligonucleotide
  Target: SCN10A; (-) strand; PAM type: NRG; PAM sequence: AAG
aaaatatacagaagggcaga

SEQ ID NO: 23350 - DNA, 20 bp, Artificial Sequence
  Description of Artificial Sequence: Synthetic oligonucleotide
  Target: SCN10A; (-) strand; PAM type: NRG; PAM sequence: CAG
acttaaaatatacagaaggg

SEQ ID NO: 23351 - DNA, 20 bp, Artificial Sequence
  Description of Artificial Sequence: Synthetic oligonucleotide
  Target: SCN10A; (-) strand; PAM type: NRG; PAM sequence: GGG
tccacttaaaatatacagaa

SEQ ID NO: 23352 - DNA, 20 bp, Artificial Sequence
  Description of Artificial Sequence: Synthetic oligonucleotide
  Target: SCN10A; (-) strand; PAM type: NRG; PAM sequence: AGG
atccacttaaaatatacaga

SEQ ID NO: 23353 - DNA, 20 bp, Artificial Sequence
  Description of Artificial Sequence: Synthetic oligonucleotide
  Target: SCN10A; (-) strand; PAM type: NRG; PAM sequence: AAG
gatccacttaaaatatacag

SEQ ID NO: 23354 - DNA, 20 bp, Artificial Sequence
  Description of Artificial Sequence: Synthetic oligonucleotide
  Target: SCN10A; (-) strand; PAM type: NRG; PAM sequence: CAG
aatgatccacttaaaatata

SEQ ID NO: 23355 - DNA, 20 bp, Artificial Sequence
  Description of Artificial Sequence: Synthetic oligonucleotide
  Target: SCN10A; (-) strand; PAM type: NRG; PAM sequence: GAG
cacatctcaatactgatgtt

SEQ ID NO: 23356 - DNA, 20 bp, Artificial Sequence
  Description of Artificial Sequence: Synthetic oligonucleotide
  Target: SCN10A; (-) strand; PAM type: NRG; PAM sequence: GAG
aactagcataatgaatagaa

SEQ ID NO: 23357 - DNA, 20 bp, Artificial Sequence
  Description of Artificial Sequence: Synthetic oligonucleotide
  Target: SCN10A; (-) strand; PAM type: NRG; PAM sequence: AAG
ataactagcataatgaatag

SEQ ID NO: 23358 - DNA, 20 bp, Artificial Sequence
  Description of Artificial Sequence: Synthetic oligonucleotide
  Target: SCN10A; (-) strand; PAM type: NRG; PAM sequence: TAG
gcaataactagcataatgaa

SEQ ID NO: 23359 - DNA, 20 bp, Artificial Sequence
  Description of Artificial Sequence: Synthetic oligonucleotide
  Target: SCN10A; (-) strand; PAM type: NRG; PAM sequence: TAG
aaaggaattaaggcaataac

SEQ ID NO: 23360 - DNA, 20 bp, Artificial Sequence
  Description of Artificial Sequence: Synthetic oligonucleotide
  Target: SCN10A; (-) strand; PAM type: NRG; PAM sequence: AGG
cacaataaaaaaaggaatta

SEQ ID NO: 23361 - DNA, 20 bp, Artificial Sequence
  Description of Artificial Sequence: Synthetic oligonucleotide
  Target: SCN10A; (-) strand; PAM type: NRG; PAM sequence: AAG
acacaataaaaaaaggaatt

SEQ ID NO: 23362 - DNA, 20 bp, Artificial Sequence
  Description of Artificial Sequence: Synthetic oligonucleotide
  Target: SCN10A; (-) strand; PAM type: NRG; PAM sequence: AGG
aacaataacacaataaaaaa

SEQ ID NO: 23363 - DNA, 20 bp, Artificial Sequence
  Description of Artificial Sequence: Synthetic oligonucleotide
  Target: SCN10A; (-) strand; PAM type: NRG; PAM sequence: AAG
aaacaataacacaataaaaa

SEQ ID NO: 23364 - DNA, 20 bp, Artificial Sequence
  Description of Artificial Sequence: Synthetic oligonucleotide
  Target: SCN10A; (-) strand; PAM type: NRG; PAM sequence: AGG
ccttaaagcataaatatcaa

SEQ ID NO: 23365 - DNA, 20 bp, Artificial Sequence
  Description of Artificial Sequence: Synthetic oligonucleotide
  Target: SCN10A; (-) strand; PAM type: NRG; PAM sequence: AAG
tccttaaagcataaatatca

SEQ ID NO: 23366 - DNA, 20 bp, Artificial Sequence
  Description of Artificial Sequence: Synthetic oligonucleotide
  Target: SCN10A; (-) strand; PAM type: NRG; PAM sequence: AAG
accaaaatagaacctcctta

SEQ ID NO: 23367 - DNA, 20 bp, Artificial Sequence
  Description of Artificial Sequence: Synthetic oligonucleotide
  Target: SCN10A; (-) strand; PAM type: NRG; PAM sequence: TAG
aaccttaaaatacaccaaaa

SEQ ID NO: 23368 - DNA, 20 bp, Artificial Sequence
  Description of Artificial Sequence: Synthetic oligonucleotide
  Target: SCN10A; (-) strand; PAM type: NRG; PAM sequence: AGG
gcactacaagaaatgctaaa

SEQ ID NO: 23369 - DNA, 20 bp, Artificial Sequence
  Description of Artificial Sequence: Synthetic oligonucleotide
  Target: SCN10A; (-) strand; PAM type: NRG; PAM sequence: AAG
agcactacaagaaatgctaa

SEQ ID NO: 23370 - DNA, 20 bp, Artificial Sequence
  Description of Artificial Sequence: Synthetic oligonucleotide
  Target: SCN10A; (-) strand; PAM type: NRG; PAM sequence: AAG
cactaccaagccagcactac

SEQ ID NO: 23371 - DNA, 20 bp, Artificial Sequence
  Description of Artificial Sequence: Synthetic oligonucleotide
  Target: SCN10A; (-) strand; PAM type: NRG; PAM sequence: CAG
agaattttccactaccaagc

SEQ ID NO: 23372 - DNA, 20 bp, Artificial Sequence
  Description of Artificial Sequence: Synthetic oligonucleotide
  Target: SCN10A; (-) strand; PAM type: NRG; PAM sequence: AAG
tgagagaattttccactacc

SEQ ID NO: 23373 - DNA, 20 bp, Artificial Sequence
  Description of Artificial Sequence: Synthetic oligonucleotide
  Target: SCN10A; (-) strand; PAM type: NRG; PAM sequence: GAG
ttcagacaaacaaatggtga

SEQ ID NO: 23374 - DNA, 20 bp, Artificial Sequence
  Description of Artificial Sequence: Synthetic oligonucleotide
  Target: SCN10A; (-) strand; PAM type: NRG; PAM sequence: GAG
ttttcagacaaacaaatggt

SEQ ID NO: 23375 - DNA, 20 bp, Artificial Sequence
  Description of Artificial Sequence: Synthetic oligonucleotide
  Target: SCN10A; (-) strand; PAM type: NRG; PAM sequence: TGG
gtttttttcagacaaacaaa

SEQ ID NO: 23376 - DNA, 20 bp, Artificial Sequence
  Description of Artificial Sequence: Synthetic oligonucleotide
  Target: SCN10A; (-) strand; PAM type: NRG; PAM sequence: CAG
agacaagataaagttttttt

SEQ ID NO: 23377 - DNA, 20 bp, Artificial Sequence
  Description of Artificial Sequence: Synthetic oligonucleotide
  Target: SCN10A; (-) strand; PAM type: NRG; PAM sequence: AAG
tcataagtgaagacaagata

SEQ ID NO: 23378 - DNA, 20 bp, Artificial Sequence
  Description of Artificial Sequence: Synthetic oligonucleotide
  Target: SCN10A; (-) strand; PAM type: NRG; PAM sequence: AAG
taagcttcataagtgaagac

SEQ ID NO: 23379 - DNA, 20 bp, Artificial Sequence
  Description of Artificial Sequence: Synthetic oligonucleotide
  Target: SCN10A; (-) strand; PAM type: NRG; PAM sequence: AAG
gaaactaagcttcataagtg

SEQ ID NO: 23380 - DNA, 20 bp, Artificial Sequence
  Description of Artificial Sequence: Synthetic oligonucleotide
  Target: SCN10A; (-) strand; PAM type: NRG; PAM sequence: AAG
gaagagaaactaagcttcat

SEQ ID NO: 23381 - DNA, 20 bp, Artificial Sequence
  Description of Artificial Sequence: Synthetic oligonucleotide
  Target: SCN10A; (-) strand; PAM type: NRG; PAM sequence: AAG
atattgtatgaagagaaact

SEQ ID NO: 23382 - DNA, 20 bp, Artificial Sequence
  Description of Artificial Sequence: Synthetic oligonucleotide
  Target: SCN10A; (-) strand; PAM type: NRG; PAM sequence: GAG
agccaagaatattgtatgaa

SEQ ID NO: 23383 - DNA, 20 bp, Artificial Sequence
  Description of Artificial Sequence: Synthetic oligonucleotide
  Target: SCN10A; (-) strand; PAM type: NRG; PAM sequence: AAG
ccagccaagaatattgtatg

SEQ ID NO: 23384 - DNA, 20 bp, Artificial Sequence
  Description of Artificial Sequence: Synthetic oligonucleotide
  Target: SCN10A; (-) strand; PAM type: NRG; PAM sequence: AAG
aaacaaaataattgccagcc

SEQ ID NO: 23385 - DNA, 20 bp, Artificial Sequence
  Description of Artificial Sequence: Synthetic oligonucleotide
  Target: SCN10A; (-) strand; PAM type: NRG; PAM sequence: CAG
tcctgaaacaaaataattgc

SEQ ID NO: 23386 - DNA, 20 bp, Artificial Sequence
  Description of Artificial Sequence: Synthetic oligonucleotide
  Target: SCN10A; (-) strand; PAM type: NRG; PAM sequence: TAG
agggattagggtcccatctt

SEQ ID NO: 23387 - DNA, 20 bp, Artificial Sequence
  Description of Artificial Sequence: Synthetic oligonucleotide
  Target: SCN10A; (-) strand; PAM type: NRG; PAM sequence: GGG
ttgcaagccagaagggatta

SEQ ID NO: 23388 - DNA, 20 bp, Artificial Sequence
  Description of Artificial Sequence: Synthetic oligonucleotide
  Target: SCN10A; (-) strand; PAM type: NRG; PAM sequence: AGG
cttgcaagccagaagggatt

SEQ ID NO: 23389 - DNA, 20 bp, Artificial Sequence
  Description of Artificial Sequence: Synthetic oligonucleotide
  Target: SCN10A; (-) strand; PAM type: NRG; PAM sequence: TAG
ccttgcaagccagaagggat

SEQ ID NO: 23390 - DNA, 20 bp, Artificial Sequence
  Description of Artificial Sequence: Synthetic oligonucleotide
  Target: SCN10A; (-) strand; PAM type: NRG; PAM sequence: GGG
tgaaaccttgcaagccagaa

SEQ ID NO: 23391 - DNA, 20 bp, Artificial Sequence
  Description of Artificial Sequence: Synthetic oligonucleotide
  Target: SCN10A; (-) strand; PAM type: NRG; PAM sequence: AGG
ctgaaaccttgcaagccaga

SEQ ID NO: 23392 - DNA, 20 bp, Artificial Sequence
  Description of Artificial Sequence: Synthetic oligonucleotide
  Target: SCN10A; (-) strand; PAM type: NRG; PAM sequence: AAG
actgaaaccttgcaagccag

SEQ ID NO: 23393 - DNA, 20 bp, Artificial Sequence
  Description of Artificial Sequence: Synthetic oligonucleotide
  Target: SCN10A; (-) strand; PAM type: NRG; PAM sequence: CAG
tcaactgaaaccttgcaagc

SEQ ID NO: 23394 - DNA, 20 bp, Artificial Sequence
  Description of Artificial Sequence: Synthetic oligonucleotide
  Target: SCN10A; (-) strand; PAM type: NRG; PAM sequence: AAG
tttctcaactgaaaccttgc

SEQ ID NO: 23395 - DNA, 20 bp, Artificial Sequence
  Description of Artificial Sequence: Synthetic oligonucleotide
  Target: SCN10A; (-) strand; PAM type: NRG; PAM sequence: CAG
gatttacataagattaacag

SEQ ID NO: 23396 - DNA, 20 bp, Artificial Sequence
  Description of Artificial Sequence: Synthetic oligonucleotide
  Target: SCN10A; (-) strand; PAM type: NRG; PAM sequence: CAG
tctgatttacataagattaa

SEQ ID NO: 23397 - DNA, 20 bp, Artificial Sequence
  Description of Artificial Sequence: Synthetic oligonucleotide
  Target: SCN10A; (-) strand; PAM type: NRG; PAM sequence: AAG
aaaggttatctgatttacat

SEQ ID NO: 23398 - DNA, 20 bp, Artificial Sequence
  Description of Artificial Sequence: Synthetic oligonucleotide
  Target: SCN10A; (-) strand; PAM type: NRG; PAM sequence: AGG
tcagataacctataaaggaa

SEQ ID NO: 23399 - DNA, 20 bp, Artificial Sequence
  Description of Artificial Sequence: Synthetic oligonucleotide
  Target: SCN10A; (-) strand; PAM type: NRG; PAM sequence: AAG
ctcagataacctataaagga

SEQ ID NO: 23400 - DNA, 20 bp, Artificial Sequence
  Description of Artificial Sequence: Synthetic oligonucleotide
  Target: SCN10A; (-) strand; PAM type: NRG; PAM sequence: AGG
aagcctcagataacctataa

SEQ ID NO: 23401 - DNA, 20 bp, Artificial Sequence
  Description of Artificial Sequence: Synthetic oligonucleotide
  Target: SCN10A; (-) strand; PAM type: NRG; PAM sequence: AAG
aaagcctcagataacctata

SEQ ID NO: 23402 - DNA, 20 bp, Artificial Sequence
  Description of Artificial Sequence: Synthetic oligonucleotide
  Target: SCN10A; (-) strand; PAM type: NRG; PAM sequence: CAG
gagctgtgagacaaaagcct

SEQ ID NO: 23403 - DNA, 20 bp, Artificial Sequence
  Description of Artificial Sequence: Synthetic oligonucleotide
  Target: SCN10A; (-) strand; PAM type: NRG; PAM sequence: AAG
tcttaagagctgtgagacaa

SEQ ID NO: 23404 - DNA, 20 bp, Artificial Sequence
  Description of Artificial Sequence: Synthetic oligonucleotide
  Target: SCN10A; (-) strand; PAM type: NRG; PAM sequence: GAG
aaaagaatcttaagagctgt

SEQ ID NO: 23405 - DNA, 20 bp, Artificial Sequence
  Description of Artificial Sequence: Synthetic oligonucleotide
  Target: SCN10A; (-) strand; PAM type: NRG; PAM sequence: GAG
gacaaagaaaagaatcttaa

SEQ ID NO: 23406 - DNA, 20 bp, Artificial Sequence
  Description of Artificial Sequence: Synthetic oligonucleotide
  Target: SCN10A; (-) strand; PAM type: NRG; PAM sequence: AAG
aagacaaagaaaagaatctt

SEQ ID NO: 23407 - DNA, 20 bp, Artificial Sequence
  Description of Artificial Sequence: Synthetic oligonucleotide
  Target: SCN10A; (-) strand; PAM type: NRG; PAM sequence: AAG
tctaaagtcaagacaaagaa

SEQ ID NO: 23408 - DNA, 20 bp, Artificial Sequence
  Description of Artificial Sequence: Synthetic oligonucleotide
  Target: SCN10A; (-) strand; PAM type: NRG; PAM sequence: AAG
ggttatctaaagtcaagaca

SEQ ID NO: 23409 - DNA, 20 bp, Artificial Sequence
  Description of Artificial Sequence: Synthetic oligonucleotide
  Target: SCN10A; (-) strand; PAM type: NRG; PAM sequence: AAG
acatcaggttatctaaagtc

SEQ ID NO: 23410 - DNA, 20 bp, Artificial Sequence
  Description of Artificial Sequence: Synthetic oligonucleotide
  Target: SCN10A; (-) strand; PAM type: NRG; PAM sequence: AAG
aatagacatcaggttatcta

SEQ ID NO: 23411 - DNA, 20 bp, Artificial Sequence
  Description of Artificial Sequence: Synthetic oligonucleotide
  Target: SCN10A; (-) strand; PAM type: NRG; PAM sequence: AGG
cacctaggcaaatagacatc

SEQ ID NO: 23412 - DNA, 20 bp, Artificial Sequence
  Description of Artificial Sequence: Synthetic oligonucleotide
  Target: SCN10A; (-) strand; PAM type: NRG; PAM sequence: CAG
tcacctaggcaaatagacat

SEQ ID NO: 23413 - DNA, 20 bp, Artificial Sequence
  Description of Artificial Sequence: Synthetic oligonucleotide
  Target: SCN10A; (-) strand; PAM type: NRG; PAM sequence: TAG
aagatcatcacctaggcaaa

SEQ ID NO: 23414 - DNA, 20 bp, Artificial Sequence
  Description of Artificial Sequence: Synthetic oligonucleotide
  Target: SCN10A; (-) strand; PAM type: NRG; PAM sequence: AGG
cacaaaaaagatcatcacct

SEQ ID NO: 23415 - DNA, 20 bp, Artificial Sequence
  Description of Artificial Sequence: Synthetic oligonucleotide
  Target: SCN10A; (-) strand; PAM type: NRG; PAM sequence: TAG
tcacaaaaaagatcatcacc

SEQ ID NO: 23416 - DNA, 20 bp, Artificial Sequence
  Description of Artificial Sequence: Synthetic oligonucleotide
  Target: SCN10A; (-) strand; PAM type: NRG; PAM sequence: AAG
ctctgaaatgtgtcacaaaa

SEQ ID NO: 23417 - DNA, 20 bp, Artificial Sequence
  Description of Artificial Sequence: Synthetic oligonucleotide
  Target: SCN10A; (-) strand; PAM type: NRG; PAM sequence: AAG
atccaaatacaagaagctca

SEQ ID NO: 23418 - DNA, 20 bp, Artificial Sequence
  Description of Artificial Sequence: Synthetic oligonucleotide
  Target: SCN10A; (-) strand; PAM type: NRG; PAM sequence: AAG
tatagatatccaaatacaag

SEQ ID NO: 23419 - DNA, 20 bp, Artificial Sequence
  Description of Artificial Sequence: Synthetic oligonucleotide
  Target: SCN10A; (-) strand; PAM type: NRG; PAM sequence: AAG
aaatatagatatccaaatac

SEQ ID NO: 23420 - DNA, 20 bp, Artificial Sequence
  Description of Artificial Sequence: Synthetic oligonucleotide
  Target: SCN10A; (-) strand; PAM type: NRG; PAM sequence: TAG
ccctggccttgttagaaata

SEQ ID NO: 23421 - DNA, 20 bp, Artificial Sequence
  Description of Artificial Sequence: Synthetic oligonucleotide
  Target: SCN10A; (-) strand; PAM type: NRG; PAM sequence: TAG
gaaaacttccctggccttgt

SEQ ID NO: 23422 - DNA, 20 bp, Artificial Sequence
  Description of Artificial Sequence: Synthetic oligonucleotide
  Target: SCN10A; (-) strand; PAM type: NRG; PAM sequence: TGG
ataattgaggaaaacttccc

SEQ ID NO: 23423 - DNA, 20 bp, Artificial Sequence
  Description of Artificial Sequence: Synthetic oligonucleotide
  Target: SCN10A; (-) strand; PAM type: NRG; PAM sequence: AGG
cttatttgagggaataattg

SEQ ID NO: 23424 - DNA, 20 bp, Artificial Sequence
  Description of Artificial Sequence: Synthetic oligonucleotide
  Target: SCN10A; (-) strand; PAM type: NRG; PAM sequence: GAG
acttatttgagggaataatt

SEQ ID NO: 23425 - DNA, 20 bp, Artificial Sequence
  Description of Artificial Sequence: Synthetic oligonucleotide
  Target: SCN10A; (-) strand; PAM type: NRG; PAM sequence: GGG
agtttggaaaacttatttga

SEQ ID NO: 23426 - DNA, 20 bp, Artificial Sequence
  Description of Artificial Sequence: Synthetic oligonucleotide
  Target: SCN10A; (-) strand; PAM type: NRG; PAM sequence: AGG
aagtttggaaaacttatttg

SEQ ID NO: 23427 - DNA, 20 bp, Artificial Sequence
  Description of Artificial Sequence: Synthetic oligonucleotide
  Target: SCN10A; (-) strand; PAM type: NRG; PAM sequence: GAG
aaagtttggaaaacttattt

SEQ ID NO: 23428 - DNA, 20 bp, Artificial Sequence
  Description of Artificial Sequence: Synthetic oligonucleotide
  Target: SCN10A; (-) strand; PAM type: NRG; PAM sequence: TGG
agaatagaaatctaaaagtt

SEQ ID NO: 23429 - DNA, 20 bp, Artificial Sequence
  Description of Artificial Sequence: Synthetic oligonucleotide
  Target: SCN10A; (-) strand; PAM type: NRG; PAM sequence: AAG
aaggaagaatagaaatctaa

SEQ ID NO: 23430 - DNA, 20 bp, Artificial Sequence
  Description of Artificial Sequence: Synthetic oligonucleotide
  Target: SCN10A; (-) strand; PAM type: NRG; PAM sequence: TAG
tgggtgttcccaaggaagaa

SEQ ID NO: 23431 - DNA, 20 bp, Artificial Sequence
  Description of Artificial Sequence: Synthetic oligonucleotide
  Target: SCN10A; (-) strand; PAM type: NRG; PAM sequence: AAG
aataatgggtgttcccaagg

SEQ ID NO: 23432 - DNA, 20 bp, Artificial Sequence
  Description of Artificial Sequence: Synthetic oligonucleotide
  Target: SCN10A; (-) strand; PAM type: NRG; PAM sequence: AGG
aagaataatgggtgttccca

SEQ ID NO: 23433 - DNA, 20 bp, Artificial Sequence
  Description of Artificial Sequence: Synthetic oligonucleotide
  Target: SCN10A; (-) strand; PAM type: NRG; PAM sequence: AAG
taagaataatgggtgttccc

SEQ ID NO: 23434 - DNA, 20 bp, Artificial Sequence
  Description of Artificial Sequence: Synthetic oligonucleotide
  Target: SCN10A; (-) strand; PAM type: NRG; PAM sequence: GGG
caaccaaacctaagaataat

SEQ ID NO: 23435 - DNA, 20 bp, Artificial Sequence
  Description of Artificial Sequence: Synthetic oligonucleotide
  Target: SCN10A; (-) strand; PAM type: NRG; PAM sequence: TGG
acaaccaaacctaagaataa

SEQ ID NO: 23436 - DNA, 20 bp, Artificial Sequence
  Description of Artificial Sequence: Synthetic oligonucleotide
  Target: SCN10A; (-) strand; PAM type: NRG; PAM sequence: AAG
catgtgaaacaaccaaacct

SEQ ID NO: 23437 - DNA, 20 bp, Artificial Sequence
  Description of Artificial Sequence: Synthetic oligonucleotide
  Target: SCN10A; (-) strand; PAM type: NRG; PAM sequence: TGG
gacaaatcggccaataaatt

SEQ ID NO: 23438 - DNA, 20 bp, Artificial Sequence
  Description of Artificial Sequence: Synthetic oligonucleotide
  Target: SCN10A; (-) strand; PAM type: NRG; PAM sequence: CGG
tttttaaaaaaatgacaaat

SEQ ID NO: 23439 - DNA, 20 bp, Artificial Sequence
  Description of Artificial Sequence: Synthetic oligonucleotide
  Target: SCN10A; (-) strand; PAM type: NRG; PAM sequence: AAG
aactaagacacacaaaaaga

SEQ ID NO: 23440 - DNA, 20 bp, Artificial Sequence
  Description of Artificial Sequence: Synthetic oligonucleotide
  Target: SCN10A; (-) strand; PAM type: NRG; PAM sequence: AAG
cccaaactaagacacacaaa

SEQ ID NO: 23441 - DNA, 20 bp, Artificial Sequence
  Description of Artificial Sequence: Synthetic oligonucleotide
  Target: SCN10A; (-) strand; PAM type: NRG; PAM sequence: AAG
gcttttaatagacccaaact

SEQ ID NO: 23442 - DNA, 20 bp, Artificial Sequence
  Description of Artificial Sequence: Synthetic oligonucleotide
  Target: SCN10A; (-) strand; PAM type: NRG; PAM sequence: TAG
ctcgaagacaaagcttttaa

SEQ ID NO: 23443 - DNA, 20 bp, Artificial Sequence
  Description of Artificial Sequence: Synthetic oligonucleotide
  Target: SCN10A; (-) strand; PAM type: NRG; PAM sequence: AAG
aacttcagagctcgaagaca
